United States Patent 10,766,935 (PLANT TRAITS CONFERRED BY ISOLATED POLYNUCLEOTIDES AND POLYPEPTIDES) - sequence listing, part 6

SEQ ID NO: 8625 - DNA, 1233 bp, Spinacia oleracea
ctctctctttctctctgtccttatttaaatatctcagatcccacatcattttttcccagaccttcaacaatggcggaatgtatataccaccaactcaaagcccaacccacatggctcatcctccttctcaccattggttccttcaccattttaagaacccttctgggagttctcaaatgggtctatgtcagtttcctcagacccgcaaaaaatctaaagaaatacggttcttgggcagttgttactggacccactgatggaattggcaagggtttcgccttccaattagctcgcaaagggcttaatctgatcttagtgggtcgtaatcctgataaactcaaagatgtttcagattcaatcaaacttaaatttgcaaatacccagattaaatctgttgttgttgatttttctggggatttggatgatggtgttaagagggttaaggaagcaattgagggtttagatgttggtgttttgattaataatgttggggtttcatacccttatgctaggtttttccatgaagttgatgaacaattgttgcagaatttgattaaggttaatgttgaagggactagtaagattactcatgctgttttgccaaacatggttaagaggaggaaaggtgctattgttaatattggttctggtgctgctattgttatcccctctgatcctctctattctgtctatgctgccacgaaagcgtatattgatcagttttcaaggtgcttgtatgtggagtacaagaatatgggaattgatgttcagtgccaggttccactatacgtagcaactaagatggcttcaatcaagagatcttccttcttcgtcccatcaacagacggatatgcaaaggctggtattcgccacataggatatgagccacgttgcacaccatactggccacactcttttctatggggcattgcatcctgtgtacccgagagcctcatcgatgcatggcgtctaaggttctgtcttgcaatccggaagagaggccaactcaaggactcgaggaagaaagagtaattaaccaaaacatcttctttctttctatgtatttgtcacctggaccaaaagagtctgtttaggttttttaggatatgtattaattaatgtattaattacaaattacaagtgcttaatttatgccaaacataaattatctgcttggtcttctgtttttccactatcagggttacccccaatatgttgtatttccaatggata

SEQ ID NO: 8626 - DNA, 2256 bp, Aquilegia formosa
tggtgttggtgtatgtagatgaagagtcacacctcgtaatcaaagacacagttgagagagttgaatgtctttgttatcttcagtgatttcagctcatctacttcaacaacttcttcaacttccaacttctttatgttatttatttaatgcacctttagagtatatttctgcctaaactctttcttcaaaccctcacactttctctctttctccaatatttcagtcgaattttagctttgtttaacaactcccaatgcaataaaatctcattgggtttctttattttttcatttcgaacaaaacccaagttttagatttgtttttagtgctttagatctaaagatctctttagttggtaatggaactctgtttttttgaccaagtaaaggctcagcctttatgggttcaaattcttcttgttgtaggaactatttctatattgaaattttcatttgctgttctaaattgggtttatgttacttttcttagacctggtaagaatcttaagaaatatggttcttgggcacttgtaacaggaccaactgatggtattggaaagagttttgcttttcaattagctcgaaaggggttgaatttggtattggttggtagaaatcctgataagttgaaggaagtttcagatggtattcaagctaaatttgggaaagttcagattaagagtgtagttgtggatttttctggtgatctaaccgaggggattcggaaaattgaagaagcaattgaaggattggatattggtgttttgattaataatgttgggatttcttatccttatgcgaggttttttcatgaagtggatgaacagctattgaaaaatctgattcaaattaatgtggaaggtactactaaggttacacaagctgttctaccaggaatggtgaagagaaagaaaggggctattgtgaacattggatcaggtgctgccattgttattccttcagatcctctatatgctgtttacgctgccacaaaagcgtacattgaccagttctcaagatgcctatatgtagaatacaaaaagagtgggattgatgtgcagtgccaggttcctttgtatgtggcaacaaagatggcttcgatcaaaagatcttcattccttgttccatcaacagatggttatgctcgtgctgctatgcgttggataggttatgagcctcgatgcacgccttattggccacattccttgctgtgggccttggttcatatgttgcctgagtatgcagttgatgcatggcgtctgcagttctgccttgccgtaaggaagaagggtcaactcaaagattcgaggaagaaggaataagtccattctgtttctctttaatcgtcataggtaagtaaggttgctgggttttagttaacaatttggtatgtcaatcttaattctctagacagtagacagcaaccaaactatgaattcaaatgtgtaacttaagtttctctccagttgtttcaaagagatgatgggtctgatttaatgttttgatgccttgttttgttctcattttcaccattatgaaagttctcatgcttaagcccatctactagagttgatatggcaaatcttattcccataaataaactttttgatagcagatcttttcacttacatgctaattatcagggtaacacggcttttccttcacttttcacagggctttccttcacttaatgagttaatggctgcttaatcatattgaaattatgttagggtttcaacttttaaacaattacaacatttctcatcatcaccaacctcctatgagatagtttccacggtatccacccaatatctcttctttccaagaccagcacaagtgcacaacatatatgactgaatgtgaagctgtgggtgacagagccaagattggtagagttaaatcattagaagttcaggctcaacaagactgaaatcatccagccaactggttttgtaccttgtccaagaaagacgagcactacagggtggatccaaacttgcaatcaagtaacagatgaaacttgtgtgccttaaggtgagattgatgcagaatgaatggcctaatcagccattaaagatgatataaatattcactgcaatagtcagttcagtaatgggacctgatatttgtgggagtcatcggaccacttaacaatgaaaatgtcatctcctttcaagtgaaaacaatatacaatgctgtaggagtacatcaagctcaagggaccccttgcaccataagatattgtctcttccctaaa

SEQ ID NO: 8627 - DNA, 1195 bp, Ocimum basilicum
tcactaatggcggactgcatcttggagcagctgaaatctcagcccacatggcttctcctcctcttctccctcggatccatctccctcctcaaactctccctctcaatcctcaactgggtctacgtcaatttcctccgccccgccaaaaacctcaaaagatacgggtcgtgggccctaatcaccggccccaccgacggcatcggaaaagccttcgccttccagctcgccaaaaagggcctcaacttagtcctcgtgggccggagcccggctaagctggaggaagtctccgccgccatcaaatccaaatccgggtcggcccagatcaagaccgtcgtcgtggacttctccggcgacttagacgacggcgtttcgaggattaaggcggcgattgcggggttggatgtggggttgctgattaacaacgtgggagtttcgtatccgtacgcgagattcttccacgaggtggatgagaagctgcttaatgatttgattaaggtgaatgtcgtcggcacgacgaaggtgacgcaggcggtgttgccggggatgttggagaggaagaagggggcgattgtgaatattgggtctggcgccgccattgttattccttctgatccgctttattctgtttatgctgcttctaaagcgtacattgaccagttatcaagatgcctctatgtggagtacaagaagagtggcattgatgtgcagtgccaggtgccattgtacgttgccacgaagatggcctcaatcagacggtcatccttcttcgttccatctgcagacgagtatgctcgtgcagctctccgttgggtgggttatgaacctcgctgcacgccttactggccgcacacggtgctgtgggccctgataagttgcttgccggagtcagctgtggacgcgtggcgtctcaagttctgcatcgggattaggaagcgagggatgctcaaggactccaggaagaaggagtagatgaagccttcaacctctcattctctgtgtttgattcttcttccacagcctcatcatccattgaggatatgtgcttgttatttgagtaatttataggcaaggatttagtgcagctttcctcatttgcagctttgtattttctttttcatcacatttgttaaaaaattttcatcattgtagtgttggttacggaaaaaatatcgaaaaagagcagtttttttgcttc

SEQ ID NO: 8628 - DNA, 1417 bp, Medicago truncatula
ccatggtgtcccaacggtccaacctccttacttaatttctgttgatttttctgctcatctaccttaccagtactacgataccattcccacactactctcccttcatctttacaataaatccattgctgctactctcatttttttcataaataaatcaacccctctctctttttcctcctaacatcaacatggattgttgcataatcagtaaactcaaaacccaaccattctggttcctcattctcttctccctcggtctcttcaccattctcagattcactcttcttcttctcaactggttctatgtcaattttctcagacaacccaaaaacctcaaaaactatggatcttgggccctcgttactggacccaccgatggcattggaaaatccttcgcctttgaactcgctcgcaaaggcttgaacctaatcctcgttggtcgtaaccccgaaaaactcaaagacgtttcagattccatcaaagccaaattcggtaaaaccgaggttaaaaccgttgtcgttgatttcaccggtgatctcgacgacggtgttaagaggattgttgaaacgattgatgggttggatgttggggttttgattaacaacgtggggatttcgtatccttatgcgagatttttccatgaagttgatcaagagcttttgaagaatttgattaaggttaatgttgttggaactactaaggttactcaagctgttttgcctgggatgttgaagaggaaaaagggtgctattgttaatattggttctggtgctgctattgttattccttctgatcctctttatgctgtttatgctgctacaaaagcgtacattgatcaattttctagatgtctttatgttgaatacaagaagagtgggattgatgtgcagtgtcaggttccattatatgtggcaacaaagatggcatcaatcaggagatcttcattctttgttccatcaacagacggctatgcaaaagcaggtgtgaaatggataggatatgaacctcgttgcacaccatactggccacatacccttctatgggccgtggcacgttcgctgccagagtctatagttgatacttggcgccttgggttttgtatgggtattagaaagagggggcagctcaaagattcgaagaagcaggaataaataaaaccatgcttgtctgtttgtattgtgtaggcatagatgttgttgctgtttactgcagactgctgctagtagattaagattccaagttgttgtgtttttagttttactcttactgtatggtcttgatgattatcaattgtgtggcctattctttttcttcccacattccaattgtgtttctgtcctttgatgttctactgatgatgatgcattgttacatcttttaacctacttttttctgttatttaaatcttacatttctc

SEQ ID NO: 8629 - DNA, 1143 bp, Solanum tuberosum
tcttgacccattaatagtaagtatcacaagaaaccatggccccagatattgcccaccataaaggcagcagcagcaatgatgaacactgtcactctctatagcgggagctcaacattttggcacaaacccatttcaagaatcaaccagaatttcaaaattagagcatcaatttccacctcagacaacatggttgctcctgctatcatagttggaggtggacgtgtgggaagagctttacaagatttgggtaatggagacgatgttttggttaaaaggggtgaaccagtacctattgattttgtaggtccaatattggtttgcactaggaatgatgatcttgaagctgtacttgaagctactcctaaatctcgttggagcgatttggtatttttccagaatgggatgctagagccttggttccaaagtaaaggccttggtgatgcagaccaagttttggcatattttgctgtatcaaagcttggtgaacccccaactgatgggaaaactgatacaaatccagaaggattgactgcggcttatgggaaatgggcatctgcagtggctgcaagattgcagaatggaggactctcttgcaaggtacttgataaggagccttttcagaagcaaatgctggagaagcttatatggatatgtgctttcatgcttgttggagctcgccatcctggagcaacagtaggagctgttgaaaaagagtaccgctctgaggtgtcaaaactgattgctgagcttgcggctgcagcagctgcagagaaaagtctagtttttgaggatgccatggaggataggctctgcgcttactcacgagcagttgcacactttccaacggctgtcaaggagttcaaatggagaaacggatggttctattcactctctgagaaggcaatcgcacaagggaaaccagatccatgcccattacatactgcatggcttaaagaactaaaaatagtctaagatataaccgttatttgatattattatgattgttgaggtcctctgtttttcttttggaggatgcatatgataagagctgatgtatcaattcaatttaattaaaaatcgtcctcctatttcatatcacaactgctgctaaattgtttgataaaatttaagtgtgctatgaat

SEQ ID NO: 8630 - DNA, 1145 bp, Solanum phureja
cttcttgacccattaatagtaagtatcacaagaaaccatggccccagatattgcccaccataaaggcagcagcagcaatgatgaacactgtcactctctatagcgggagctcaacattttggcacaaacccatttcaagaatcaaccagaatttcaaaattagagcatcaatttccacctcagacaacatggttgctcctgctatcatagttggaggtggacgtgtgggaagagctttacaagatttgggtaatggagatgatgttttggttaaaaggggtgaaccagtacctattgattttgtaggtccaatattggtttgcactaggaatgatgatcttgaagctgtacttgaagctactcctaaatctcgttggagcgatttggtatttttccagaatgggatgctagagccttggttccaaagtaaaggccttggtgatgcagaccaagttttggcatattttgctgtatcaaagctaggtgaacccccaactgatgggaaaactgatacaaatccagaaggattgactgcggcttatggaaaatgggcatctgcagtggctgcaagattgcagaatggaggactctcttgcaaggtacttgataaggagccttttcagaagcaaatgctggagaagcttatatggatatgtgctttcatgcttgttggagctcgccatcctggagcaacagtaggagctgttgaaaaagagtaccgctctgaggtgtcaaaactgattgctgagcttgcggctgcagcagctgcagagaaaagtctagtttttgaggatgccatggaggataggctctgcgcttactcacgagcagttgcacactttccaacggctgtcaaggagttcaaatggagaaacggatggttctattcactctctgagaaggcaatcgcacaagggaaaccagatccatgcccattacatacttcatggcttaaagaactaaaaatagtctaagatataaccgttatttgatattattatgattgttgaggtcctctgtttttcttttggaggatgcatatgataagagctgatgtatcaattcaatttaattaaaaatcgtcctcctatttcatatcacaactgctgctaaattgtttgataaaattaaagtgtgctatgaat

SEQ ID NO: 8631 - DNA, 1146 bp, Solanum melongena
aaaacgagtggctatcttcttcacccactttccatttaatagtaacagaacaaaccatggaaccagaaattgcccaccatgaaagcagcaatgatgaatactgtcaccctctctagctcaacaatttggcataaatgcacaaaacccacttcaagaatcaacctgaatttcaaaattagagcatcaatttccacctcagccgaaatggctacaaaggtagctcctgccatcatagttggaggtggacgtgtaggaagagctttacaagacttgggtaatggagatgatgttttggttaaaaggggtgaatcagtacctgttgattttgtaggtccaatattggtttgcactaggaatgatgatcttgaagctgtacttgaagctactcctaaatctcgttggagcgatttggtatttttccagaatgggatgctagagccttggttccagagtaaaggcctcggtgatgcagaccaagttttggcatattttgcagtatcaaagcttggtgaacccccaaccgatgggaaaactgatacaaatccagaaggattgactgcagcttatgggaaatgggcatctgcagttgctgcaagattgcatgctggaggactctcttgcaaggtacttgacaaagagccttttcagaagcagatgctggagaagcttatatggatatgtgctttcatgcttgttggagctcgtcatcctggagcaacagtaggagctgttgaaaaagactaccgctctgaggtctgaactgattgctgagcttgcggctgcagcagctgcagagaaaggtctagtttttgaggatgccatggaggacaggctctgcgcttattcacgagctgttgcacactttccaacggctgtcaaggagttcaaatggagaaacgggtggttctatgcactgtctgagaaggcaatcgcagaagggaaaccagatccatgcccattacatactgcatggcttaaagaactaaaaatagtctaagatttgatatactgtgatgaggccctctgtttttcgtttggaggatgtatatgagagctgctatatcaattaactttaaatgttaaaatcgtcctcctatttcatattggaatcattctacttttgctctgtattggtggaaaaccttc

SEQ ID NO: 8632 - DNA, 1012 bp, Nicotiana benthamiana
agtggctctcttcttgacccacttttcattaattaatacttcagaaaaaaaccatggccccaaaaactgtgcaacatgaaggcagcaatggtgaccgctgtcacactttctagctcaacaatttggcaccactacacaaaacccatttcaagaatcaacctcaatttcagaattagagcatcattatccacctcagctaatatggctactagcaccacaacaaaagtagctcctgcaatcatagtcggaggtggacgtgtgggcagagctttacaagatttgggtaatggagatgatgttttggttaaaaggggtgaacctgttcccgttgattttgctggtccaattttggtttgcactaggaatgatgatcttgaagcagtacttgaagctactcctaaatctcgttggagcgatttggtatttttccagaatggaatgctggagccttggttccaaagtaaaggtctcagtgatgcagaccaagttttggcatattttgcagtatcaaagcttggtgaaccccctactgatgggaaaactgataccaatccagaaggattgactgcagcttatggaaaatgggcatctgcagtggctgcaagattacagactggtggactctcttgcaaggtacttgagaaggagccttttcagaagcaaatgttggagaagcttatatggatatgtgctttcatgcttgttggagctcgtcatcctggagcaacagtaggtgctgttgaaaaagagtatcgctctgaggtgtctcaactgatcgctgagcttgcagctgcagcagctgcagagaaaggtctagtttttgaggatgcgatggaggataggctgtgcgcttactcccgagcggttgcacactttccaacagctgtcaaggagttcaaatggagaaacggatggttctattcactctctgagaaggcaatcgcagaagggaaacctgatccgtgcccattacacactgcatggcttaaagaactaaaaatagtctgaggta

SEQ ID NO: 8633 - DNA, 1316 bp, Nicotiana benthamiana
ataaagtgataaaaattctggatcataagtgaaaacgagtggctctcttcttgacccaattttcgttaattaatactcagaagtagaaaaaaccatggccccaaaaactggacaccatgaaggcagcaatgttgaacgctgtcacactttctagctcaacaatttggcaccactatacaaaccccatttcaagaatcaacctcagtttcagaattagagcatcattatccacctcagctaatatggcaactggcaccacaacaaaagtaactcctgctatcatagtcggaggtggacgtgtaggcagagctatacaagatttgggtaatggagatgatgttttggttaaaaggggtgaacctgttcccgttgattttgctggtccaatattggtttgcactaggaatgatgatcttgaagcagtacttgaagctactcctaaatctcgttggagcgatttggtatttttccagaatggaatgctggagccttggttccaaagtaaaggtctcggtgacgcagaccaagttttggcatattttgcagtatcaaagcttggtgaacctcctactgatgggaaaactgataccaatccagaaggattgacagcagcttatggaaaatgggcatctgcagtggctgcaagattacaggctggtggactctcttgcaaggtacttgagaaggagccttttcagaagcaaatgttggagaagcttatatggatatgtgctttcatgcttgttggagctcgtcatcctggagcaacagtaggagctgttgaagaagagtatcgctctgaggtgtctcaactgatcgctgagcttgcagctgcagcggctgcagagaaaggtctagtttttgaggaagcaatggaggataggctctgtgcttactcccgagcagttgcacattttccaacggctgtcaaggagttcaaatggagaaatggatggttctattcactctctgagaaggcaatcgcagaagggaaaccagatccatgcccattacatactgcatggcttaaagaactaaaaatagtctaatgtataaagtgtacttggtatatcatagttgttcgaggccctctgttttcttttggaggatgtagatgagagctgctgtatcattttattgtaatttggaagtcgtactcctatttcatcttattttctgccttttggtggaaaatcttcttgttatgtgacttgagtcacgtaggataaccagtgcttataaattgtttgacgtgctagatgaatcaaggggtcgtctgtgaattaaaaatatattctgtgtaaaactatccatta

SEQ ID NO: 8634 - DNA, 864 bp, Nicotiana tabacum
ggtgcaacatgaaggcagcaatggtgaacgctgtcacactctctagctcaacattttggcaccactacacaaaacccatttcaagaatcaacctcaatttcaaaattggagcatcattatccacctcagctaacatggctactggcaccacaacaaaagtagctcccgccatcatagtcggaggtggacgtgtgggaagagctttacaagatttgggtaatggagatgatgttttggttaaaaggggtgaacctgttcccgttgattttgttggtccaattttggtttgtactaggaatgatgatcttgaagctgtacttgaagctactcctaaatctcgttggagcgatttggtatttttccaaaatggaatgctggagccttggttccaaagtaaaggtctcggtgatgcagaccaagtattggcatattttacagtatcaaagcttggtgagccccctactgatgggaaaactgataccaatccagaaggattgactgcagcttatggaaaatgggcatctgcagtggctgcaagattacatgctgggggactctcttgcaaggtacttgacaaagagccttttcagaagcaaatgctggagaagcttatatggatttgtgctttcatgcttgttggagctcgtcatccaggagcaacagtaggagctgttgagaaagagtaccgctctgaggcgtctaaactgattgctgagcttgcatctgcagcagctgcagagaaaggtctagtttttgaggaagccatggaggataggctctgtgcttactcccgagcagttgcgcattttccaacggctgtcaaggagttcaaatggagaaacggatggttctattcactctctg

SEQ ID NO: 8635 - DNA, 1330 bp, Amsonia hubrichtii
gataacccgaataatctgaaaaaccagcaacggtggcaccatggcctcaaattcaacaagctacaatggccaccaccgcacttgctctctctagctccactctttgccaacattgcaccaaacccacctcagtaaattggctaagaagcttcaagataggagcatcgttatcaacatcaaccactatggcttctactgcaacaaaagttatccctgctattatagttggaggtggacgtgtaggaagagctttacaagacatgggaagtggcgatgatgtattggttaagagaggtgaatctgtgcctattgattttcctggtccgatcttggtctgtactagaaatgatgatcttgaagctgtactcgagtccactcctaagtctcgttggagcgatttggtttttttccagaatgggatgctggaaccatggttccggagtaaagggctcggtgatgctgaccaagttttagcatattttgccgtttcaaagcttggtgaacctcctgttgatggaattacggatacaaatccagaggggctcactgcggcttatgggaaatgggcatctgcagttgcgactagattaggggctggtggtctttcttgcaaggttcttgaaaaggaagcatttgagaagcagatgttggagaagcttatatggatatgtgcattcatgctcgttggagctcgccatcctggaacaactgttggtggtgttgagaaggaatatcgggccgaggtttcgagcctcatttctgaactggcagctgcagcagctgcagaaaagggtcttgtttttgaagaatcaatggaggatagattatgtgcttactctcgagcagttgcccacttcccaacagctgttaaagagttcaaatggaggaatggttggttctattcactctcagaaaaggcaattggagaagggaaacctgatccttgcacactacacacagcgtggctcaaagaattgaagatagtgtaaagctaatcaatgaatttcgtagaacagtcctgttaaataaaattcagctattatttatccattcgagttttccttctggtatgcccatgcgtgttggttgccaagaactgctacaattatcattctccatttcttggatgcagtaacaccatttgatgataaactattgctcgaaaccctgaggttagcaatggcaaagctacagcgctgatcctcatttctggtctgcccagtccttgttcccctactgctagaaatgacttatttttagttttttaaatataggtaaattaggtattttgctcctctaatttatttgtactaaatttcctaataaatta

SEQ ID NO: 8636 - DNA, 1179 bp, Sesamum indicum
atcccaacgaagatcaagtgaaaaccacaccatcgaattccagatggattcttctcaatctcccaccagcatccatggccgccacactctccctctctagttcttcattcttgcaccactgcgcaaaacccacttcaagaatctgcctcagcttcaaagccaaagcctctttatcaacttcttcttcgtccatggcaaccacagcagagaaggtcgctcccgctattatagtgggcggtggccgtgtgggaaaagctcttcaggacatgggcagtggcgatgatgtcctagtaaagagaggggagcccgtgccgcttgatttccccgggcccattttagtgtgtacccgcaatgatgatctggatgcggtgcttgaatcaacccctaattcgcgctggagcgatttggtgtttttccagaacggaatgctggagccgtggtttgaaagtaaaggcctaggtgacgctgatcaagttttggcatattttgcggtgtcaaagcttggtgaacctcctatagatggaataaccgacaccaatcctgagggtttgacagctgcgtatgggaagtgggcatctgcagttgccggaagattgcgtgctggaggcctgtcttgcaaggtacttgaaaaagatgcatttcagaagcaaatgcttgagaagcttatatggatatgtgctttcatgcttgttggagcccgtcatcctggagcaactgtaggtgttgttgagaaggaatatcgttctgaggtgtctgcccttatagcagaacttgctggagctgcagctgcagagaaaggtatagtctttgaaggagcaatggaggaaagattgtgtgcttattcacgggcagtcgctcacttccctacagcagttaaggagttcaaatggaggaatggatggttctattcgctgtcgcagaaagcaattgctcaaggcaaagacgatccgtgccccttgcacacagcatggctcaaagaactgaagatagtgtaaaacattcatgaagcacgattgtggatttgaactcatacttgtgaaataaatagctaaacattttttgaacatgacactcccttcttgttcatttgccaccattttcacaatgtaaccactgttcattgcgcttcctggtttgtctttgatgcaagtgttattattcccttccttgcatgccatg

SEQ ID NO: 8637 - DNA, 1138 bp, Vinca minor
cgacccaagtcatctgaaaaaccgaagtagaactctgcaaccatgggaagctccttcaatggccaccaccacactttctctctctagctccactctttggcaacattgtaccaaacccacttcagtaaacaagctaagaaccttcaaggtatcagccatggcttctgctgctgctactactactgcaacaaaagtcattcccgccattatagttggaggtggacgtgttggaagagctttacaagacatgggaaatggtaatgatgtattgattaagagaggtgaatctgtgccgcttgattttgctgggcctattttggtttgtactagaaatgatgatcttgatgctgttcttgattccacccctaaatctcgctggaccgatttggtttttttccagaatgggatgctggagccatggttccagagtaaaggattgggtgatgctgaccaagttttagcttattttgctgtttcaaagcttggagaacctcctattgatgggattacagatacaaatcctgaagggcttacagcagcttatggaaaatgggcatctgcagttgccaccagattacaagctggtggactttcttgcaaggttcttgaaaatgaagcatttaagaagcaaatgttggagaagcttatatggatatgtgcattcatgctcgtcggagcacgccatccgggaactactgttggtggtgttgagaaagaatatcgctcagaggtatcgagcctcatttctgaactggcagcagcagcagctgcagagatgggtcttgtttttgaagacgcaatggaagatagactatgtgcctactctcgagcggttgctcacttcccaacagctgttaaagagttcaaatggaggaatggttggttttattcactttcagaaaaggccattgcagaagggaaacctgatccttgcccactacacactgcttggctcaaagaattgaagatagtttagatgtaatcaatgaatttcatagatcagtccacctgttaaataaaatcctagtattatatttatttgatttttaactacaaaactcaacgtatcattatcaagcacggataaggcaattggtgcatcgcttctaatcatggattataagtctcagattacccc

SEQ ID NO: 8638 - DNA, 1065 bp, Tabernaemontana elegans
ctccactcttcggccaaagtgcacgaaacccacttcagtaaataggctaagaagcttcaggataggagcatcactgtcaacatcaaccacgatggcttctactgctacgaaggttatccctgcgattatagtgggaggtggacgtgtaggacgagctttacaagacatgggcaatggggatgatgtcttgattaagagaggtgaatccgtgcctcttgattttcctgggcctatcttggtctgtactcgaaatgatgatcttgagtctgtacttgagtccactcctaagtctcgctggagcgatttggtatttttccagaatgggatgctggagccatggttccagagtaaacggctcggtgatgctgaccaagttttagcatattttgccgtttcaaagcttggtgaacctcctgctgatggaattacggatacaaatccagaggggctcacagcagcttacgggaaatgggcttctgcagtcgcaaccagattgcgagctggtggtctttcttgcaaggttcttgaaaaagaagcatttgagaagcaaatgttggagaagcttatatggatatgtgcattcatgctggttggagctcgccatcctggaacaactgttggtggtgttgagaaggaatatcgatctgaggttgcgagcctcatttctgaactggcagctgcagcagccgcagaaaagggtcttgtttttgaagaagcaatcgaggatagattatgtgcttattctcgagcagttgcacactttccaacagctgttaaagagttcaaatggaggaatggttggttctattcactctcagaaaaggcaattgcagagggaaaaccggatccttgcccactacatacagcgtggcttaaagaattgaagatagtgtaaaataagccatgaatttcatagatcagtcctgttgaataaaattcagcttttgttatccattagaactttttccgttttgatatgcgagtgtggttgcgaagaactgccagaattagcattcctcagttcttggatgcaatttgaatcatttgatgatatacaatagcttg

SEQ ID NO: 8639 - DNA, 2613 bp, Flaveria ramosissima
catgaaaccgacgaccgtttaagggtacacatcaccgacgcacagaagcaacgatgggaagtaccgtacaacctcctccccagagaccacccaccaacgccgtcgcaacaaccccggaaaaccccatcgccgccgcagagttcgccggcggcgaactgatcttcagctacatctcaaagccattctcattcgccgtcagaagaaaatccaacggtcaaaccatcttcaactccaccgccgacgaatcctcaccctacaattcactagtcttcaaagaccaatacctcgagatctcaacatctttaccgaaagacgcttcgttgtacggtctcggggagaattcacagccccacgggatcaaattgtacccaaatgacccgtatacgctgtggacgacggaccaatcggcaatcaatttgaatatggatctttacgggtcgcacccggtgtatatggatttgaggaatgtgggtggggaagcttatgctcatggggttttgttgttgaatagtaatgggatggatgtgttttacacaggcagttccttgacgtataaggtgattgggggtgttttggacttttacttctttgcgggcccgtctcccctcgcggttgtggatcagtatactcagctcattggccgccccgcgcctatgccttactggtctcttggatttcaccaatgtagatggggttaccataacctttctgtagtcgaagatgtcgtggagaattacaaaaaagctaatatcccgctagacgttatttggaacgacgatgatcacatggatggtcacaaagatttcaccctcaacccaaacgcttaccctcgagccaaactacttgatttcctgcaacgaatacacgctcgtggcatgaagtacattgtcattattgaccctggaatcggtgtaaacacgtcttatgggacctaccaacgaggtatcgcaaaagacgtgtttattaaatacgagggcaagccttatttggctcaggtttggcccgggccgttaactttccggattttcttaaccccaccactgttgcgtggtggggagatgaagtacggaggtttcacgagctcgtccctgtggacgggctgtggattgatatgaacgaggcttcaaatttttgttctggtttgtgcacgattcccaaagggaagcagtgtccaactggaaccgggcctggttggatatgttgtttggattgcaaaaatataacaaatacgaaatgggatgatcctccttataagattaacgcgtctgggacgcgtgttcccatcgggtacaagactattgctacgagtgcggttcattataatggtgttcgagagtatgatgctcatagtatttacgggttttctcatgccgttgcaactcacaaggcgcttcaagggcttcagggaaagcgcccttttatcttgtcccgatccacgtttgttggatcggggcattacactgctcattggactggtgacaaccaaggtacatggaatgatattaagtattcaatatacaccatgttgaattttgggctttttggtattcctatggttgggtcggatatatgcgggttttacccacaaccaaccgaagaactatgcaaccgttggatagaattgggcgcgttttacccgttttcaagagaccatgctaactactattctccaagacaagagctttaccaatgggaaacggtagcaacatcggctcgtaatgctttaggtatgcggtacaagttgcttccttacttgtacacgttgacttacgaggcacacaccactggtgcacccatcgctcgccccctctttttctcattcccaaacatccccgagttgtatggactaagcacacaattcttgcttggcgagagtctaatggtctcacctgttcttgaccagggtcgaaccaacgtgtcagccgtgttccctcctggaacatggtacaatctgttcgaccctagtcaagcaatcatctcaaaaggaacccaaacattcaccctagatgctcctttgcacgtgatcaatgtccatctatgtcaaaacaccattcttccaatgcaaaagggaggaatgatatccaaagaagcaagaatgacaccatttacccttctagttacgttccccgctggcgccactgacgccaaagcgaaaggaaagcttttccttgacgatgacgagttgccagagatgacactaggcaacggtcagtcaacttatatcgagtttagcgcgacagcgtctaaacaaatggtgaaggtgtggtcagatgtggaggatagtaagtttgctctagataaaggttgggttattgagaaaattacggtattgggactaagcggggttggaggtgctttcgctgtcgaggtcgagggtaatttggacattttggatgagtctaaagttgagttgatagaaaccgaacataagtttacacatggattgtcgacgaagagtgtgatggttgaagttggagggttaaacataccagttggtaagaaatttacaatgtcgtggagaatgggaattagttagttcttgaagggcttgttttgtcaattattggttctttgtaccgcttagaaattagaatgttgtgtggtagggagttt

SEQ ID NO: 8640 - DNA, 4122 bp, Secale cereale
gcacagctcgtccgccgccaaagatgttctcgccggcgactccggaaaccccacctccaccgcaggcagaaggaggaggcgacccttcacccctcctcctgctcccgcccactccccttcccctggtggattcgccctctccgaccgccccgccaccggcaccccggccccatggaccacctcctccctcctcgccaggatttcgacatcaaagcaaacagacagggctggcgattctgaccagatccaaccagtgcgcgtagcagagtttccccaagtcgtgaggaatgcacaagccaaccttctgcagaagaattttgccggcaagagcatgcttgtaggtggcattgacaaagaaacatcccttgcatggatgatatgtggaaatgagctttttgtctggagctacctggctgctgttgcaaaagattgtcttgtacttgagatcccaacttcgcttatgggaaacaaagacggaaaacccctctctggtaaccagtggacggtttgcatcatgagatggcatagtagtggtccatcaacaaggaacagtggagatatgttgcaccgaagaagttcgactggtgttatcctctgcaacagaagaacacaagctattgcatattggcctgacatctatggtgaaagtagcaagagtccagttcttagtttatttggccacagtgacacatctgcaagtgatggtatatctggatgttacaggtttaactcactaattgcagcttccgttccaggagccgctcatgaatgtattgtgattgcttccgagccaacaggtgctttatggttgtttcagtgttcaccactgggaattcaccgaagagaagtccatcgtgatacattaggagataatggtactgatcattctcagaaaaataatggtggaagatccttggtttggctaccaagcaatgaatcatccgaggctgctgaacggaagttctttctgttgactagccaggggatacaatgttggggcatctcactcttgcatggaatcaatgtaaaaatattagggtctcaggaaattgttggtagtgatggggagttgggcataaaaaaagacatagctggtcaaaagaacatttggcttttggacatgcagatagatgagcgtgggaaggaatttaatattcttgttgctaccttctgcaaagaccgggtgagtgggtcaaactacactcagtattcacttctgacaatgctgtacaaatcgaatcaaaagtttccatccggaaacaatgtggttaaatgcgaaaggtttttggagaaaaaagctcctgctcaggtgataatccctaaagctcgagtggaggatgaagaatttttgttctccatgaggctaaaaactggcggcaagccttctggctcagtgatcattttatcaggtgatggaaaagcaacggtggccatctattggaggggctctacccgactctatcaatttgatctgccttgggatgctggaaaggtttttgatgcttccattatcccatctcctgatgacagggatgaaggagcttgggttgttctgacagaaaaggcaggaatctgggcaatacctgaaaaggctgtattagttggtggggttgagcctccagagcgcagcttatcacgaaaaggaagctgtaatgaagcggtcgctgaagagaaaaggagaagtcaagcattcagtgccagtattgttcccagaagagttagctccgaggcttggagtgctggagacaggcaaagaccagcattaactggcgtatcccagcaggctgtggttgatgaagaggctgagatgttacttaatcggctgtttcatgattttattttgtctggtgctgttcacgaggcacttcaaaagcttagagtagcaggggcatttgagaaagagggtgagatgaacgtatttgttcgagtgagcaaatctattgtaaacacattatctaagcactggacaacaactagagaagctgaatttcttgcttcaacaattgtttcatcccttgctgagaaacgtcaaaaacatgagaaattccttcaatttcttgtcttgtccaagtgtcatgaagaactctcttcaaaacaaagagctgcaatgctaagtgtcatggaacatggagaaaagctctccggaatgatccatctgagagaattacaaaatgcgcttagtcagcagagttcaagcacacgtttatcacctcagtctaaaacctcaactgctggtgcgctgtggaatctcattcagctggtcggtgagaaagctcgacggaacactgttctattaatggaccgtgataatgctgaagttttctacagtagagtttcggatatagaggatctattttattgtttgtcgcatcaacttcggtatattataaccggagaagaacacccatctgttcagatgcaacgtgcacttgagttatcaaatgcttgtgtgaccttagttcaggcagcattgcactacagagctgagtacaaggactggtatccttttcctgaaggactgataacatggaacagccagcctgtagtgcggtctggaatctggaatctggcatcatctgtgatggagcttttgagagaaccaggatctgcagacatgccaatgaaatctaatctatggtctcagctggaaggactcgcagatatgctactggagggatatattggtgtattaactgccaaatttgaacgtggggaggaccatggtgtgctagcccaagaatactgtgaacggagagatgagcttcttggatccctttatgaccttgcaaagcaaattatagaagcaaaatatcaggagtcaagtgaaggcaatgacaatcctgatctgaaagaatctatatttagagaggtcacttcttctattttggcaacagctaaacggcatgaagggtaccaaacgttgtggcagatttgctatgatatcagtgatacggttctcctccgcaatcttatgcatgatagtgtaggacctcatggaggattcagtttctacgtttttaaacagctaatcaacagccggcattacgctaagctgttaaggctgggagaagaattccaggaagagctagctaattttctgaaagaccgtagcgatcttttgtggcttcacgagatatgcttaaatcagttctcaactgcttcagagactcttcatacctgtgctctgttttcaagtcctggagaagatgctgacctaacaagcaccagaaagtcgctgtcctttgttgaaagaagacgtcttctctatctctctaaaattgctgcaacagcaggtaaggatgttgattatgaagtgaaggttgcacagatagatgctgatatccggattctaaatcttcaggaagagattgttcagcaggatccagaatatgcacagggcaaacatacaagcaagcttcttccgccatcagaactgattgagatgtgcatgaagggaggccgcgagctttctctcaaagctttcgaagtatttgcttggacaggctcctcgttccgaagctccaacaaaggccttttagaggcttgctggacgaacgcagccgaccaggatgactgggtcgagctctcacaggcatcagtttcagaaggctggagcgacgaagtcatccaagaatctctagaaggaacggtcctcttcaacgcttcgaggctgtgctacagctcggacgcggtggtgttcgacggcacgttcgaggaggtgctgccagtgaggaaagaggacgtgcacgcgagaggcctggaggccaagtgcttctcggtggaggaggtgctgatgcagcacgacgcctttccggatgccggtaagctgatgatgacggcggtggtcatgggcaaggagctatcctatgctgccccggcagatgagcctgtggacatggactcgtgataatgtcagagagggaggcgtgtatgtaggctggctggagttccaaatcatcatcagtgcttttactttgtgtggccatgcaatcgtcggagttctttggttgaccggaatagtaatttttactccgtgatggccatgcaatagtaaatttattctctgatgtactgatgtccattgtcggctgtaaacctttgtagagactgcaacattgtcag

SEQ ID NO: 8641 - DNA, 4374 bp, Brachypodium distachyon
aaaagagaaaactcaaaacactagtaaaaccctagcctaccggagagagcgccgagaccgagaggcctgctagtcggggagcctgcccgcgtgaggtggctacagcagagctcttccgccgccaaaaatgttctcgccggcgatcaggaagcccctccacctccaccgcagggacaaggggggcgcgaccccttcacctcctccggctcccgtccactccccgtcacctggtggagcggccctctccgaccgccccgccactggcaccccggccccatggacctcctcctccctcctcgctaggatttcgacttcgaagcaaatagacagggctggcgattcggaccagatccaaccagtgcgcgtagcagagtttccccaagtcgtgaggaatgcacaagacaaccttatacagaagaatttttctggcaagaccatgcttgctggtggcattgacaaagaaacatcgcttgcatggatgatatgtggaaatgagctatttatctggagctacttggcttctgttgcaaaagattgtcgtgtacttgagctcccatcttcccttatgggaaccaaagatgcaagacccctctgtgggaatcagtggatgctgtgcatcattagatgttgcagtagtgatccatcaacagggaacaatggggatatgttgcacggaagaagttcgatcggtgttatcctctgcaacagaagaacacaagctattgcatattggcctgatatctatgacagtagcaagagtccagctcttagtttatttggctacagtggggcatctgcaagtgatggtacatctggatgtcatacgtttaactcactcattgcaacttccattccaggacgcattcaggaatgtattgtgatagcttctgaaccgacaggcactttatggctgtttcagtgttcaccagtagaaattcatcgaagagaagttcatcaggatacatcagaagataatggtacagatcattctcagaaaaataatggtgggagatcattggcttggctaccatgtaatgtatcatccgaggctgatgagcagaagttctttctgttgactggccatgggatacaatgttggagcatctcactcttgcatgacatcaatgtaaaaaaaatagggtctcaggaaattgttggcagtgatggggagttgggcataaaaaaggacatagctgggcagaagaacatctggcttttggacatgcagatagatgagcacggaaaggaatttaacattctttctgctaccttctgcaaagatagggtgagtgggtcgaactatactcagtattctcttctgacaatgctgtacaaatctaaccagaagttttcatcccaagagaatgtggccaaatgtgaaaggtttttggagaaaaaagctccttctcaggtgataattcctaaagctagagtggaggatgaagaatttttgttctccatgaggctaaaaactggtggtaaaccttctggctcagtgatcatcctatcaggtgatggaacagcaacagtggccatctattggagaggttccacccgactttatcaatttgatcttccttgggatgctggaaaggttttggatgcttccattatcccatccgctgatgatagagatgaaggagcttgggttgttctgactgaaaaggcaggagtctgggcagtacctgaaaaggctgtattagttggtggggttgagcctccggagcgcagcttatcacgaaaaggtagttgtaatgaagcaatcgctgaagagaaaaggagaagtcaggcattcagcgccagtgttgttcccagaagagttagctctgaggcttggactgctggagaaaggcaaaggccatcattaactggcatagctcagcaggttgtggttgatgaagaggcagaaatgttactcaatcgtctctttcatgattttattttgtctggtgcagctcatgaggcacttcaaaagcttagagcatcaggagcatttgagaaagagggtgagatgaatgtatttgttcggataagcaaatccattgtaaacacattatctaagcactggacaacaactagagaagctgaatttcttgcttcgactattgtttcttcccttgctgagaagcagcaaaaacatgagaaattccttcaatttcttgtcttgtccaagtgccatgaagaactatcttcaaagcaaagagctgcaatgctaagtgtcatggagcatggagaaaaactctgtggagtgatccagctaagagaattacaaaatgtgcttagccagcagcgttcaagcacacatttatcacctcagtcaaaaacccaaactactggggcactttggaacctcatccagttggttggtgagaaagctcgacgaaacactgttctgttaatggatcgtgataatgctgaagtgttctacagtagagtttctgacatagaggatctattttactgtttgtctcatcaacttcagtatattataaccggagaagaacacccgtctgttcagatgcagcgcgcacttgaattatcaaatgcttgtgtgaccttagggcaagcagcattgcactacagagaggagcacaaggactggtatccttctcctgaaggactgataacatggaacagtcagcctgttgtgcggtctggaatctggaccctggcatcatctgtgatggagcttttgagagaaccaggagctgcaggcatgtcgatgaagtccaatctatgttctcagctggaaggacttacagatatgctattggagggatatataggtctgttaactgcaaaatttgaacgtggggaggaccatggtgtgctagcccaagagtactgtgaacggagagacaaacttcttggagccctttatgaccttgcaaaacaaattgtagaggcaaaatatcaggagtcgagagaaggtgatgacaatcttgatctgaaagaatctatatttagagaggttacttctcctattttagcaacagctaaacggcatgaagggtaccaaacgttgtggcagatttgctatgatatcagtgatactgttctcctacgcaatctaatgcatgatagtgtaggacctcgcgggggatttggtttctatgtttttgaacagctgaccaatagccgccaatatgctaagttgttgaggctgggagaagaattccaggaaatgctagctagttttcttaaagaccggactgatcttctgtggcttcatgagatatgcttaaatcagttctcagctgcttcagagactcttcgtacatgtgccttgctttcgactcccagggaaaatgctgatctcacaagtaatagaaagccgctgtcatttgttgaaagaaggcgtcttctatatctctctaaaattgctgcaacagcaggtaaggatgaagattacgaagtgatagttgcagggatagatgctgatatccggattctaaaactgcaggaagagattattcaacatgatccagaatatgcgcagggtaaatatacaaacaagctgcttcgtccatcagagctcattgagatgtgtctgaagagaggccgagacctttctctcaaagcttttgaagtatttgcttggacaagctcctcgtttcgaagttccaacagaggccttctagaggattgctggatgaatgcagccaaccaggatgactggctcaagctttcacagtcatccacatcacaaggctggagcgacgaagtcacccaagaatctctccatggaacggtcctcttcaacgcttccaggctatgttatggcccagacgcagttgtgcttggcggttcatttgaagaggtgctgcctttgaggaaagaggatgtgcatgcgagaggtctggagggcaaatgcttctcagtggaggaagtgctgatgcagcacgatgttttcccggacgccggtagattgatgatgacagcagtggtattgggcaaggagctatcttttgatgttccagcagatgaacctgtggagatggactcgtgataatgtcggagaggaaaagtgttgggcagactcccaaatcaatgttcttactttgactttgtgatgagcatccaatagtcttataactacaatcagaattattttagtggaatggaacgtggagtgcatgttgtatttagtggcaaaaccatttgtagagaccgcaacattgctagctcctgccttatttttaggtcgagctcggttttgagagttgaaataggctgtttttctctttgtctcagtaaataagctgatgatgttatggaatcgatgcatgaactggggatgcaaaaacctcgccgcgttactctttttcttcacagcgaggctttttgtaccagattttttacattcttttagtg

SEQ ID NO: 8642 - DNA, 4190 bp, Setaria italica
ccctagcccaccggagagagcgccgagaccgagaggccggctggtcggagaaggtgaggccgtgagggtgctctcagcccaaccgccgcgccgccgaaaatgttctcgccggcgatcaggaagccacacctcctccaccgcagggacagggaggaggcgtccccttcacctccacctgctgctcctacccactccccgtcgcctcgcggattcgccatccccgaccgccccgctaccggaaccccggccccttggacctcctcctctctcctcgctagaatttcggcatcgaaacgaactgaaaaggcgggtgattcggaccagatccaaccggtgcacgtagcagagtttccccaagtcgttcggaatgcccaagccggccttctacagaagaatttctctggcaagaacatgtttgctggtggcattgataaagaaacatcccttgcgtggatgatatgtggaaatgagctttttatctggaactactcggcttctgttgctaaagactgtcttgtccttgacgttccatcttctctgattggatacaaagacgtgaaacccctccccggtattcagtggacagtttgtataatgagatggcatagtagcggtgcatcaacaagaaacagtggagagatattgtatagaaaaagttctactggtgttatcctctgcaacaaaagaacacaagctgttgcttattggcctgacatctatgctgaatttaataggagtcttgtccttagttcaccgtttgatgagctgtctgcaagtgatggtgcatctgatcgtttcaggtttaattcgattattgcagctgcagttccaggaggcactcacgagtgtattgcaatagcttctgagcctacaggtgctttgtggttgttcaagtgttcaccagaaggaattcgtcaagaaaaagtcctcagagatacattaggagatggtggtgcggatcattctcagaaaagtaatggtggaaggtcattggcttggctgccaagtaatgtatcatcggagggttctgatcggaagttctttttgttgacaaacaatgaggtgcaatgttggagtgtctcactcttgcatgacatcaatataaaaaaattagggtctcaggaaattgttggtactgatggcgatgcgagcataaagaaagatatagctgggcaaaaaaatatatggcttttggacatgcagatagatgagcatgggaaggaatttagcattcttgttgctacattttgcaaagatagggttagtgggtcgaactacactcagtattctcttctgacgatgctgtacaaacctaaccagaagttttcatctgaagataatgtagttaaagttgaaaggtttttggagaaaaaagctccctctcaggtgattattcctaaggctagagtagaggatgaagaattcttgttctcgatgaggctaagaactggtggtaagccttctggttctgtaatcatcctgtcaggtgatggaacagcaacagtggccatatattggagaggttcgacccgactttatcagtttgatttgccttgggattctggaaaggtcctggatgcttccgttatcccatcacctgaggatggagatgaaggtgcttgggttgtcctgacagaaaaggcaggagtctgggcgattcctgaaaaagctgtattagttggtggagttgaaccaccagagcgcagcttgtcacgaaaaggtagttgtaatgaagcagttgctgaggagaaaagaagaactcaagtcttcagtgccagtgttgctcccaggagagttagctctgaggcttggagtgctggagagaggcaaaggcctcctttaactggaatagctcagcaggctgtggttgatgaagagtcagaaatgctactgagtcggttatttcatgattttataatctctggtgcagttaatgaggcacttcaaaagcttagagatgcaggagcgtttgacaaagagggtgagatgaatatatttgttaggatgagcaaatcaattgtaaacacattagctaaacactggacaacaaccagagaagctgaatttcttgcctcaacaattgtttcatcccttgttgagaagcagcaaaaacatgagaaattcctccagtttcttgtcttgtcaaagtgccatgaagaactcacttcaaagcaaagagctgcaatgctaactatcatggagcatggtgaaaagctttctggaatgattcagcttagggaattacataacgctctcatccagcagcgctcaagtactcatttatcacctcagttaaaaacccaagccactggtgccctttggaaccttattcagttggttggtgagaaagctcgaagaaacacagttctcttaatggatcgcgataatgcagaagtgttctatagtagagtttctgatatagaggatctattttattgcttatctcatcagcttcaatacatcattagtagagaagaacacccttctgttcagatgcaacgtgcacttgagttagcaaatgcttgcagcaccttagttcatgctgcattgcactacaggaaggagcacaaggagtggtatccttctcctgaaggactgataacatggaacagccaccttgttgtacggtctggaatatggagtttagcatcatttgttatggagcttttgggagaatttggagctgcagacatgacaatgaagtctaatctatggtctcagctggagggactcacagatattctactggaggcatatataggtcttttaactgccaaatttgaacgtggtgatgaacatggtgtgctagtccaagaatattgtgaaaggagagatgaacttctcaggtcactctacaaccttgctaaacaaatagtggaggcaaaataccaggagtcaagagatggtaaagacaatttggatctgaaagaatctatatttagagaggttatttctccaattttggcaactgccaaacggcatgaaggataccaaacactgtggcagatttgctctgacctcaatgattcagttctcctccgtagtctaatgcatgatagtgtagggccgcatgggggattcagtttctttgtatttaaagagctagtcaacagcagacaatactctaagctgttaaggctgggtgaagaattccaggaagagctagctagttttctgaaagaccggaatgatcttctgtggcttcatgagatatgcttaaaccagttctcatctgcttctgagactcttcatacctatgctttgcgtggcagtcctgatgaagatgctagtgtcacaaccagcagaaagccactgtcctttgctgaaagaagacgtcttctttatctctctaaaattgctgcaacagcaggtaaggatattgactatgaagcgaaggttgcacggatagaagcagacatgtggattctaaaattgcaggaagaaattgttcagcatgatccagaatatgcacaagtcaaatatacaaccacattgcttgatccatcagaactgattgagatgtgcctgaagagagaccaagagctctcccttaaagcctttgaagtatttgcttcgacaagctcatcgttccgaagctccaacagaggccttcttgaggcatgctggacgaatgcaaccaaccaggatgattggctgaagctttcgcaggcatccacttcagaaggttggagcgacgaagtcatccaagaatctcttcaaggaactgtccttttcaaagcttccaggttgtgttatagccctgattcggtggtgtatgatggcacttttgaggatgtgctgcctgtgaagaaagaggatgtacatctgagaggtttggagagcaaatgcttgtcagtggaggaagtgctgatgcagcacaaggattttccagatgctggtaaattgatgatgactgcagtgattatgggcaaggaggtatcttacacagctgcagaacctgtggagatggagtcatgaaataatgtcagatttgtacgatagacttctgagtttaatcatgggaaaatttttgccttggtgacatcggacatgtggttttggtcgtatctgctctgcacagtggcagaagattatcagttcacgccattttttagcatgaactgtgacttgtaaacaggcaatcttttcgttttagttttctggagaaaaacatatgttctgcgttgatc

SEQ ID NO: 8643 - DNA, 4322 bp, Oryza sativa
gaactggggagctcaaaacactcgtaaaaccctagcctaccggagcgagcgccgacgccgagacgccgagagcccaaggtcggctagtcggagagtgcggccgcgtgcgggtggctgctgcgctgcgcgaactcccccgccgccaaagatgttctccccggcgatcaagaagccccacctgctccaccgcagggacaaggaggaggcgtccccctcaccccctcccgctcccgcgcacacgcccgcgcctcgtggatttgccgtccacgaccgccccgccaccggcaccccggcgccgtggacctcctcctccctgctcgccaggatttcaacatcaacacgaacagacaggacaggggattctggccagatccaaccggtgcatgtatccgaatttccccaaatagttcgaaatgctcaagccaaccttctgcaaaagagtttttccggcaagaacatgcttgctggtggcattgataaagaaacatcccttgcatggatgttatgtggaaatgagctttttatctggagttacctggcttctgttgcaaaagactgtcttgtacttgaggtcccttcttctcttatggggaacaaagaagaaaaatctctatgtggtaatcagtgggcagtttgcatagtgagatggggtagtagtggtgcatcaacacggagcagtggagatatattgcatcgaagaagttcgactggttttatcctgtgcaacaaaagaacacaagctatagcttattggtctgatatctatgctgaaagcagtaagagtccagttcttgatttaattggatatggtgatacatcttcaggtgatggcacatctggaaactgcaggattaattctcttattgcagtggcagttccaggaggtattaatgaatgcattgtgattgcttctcagccaacaggcacattatggatgttctggtgttcaccagctgcagttcgtcgaagagaaattcataagggtacattaggagtttataatgctgatcattctcagaaaaatagtggtggaaggtccttggcttggctaccaagtaaagcatcatctaaggctgctgaacggacgttctttttattgactagtcatgagctgcaattctggagcatctcattcgggcatgatatcaactgcaaaaaaatagggtctcaggaaattgttggtagtgatggtgatatgggaataaagaaagacatagctggacagaaaaacatatggcttttggacatgcagatagatgatcatgggaaagaaattatcattcttgttgctaccttctgcaaagatcgggtgagtgggtcgaactacactcagtattctcttctgacgatgctgtacagacctaaccaaaagttttcatctgaagataatgtgattaaaactgaaaggtttttggagaaaaaagctccttctcaggtgataatccctaaggctagagtagaggatgaagagttcttgttttctatgaggctaaaaactggtggtaagccttctggttctgtaatcatactgtcaggtgatggaacagcaacaatagccatatactggagaggttcaacccgtctctatcaatttgatctgccttgggatgctggaaaggttctcgatgcttcagttatcccatcttccgaggacagagatgaaggagcttgggttgttcttacagaaaaggcaggagtgtgggcaattcctgagaaagctgtgttagttggtggggttgagccaccagagcggagcttgtcaagaaaaggaagttgcaatgaagcagttgctgaagagaaaagaagaaatcaggcattcaatgctagtgttgtacccagaagagctagttctgaggcttggagtgctggagagaggcaaagaccagcattaactggtatagctcagcaggctgtggttgatgaggagtctgaaatgttattaaatcggttatttcatgattttgttttgtccggtacagttcatgaagcacttcaaaagcttagagcagcaagcgcatttgacaaagagggtgagatgaacatatttgttcgaataagcaaatccatcgtaaacactctatctaagcattggacaacaactagagaagctgaatttcttgcttcaacaattgtttcatccctaactgagaagcagcaaaaacacaagaaattccttcagtttcttgtcttgtctaagtgccatgaggaactctcttcaaagcaaagaactgcgatgctaactgtcatggaacatggagaaaagctctctggaatgatccagctcagagaattacaaaatgctcttagccatcaacgctcaagcataaatttatcacctcagtcaaaaaaccaaacaactggtgcattgtggaaccttattcaattggttggtgagcaatctcgaagaaacactgttctcttaatggaccgtgataatgctgaagtgttctacagcagagtttcagatatagaagatctatttaattgcatatctcatcagcttcaatacattataaccggagaagaaaacccttctgttcagatgcaacgtgcacttgagttatcaaatgcttgcatgaccctagttcaggcagcattgcgctacagagaggagcacaaggactggtatccttctcctgaaggactgataacatggaacagccagcctgttgtacgatctggaatctggcgagtagcatcctttgtcatggagcttttgagagaaccaggggctgcggacatgtcaatgaagtcaaacctatggtctcagttggaacgactcacagatatcctactggatgcatatatcgggttgttaactgctaaattcgagcgtggggatgagcatggtgtgctaatccaagaatactgtgacagaagagatgaacttcttgggtccctctatgacctcgcaaaacaaattgtagatgtaaaatatcaggagacgacagaagtcactgacaatctggaactgaaagaatctatattcagagaagtcacttctccaattttggcaacagctaaacggcatgaagggtaccaaacattgtggcagatttgctatgatctcagtgatacaggccttcttcgcagtcttatgcatgatagtgtaggacctcacgggggattcagtttctttgttttcaaacaactagtcaaaaggcgtcaacatgctaagctattaagattaggtgaagaattcccggaagagctagccaattttctgaaagagcgggatgatcttctgtggcttcatgagatatgcttaaatcggttctcttctgcttcgaagactcttcatactctcgtgagtcctgaggaagatgctaaccttacaagcaacaggaaatcactgtcctttgttgaaagaagacgctttctctatctctccaaaattgcagcagcagcaggtaaggatgttgattatgaagtgaaggttgcccatatagatgcagatatccgaattctaaatctgcaggaagagattgttcagcatgacccagagtatgcaccagataaatatactaccaagccatttcgtccattggaactgatcgagatgtgcctgaagggagatcgagagctctctcttaaagcttttgaagtatttgcttggacgagggcctcgttccggagctccaacaaaggccttctagaggcttgctggatgaatgcagccgaccaggacgactgggttagccttcaagaggaatcttcaggaggttggagcgatgaagtcatccaagaatctcttcagggcactgtcctgttcaatgcctccaggctgtgttatagcccagacgccgtggtgtatgacggttcgtttgaggacgtgctgcctgtgaagaaagaagacttgcatctgagaggcttggagggcagatgtctctcagtggaggaagtgctgatgcagcacaaggatttccctgatgcgggtaaattgatgatgaccgcggtgataatgggcaaggagctaccttatactgtttccacagctgaacctgttgacatggactcttgatactgtcacattctgtcagggagaaagacctgcaggttgggacctccaaatctgaaatcagagtcaattttcttttctttgcagcacggaatgtgtacagttccagatgtattcatattgcgggcgaaactatttgtagagactgcaagattttgcccttttttagcatgagctgtggcttgaaacgagtttttctcccccgatggaacaaagcaagctgatgctgtatcttaaaattttcttattagtaggaaatgcaaaatgcattcttttcttagtaatcaaggtttttcgtttttgg

SEQ ID NO: 8644 - DNA, 4436 bp, Sorghum bicolor
aaagggtcaggtttgctcatgcgattattgccttcacaaattcaaaccgatgtcccgtgtccctcctaggcagggggcaaagcgcaagaaagagaaaaagaaacaagccaaactctagtaaaaccctagcccaccggccaccggagagggcgccgagagccagaagccggctggtcggagaaggcgaggtcctagcagcctagccacagcgccgccgaagatgttctctccggcaatcaggaggccacacctcctcaaccgcagggacagggaggagggatccccttcgccgcctcctgctgctcccgcccattccccgtcgcctcacgggttcgccgtgcccgaccgccccgccaccggcaccccggtcccatggaactcctcctccctcctcgctaggatttcgacgtctaagcgaactgacaggactggtgattcggaccagatccaaccagtgcgcgtagcggagtttccccaagttgttcggaatgcccaagccagcctgctacagaagaatttctctggcaagaacatgcttgctggtggcattgataaagaaacatcccttgcgtggatgatatgcggaaatgagctttttatatggagttacttggcttctgttgcaaaagactgtattgcacttgacattccatcttctcttatcggatacaatgacgtgaaacccctcctcggtattcagtggacagtttgtataatgagatggcatagtggtggtgcatcaacaaggaatagtggagagatgttgcatagaaaaagttcaactggtgtgatcctctgcaacaaaagaacacaagctgttgcttattggcccgatatctatgctgaatttaataggagcctagttcttagttcgtcaggtgatggtgaggtgtctgcatgtgatgctgcatctgattgtttgaggtttaattcgcttattgcggctgcagttccaggatgtattcatgagtgcattgcaatagcttctgatcctgcaggtgctttgtggctgttccagtgttcaccggaaggaattcatcaaagaaaagttcatgcagatacattaggagatggtggtgccgatcattcccagaaaagtaatggtggaaggtccttgatttggttaccaaataatgtctcatctgagggttctgaccggaagttctttttattgacaaacaatgaggtgcaatgttggagtatctcattcttgaatgacatcaatgtcaaaaaattagggtctcacggaattgttggtactgacggagatgtgggcattaagaaagatatagctgggcagaaaaatatatggcttttggacatgcagatagatgagcgtgggaaggaatttagcattcttgttgctacattatgcaaagatagggttagcgggtcaaactacactcaatattctcttttgacaatgctgtacaagcctaaccagaagctttcgtctgaagataatgtagctaaagttgaaaggtttttggagaaaaaagctccttctcaggtgataattcctaaggctagggtagaggatgatgaattcttgttctccatgaggctaaaaactggtggtaagccttctggttctgttatcatcctgtcaggtgatggaacagcaacagtggccatgtattggagaggttccacccgactttatcagtttgatctgccttgggatgctggaaaggtcctagatgcttccgttatcccatcagctgaggacagagatgaaggtgcttgggtggttctaacagaaaaggcaggggtctgggcaattcctgaaaaagctgtattagttggtggggtggaacctccagaacgcagcttgtcacgaaagggtagttgtaatgaaacaattgctgaggagaaaagaagaagtcagggcttcagtgctagtgttgttcccaggagagttagctctgaggcttggagtgctggagagaggcaaaggcctgcattaactggcatagctcagcagtctgtggttgatgaagagtctgaaatgctactgaaccgattatttcatgattttataatctccagtgcagttagcgaggcacttcaaaagcttagagcagcaggagcatttgagaaagagggtgagatgaacatatttgttcggacgagcaaatccattgtaaacacattagctaaacattggacaacaaccagagaagctgaatttcttgcctcaacaattgtttcgtcccttgttgagaagcagcaaaaacatgagaaattccttcagtttcttgtcttgtcaaagtgccacgaagaactcgcttcaaagcaaagagcagcaatgctaactgtcatggagcatggtgaaaagctctctggaatggcacaccttagggaattacaaaatgcccttatccagcaacgctcaagcactcatttatcacctcagtcgaaaacccaaggtactggcgctctttggaaccttattcagttggttggtgagaaagctcgaagaaacacagttctcttaatggatcgtgataatgctgaagtgttctacagtagggtttctgatatagatgatctattttattgtttatctcatgagcttcaatacatcattagtagagaagaacacccatctgttcagatgcaacgtgcacttgagttagcaaatgcttgtatcgccttagttcaggcagcatcacactacaggaaggatcacaaggaatggtatccatctcctgaaggactgataacatggaacagccaacctgttgtacggtctggaatctggagtttagcatccttgattatggagcttttgggagattcaggagctgcagacatgtcaatgaaatctagtctatggtctcagctggaaggactcacagatattctactggaggcatatataggccttttaactgcccaatttgaacgtgggcaggaacatggtgtgctagtccaagaatattgtgaacgaagagatgaacttctcagatccctctacaaccttgctaaacaaatagtggaggtcaaataccaggagtcaaaagatggtacggacaatctggatctgaaagaatctatatttagaaaggttatttctcctattttagcaacagccaaacgacatgaagggtaccagacactgtggcagatttgctatgatctagatgattcagatctcctccgcagcctaatgcatgatagtgttgggcctcatggcggattcagtttctttgtctttaaagagttagtcaacagaggagactactctaagctgttaaggctaggtgaagaattccaggaagagcttgcaagctttctgaaagagcggagtgatctgctgtggcttcatgagatatgcttaaaccagttctcatctgcttctgagacccttcatacctatgctctgcgtggtagtcctgatggagatgctagcttcacaaccagcagaaagccactatcctttgttgaaagaagccgtcttctttatctctctaaaattgctgcaacagcaggtaaggatattggttatgaggtgaaggttgcacggatagaagcagacatgcggattctaaaactgcaggaagaaatagttcagcatgatccagaatacgcacaagtaaaatatacaaacgcattgcttggtccatcagaactgattgagatgtgcttgaggagagaccgagagctctcctttaaagcttttgaagtatttgctttgacaagctcatcattccgaagctccaacagaggtcttctagaggcatgctggatgaatgcaactcaccaggatgattgggtaaagctttcagaggcatccacgctagaaggttggagtgacgaactcatcgaagaatctcttcaagcaactgtcctcttcaaagcttccaggttgtgttacagcccggatgctgtggtgtatgatggcacctttgaggatgtgctgcctgtgaagaaagaggatgtccatctgagaggtttggagagcaaatgcttgtcagttgaagaagtgctgatgcagcacaaagattttccagatgctggtaaattgatgatgactgcagtgattttgggcaaggaactaacttttacagccacagaacctgtggagatggactcataaataatagttttagatttctatgatagactgtcaaaacatcgcagtcatttcattgtaattgccgtcgggtagtttcatcatcgtaaaaatcttgtcttggcaacacgggatatgtagttttggttgtttctgctctgcgcagtcacagaaacatgattccgtagcccaagattatcagttcacgccagtttttagcatgagctgagacttctaaacagggtgctttttgttttctggttctggagaggaataccttctgtgttgatcaaattatgtatgtcagcatgaaaagttgttctggagagaatattttctatatttacttaaatttgac

SEQ ID NO: 8645 - DNA, 4384 bp, Panicum virgatum
agagaaaatacactcacaaagcaaaaactctagtaaaaccctagcccgccggagagagcgccaagaccgagaggccggctggtcggagaaggggaggccgtgagggtgctctctgcccaaccgccgcaccgccgaagatgttctcgccggcgatcaggaagccccacctcctccaccgcagggacagggaggaggcatccccttcacctccacctgctgctcccgctcactccccgtcgcctcgcggattcgccatctccgaccgccccgctaccggcaccccggccccttggacctcatcctctctcctcgctaggatttcgacatcgaagcgaactgacagggctggtgaatcggagcagatccaaccggtgcacgtagcagagtttccccaaatcgttcggaatgcccaagccagccttcgacagaaaattttctctggcaagaacatgtttgcgggtggcattgataaagaaacatcccttgcctggatgatatgcggaaatgagctttttatctggaactactcagcttcttctgctaaagactgtctagtacttgacgttccatcttctcttattggatacaaagatgtgaaatccctccccggtattcagtggacagtttgtataatgagatggcatagtagtggtgcatcagcaagaaacagtggagatatattgtatagaaaacattctactggtgttatcctctgcaacaaaagaacacaagcagttgcttattggcctgacatctatgctgaatttaataagagtctagttcttagctcaccaggttatggtgaggtgtctgcaagtgatggtgcatctgattgtttcaggtttaattcgattattgcagctgcagttccaggaggcactcacgagtgtattgcaatagcttctgagcctacaggtgctttgtggttgttccagtgttcaccagaaggaattcgtcggcagaaaatccatggtgatacattaggagatggtggtgccgatcattctcagaaaagtaacggtggaaggtcattggcttggctaccaaattatgtctcatctgagggttctgatcggaagttctttttgttgacaaacaatgaggtgcaatgttggagtatctcgctcttgcatgacattgatataaaaaaattagggtctcaggaaattgttggtactgatggggatgtgagcataaagaaagatatagctgggcagaaaaatgtatggcttttggacatgcagatagatgagcatgggaaggaatttagcattcttgttgctacattttgcaaagatagggttagtgggtcaaactacactcagtattcacttctgacaatgctgtacaaacctaaccagaagttttcatctgaagataatgctgttaaagttgaaagatttttagagaaaaaagctccttctcaggtgattattcctaaggctagagtagaggatgaagaattcttgttctcattgaggctaaaaactggtggtaagccttctggttctgtaatcatcctgtcaggtgatggaacagcaacagtggccatatattggagaggttccacccgactttatcagtttgatctgccctgggatgctggaaaggtcctagatgcttccgttatcccatcagctgatgacagggatgaaggtgcttgggttgttctaacggaaaaggcaggagtctgggcgattcctgaaaaagctgtattagttggtggggtcgaaccaccagagcgcagcttgtcacgaaaaggtagttgtaatgaagcagttgctgaggagaaaagaagaactcaagtcttcaatgctggtgttgttcccaggagagtcagttctgaggcttggagtgctggtgagaggcaaaggcctgctttaactggcatagctcagcaggctgtggttgatgaagagtctgaaatgctactgaatcggttatttcatgatttcataatatctggcgcagttaatgaggcacttcaaaagcttagagccgcaggagcatttgacaaagagggcgagatgaacatatttgttcggatgagcaaatccattgtaaacacactagctaaacactggacaacaaccagagaagctgaatttcttggctcaacaattgtttcgtcccttgttgagaagcagcaaaaacatgaaaaattcctccagtttcttctcttgtcaaagtgtcatgaagaacttgcttcaaagcaaagagctgcaatgttaaccatcatggagcatggtgaaaagctttctggaatgatacagcttagggacttacataatactcttatccagcaacgctcaagtactcagttatcacctcagttaaaaacacaaaccactggtgccctttggaaccttattcagttggttggtgagaaagctcgaaggaacgcagttctcttaatggaccgtgataatgcagaagtgttctacagtagaatttctgagatagaggatctattttattgcttatctcatcagcttcaatacatcattagtagagaggaaaacccttctgttcagttgcaacatgcacttgaaatagcaaatgcttgtatcaccttagttcatgcagcattgcactacaggaaggagcacaaggagtggtatccttctcctgaaggactgataacatggaacagccaccctgtcgtacggtctggaatctggagtttggcgtcatttgttatggagcttttgggagaatcaggagctgcagacatgtcaatgaaatttaatctatggtctcagctggagggactcacagacattctactggaggcatatataggtcttttaactgccaagtttgaacgtggggatgaacatggcgtgctagtccaagaatattgtgaacgaagagatgaacttctcggatccctctacaacgttgctaaacaaatagtggaggccaaataccaggagtcaagagatggtacagacaatctggatctgaaagaatctatatttagagaggttatttctccaattttgggaacagccaaacggcatgaaggttaccaaacactgtggcagatctgctctgacctcaatgattcagttctcctccgtagcctaatgcatgatagtgtagggcctcatgggggattcagtttctttgtttttaaagagctagtcaacagaagacactactctaagctgttaaggctgggtgaagaattccaggaagagctagctagttttctgaaagagcgcagtgatcttctgtggcttcatgagatatgcttaaaccagttctcatctgcttctgagactcttcatacctatgcgctgcatggtagtcctgatgaagatgctagtgtcacaaccagcagaaagccactgtcatttggtgaaagaagacgtcttctttatctctctaaaattgctgcaacagcagataaggatattgactatgaagcgaaggttgcacggatagaagcagacttgcggattctaaaacttcaggaagaaattgttcagcatgatccagaatatggtcaagtcaaatatacaaccacgttgattgatccatcagaactgattgagatgtgcctgaagagagaccaagagctctcccttaaagcttttgaagtatttgcttcgacaagctcatcattccgaagctccaacagaggccttcttgaggcatgctggatgaatgcaaccaaccaggatgattgggtgaagctttcggaggcatccctgtcagaaggttggagcgacgaagtcatacaagaatctcttcaaggaactgtcctcttcaaagcttccaggctgtgttatagcccggattctgtggtgtatgatggcacttttgaagatgtgctgcctgtgaagaaagaggatgtacatctgaggggtttggagagcaaatgcttgtcagtggaggaagtactgatgcagcacaaggattttcctgatgctggtaaattgatgatgactgcagtgattatgggtaagaagctatcatatacagctgcagaacctgtggagatggactcatgaatgatattttcagatctgtgcgatagacttccaaatttcatcattgggaaaaaaaaatcttggtgacatcggatatttggttttggttgtatctgctctgcgcagttgcagaaacatgattccagatattcaaagatggtcagttcacgccattttttagcatgagctgtgacttgtaaacacgctgccttttcctttagttttctggagaggaacatctgtgctgctgcgtttatcatcccttaagtgcttaagtgtattaagggcttaagtgccaaatattgttactatcaaacttcgactagccaaaaagttgtccaatgtgttttgatgggggctatcagctaagaaaagatctgtctgtc

SEQ ID NO: 8646 - DNA, 3565 bp, Triticum aestivum
ttcggccacagtgacacatctgcaagtgatgccatatctggctgttacaggtttaactcgctaattgcagcttccgttccaggagccgctcatgaatgtattgcgattgcttctgagccaaccggtgctttatggttgtttcagtgttcaccactgagaattcaccgaagagaagtccatcgtgatacattaggagataatggtactgatcattctcagaaaaataatggtggaagatccttggtttggctgccaagcaatgaatcatccgaggctgctgaacggaagttctttttgttgactagccaggggatacaatgttggggcatctcactcttgcatggaatcaatgtaaaaatattagggtctcaggaaattgttggtagtgatggggagttgggcataaaaaaggacatagctggtcaaaagaacatctggcttttggacatgcaaatagatgagcgcgggaaggaatttaatattcttgttgctaccttctgcaaagaccgggtgagtgggtcaaactacactcagtattcacttctgacaatgctgtacaaatctaaccaaaagtttccatccgaaaacaatgtggttaaacgcgaaaggtttttggagaaaaaagctcctgctcaggtgataattcctaaagctcgagtggaggatgaagaatttttgttctccatgaggctaaaaactggcggcaagccttctggctcagtgatcatcttatcaggtgatggaaaagcaacggtggccatctattggaggggctctacccgactctatcaatttgatctgccttgggatgctggaaaggtttttgatgcttccattatcccatctgctgaggatagggatgaaggagcttgggttgttctgacagaaaaggcaggaatctgggcaatacctgaaaaggctgtattagtaggtggggttgagcctccagagcgcagcttatcacgaaaaggtagctgtaatgaagcggtcgctgaagagaaaaggagaagtcaagcattcagtgccagtattgttcccagaagagttagctctgaggcttggagtgctggagacaggcaaagaccagcattaactggcgtagcccagcaggctgtggttgatgaagaggctgagatgttacttaataggctgtttcatgattttattttgtcaggcgctgttcatgaggcacttcaaaagcttagagtagcaggggcatttgagaaagagggtgagatgaacgtatttgttcgagtaagcagatctattgtaaacacattatctaagcactggacaacaactagagaagctgaatttcttgcttcaactattgtttcatcccttgccgagaaacgtcaaaaacatgagaaattccttcaatttcttgtcttgtccaagtgccatgaagaactctcttcaaaacaaagagctgcaatgctaagtgtcatggaacatggagaaaagctctctggaatgatccatcttagagaattacaaaatgcgcttagccagcagagttcaagcacacgtttatcaccacagtccaaaactccaactgctggtgcactgtggaatctcattcagctggtcggtgagaaagctcgacggaacaccgttctattaatggatcgtgataatgctgaagttttctacagtagagtttctgacatagaggatctattttattgtttgtcgcatcaacttcggtatattataaccggagaagaacacccatctgttcagatgcaatgcgcacttgagttatcaaatgcctgtgtgaccttagttcaggcagcattacactacagagcggagtacaaggactggtatccttctcctgaagggctgataacatggaacagtcagcctgtagtgcggtctggaatctggaatctggcatcatctgtgatggagcttttgagagaaccaggatctgcaggcatgccaatgaaatctaatctatggtctcagctggaaggactcacagatatgctactggagggatatattggtgtattaactgccaaatttgaacgtggggaggaccatggtgtgctagcccaagaatactgtgaacggagagatgagcttcttggatccctttatgaccttgcaaagcaaattatagaagcaaaatatcaggagtcaagtgaaggcaatgacaatcctgatctgaaagaatctatatttagagaggtcacttctcctattttggcaacagctaaacggcatgaagggtaccaaacgttgtggcagatttgctatgatatcagtgatacggttctcctccgcaatcttatgcatgatagtataggacctcatgggggattcagtttctacgtttttaaacagctaatcaacagtcggcattacgctaagctgttaaggctgggagaagaattccaggaagagctagctaattttctgaaagaccgcagtgatcttttgtggcttcatgagatatgcttaaatcagttctcaactgcttcagagactcttcatacctgtgctctgctttcaagtcctggagaagatgctgacctaacaagcaccagaaagtcgctgtcctttgttgaaagaagatgtcttctctatctctctaaaattgctgcaacagcaggtaaggatgttgattatgaagtgaaggttgcacagatagatgctgatatccggattctaaatcttcaggaagagattgttcagcatgatccagaatatgcacagggcaaacatgcaagcaagcttcttccgccatcagaactgatcgagatgtgcatgaagagaggccgcgagctttctctcaaagccttcgaagtatttgcttggacaggctcctcgttccgaagctccaacaaaggccttctagaggcttgctggacaaacgcagccgaccaggatgactgggtcaagctctcacaggcatcagtttcagaaggctggagcgacgaggtcatccaagaatctctccaaggaacggtcctcttcaacgcttcgaggctgtgctacagctcggatgcggtggtgttcgatggcacgttcgaggaggtgctccccgtgaggaaagaggacgtgcaagcgagaggcctggaggccaagtgcttctcggtggaggaggtgctgatgcagcacgacgcttttccggacgccggtaggctgatgatgacggcggtggtgatgggcaaggagctgtcctatgctgccccggcagatgagcctgtggacatggactcatgatcatgccggagagggaggcgtgtatgtaggctggagttccaaatcatcagtgctcttgctttgtgtggccatgcaatcgtcggggttatttggtcgactggaatagtagtaaattttactccgtgatggccatgcaatagtaaattttactctgtgatactgatgcccattgtcggctgtaaacctttgtagagactgcaacattgtcagctcttgcctttttcttttagctcgagctgtgttttgaaaattgaaacatgcgtcggacgtggagttttacaccgagggctcaaatgctcttggctcttgggtgaacagtaaatttaaaaag

SEQ ID NO: 8647 - DNA, 1164 bp, Pseudoroegneria spicata
cccgaccccaggcgtggctcgccgcgagatggtggcacttttacattagctatgctagtttgtgtcttgttatcttttcaaatggtgaagctgacaatgatagcccgcatcactgatggccttccattggcggaggggttagatgatggtcgagatctgaaggatgctgacttctacaagcagcaagcgaaactgttgttcaaaaacctatctaaaggccagcacgaatcatcaaggctgtcaattgagactggaccgtactatttccattacatcattgagagccgtgtatgctatttgacaatgtgtgaccgttcttatcccaagaaacttgcattccagtatttagaagatctaaaaaatgaattcgagagggtcaatggcagccaaattgaaactgctgcaaggccatatgctttcatcaaatttgatacattcatacagaaaaccaggaaactatatttggataccagaacccaaaggaaccttgccaagttgaatgatgagctctacgaggtgcaccagattatgactcgcaatgttcaagaagttcttggtgtgggtgaaaaactagatcaggtgagtcaaatgtctagcaggttgacctctgatacgagaatgtatgcagacaaggcaaaggatctcaatcgccaggccttaattcggaagtatgcccctgtggccattgtgattgggatagtactgatgctcttttgggtcaagaacaagatatggtgaccgagtgaagctcgacatccttcactatgacgccgagaattctctgtcaacagatgcttctacagcttatcccgcatctgcctattcaagcgagattacctttttagccgccttatattcttcccaaacaagaggagcaaacagtaaacccgttgtgtagtattagtatagatctgatcctgatgcatgagttctccatgaaatcttggagccgaacataccatgaactattagagtgtagattcggccgaaatagtatatggtctttttgtgagctgaacatgtaagatctgtcgtgctattgtatgcagaaatgcttcagttgcgatgaaatatgttcaacatgctactgaagaacaggccatgtcaaattcattttcagtttaccaaatttgttcggtgaaatgttttgacatggaaaatcca

SEQ ID NO: 8648 - DNA, 1199 bp, Secale cereale
ctctctatctctcacccaaagcgaaccagaacccgacgcgaggcgtggctcgccgcgagatggtggcacttttacattagctatgctagtttgtgtcttgttatcttttcaaaatggtgaagctgacaatgatagcccgcatcactgatggccttccattggcggaggggttagatgatggtcgagatctgaaggatgctgacttctacaagcagcaagcaaaactgttgttcaaaaacttatctaaaggccaacacgaatcatcaaggctgtcaatcgagactggaccgtactatttccattacataattgagagccgtgtatgctatttgacaatgtgcgaccgttcttatcccaagaaacttgcattccagtatttagaagatctaaaaaatgaattcgagagggtcaatggcagccaaattgaaactgctgcaaggccatatgctttcatcaaatttgatacattcatacagaaaacaaggaaactatatttggataccagaacccaaaggaaccttgccaagttgaatgatgagctctatgaggtgcaccagattatgactcgcaatgttcaagaagttcttggtgtgggtgaaaaactagatcaggttagtcaaatgtctagtaggttgacctctgatacgagaatgtatgcagacaaggcaaaggatctcaatcgccaggccttaattcggaagtatgcccctgtggccattgtgattgggatagtactgatgctcttttggatcaagaacaagatatggtgaccgaccgagtgaagctcgacatccttcattatgacgccgagaattctatgtcaacagatgcttctacagcctatcccgcatctgcctattcaagcgagattacctttttagacgccttatgtttttcccaaacaagaggagcaaacagtaaacccgttgtgtagtatagtacagtgtagatctgatcctgatccatgagttctccatgaaatcttggagccgaacataccatgaactattagaggtggccgaaatagtaaatggtcttctttttgtgagctcaacatgtaagatctgtcgtggcaacataccgtaaacagaaatgctttggtcgcgatgaaatttgttcaacatgctactggagaacaggccatgccaaattaccaattttttttgaaatgacaatttaccaaatttgttcggtgagtc

SEQ ID NO: 8649 - DNA, 1665 bp, Triticum aestivum
ttcttccgcttctgtttcacctctctccctcactcaacgcggaccagaacacgacgcgaggcgcgtggctcggcgcgagatggtggcacttttacattagcgatgctagtttgtgtcttgttatcttttcaaaatggtgaagctgacaatgatagcccgtatcactgatggccttccattggcggaggggttagatgatggtcgagatctgaaggatgctgacttctacaagcagcaagcaaaactgttgttcaaaaacttatctaaaggccaacacgaatcatcaaggctgtcaattgagactggaccgtactatttccattacatcattgagagccgcgtgtgctatttgacaatgtgtgaccgttcttatcccaagaaacttgcattccagtatttagaagatctaaaaaatgaattcgagagggtcaatggcaaccaaattgaaactgctgcaaggccatatgctttcatcaaatttgatacattcatacagaaaactaggaaactatatttggataccagaacccagaggaaccttgccaagttgaatgatgagctctacgaggtgcaccagattatgactcgcaatgttcaagaagttcttggtgtgggtgaaaaactagatcaggtgagtcaaatgtctagtaggttgacctctgatacgagaatgtatgcagacaaggcaaaggatctcaatcgccaggccttaattcggaagtatgcccctgtggccattgtgatggggatagtactgatgctcttttgggtcaagaacaagatatggtgaccgagtgaagctcgacatccttcaccatgacgccgagaattctatgtcaacagatgcttctacagcttatcccgcatctgcctattcaagcgagattacctttttagccgccttatgtttttcccaaacaagaggagcaaacagtaaacccgttgtgtagtattagtatagatctgatcctgatccatgagttctccatgaaatcttggagccgaacataccatgaactattctattagaggtgtggattcgaccgacatagtaattggtcttcattttgtgagcccaacatgtaagatctgtcgtgcaacatattgtatgcagaaatgctttggtcgagatgaaatatgttcaacatgctactgaagaacaggccatgccaacttcatttccaatttaccaaattttgttcggtgaaacgttttgacacggaaaattcacacgattctagttgacacggaaaattcacacgattctagttgaaattgcttgtttcctgtaaaatcctgccttaataatttcttacagttgaacccccaaaccccgagctagtagaggctgcgggtcagcaccggaagccaagcaccctgccgtcgataggcgagacgccgacgcggcacaccttggacgcctgcacccggtgcgtcagcacccgcagcaccatcaccttgcccttcaccaccagcagcgagtccacctccatcatggcagccgcggccgccggctgctgcgcggtcgtgtcagcggcggtcgtgtggccgccgggaatgccggaccgccaatgcgtggccaaacccttgggctcccgccgttcatcaagcccccgggaactacacgagccacttccccgccggtcaagcaacccggacccactt

SEQ ID NO: 8650 - DNA, 1232 bp, Triticum aestivum
ggcgcttgccctcctagtagtttgttctctctcttcttccgcttctctttcacctctcttcctcactcaacgcgaaccagaacccgacggaggcgtggctcgccgcgagatggtggcacttttacattagcgatgctagtttgtgtcttgttatcttttcaaaatggtgaagctgacaatgatagcccgtatcactgatggccttccattggcggaggggttagatgatggtcgagatctgaaggatgctgacttctacaagcagcaagcaaaactgttgttcaaaaacttatctaaaggccaacacgaatcatcaaggctgtcaatcgagactggaccgtactatttccattacatcattgagagccgtgtatgctatttgacaatgtgtgaccgttcttatccaaagaaacttgcattccagtatttagaagatctaaaaaatgaattcgagagggtcaatggtagccaaattgaaactgctgcaaggccatatgctttcatcaaatttgatacattcatacagaaaaccaggagactgtatttggataccagaacccaaaggaaccttgccaagttgaatgatgagctctacgaggtgcaccagattatgactcgcaatgttcaagaagttcttggtgtgggtgaaaaactagatcaggttagtcaattgtctagtaggttgacctctgatacgagaatgtatgcagacaaggcaaaggatctcaatcgccaggccttaattcggaagtatgcccctgtggccattgtgatggggatagtactgatgctcttttggatcaagaacaagatatggtgacccagtgaagctcgacatccttcactatgacgccgagaattctatgtcaacagatgcttctacagcttatcccgcatccgcctattcaagcgagattacctttttagccgccttatattgtcccaaacaagaggagcaaacagtaaacccgttgtgtagtagtattagtatagatctgatcctgatccatgagttctccatgaaatcttggagccgaacataccatgaactattctattagagttgtagattcgaccgacatagtaattggtcttctttttgtgagcccaacatgtaagatctgtcgtgcaacatattgtatgcagaaatgctttggtcgagatgaaatatgtttgacatgctactgaagaacaggccatgccaacttcatttccaatttaccaaacttgtt

SEQ ID NO: 8651 - DNA, 1219 bp, Brachypodium distachyon
gacaaaagcgcctccccgggactttcctctcctttcttctcctccgcctctctcagagcgaacgacgacgacgcgagccggcgaggcggaggcgttggcccgccgcgagatggtggcagttttagattatctatgctagtttggttcttgttacattcccaaaatggtgaagctgacaatgatagcacgtgtcactgatggccttccattggtggaggggctagatgacggtcgagatctgaaggatgctgacttctacaagcagcaagcaaaactgttgttcaagaacttatcaaaaggacaacatgaatcatcaaggctgtcaattgagactggaccatactttttccattacatcatcgagggccgtgtatgctacttgacaatgtgtgatcgttcttatccaaagaagcttgcattccagtatttagaagatctaaaaaatgaatttgagagagtcaatggcaaccaaattgaaactgctgcgaggccatatgctttcattaaatttgacacgttcatccagaaaaccaggaagctgtatttggatacgagaacccaaaggaaccttaccaagctgaacgatgagctctacgaggtgcaccagattatgactcgcaatgttcaagaagttcttggtgtgggtgaaaaactagaccaggtgagccaaatgtctagtaggttgacctctgataccagaatgtatgcagataaggcaaaggatctcaatcgccaggccttaatccggaagtatgcccctgttgctattgtgattgggatagtactgatgctgttttgggtcaagaacaagatatggtagtgaagctgggacgtcgtccattacgaccgctgagacccttccgagttcttggcgtcgatggctgaacagatgctcctactacagcttatcccgcatctgcctattcaagcgagtactttgtagccgcccaaacaagagtagcaaacagtaaacccgtcgtgtagtatagaccctggttatggagctgatcttcatggatgtgttccatgaattcttgtatcccgcacattccatgacttcttggagcccgcacattccatgaactaaatagatttgtactactttcggcctttcgatctccgaaatggtaatgttttttgcgagctcgccatgtaagatctgtagcttaccatactttatgcagaatgtttcggccgcgatgaaattccacaagagcag

SEQ ID NO: 8652 - DNA, 1142 bp, Hordeum vulgare
gtggcacctttacattagttatgctagtttgtgtctggtcatcttttcaaaatggtgaagctgacaatgatagcccgcatcactgatggccttccattggcggaggggttagacgatggtcgagatctgaaggatgctgacttctacaagcagcaagcaaaactgttgttcaaaaacttatctaaaggccaacacgaatcatcaaggctgtcaattgagactggaccgtactatttccattacatcattgagagccgtgtatgctatttgacaatgtgtgaccgttcttatcccaagaaacttgcattccagtatttagaagatctaaaaagtgagtttgagagggtcaatggcagccaaattgaaactgctgcaaggccatatgctttcatcaaatttgatacattcatacagaaaaccaggaaactgtatttggataccagaacccaaaggaaccttgccaagttgaatgatgagctctacgaggtgcaccagattatgactcgcaatgttcaagaagttcttggtgtgggtgaaaaactagatcgtgattcgtttttgccctttgcagaggtgagtcaaatgtctagtaggttgacctctgatacgagaatgtatgcagacaaggcaaaggatctcaatcgccaggccttaattcggaagtatgcccctgtggccattgtgattgggatagtactgatgctcttttgggtcaagaacaagatatggtgaccgagtgaagctcgacatccttcactgtgacgccgagaattctatgtcaacagatgcttctacagcttatcccgcatctgcctattcaagcgagattaccattttagccggcttatgctctccccaaacaagaggagcaaacagtaaacccgttgtgtagtactcctactattagtatagatctgatcctgatgcatgacttctccatgaaatcttggagccgaacatactactccgtacctattagaggtgtagattcggccgacatagtaattggtcttccttttgtgagctcaacatgtaagatcagtagtggcaagataccggaaacggaaacgctttggtcacgatgaaatttgttcagcatgctactggagaacaggctatgtcaaattcatttcaaatttgcc

SEQ ID NO: 8653 - DNA, 1236 bp, Festuca arundinacea
tgcgctttctgcctctgcaaaatcgcctcccttcccttgccgtccctctcccctctctcttcttctcttccgccccagaacccgcctacgcgacacgaagcgaggcgcgagctcgccagccgcgagatggtcgcacttttacattagatatgctagtttgtttcttgtcatcttttcaaaatggtgaagctgacaatgatagcccgtatcactgatggccttccattggctgaggggttggatgatggtcgagatctgagggatgctgacttctacaagcagcaagcaaaactgctgttcaaaaacttatcaaaagggcatcatgattcatcaaggctgtcaattgagactggaccatacctttttcactacatcattgagagccgtgtatgctatttgacaatgtgcgaccgttcttatccaaagaaacttgcattccagtatttagaggatctaaagaatgaatttgagagagtcaatggcagccaaattgaaactgctgcaaggccatatgctttcatcaaatttgacacgttcatacagaaaaccaggaagctgtatttggataccagaacccaaaggaaccttgccaagttgaatgatgagctctacgaggtgcaccagattatgactcgcaatgttcaagaagttcttggtgtgggtgaaaaactagatcaggtgagtgaaatgtctagtaggttgatctctgataccagaatgtatgcagacaaggcaaaggatctcaatcgccaggccttgattcggaagtatgcccctattgccattgtgattgggatagtagtgatgctcttttgggtcaagaacaagatatggtgaccgagtgaagcaaagctcggacatcctccattacaagatgaagacttctcaagatcccgatgcaccgtataatcgattccagcccaacagtcgcttctacagcttatcccgcatctgcctattcaagcgagagtacactttagctgcatattcctctcaaacaagagtaccgaactgcaaacctagacgcgttgtgtagcagtaatagatcctgatggatgagttccatgaattcttggagccgcacattccattaactaatactccgtagatgtgtagagttggcttatctcggaaatggtaaatgtttctttttgccatgtgctaagatttcgggctgatcggctagtatttgtactgttctaagtgagcatgtttatggaatgttcgtaaacgcaa

SEQ ID NO: 8654 - DNA, 1226 bp, Avena sativa
tctcttctgctcttccgcctctctcactccacgcaaaccggaacccgccgcagcgacacgaagcgaggcgagtgctcgcgcgagatggtcgcacttctacattagctatgctagtttgtttctcgtcatcttttcaaaatggtgaagctgacaatgatagcccgtgtcactgatggccttccattggcggaggggttagacgatggtcgagatctgaaggatgctgacttctacaagcagcaagcaaaattgttgttcaaaaacttatcaaaagggcatcatgattcatcaaggctgtcaattgagactggaccataccttttccattacatcattgagggccgtgtatgttatttgacaatgtgcgatcgttcttatccaaagaaacttgcgttccagtatttggaagatctaaagaatgagtttgagagggtcaatggcagccaaattgaaactgctgcaaggccatatgctttcatcaaatttgacacgttcatacagaaaaccaggaaactgtatttggataccagaacccaaaggaaccttgccaagttgaatgatgagctctacgaggtgcaccagattatgactcgcaatgttcaagaagttcttggtgtgggggaaaaactagatcaggtgagccaaatgtctagtaggttgacctctgataccagaatctatgcagacaaggcaaaggatctcaatcgccaggccttgattcggaagtatgcccctgttgccgttgtgattgggatagtagtgatgctcttctgggtcaagaacaagatatggtgaccgagtgaagctcgggcatcctcaattacaagatggagacttctcaagatcccggtgcactgtatcatcgattctagctcgacagtcgcttctacagcttatcccgcatctgcctattcaagcgagagtacaatttagctgtctattcctcccaaacaaaacgagagtaccaaatagtaaatctatggtcccgttgtgtagtatagacccttatcctgatggatgagttccatgaattcttggagccgcacattccatgaactaatagacgtgtagagttggcttttcgatccctgaaatggtaattggtttctttttgctagctcaacatgtaagatttcaggctgatcgacaagtatctgtcagcgtacaatactgtgtgggcatgttctgcaacgtttgtaaacgcgaatgaaatttgttccgcatgc

SEQ ID NO: 8655 - DNA, 926 bp, Avena sativa
cctttctcttctgctcttccgcctctctcactccacgcaaaccggaacccgccgcagcgacacgaagcgaggcgagtgctcgccgcgagatggtcgcacttctacattagctatgctagtttgtttctcgtcatcttttcaaaatggtgaagctgacaatgatagcccgtgtcactgatggccttccattggcggaggggttagacgatggtcgagatctgaaggatgctgacttctacaagcagcaagcaaagttgttgttcaaaaacttatcaaaagggcatcatgattcatcaaggctgtcaattgagaccggaccataccttttccattacatcattgagggccgtgtatgttatttgacaatgtgcgaccgttcttatccaaagaaacttgcattccagtatttggaagatctaaagaatgagttcgagagggtcaatggcagccaaattgaaactgctgcaaggccatatgctttcatcaaatttgacactttcatacagaaaaccaggaaactgtatttggataccagaacccaaaggaaccttgccaagttgaatgatgagctctacgaggtgcaccagattatgactcgcaatgttcaagaagttcttggtgtgggggaaaactagatcaggtgagtcaaatgtctagtaggttgacctctgataccagaatctatgcagacaaggcaaaggatctcaatcgccaggccttgattcggaagtatgcccctgttgccgttgtgattgggatagtagtgatgctcttctgggtcaagaacaagatatggtgaccgagtgaagctcgggcatcctcagttacaagatggagacttctcaagatcccggtgcactgtatcatcgattctagctcgacagtcgcttctacagcttatcccgcatctgcctattcaagcgaga

SEQ ID NO: 8656 - DNA, 1067 bp, Zea mays
caccatttgctgttcaccttccctcccgtttgcctcctctcgctgtctcgtagcttctttcctccggcgacggctgggcgagcggccgccagtcggtcccttcgtcggcgacgagcatccacctgcgccggcgctccatcttccgctccctcccttactcgcgctcggcacacaggcgacggcggcggcgctcaggatcgggctatcaccgacggggtccggcttctccgcccgcctctcgccactcgtcctcgcctccggtcctccgcacaccggccggtgatcctgcctctgtaggttttttgtactatactttttagtggttctggccttcttgacacaatggtgaagctgacaatgatagctcgtgtcactgatggccttccactggcagaagggttggatgatgggcgagatctgaaggattctgatttctataagcagcaagctaaacttcttttcaagaacttgtcaaaagggcatcatgaagcttcacggatgtcaattgagacagggccctactatttccactacattattgagggcagagtatgttatctgactatgtgtgaccgctcttatccgaagaaacttgcattccagtacctagaagatctgaaaaatgaatttgagagggtcaatggcaaccaaattgaaactgctgcaaggccatatgcttttatcaagtttgatacattcatccagaagactaggaaactgtatttggatacaagaactcaaagaaacctcgcaaaactgaatgatgaactctatgaggtgcatcaaattatgactcgcaatgttcaagaagttcttggtgttggtgaaaagctagaccaggtcagtgaaatgtcaagcaggttgacttctgatacaagaatatacgcagataaggctaaggacctcaaccggcaggcgttgattcggaagtatgctcctgtcgccattgtcattggggtagtattgatgctgttttggctcaagaacaagatatggtgattgtacagtacgaaggatactgggccctgttacaacaccggagaagaacagatggagataaaaaccag

SEQ ID NO: 8657 - DNA, 1288 bp, Sorghum bicolor
caggctcggtccctcaacgcagatctccttccccactcgcgctcaggctcggtcgcagggattggatcttccgcgcgtcggcggctccccctcggcggcgtccagcgacggaggggcagtcctaggctcggcggcgccgtcggcggctccccctcccgcctctcgccagtcgcctcgcgccctcgcctccgtcctccgcgcaccggccggcgaccctgcctctgtaggttttttgtactatactttctagtggttctggccgtcttgacacaatggtgaagctgacaatgatagcccgtgtcactgatggccttccactggcagaagggttggatgatgggcgagatttgaaggatgctgatttctacaagcagcaagctaaacttcttttcaagaacttgtcaaaagggcatcacgaagcttcacggatgtcaattgagacagggccctactatttccactacatcattgagggccgagtatgttatctgactatgtgtgaccgctcttatccgaagaaactcgcattccagtacctagaagatttgaaaaatgaatttgagagggtcaatggcaaccaaattgaaactgctgcaaggccgtatgcttttatcaagtttgatacattcatccagaagactaagaaactgtatttggatacaagaactcaaagaaacctcgcaaaactgaatgatgaactctatgaggtgcatcaaattatgactcgcaatgttcaagaggttctgggtgttggtgaaaagctagaccaggtcagtgaaatgtcaagtaggttgacttctgatacaagaatatatgcagataaggcaaaggacctcaaccggcaggcgttgattcggaagtatgctcccgtcgccattgtcattggggtagtattgatgctgttttggctcaagaacaagatatggtgattgtacaatatgaaggaaactgggccctgttacaacaccggagaagaacagatggagaaaaaaaccagttcgattctggaaaaaaaagatgctttggtgacttgtatcccgtatctgcccattcaagcgagtacttgagctgccctttgctcctccctataagctagtatattaaagtgaattcgttgtagtgcagaccttataagaaactcagattttgtgcatccgtggaactcgtaaatacaagagctctgtagagttgactttacgacagcggggttgtaatttttctggctgaactcaatgtaaggattcagactgatctgatgagttgacttcacttgggcgcgcttatcttg

SEQ ID NO: 8658 - DNA, 1186 bp, Avena sativa
ccctcccttccccggtggtgtcctctcctctctcttctgctcttccgccactctcactctacgcaaaccggaaccagccgcagcgacacgaagcgaggcagtgctcgcgcgagatggtcgcacttctacattagctatgctagtttgtttctcgtcatcttttcaaaatggtgaagctgacaatgatagcccgtgtcactgatggccttccattggcggaggggttagacgatggtcgagatctgaaggatgctgacttctacaagcagcaggcaaaattgttgttcaaaaacttatcaaaagggcatcatgattcatcaaggctgtcaattgagactggaccatacctcttccattacatcattgagggccgtgtatgttatttgacaatgtgcgatcgttcttatccaaagaaacttgcgttccagtatttagaagatctaaagaatgagtttgagagggtcaatggcagccaaattgaaactgctgcaaggccatatgctttcatcaaatttgacacgttcatacagaaaaccaggaaactgtatttggataccagaacccaaaggaaccttgccaagttgaatgatgagctctacgaggtgcaccagattatgactcgcaatgttcaagaagttcttggtgtcggtgaaaagctagaccaggttagtgaaatgtcaagcagattgacatcggacacgagaatctacgcagataaggccaaggatctcaatcgccaggccttcattcggaagtatgctcctgttgccattgtgattggggtcgtaataattctgttctgggcgaagaacaagatatggtgattccactaaacaacggaagctggcccgtggtatgacacttgaggaagaacacagataaggttgattctggatgaagagatatatgctttgatggcttgtatcccgtgtctgcctgttcaagcgagaactctgaagctatctttactcctccatacaagcaattctactgaattcgttgtagtgtagaacatatatgacggacttgattttgtgaatcctcagaaccgtacatacaagagctctgtagagttgacctttcgataccgggattgtatttttgtgttaactcttgtaagaatccaggcggatgaactctgtactcttgctcccaccatggcaacatatattccttgtttgacact

SEQ ID NO: 8659 - DNA, 1201 bp, Saccharum officinarum
agttgccaaccgacatagatctcatcgttcccgttcacctcccctctcttcccgtttacctccctctcgctctctcgtagcttctttcctgcggcgacggctgggcgagcaggcgcccttttcgtcgggccattcgacggcgacgagcatccacctgctctgtaggttttttgtactatactttctagtggttctggccttcttgacacaatggtgaagctgacaatgatagctcgtgtcactgatggccttccactggcagaagggttggatgatgggcgagatcagaaggatgctgatttctacaagcagcaagctaaacttcttttcaagaacttgtcaaaagggcatcacgaagcttcacggatgtcaattgagacagggccctactatttccactacatcattgagggccgagtatgttatctgactatgtgtgaccgctcttatccgaagaaacttgcattccagtacctagaagatctgaaaaatgaatttgagagggtcaatggcaaccaaattgaaactgctgcaaggccatatgcttttatcaagtttgatacattcatccagaagactaagaaactgtatttggatacaagaactcaaagaaacctcgcaaaactgaatgatgaactctatgaggtgcatcaaattatgactcgcaatgttcaagaggttcttggtgttggtgaaaagctagaccaggtcagtgaaatgtcaagcaggttgacttctgatacaagaatatacgcagataaggcaaaggacctcaaccggcaggcgttgattcggaagtatgctcctgtcgccattgtcattggggtagtattgatgctgttttggctcaagaacaagatatggtgattgtacaatatgaaggaaactgggccctgttacaacaccggagaagaacagatggagaaaaaaaccaggtcgattctggatcaagaagatgctttggtgacttgtatcccgtatctgcccattcaagcgagtacttgagctgccctttgctcctccctataagctagtatattaaaagtgaattcgttgtagtgcagaccttatgagaaactcagattttgtgcatccgtggaactcgtaaatacaagagctctgtagagttgacttacgacatcggggttgtaatttttctggcggaactcaatgtaaggattcatgctgatctgatgacttc

SEQ ID NO: 8660 - DNA, 1210 bp, Oryza sativa
agacggaacggtggggctgtcgaagcatccgcgtcctccgggctccggcgactccgcggccgcgatctcttcggctctccccgccggagacggccaccgcgtcgcctcccccttcaaccgcctcgatcccttcctgttctttcggtattttggtgtagtttgcactggtttctggatttcttgacaaaatggtgaagctgacaatgatagcacgtgttactgatggccttccactggcagaagggttggatgatggacgggatcagaaggacgctgacttttacaagcagcaagctaaacttctattcaaaaacttatcaaaggggcaacatgaagcctcgcggatgtcaattgagactgggccatactattttcattacatcattgaggggcgagtatgctatctgactatgtgtgaccgttcttatccaaagaaactcgcattccagtacctagaagatctgagaaatgaattcgaaagagtcaacggcagtcaaatcgaaacagctgcaaggccgtatgcgtttattaagtttgacacattcattcagaagactaagaaactctatttggatactagaacccagaggaatcttgcgaaattaaatgatgagctctatgaggtgcatcaaattatgactcgtaatgttcaagaagttcttggtgtcggtgaaaagctagaccaggtcactgaaatgtcaactaggctgacttctgacacaagaatctatgcagataaggctaaggatctcaatcgccaggccttgattcggaagtatgcccctgttgccattgtgatcggtgtagttttgatgctcttttggttgaagaacaagatatggtaactgcactaaactaaggaagctgggcctgcattaccacactggtgcaagaaaaaccgaaaatttaggtagattctggatcaagagatatcaagagatgctttggtgacttgtatcccgtatctgcccattcaagcgactacttcagctgcctttcaccctcctcccgacaagctattcaagccaattcgttgtagcatacagtagaccttataacggaactcggacttgattttgtgaacccttggaaccgtatatacaagagctctgtagagttgaatttttttatattgggatgatattgcattttattttgcaaactcatgtaagaattcaggctgaatatcctatattacaatatctctgct

SEQ ID NO: 8661 - DNA, 1177 bp, Oryza sativa
ggacgaaacggcggtgggctctcgaaacttccgggctccggcgactccgccggccgcgatctcctcctcctcctcctctccggctcttcccggagacgaccaactccctccttcctgttcatttggtattctggtgcagtttgcagtggtttctggccttcttgacaaaatggtgaagctgacaatggtagcacgtgtcactgatggccttccactggcagaagggttggatgatggacgggatcagaaggacgctgacttttacaagcagcaagctaaacttcttttcaaaaacttatcaaaggggcaacatgaagcctcgcggatgtcaattgagactgggccatacttttttcattacatcattgaggggcgagtatgttatctgacaatgtgtgaccgttcttatccaaagaaacttgcattccagtacctagaagatctgaaaaacgaatttgaaagagtcaatggcagtcaaatcgaaacagctgcaaggccatatgcctttattaagtttgacacattcattcagaagactaagaaactttatttggacactagaacccagaggaatcttgcgaaattgaatgatgagctctatgaggtgcatcagattatgactcgcaatgttcaagaagttcttggtgtcggtgaaaagctagaccaggtcactgaaatgtcaactaggttgacttctgacacaagaatgtatgcagataaggctaaggatctcaatcgccaggccttgattcggaagtatgcccccgttgccattgtgatcggtgtagttttgatgctcttttggttgaagaacaagatatggtaactgcaccaaatgaaggaagctgggcctgcgttacaacactggagaaagaaaaacaaaaaaattaggttgattctggatcaatagtgctttggtgacgtgtatcccgtatctgcccattcaagcgagtacttcagctgcccttttaccctcctcctcactacaaagctattcaagtcaattcgttgtagcataggccttatgacggacttgattttgtaaatccttggaactgtacatataagagctctgtagagttgagttttcggtattgggatgggattgtattcttttgcaaactcaactcatgtaagaattcaggctgaatatcgtatactccatatctcttggact

SEQ ID NO: 8662 - DNA, 1208 bp, Echinochloa colona
ctggtgtctggtgcgctctcctccctcgcggcgcttccttcagcagaacccaacccaagcccccaaaggaggcctccacatggtggtgcttttagattacctatactagtttgcctattgctatatttcccaacatggtgaagctgacgatgatagcacgtgtcactgatggcctcccactgtcggagggactggatgatgttcgggatctcaaggacgctgatttctacaagcagcaagcaaaactgttgttcaagaacttgtcgaaagggcagcacgatgcatcgaggatgtcaatcgagactggaccataccttttccactacattattgaaggccgtgtgtgctatttgactctgtgtgaccgttcttatcccaagaaacttgcattccagtatctcgaagacctcaaaagtgaatttgagagggtcaatggcagccaaattgaaactgctgcaaggccatatgcatttattaaatttgatgcattcatacagaagaccaagaaactgtacctggatacaagaacacaacgtaacctcgccaagctgaatgatgaactctacgaggtgcaccagattatgactcgcaatgttcaagaagtgcttggtgttggtgaaaaactagaccaggtgagcgaaatgtccagtaggttgacctctgatactagaatctatgcagagaaggcgaaggatctcaatcgccaggccttaattcgcaagtatgcccctgttgccattgtgattgggatagtactgatgctcttttgggtcaagaacaagatatggtgacgtggcgtatctcggacctcctgagttatgtcgctggaacctggtgctgagttaatctcggtgtttgattctggctcaacagatgcttcgatggcttatcccgcatctgccgattcaagcgagtactttagctgcgaaaagcaaacctgctgtagtatacaccctagatatgatggatggccttggaaggcgcgttttcctattaactggatcagtgtagcagtatatggttctggcgagcgcaccatgtaagggtcaaggtttcaggctgcctgccgatagacaatcgtttcagttagtacatactgtatgccaaaccaaactctatgtatgccatgttttgtgacatttttctggcagcaattaaacatgtttgacttgctgctgctggagcctggaagcagatcatttttattc

SEQ ID NO: 8663 - DNA, 1276 bp, Oryza sativa
aagcttatcaaaaaaaaaaagaaaaaaaagaagtgaagaagacggaacggtggggctgtcgaagcatccgcgtcctccgggctccggcgactccgcggccgcgatctcttcggctctccccgccggagacggccaccgcgtcgcctcccccttcaaccgcctcgatcccttcctgttctttcggtattttggtgtagtttgcactggtttctggatttcttgacaaaatggtgaagctgacaatgatagcacgtgttactgatggccttccactggcagaagggttggatgatggacgggatcagaaggacgctgacttttacaagcagcaagctaaacttctattcaaaaacttatcaaaggggcaacatgaagcctcgcggatgtcaattgagactgggccatactattttcattacatcattgaggggcgagtatgctatctgactatgtgtgaccgttcttatccaaagaaactcgcattccagtacctagaagatctgagaaatgaattcgaaagagtcaacggcagtcaaatcgaaacagctgcaaggccgtatgcgtttattaagtttgacacattcattcagaagactaagaaactctatttggatactagaacccagaggaatcttgcgaaattaaatgatgagctctatgaggtgcatcaaattatgactcgtaatgttcaagaagttcttggtgtcggtgaaaagctagaccaggtcactgaaatgtcaactaggctgacttctgacacaagaatctatgcagataaggctaaggatctcaatcgccaggccttgattcggaagtatgcccctgttgccattgtgatcggtgtagttttgatgctcttttggttgaagaacaagatatggtaactgcactaaactaaggaagctgggcctgcattaccacactggtgcaagaaaaaccgaaaatttaggtagattctggatcaagagatatcaagagatgctttggtgacttgtatcccgtatctgcccattcaagcgactacttcagctgcctttcaccctcctcccgacaagctattcaagccaattcgttgtagcatacagtagaccttataacggaactcggacttgattttgtgaacccttggaaccgtatatacaagagctctgtagagttgaatttttttatattgggatgatattgcattttattttgcaaactcatgtaagaattcaggctgaatatcctatattacaatatctctgctgcatgtgactcatcatcatcttaaaaa

SEQ ID NO: 8664 - DNA, 1258 bp, Oryza sativa
agaagagaagtgaagaggacgaaacggcggtgggctctcgaaacttccgggctccggcgactccgccggccgcgatctcctcctcctcctcctctccggctcttcccggagacgaccaactccctccttcctgttcatttggtattctggtgcagtttgcagtggtttctggccttcttgacaaaatggtgaagctgacaatggtagcacgtgtcactgatggccttccactggcagaagggttggatgatggacgggatcagaaggacgctgacttttacaagcagcaagctaaacttcttttcaaaaacttatcaaaggggcaacatgaagcctcgcggatgtcaattgagactgggccatacttttttcattacatcattgaggggcgagtatgttatctgacaatgtgtgaccgttcttatccaaagaaacttgcattccagtacctagaagatctgaaaaacgaatttgaaagagtcaatggcagtcaaatcgaaacagctgcaaggccatatgcctttattaagtttgacacattcattcagaagactaagaaactttatttggacactagaacccagaggaatcttgcgaaattgaatgatgagctctatgaggtgcatcagattatgactcgcaatgttcaagaagttcttggtgtcggtgaaaagctagaccaggtcactgaaatgtcaactaggttgacttctgacacaagaatgtatgcagataaggctaaggatctcaatcgccaggccttgattcggaagtatgcccccgttgccattgtgatcggtgtagttttgatgctcttttggttgaagaacaagatatggtaactgcaccaaatgaaggaagctgggcctgcgttacaacactggagaaagaaaaacaaaaaaattaggttgattctggatcaatagtgctttggtgacgtgtatcccgtatctgcccattcaagcgagtacttcagctgcccttttaccctcctcctcactacaaagctattcaagtcaattcgttgtagcataggccttatgacggacttgattttgtaaatccttggaactgtacatataagagctctgtagagttgagttttcggtattgggatgggattgtattcttttgcaaactcaactcatgtaagaattcaggctgaatatcgtatactccatatctcttgcacttcatgcccatgttgcctaaacgtattatgccctgattagttacattttgagtaattttatggtca

SEQ ID NO: 8665 - DNA, 1588 bp, Panicum virgatum
tggcgagccgagccgagccacctgatgtgcatgtcatgactcaagccgaacaagccttcaatccgaagccgagccgaggggccacaagccgacctggcgcacgctgcgctgcttcttcttcctcctcttccggcgccgctgggtggtgctctcctcctcctcctcggcctccctcacgagaagcggaacccaaaagcagccgaagccacgcacggcgacggcgacggcgacggcgacggcgacggcgacggcgcggcgtgctacatggtggtgcttttagattacctgtactagtttgcctcttgctatatctccaaaatggtgaagctgacaatgatagcacgtgtcactgatggccttccactgtcggagggactagatgatggtcgggatctgaaggatgctgatttctacaagcagcaagcaaaacaattgttcaaaaacttgtcaaaagggcagcacgaagcatcgaggatgtcaatcgagactggaccataccttttccactacatcattgaaggccgtgtgtgctatttgacactgtgtgaccgttcttatcccaagaaacttgcattccagtatctcgaagacctcaaaaatgaatttgagagggtcaatggcagccaaattgaaactgctgcaaggccatatgcatttattaaatttgatgcattcatacagaagaccaagaaactgtatttggataccagaacacaaaggaaccttgccaagcttaatgatgagctctacgaggtgcaccagattatgactcgcaatgttcaagaagttcttggtgtcggtgaaaaactagaccaggtgagcgaaatgtccagtaggttgacctctgatactagaatctatgcagagaaggcgaaagatctcaatcgccaggccttaattcgtaagtatgcccctgttgccattgtgattgggatagtactgatgctcttttgggtgaagaacaagatatggtgacttgtggtgtatctcggacctcctgagttacaatgctggagcctggtgcaccgtcatctgcatgcaaccaccatatgttgattctggctcaacagatgcttcgatggcttatcccgcatctgccgattcaagcgagtactgtagctaccaaaagcgatcccgttgtagtatactacactagatatggacctggtcttaatgttgaattctcggaactggcgcgttcctattaaccggatctgcgtagtagtgtatttctgtgagcgcaccatatacaaggtctgaggctgctgaactgggggacgagtgctatttcacttgccatactgtatgcaaaactaaacatgttccaatctggtggtggagcctagagaggcaggtcatttccttttattacggatcccttgaatgtagtgtaatgaaatgttgttgtgtggagttcacatgattggcaggctggaaatcgacaaggcccttttgagttttgactcggaactttgtagtttgctttggtcctggacttgggaagtaatctgacagtctagaggaggttgacagttaagcaaatggggaaaagaaaatctagctagaattcattcacactgatatactg

SEQ ID NO: 8666 - DNA, 1008 bp, Echinochloa colona
aatggtgaagctgaccatgatagcgcgtgtcactgatggccttccactggcagaagggttggatgatgggcgagatcagaaggatgctgatttctacaagcagcaagctaaacttattttcaagaacttgtcaaaagggcatcatgaagcttcccgaatgtcaatcgagacaggaacctactatttccactacatcattgaaggccgagtatgttatctgactatgtgtgaccgctcttatccgaagaaacttgcattccagtacctagaagatctgaaaaatgaatttgagagggtcaatggcaatcaaatagaaactgctgcaaggccgtatgcttttatcaagtttgatacattcatccagaagactaagaaactgtatttggatacaagaactcaaaggaaccttgcaaaattgaatgatgagctctatgaggtgcaccaaattatgacccgcaatgttcaagaggttcttggtgttggtgaaaagctagaccaggtcagtgaaatgtcaagtagattgacatctgacacaagaatatatgctgataaggcaaaggacctcaatcggcaggccttgattcggaagtatgctcctgttgcaattgtgatcggggtagtattgatgctgttttggctcaaaaacaagatatggtgaatgtaatatacaaaggaagccatgccccatttgactggagaagaacatatgaaaatcagattggtcgattctggatcaagagatgctttggtgacttgtatcccgtatctgcccattcaagcgagtactacagcttctttctgctcctccctacaagccattcaaagtgaattcgttgtagtatagaccttatgacatactcgaattttgtgcatccgtggaataggtaaatacaagagctctgtagagttggattcgcgacaccgggattgtaatttttctggtgaaacttaatgtatggatttggctgatgaactgtactcacgctgatttacaaattttaatgtggc

SEQ ID NO: 8667 - DNA, 1279 bp, Pennisetum glaucum
tcttcttccttccttcctcgatctcttcttcctcttccggcgctgtgctgcggctgcgctgcgctgcgctggtgtgtctctcctcccaatccgtcctcgccacccacgcggcggaagcccgaacccgccgcagccacatggtggtgcgtttacgtcacctgtgctagttcgccccctttgctacacttccaaaatggtgaagctgaccatgatagcgcgcgtcaccgacggccttccgctgtcggagggactagacgatggtcgggatctcaaggatgctgacttctacaagcagcaagcgaaacagttgttcaagaacttgtcgaaagggcagcacgaagcttcgaggatgtcgatcgagactggaccgtaccttttccactacatcatcgaaggccgtgtgtgctatttgactctgtgtgatcgttcttatcccaagaaactcgcattccagtatctcgaagatctcaaaaatgaattcgagaaggttaatggcagccaaattgaaactgctgcaaggccatatgcatttattaaatttgatgcattcatacagaagaccaagaaactgtacttggatacaagaacacaaaggaaccttgccaagctgaatgatgagctctacgaggtgcaccagattatgactcgcaatgttcaagaagttcttggtgtcggtgaaaaactagatcaggtgagcgaaatgtccagtaggttgacctctgatactagaatctatgcagagaaggcgaaagatctcaatcgccaggccttaattcggaagtatgccccggttgccattgtgattgggatagtactgatgctcttttgggttaagaacaagatatggtgacttgggtgtatctcggacctccctgagttacgcgacgctggaacctggtgccgagtgtcagatgcttcgacggcttatcccgcatctgccgattcaagcgagtactttagctgccaaaatcaagcccgttgtagtagtatacacacctagatatggacctagtgttaaccgttctcggaacaggcgggcgcacattcagcagtatatgcctttttttttcttgcgagcgcaccatgtaagagtcgaggtttctggctgctgatagacagacacaagaagtatttcagtacttaccatactgtatgagaaactgaacatgttcagcatgtgcatgttgctggagcctggaggcaggtcgtttccatttactacatacacaagaagtatttcagtacttaccatactgtatgagaaactgaacatgttcag

SEQ ID NO: 8668 - DNA, 1150 bp, Sorghum bicolor
cgagcgctacggcagcagcgcgtctctctcttcctcttccggtgctcgtgctctccgccctccgcctccctcgcgcggaacccaggcggcccccgccgcagccgcagctacgcaaaggcgaatggtggcacttttacattacctatgctagtttgcctcatgctatatttccaaaatggtgaagctcactatgatagcacgtgtcactgatggccttccattgtcagagggattagatgatggtcgggatctgaaggatgctgacttctacaagcagcaagcaaaactgttgttcaagaacttgtcaaaagggcagcatgaggcatcaaggatgtcaattgagactggaccataccttttccactacatcattgaaggccgtgtgtgctatttgactctgtgtgatcgttcttatcccaagaaacttgcattccaatatcttgaagatctcaaaaacgaatttgagaaagtcaatggcagtcaaattgaaactgctgcaaggccatatgcatttattaaatttgatgcattcatacagaagaccaagaaactttatttggattccagaacacagaggaaccttgccaagctgaatgatgagctctacgaggtgcaccagatcatgactcgcaatgttcaagaagttctcggtgtcggtgaaaaactagaccaggtgagtgagatgtcaagtaggttgacctctgatactagaatctatgcagacaaggcgaaagatctcaatcgccaggccttaatacgtaagtatgcccccgttgctattgtgattgggatagtactgatgctcttttggctgaagaacaagatatggtgacttggtgcatcccgtgcttcctgagttgcctatgttgatcctggttcaaaagatgcttcgatggcttatcccgcatctgccgattcaagcgagtactttagctgtcaaaagcaaaaccgtggtagtagatattcttggaattgcgcatttctattgacctgatctgcatagcagtatgatagttttcgtgagcgcaccatgtaagcgtcggaaatttattcaggttgctgacacacttaatgccatgtgttgtgacactttgagcacaaattatttatttaacatggcgggtgtgctgctggagcctggaggcaggct

SEQ ID NO: 8669 - DNA, 1419 bp, Panicum virgatum
ctaaagccttcaagccgaagcctcgtctgaactgaaggcaagccgagccgaccaggcgcaagctgcgcttcttcttcttcctccaactcttccggcgccgcgctagtgctctccacctcctcctcctcctcggcctccctcacgagaagcggaacccaaaagccgccgcagccacgcacggcgacggcgcggcgcgctacatggtggtgcttttagattacctatgctagtttgcctcttgctatatctccaaaatggtgaagctgacaatgatagcacgtgtcaccgatggccttccactgtcggagggactagatgatggtcgggatctgaaggatgctgatttctacaagcagctagcaaaacaattgttcaagaacttgtcaaaagggcagcacgaagcatcgaggatgtcaatcgagactgggccataccttttccactacatcattgaaggccgtgtgtgctatttgacactgtgtgaccgttcttatcccaagaaacttgcattccagtatctcgaagatctcaaaaatgaatttgagagggtcaatggcagccaaattgaaactgctgcaaggccatatgcatttattaaatttgatgcattcatacagaagaccaagaaactgtatttggataccagaacgcaaaggaaccttgccaagctgaatgatgagctctacgaggtgcaccagattatgactcgcaatgttcaagaagttcttggtgtcggtgaaaaactagaccaggtgagcgaaatgtccagtaggttgacctctgatactagaatctatgcagagaaggcgaaagatctcaatcgccaggccttaattcgtaagtatgcccctgttgccattgtgattgggatagtactgatgctcttttgggtgaagaacaagatatggtgactttggtgtatctcggacctcctgcgttacaatgctggaacacctggtgcagagtcatctgggtgcaagcaccatatgttgattctggctcaacagatgcttcgatggcttatcccgcatctgccgattcaagcgagtactttagctgccaaaagcaaacccgttgtagtatatggacctggtcttagtgctgaattctcggaactggcgcgttcctattaactggatctgcattgtagtatatgtttttttttctgcgagcgcaccatgtacaaggcctgaggctgctgaattgtgatagacgagtgtttcacttaccatactgtatgaaaaactaagcatgttgaaacttgctggtggagcccacctggaggcagttcatttccatttattacggattacttcccagtctattcaactagtattccattcccagtatgtgacagagagggctcttgcttgctttctcctcgcatcgcaagaatcaaattgagatgttattttgttg

SEQ ID NO: 8670 - DNA, 1180 bp, Setaria italica
ctctcttccggcgctggtgctctctcctcctcctcctcctcctccctccctcacgcggcggaagcccaagccgccgcagccacatggtggtgcttttagattacctatgctagtttgcctcttgctatatttccaaaatggtgaagctgacgatgatagcacgtgtcactgacggccttccactgtcggagggactagatgatggtcgggatctgaaggatgctgatttctacaagcagcaagcgaaacaattgttcaagaacttgtcaaaagggcagcacgaagcatcgaggatgtcaatcgagactggaccataccttttccactacatcattgaaggccgtgtgtgctatttgactctgtgtgaccgttcttatcccaagaaacttgcattccagtatctcgaagatctcaaaaatgaatttgagaaggttaatggcagccaaattgaaactgctgcaaggccatatgcatttattaaatttgatgcattcatacagaagaccaagaaactgtacttggatacaagaacacaaaggaaccttgccaagctgaatgatgagctctacgaggtgcaccagattatgactcgcaatgttcaagaagttcttggtgtcggtgaaaaactagaccaggtgagtgaaatgtccagtaggttgacctctgatactagaatctatgcagagaaggcgaaagatctcaatcgccaggccttaattcggaagtatgcccctgttgccattgtgattgggatagtactgatgctcttttgggttaagaacgagatatggtgacttggtgtatctcggacctcctgagttacacaacgctggaacctggtgccgagtgtcagatgcttcgatggcttatcccgcatctgccgattcaagcgagtactttagctgccaaaagcaaacccgttgtagtatacaccctagatatggacctggtgttaatgattctcggaattattaactggatctgcgtagtagtatatgttttttgcgagcgcaccatgtaagagtcaaaggttttcggctgctgatagacaagtatttcactacttaccatactgtatgggaaactgaacatgttcaacatgctgctggagcctggaggcaggtcgtttccattgattacagatttcccagtttatttatttaattaacgagtattcccg

SEQ ID NO: 8671 - DNA, 1389 bp, Saccharum officinarum
tctcttccggtgctcgtggtctccccgccctccgcctccctcgcgcggaactcaggcggccgccgccgacgccacgcaaggcgaccgcgcggcatggtggcgcttttacattacctatgctagtttgcctcatgctatatttccaaaatggtgaagctgactatgatagcacgtgtcactgatggccttccattgtcggagggattagatgatggtcgggatctgaaggatgctgacttctacaagcagcaagcaaaactgttgttcaagaacttgtcaaaagggcagcatgaggcatcaaggatgtcaattgaaactggaccataccttttccactacatcattgaaggccgtgtgtgctatttgactctgtgtgatcgttcttatcccaagaaacttgcattccaatatcttgaagatctcaaaaacgaatttgagaaagtcaatggcagccaaattgaaactgctgcaaggccatatgcatttattaaatttgatgcattcatacagaagaccaagaaactttatttggattccagaacgcagaggaaccttgccaagctgaatgatgagctctatgaggtgcaccagatcatgactcgcaatgttcaagaagttctcggtgtcggtgaaaaactagaccaggtgagtgaaatgtccagtaggttgacctctgatactagaatttatgcagagaaggcgaaagatctcaatcgccaggccttaattcgtaagtatgcccccgttgctattgtgattgggatagtactgatgctcttttggctgaagaacaagatatggtgacttggtgcatctcgcgcttcctcagttgcaatgctagaacctactgagttgcctatgttgatcctggctcaaaagatgcttcgatggcttatcccgcatctgccgattcaagcgaataccttagctgtcaaaagcaaaaccgtggtagtagatatggccttggattcttggaactgcgcatttctattgactagatccgcgtagcagtatgatagttttcgtgagcgcaccatgtaggcgtcaaatttattcaggctgctgacacacttaatgccatgtgttgtgacactttgagcacaatttatttaacatggcgggtgtgctgctagagcctggaggcaggctatttccatttacagttgcacaatctgttcaatgagacgtgtatgcaagtgagagggctatttctcagagccactgatctcaactgcttcattctagattataagacgttctgcgcttttttgatccatgtacttagatacactatgtctagatggaatagcaaaagcaaaatatctaaaaaaaaaaagcgtgggtcgaccccccgggtattccggggcggtaccgcaggcgacatgctaa

SEQ ID NO: 8672 - DNA, 1177 bp, Zea mays
attctcttcctcttccggtgctcgtgctcgtgctcgtgctctccgccctccccctccgccacttcgcgcggaacggaacccaggccgccgccgacccagccaccgctaggcgtctaggcgaccgcgcggcatggtggcgcttttacactacctatgctagtttgcctgatgctacatttccacgatggttaagctgactatgatagcgcgtgtcactgatggccttccattgtcggagggattagatgatagtcgggatctcaaagatgctgacttctacaagcagcaagcaaaactgttgttcaagaacttgtccagagggcagcatgaggcgtcaaggatgtcaattgagacaggaccgtaccttttccactacatcattgaaggccgtgtttgctatttgactttgtgtgaccgttcttatcccaagaaacttgcattccagtatctcgaagatctcaaaaatgaatttgagaaagtcaatggcagccaaattgaaactgctgcaaggccatatgcatttattaaatttgatgcattcatacagaagaccaagaaactgtatttggataccagaacacagaggaaccttgctaagctgaacgatgagctctatgaggtgcaccagatcatgactcgcaatgttcaagaagttctcggtgttggtgaaaaactagaccaggtgagtgagatgtcaagtaggttgacttcggatactagaatctatgcagagaaggcgaaagatctcaatcgccaggcattgattcgtaaatatgcccccgttgctattgtgattgggatagtagtgatgctcttctgggtgaagaacaagatatggtgactggtgccatcttgcgttcacagttatcatgctggaaccagctgagttgtcttgtcttccctcgtgcaaccatatgtttgatcgtggttccaaaaagaaaagaaagatggctcgatggtttatcccgcatctgccgattcaagcgactactttagctatcaaaagcaaaaccacggtagtagagatagccttggaactgcacatttctattaactggacatgtataatagttctcgtgagcgcacaccatgtaatcgtcgaaattcatccatgtgttgtgacattttttgagcacagttgaacatgtggtggagcctggaggcaggtcattctcag

SEQ ID NO: 8673 - DNA, 1273 bp, Brachypodium distachyon
tcttggagatctcttcttcttgccgagggactcagcgacccagccccctcgctccgtgcatcttcttcctcctcgcgcgagcgccgtcacccatcccgctgccgagcgcccgagccccctagctcgtcttcctcctcgctcgagcgcctccaccgcaggtgtctcttttggctatcaactatactgttgtagtggtttctagcattcttaacaaaatggtgaagctgacaatgatagcgcgcgtcactgatggccttccgctggcagaagggctggatgacggccgggatcagaaggattctgacttctacaagcagcaagctaaacttctttttaagaatttgtcaaatgggcatcatgaagcctcaaggatgtcgattgagaccgggccttactttttccattacatcattgaaggtcgagtatgttatctaacaatgtgtgaccgttcttatccaaagaaacttgcattccaatacctagaagatctgaagaatgaatttgagagagttaatggcagtcaaattgaaactgctgcaaggccttatgcttttattaagtttgacacattcatacagaagactaagaaactgtatttggatactagaacccaaaggaaccttgcaaaattgaatgatgagctctatgaggtgcaccaaattatgactcgcaatgttaaagaagttcttggtgtcggcgaaaagctagatcaggtcagtgaaatgtcaagtaggttgacatccgacacaagaatctatgcagataaagcaaaggatctcaatcgccaggccttcattcggaagtatgctcctgttgccattgttattggggttgtaataatgctcttttgggccaagaacaagatatggtgattactctaaacaaatgaagctggcctgtgttacactggagaatgagcacagttaaggtcgattctggatcaagagatgcttcaaagacttgtatcccgtgtctgccctttcaagcgactacaactgccttcacccgtccctagtccctacaagctacacaaatgggaattcgttgtagtatagaccttatataacagacttgattttgtgaatcctcggaaccatacatacaagagctccatagtgtcgacttttcgataccgggattgtatttttgtgtgttaactcatgtaagaatccaggctgatgaactacactctgcttccgcacttcactacatcatatttccatgttcgtcgtgtgggctaggatgaaatctgttatacagttaatgagatgct

SEQ ID NO: 8674 - DNA, 1014 bp, Leymus cinereus x Leymus triticoides
agtttgcaccggtttctggtgttcttcgcaaaatggtgaagctgacaatgatagcgcgtgtcactgatggccttccgctggcagaagggctggatgatgggcgggatcagaaggattctgatttctacaagcagcaagctaaacttcttttcaagaacttgtcaaaggggcaacatgaagcctcacggatgtcaattgagaccggatcatactttttccattacatcattgaaggccgagtatgttatctaacaatgtgtgaccgttcttatccaaagaaacttgcattccagtacttggaagatctgaaaaatgaattcgagagagtcaatgggagtcaaattgaaactgctgcaaggccttacgcttttattaaatttgatacatacatacagaagactaggaaactgtatttggataccagaacccagaggaacattgcgaaattgaacgatgagctctatgaggtgcatcaaatcatgactcgcaatgttcaagaagttcttggtgtcggtgaaaagctagatcaggttagtgaaatgtcaagtaggttgacatctgacacgagaatctatgctgataaggcaaaggatctcaatcgccaggccttcattcggaagtatgctcccgttgccattgtgattggggttgtaataatactgttctgggccaagaacaagatatggtgattcgactaaacaaggaagcatgcctgtgttataacactggagaaggaaattctggatcaagagatgcttcgatgacttgtatcccgtatctgcccgttcaagcgagtactttgaagccacctttacacctccttacaagcagctattcaagtgaatgaattcgttggttgtagtagagaccatatgacggacttgattttgtgaaccctgggaacagtacatacaagagctctgtagagtcaagttttcgatatcaggatcatatttgttgtgttaactcgtgtaagaatcaggctgatgaactatacagtactccgttgctcca

SEQ ID NO: 8675 - DNA, 1441 bp, Pennisetum glaucum
ggcccagcctggatccaaaagggctcagccttcgtggtgggttatttggttccgcgtcaagggcgagcaagggcgctgcgttggtgaatcatcaaggcggcgacgagatcgaggcaggctcccgtacggatcttccgtctcctgcccctcccccacatcctccgccatcaaactcagaacgcgttcagcaacgggattgagggaattgtaactgctagggaaggattcaaccctgttgagttgattcgatatttcttacttgtaggtttatactatatttattagtggttctggcttttttgacacaatggtgaagctgacaatgatagcacgtgttactgatggccttccactggcagaagggttggacgatgggcgagatcagaaggatgctgatttctacaagcagcaagctaaactcattttcaagaacctgtcaaaaggacatcatgaagcttcccggatgtcaattgagacaggggcatactacttccactacatcattgaaggccgagtgtgttatttgactatgtgtgaccgctcttatccgaagaaacttgcatttcagtacctggaagatctgaaaaatgaatttgagagggtcaacggaaatcaaatagaaactgctgccagaccgtatgcttttatcaagtttgatacattcatccagaagactaagaaactatatttggatacaagaactcaaaggaaccttgcaaaactgaatgatgaactctatgaggtgcatcaaattatgacccgcaatgttcaagaggtgcttggtgttggtgaaaagctagaccaggtcagtgaaatgtcaagtagattgacatctgacacgagagtatacgcaaataaggcaaaggacctcaatcggcaggccttgattcggaagtatgctcctgttgcgattgtgattggggtggtgttcattctcttttggctcaaaaacaagatatggtgaatccaatatacaaaggaagccgtagcccatttgactggagaccagatgaaaatctggctggtcgattctggatcaagagattcggtgacttgtatcccgaatctgcccattcaagcgagtacttcagcttccttttgctcctccctacaaagctattcaaatggacaaagctattcaaatggattcgttgtactatagaccttgggacaaagtcagaattttgtgcatcgtggaattggtaaatacaaagagagctctatagagtcgactttacgacattgggattgtaatttttctggtgaaactgaatgcaaggattcatgctgacgaagtgtactctcgctgacgctcttggtgtggctttacagtgtactggagctatgtggttgctgaagtcgtgcacctatactaattgagcaacctagcagtagcctcagcagcatgttttgagtaaatattattggcaaaatttgagta

SEQ ID NO: 8676 - DNA, 1859 bp, Panicum virgatum
gatggtcaagaatatccgattttaaagttggatgatcaaagtcaaatatattggatgaccaacaatggactttaccccaacttatatataggagccctccataccgaccagcaaattaatgggctcctgtgtttgggccctttgtgggctcttcaaaagggcaggagggcaggagtgttggttggatcgggctggctttttgacgtgccctgttgggctaagcccgtggattctaaccagaggcgctctgcctcctccgttcgtggtggcttatcgttccgcgtcaggacagaagactcgaggagtagagagggcgagaacggcgctgcgctggtaaatcattcgccgggcggcggcggcgacgagatcgaggccgggctcccgttcggctcttcttcgtcttgcttcctaggcctcgcacgcgtgcgcctgcacggagcgccacctccctcaccgccaacgacgcagcagttgcaaagggcgccggaacctatctctccgtcacctccgtgctcaactccgtcgaatctacagcctcccctgcccctccgcatcctccgccatcaaactcagtcactcaggtcgggctcaacaacgagatcaaggaaattgtaactactaggaaaggaaactgtgcggttaagttgatttggtatttgtaagctttggactgatctacaatattttcacggctcaattgaaagcttactttgtaggttttctactatattttttagtggttctggctttcttgacacaatggtgaagctgaccatgatagcgcgtgtcactgatggccttccactggcagaagggttggatgatgggcgagatcagaaggatgctgatttctacaagcagcaagctaaacttatttttaagaacttgtcaaaagggcatcacgaagcttcccggatgtcaattgagacaggggcctactttttccactacatcattgaaggccgagtatgttatctgactatgtgtgaccgttcttacccaaagaaacttgcattccagtacctagaagatctgaaaaatgaatttgagagggtcaatggcaatcaaatagaaactgctgcaaggccatatgcatttatcaagttcgatacattcatccagaagactaagaaactgtatttggatacaagaactcaaaggaaccttgcaaaactgaatgatgagctctatgaggtgcatcaaattatgacccgcaatgttcaagaggttcttggtgttggtgaaaagctagaccaggtcagtgaaatgtcaagtagattgacatctgacacaagaatatacgcagataaggcaaaggacctcaatcgacaggccttgatccggaagtatgctcctgttgcgatcgtgattggggtagtcttcattctcttttggctgaaaaacaagatatggtgaatgtaacatacaaaggaagccgtgccccatttgactggagaaaggatgaatgaatttctggttggtcgattctggatcaagagatgcttctgtgacttgtatcccgtatctgcccattcaagcgagtactttagcttccttttgctcctgccttacaagctactcaagtgaattcgtttttagtatagaccttactcatgaggaactcagaattttgtggatccgtggaattggtaaatacaagaagtctgtagagttgattttacggcattgggattgtgatttttctggtgaacctattagtaaggattcaggctgatgaactgtactcgtgcacacttcgctacttaatatggatttacgcaattttaatctgtcttagagcggattaagtgctacgtatgacgtgtatacctgaatgagttgagcaactaagcactatc

SEQ ID NO: 8677 - DNA, 1992 bp, Hordeum vulgare
attctggttccgagccggccaatctccccaaccgacacgcgaagcagagccaaacctccgctctcttccctccctccggcgatctgcttccccgacgacggccgcggcgtctccagccgccgcgctctcctcccaccatctctattcgccatcagccatatagtttgtagtggtttctggtgttcttcacaaaatggtgaagctgacaatgatagcgcgtgtcactgatggccttccgctggcagaagggctcgatgatgggcgggatcagaaggactctgatttctacaagcagcaagctaaacttcttttcaagaacttgtcaaaggggcaacatgaagcctcacggatgtcaattgagaccggatcatactttttccattacatcatagaaggccgagtatgttatctaacaatgtgtgaccgttcttatccaaagaaacttgcattccagtacttggaagatctgaaaaatgaatttgagagagtcaatgggagtcaaattgaaactgctgcaaggccttacgcttttattaaatttgatacatacatacagaagactaagaaactgtatttggataccagaacccagaggaacattgcgaaattgaacgatgagctctatgaggtgcatcaaatcatgactcgcaatgttcaagaagttcttggtgtcggtgaaaagcttgatcaggttagtgaaatgtcaagtaggttgacatctgacacgagaatctatgctgataaggcaaaggatctcaatcgccaggccttcattcggaagtatgcccccgttgccatcgtgatcggggttgtaataatactgttctgggccaagaacaagatatggtgattccaccaaacaaggtagccggcctgtgttagaagactggagaaagaaattctggatcaagagatgcttggatgacttgtatcccgtatctgcctgttcaagcgagtactttgaagctacctttacacctccttacaagcagctattaagcgaatgaattcgttgtagtgtagaccatatggcggacatgattttgtgaatcctgggaaccgtacatacatacaagagctctgtagagtctgagttttcgatatcgggatttatattttgttgtgttgactcatctgagaattcaggctaatgaactatactccgtcgctcctgcacttttatgccatgtttgtttacttattattttctcggtgcaaaagataaagcatgctttatgtatgtaatagtaatatagtacgctgtagcatcaccgttttgtccaatgtagcattatcttgtgtagattaagccagtcaaactgtgggcggtgcgtctgctcagccagattcgattctttccttgcgatcgcaggcaactcatggtctaaaagggaggggaatgcccagctgcgctgctttcagcgtgaccaactgaagggaatgacacaccacatgctcgtctcatacgaccggagctgaaagatcgatcttggcacatgttataagacatgatcattaccgattaatttcagtcactgtatccgaatgatacgacaagccgcctttgattgattgattgatgttccatggaacattcgtattacagaggctagctactagggctactagctagcttccgatgcggaaagaagaagaagaaaggggaatgaaatcagtagctgtgtaggctagcagtctgccgccgatctcgtcggccttcggcgcaggacgtcacccagcggcctgcagacgaatcaagaggaccatgttagatagttactacagtttactggtggatcgatcggcctgatcacgggagcttaatcacctaggaggtgggatcggattcggcggggagctgctgcagcggaggcggctgcgggtcctggtggtcgtggaggagcgcgcgggtctcgtggatccggaagcgggtggcggccaccacccgcttgagccggcgccgcttgccgtagttctcctccaggcggcgct

SEQ ID NO: 8678 - DNA, 1231 bp, Secale cereale
gtcgagacccgtcccgtcgtatccccctccggcccggccaatctcccaaccgacacgcgaagcagagccccgccaaacctgcgctctcctcccctccctccggcgacccccccgcgatctgcttcctcgccgacggccgcggcgtctccggctgcggcgctcccctcccaccgtgtctctattggctagtttgtagtggtttcttgtgttcttcgcaaaatggtgaagctgacaatgatagcgcgtgtcactgatggccttccgctggcagaagggctggatgatgggcgggatcagaaggactctgacttctacaagcagcaagctaaacttcttttcaagaacttgtcaaaggggcaacatgaagcctcacggatgtcaattgagaccggatcatactttttccattacatcattgaaggccgagtatgttatctaacaatgtgtgaccggtcttatccaaagaaacttgcattccagtacttggaagatctgaaaaatgaattcgagagagtcaatgggagtcaaattgaaactgctgcaaggccttacgcttttattaagttcgatacatacatacagaagactaagaaactgtatttggataccagaacccagaggaacattgcgaaactgaatgatgagctgtatgaggtgcatcaaatcatgactcgcaatgttcaagaagttcttggtgttggtgaaaagctagatcaggttagtgaaatgtcaagtaggttgacatctgacacgagaatctatgctgataaggcaaaggatctcaatcgccaggccttcattcggaagtatgctcccgtcgccattgtgatcggggttgtaataatactgttctgggccaagaacaagatatggtgattgcactaaacaagggaaacggcctgtgttattacaccggggaaagtaattctggatcaagagatgcttcgatgacttgtatcccgtatctgcccgttcaagcgagtactttgaagccacatttacacctccttacaagcagctattcaagtggattcgttgtagtgtagaccatatgacggatttgatttcgtgaaccctgggaacccgtacatacaagagctctatagagtcaagttttcggtatcaggactatatttgtcgtgtcaactcgtgtaagaaaaatcaggctgatgaactatacagtgctccgtcgctcccgcccttgactgcataccatgccatgttcgacagg

SEQ ID NO: 8679 - DNA, 1705 bp, Panicum virgatum
gaagaagtgggccgcggtgggctgtgcgacgtctagcttacacgtcttcgggaatgcatataggacctccccgttttgaagggctcaggcctccttcgttgccttcgtgtggcttatcgttcggcgtcaggacagaagactcgaggagtcgacagggcgaagagcggcgctgcgctggtaaatcattcgccgggcggcggcgacgacgagatcgaggccgggctcccgttcggctcttctccgtcttgctacctagacctcgcacacgtgcctgtacggagcgccgcctcctcaccgtcaacgacgcagcagttgcaagggcgccggcacctatctctccgtcacctccgtgctcaactccgtcgaatctacagcctcccctgcccctccgcatcctccgccatcaaactcagtcgctcaggtcgggtccgacaacgagatcaaggaaattgtaactactaggaaaggaaactttacggttgagttgattcgatatttgtaagctttggacttatctacaatattttcacgactccattgaaagcttactttgtaggttttctactatattttttagtggttctgcctttcttgacacaatggtgaagctgaccatgatagcgcgtgtcactgatgggcttccactggcagaagggttggatgctgggcgagatcagaaggatgctgatttctacaagcagcaagctaaacttatttttaagaacttgtcaaaagggcatcacgaagcttcccggatgtcaattgagacaggggcctactttttccactacatcattgaaggccgagtatgttatctgactatgtgtgaccggtcttatccaaagaaacttgcattccagtacctagaagatctgaaaaatgaatttgagagggtcaatggcaatcaaatagaaactgctgcaaggccatatgcgtttatcaagtttgatacattcatccagaagactaagaaactatatttggatacaagaactcaaaggaaccttgcaaaactgaatgatgagctctatgaggtgcatcaaattatgacccgcaatgttcaagaggttcttggtgttggtgaaaagctagaccaggtcagtgaaatgtcaagtagattgacatctgacacaagaatatacgcagataaggcaaaggacctcaatcgacaggccttgatccggaagtatgctccggttgcgattgtgattggggtagtcttcattctcttttggctgaagaacaagatatggtgaatgtaacatactacaaaggaagccgtgccccatttgactggagaaggacggatgaaattctggttggtcgattctggatcaagagatgcttctggtgacttgtatcccgtatctgcccattcaagcgagtactttagcttccttttgctcctaccttacaagctattcaggtgaattcgttgtagtacagaccttactcatgaggaactcgaattttgtggatccgtggaattggtaaatacaaggggtctgtagaggtgattttacggcatcggcatcgggattgtaattttttctggtaaaactattagtaaggattcaggctgatgaactgtactcgtgcacacttcgctactatatggatttacgcaattttaatctggcatttgctgcggattaagttgcttcgtaatttctgatgacgtgcctgtacgaattgagcaactaag

SEQ ID NO: 8680 - DNA, 2259 bp, Triticum aestivum
aaccgacacgcgaagcagagccagcagccccgccagactctccctccggcgatctacttccccggcgacggccgccgcgtctccagctgccgcgctctcttcccaccgtgcctttattggctatcaactatatagtttgtagtggtttctggtgttcttcgcaaaatggtgaagctgacaatgatagcgcgtgtcactgatggccttccgctggcagaagggctggatgacgggcgggatcagaaggattctgatttctacaagcagcaagctaaacttcttttcaagaacttgtcaaaggggcaacatgaagcctcacggatgtcaattgagaccggatcatactttttccattacatcattgaaggccgagtatgctatctaacaatgtgcgaccgttcttatccaaagaaacttgcattccagtacttggaagatctgaaaaatgaattcgagagggtcaatgggagtcaaattgaaactgctgcaaggccttacgctttcattaagttcgatacatacatacagaagactaagaaactgtatttggataccagaacccagaggaacattgcgaaattgaacgatgagctctatgaggtgcatcaaatcatgactcgcaatgttcaagaagttcttggtgtcggtgaaaagctagatcaggttagtgaaatgtcaagtaggttgacatctgacacgagaatctatgctgataaggcaaaggatctcaatcgccaggccttcattcggaagtatgctcctgttgccattgtgattggggttgtaataatactgttctgggccaagaacaagatatggtgattccactaaacaaggaaggccggcctgtgttataacactggagaaagaaattctggatcaagcgatgcttcgatgacttgtatcccgtatctgcccgttcaagcgagtagtttgaagccacctttacacctcgttacaagcagttattcaagtgaatgaattcgttggttgtagtatagaccatatggcggacttgattttgtgaaccctgggaaccgtacatacaagagctctgtagagtcgagttttcgatatcgggatcgatttatattttgttgtgtcaactcatgtaagaattcaggctgatgaaactatacagtactccgtcgctcccgcccttgactgcataatatgccatgttcgacagcattcttccttgtgtgcaacgatgaaagtcgtcttagtacactctagcatcgccgtcttaccttatcttaccatgatcttctctataccttcgggtatgtgaagatgtcggagcccggcttgcgacggcggtggcagggaatgcaggcatctgatgagccagattctttccttgcaatcgcaggcaactcgtctaaaagcagtgcaggcatcttgggcagctgctttcagcgtgaccaacacagagtttcgtgacggtagcagaggtttgatacgacaggggctgaagactttggcacatgtatgcgtgcagtcactgaagacattattactactactgtattacagagtgagtccctgccaggtgctaacttccgattcatttcagtcactgtatgcgacgcgaatgacatgacaagcctttttctgattgattgatgttccatggaacattcgtcccgccgtatgttgcagaggctagctaccaggctactagctagcttcctccgatgcgaaaaaacaagaagaaaggggaatgaaatcagtagctgtgtaggctcgcagcctgccgatccgatcggtcttcggagcaggacgtcacatcacccggccgcgactccctaggaggtgggatcggattcggcggggagctgctgctgctgcggcggcgggtttgcccgtgttgaacgtcggagctctgtccggcgttcaataccctggcactactgcatatcctgcggccccatatgttttgccaccgcagctcgcgccatctgtgcttcagagtgctgctgctgcgattcagaaattaagtcaggtaaaactaccggatgagcttatagcacgagaagttgttataaatgacgctgatccatctgtgcgatataagctcacgaagcggcaaacacaggacgagattcaacaatgcacatgcactgtcatcattacaaggggaaaataccatcctcctaatggacagcctgatggtgagaagccactctatctacatatctctgcaggatctcagctaaaagataccgctgagcgcattaaagcagttgatcttgcagc

SEQ ID NO: 8681 - DNA, 1185 bp, Avena sativa
tcctccgccccggctagtgtcccaactcccaaccgacacgcgcagcagagcacgtgcccgccaaacttgcgcttccctccggcgacccggcgatctgcttccccggagacggtcaccgcatcaggttccgctgccgcgcctcctccgcgtgtctctataggctatcaagtatatagtttctagtggtttttggtgttcttcgtgaaatggtgaagctgacaatgatagcgcgggtcactgatggccttccactggcagaagggctggatgacgggcgggatcagaaggattctgacttctacaagcagcaagctaaacttctttttaagaacttgtcaaaggggcaacatgaagcctcgcggatgtcaattgagaccggatcatactttttccattacatcattgaaggccgagtgtgttatctaacaatgtgtgaccgttcttatccaaagaaacttgcattccagtacttggaagatctgaaaaatgaatttgagagagtcaatgggaatcaaattgaaactgctgcaaggccttatgcttttattaagtttgatacatacatacagaagactaagaaactctatttggacaccagaactcaaaggaacattgcaaaattgaatgatgagctatatgaggtgcaccaaatcatgactcgcaatgttcaagaagttcttggtgtcggtgaaaagctagaccaggttagtgaaatgtcaagcagattgacatcggacacgagaatctacgcagataaggccaaggatctcaatcgccaggccttcattcggaagtatgctcccgttgcaattgtgattggggtcgtaataattctgttctgggcgaagaacaagatatggtgattccactaaacaacggaagctggcccgtggtatgacactcgaggaagaacacagataaggttgattctggatgaagagatatatgctttgatggcttgtatcccgtgtctgcctgttcaagcgagaactctgaaaccatctttactcctccatacaagcaattctactgaattcgttgtagtgtagaacatatatgacggacttgattttgtgaatcctcagaaccgtacatacaagagctctgtagagttgacctttcgataccgggattgtatttttgtgtcaactcttgtaagaatccaggcggatgaactctgtactc

SEQ ID NO: 8682 - DNA, 1127 bp, Avena sativa
gcttccccggagacggtcaccgcatcaggttccgctgccgcgcctcctccgcgtgtctctataggctatcaagtatatagtttcttgtggtttctggtgttcttcgcgaaatggtgaagctgacaatgatagcgcgggtcactgatggccttccactggcagaagggctggatgacgggcgggatcagaaggattctgacttctacaagcagcaagctaaacttctttttaagaacttgtcaaaggggcaacatgaagcctcgcggatgtcaattgagaccggatcatactttttccattacatcattgaaggccgagtatgttatctaacaatgtgtgaccgttcttatccaaagaaacttgcattccagtacttggaagatctgaaaaatgaatttgagagagtcaatgggaatcaaattgaaactgctgcaaggccttatgcttttattaagtttgatacatacatacagaagactaagaaactctatttggataccagaactcaaaggaacattgcaaaattgaatgatgagctctacgaggtgcatcaaatcatgactcgcaatgtccaagaagttcttggtgtcggtgaaaagctagaccaggttagtgaaatgtcaagcagattgacatcggacacgagaatctacgcagataaggccaaggatctcaatcgccaggccttcattcggaagtatgctcctgttgccattgtgattggggtcgtaataattctgttctgggcgaagaacaagatatggtgattccactaaacaacggaagctggcccgtggtatgacacttgaggaagaacacagataaggttgattctggatgaagagatatatgctttgatggcttgtatcccgtgtctgcctgttcaagcgagaactctgaagctatctttactcctccatacaagcaagttctactagtgaattcgttgtagtatagaccatatatgacggacttgattttgtgaatcctcagaaccgtacatacaagagctctgtagagttgacctttcgataccgggattgtatttttgtgttaactcttgtaagaattcgggcggatgaactctgtactccttgctcccaccatggcaacatatattccttgtt

SEQ ID NO: 8683 - DNA, 1791 bp, Ananas comosus
ttccctctttgccttcgccctcgccctcgccctcgccctcatctcgtcgtcttcgccgagcgcacggatctcttcggagcctgcgaagatcggcgatcgccaacctcggattggttcctctcccgtggcttccgaagatcgtctactgcagagtgagccgttttgtgggtaaaatggtgaaactaacgatgatagcacgaatcaccgatggtcttccattggcggaagggttagatgatggtcgcgatcagaaagatgctgatttctataagcagcaagcaaaacttttgttcaagaatctgtcaaaagggcattatgaggcctcgcggatgtcaattgagactggtccttactactttcactatataattgaagggcgtgtttgctatctgacaatgtgtgatcgttcatatccaaagaaacttgcttttcagtacctggaagacctaaaaaatgagtttgaaagggtcaacgggaatcaaattgaaactgctgcaaggccgtatgcttttatcaaatttgacacttttatacagaagaccaagaaactctacatggatactcggacccaaagaaatctagcaaagttaaatgatgaactttatgaagtgcaccagatcatgactcgtaatgttcaagaagttcttggtgttggtgaaaagctggaccaggtcagtgaaatgtctagtaggttgacatccgaatcccgcatctatgctgacaaggcaaaggatttaaataggcaggctttgattcggaaatgggctcctgtcgcaattgtgctcggagtcgtcatggttctattttgggtcaaaacaaagatatggtgattctgctgattcagcagcgttttagagtttgcgcaacagaatgtgttgaattcggttcaagcattaaagcatatcaacatgatagccgcttcaactgcctagagatgcttcgaaacggcttctttctacagcgtcttctccttaaagcaagtaaaactcggttgcctttttactcatccccatcagagtttcattcgaagaaatatatcccttataattccgacttagctgagtattctatgaaattcaattcttttagttttactttgtaaaaagttggcattggtagagtctccgacgtctagttttgccgacttccatgccgtatggacaaaatctgctcgccatcgctgttgatccttgccttgtagaacgactggtatgtcagtttgtttcctcaatgtccagttcatatgaatgttcccaccattactccttttgggtagatggatagttcccatgccatcccaatgttgaagtttgtccatgcgcatccactcaaatagtttaaaccttgaacttttacatatattgcactgtagcacctcgctgctagaaaaatctgtgttcatacaaaatgactgttttatgtctgtttattatgaaacgggatgctcaaaataatgctaaaatggttcctcaacatgaacattttatgcttaagcccccctgaaatatagggtgtacatgtacattttatatccttaagtctaagagtccaaaaaattgctttaggaattttagtttagtgggtaaatctcagtcatttgaagctcagggcgtaagatttacacggttgatgcacgaatagtattgctctttttatttagaataagacggaactaaaccataatatatgtaaaggattagaaaatgtgcagcctctagtcgtcgtattttgttgatcttggtggtaggtgcaagttttgttagtaattagtggaagtgcagcttttatttg

SEQ ID NO: 8684 - DNA, 1402 bp, Setaria italica
ccgcgtcaggtcagaagactcgagaactcgagggcgagggcgctgagctggtgaatcatccgggcggcgacgagatcgtggcagggctcccgttcggctcttccgtcttgctaacttcgcacgagtgcgagcgccgcctgtctcaccgtcaacaacgcagcagtcgcaagggctcgaatctacggcctcctgcccctccgcgcatcctccgccatcaaactcagaacgggttcggcaacgagattgaggaaattgtaactacaaggaaaggattcaaccctgttgagttgattcgatatttgtaagatctggactggtctatggtactttcacgacctaattgaaagctcacttgtaggttctatactatactttttagtggttctggctttcttgacacaatggtgaagctgacaatgatagcacgtgttactgatggccttccactggcagaagggttggatgatggacgagatcagaaggatgctgatttctacaagcagcaagctaaactcattttcaagaacttgtcgaaagggcatcatgaagcttcccggatgtcaattgagacagggacatactatttccactacatcattgaaggccgagtatgttatttgattatgtgtgaccgctcttatccaaaaaaacttgcattccagtacctagaagatctgaaaaatgaatttgagagggtcaacggaaatcaaatagaaactgccgccaggccgtatgcttttatcaagtttgatacattcatccagaagactaagaaactgtatttggatacaagaactcaaaggaacattgcaaaattgaatgatgagctctatgaggtgcatcaaattatgacccgcaatgttcaagaggtgcttggtgttggtgaaaagctagaccaggtcagtgaaatgtcaagaagattgacatctgacacgatagtatacgcaaataaggcaaaggacctcaatcggcaggccttgattcggaagtatgctcctgttgcgattgtgattggggtggtcttcattctcttttggctcaaaaacaagatatggtgaatgtgatatacaaaggaagccgtggcccatttgactggagaacagatggaaatccggttggtcgattctggatcaagagatgctttggtgacttgtatcccgtatctgcccattcaagcgagtacttcagctctcttttgctcctccctacaagatattctagtggattcgttgtagcatagaccttatgaaaaactcgaattttgtgcatccgtggaattggtaaatacaggctctgtagagttgactttacggcatggggattgtaatttttctcgtgaaacttaatgcaaggattcaggctgatgaactggatactcacgcgcacttacgctttgtcatga

SEQ ID NO: 8685 - DNA, 1312 bp, Musa acuminata
cgtatctctttctttcttcgtatctgcttcttatttcgatccccacgtccgcggcgacgctcccgggacccaacgaggatctcaaggctgccgatcgactctccggctgtcctttcgtagaatccctcgagttgagctctccggtagttctgactgtcattttgattcataatcttctttgcttcttatcctcgtgggtgaagatggtaaagttgacaatgatagcacgggttactgatggcctacctttagcagaaggattggatgatggtcgtgaccagaaagatgctgacttctataagcagcaagcaaagcttttattcaagaacctctcaaaaggtcattacgaggcttctagaatgtccattgagactggtccatactttttccactacattattgagggtcgtgtttgttacctgacaatgtgtgaccgttcttaccctaagaagcttgctttccaatacttggaggacctcaagaatgaatttgagagggtcaatgggagtcaaattgaaactgctgcaagaccatatgcttttatcaaatttgatactttcatacagaagaccaagaaactttatttggacacccgcacccagcgtaatatggcaaagctgaatgatgaactatatgaagtccaccaaataatgactcgcaatgttcaggaggttcttggtgttggtgaaaaattagaccaggtcagtgaattgtcaagcaggttgacatctgagtctcgaatctatgctgacaaagcaaaagacctaaatcgacaggctttgattcgaaaatgggctcctgttgccattgtgctcggagttgtcatgcttctgttttgggttaggaaaaagatatggtgactgctgatcagatagcatcaacgtctctctgcattatgtgccatttctttggtgttgctcgtataggtatccttctcggctactaggtgttataatgagttttccatggcgatggaagcacagacagatgcactcgttttccaaatgatgagaatacatcaggtgcaagaatcagtagactactaaacattttccagggattcagtatatacattatggagattgttgctcccgaaatctattgctatatcgtcttcaatttttgggacatcatgcaaaatttttaaggttacatctagctgatttttcaacgtttttgagaaagctgctaccgtcgtaatgtttgtgttgcattcccattataccattgtggcatccgcaatcttctgagtccactgcttgtcctgcaaacttccgagataattggttgcgattaagtgaccacaaactat

SEQ ID NO: 8686 - DNA, 1224 bp, Festuca arundinacea
aaccgacacgcgcagcagagcacgtgcccgccaaacttgcacttctctccggcgacaccgcgatctgcttccccggagacggccgccgcacccgtttccgctgccgtgcctcctccccgtgtctctattgggtaccaagtatatagtttgtagttgtttctggtgctcttcgcaaaatggtgaagctgacaatgatagcgcgggtcactgatggccttcctctggcagaagggcttgatgatgggcgggatcaaaaggattctgacttctacaagcagcaagctaaacttctttttaagaacttgtcaaaggggcaacatgaagcctcaaggatgtcaattgagaccggatcatactttttccattacatcattgaaggccgagtatgttatctaacaatgtgtgaccgttcttatccaaagaagcttgcattccagtacttggaagatctgaaaaatgaattcgagagagtcaatggaagtcaaattgaaactgcggcaaggccttatgcttttattaagtttgatacatacatacagaagactaagaaactctatttggataccagaacccaaaggaacattgcaaaactgaatgatgagctctatgaggttcatcaaattatgactcgcaatgttcaagaagttcttggcgtcggtgaaaagctagaccaggtcagtgaaatgtcaaataggttgtcaaatgaaacgaaaatgtatgcagataaggcgaaggatctcaatcgccaggctttcattcggaagtatgctcctgttgccattgtgattggggtcgtaataatcctgttctgggccaagaacaagatatggtgattccactaaacaaaggaagctggcctgtggtataacactggggaaagaagacagttatggtcgattctggatcaagagatgcttggatagcttgcatcccgtatctgcctgatcaagcgagtagtttgaagctaccttcttacaagctattcaagtgaattcgttgtagtatagatcatatatgacggacttgattttgtgaatcctcagaaccgtatatacaagagctctgtagagttgacctttggataccgggattttattttcctgtgaactcttgtaagaatttcggctgatgaactatactccattgctcccacctttgatatataatatgctaaaaacgtttctttttggcgcaaggataaagttaaaaaaaaaaaaaaaaaaa

SEQ ID NO: 8687 - DNA, 1088 bp, Cocos nucifera
caccggccccttgcttttcttttctccagctcctcgtcctcccctccctctccgtcctaccactccctggccgatagcttcgtcgaagggagatcgaatcccaccatttcctgatctcaacgaaactcgtacgctcagtggaccttcgccgcacgccgagatcgccggtggttttgaaagattagtttcttcaattcttgatcaattcttagtttaagataagatggtgaagctgacaatgatagcacgcgttactgatgggcttccattagcagaagggttggatgatggccgtgatcagaaagatattgaattctacaagcagcaagctaagcttttatttaagaacctgtctaaagggcaacatgaggcttcaagaatgtcaattgagactggtccttactttttccactatatcattgaaggtcgtgtttgttatttgacaatgtgtgatcgttcttatcccaaaaaacttgcttttcaatacctagaagacctcaaaaatgagtttgagagagtcaatgggaaccaaattgaaacagcagcaaggccgtatgcttttatcaagtttgatacattcatacagaagaccaagaaattgtacttggatactcgtacccagcgtaaccttgcaaagctgaatgatgaactttatgaggttcaccaaataatgactcgcaatgttcaagaagtacttggtgttggtgaaaaacttgatcaggttagtgaactgtcaagccggctaacatctgaatctcgcatctatgcagacaaggcgagagatctaaatcggcaggctttgattcggaagtgggctccggttgctgttgtgcttggagtcgtcatgcttcttttttgggtcaaaaagaagatatggtgattccatgtattgaaagaggcaattgcgatttttgttcgtcatatacaaatgtatacatttccagctcggtaataccaatgtttagatgttgttttgcaagagacaagaaacacgcctgggtgctattcttcttttcgcctgccattagagtacattggagacaaatcggatgatgtgattaaattctgcaaatattagttgagatagt

SEQ ID NO: 8688 - DNA, 1267 bp, Zostera marina
actggaaacatcactaatcttcttcgttcttctccccctcttctccatctctcgcattcgcacttcctcgagatttctacggtggaggtttaccgatctcgtcttccgctaacagatccgatatcggcgaccgtcaagcttctggagcaaactagcagggagaaagagctggcaaatttatagatcggatatttctttagcatcatccacattgttaagatggtgaagttaactatgatagcacgtgtgaccgatgggcttccattagcagaaggtttagaagatggtcgtgagcataaagatgttgatttctacaagcagcaagccaagctgttgttcaagaacctctctaagggacactatgaggcttcaaggatgactattgaaaccggtcctaatttcttccactatattatcgagggtcgtgtttgttatttaacaatgtgcgatcgttcttatcctaagaaacttgcatttcaataccttgaagacctcaaaaatgaatttgagagagttaatggaaatcaaattgagacagctgccaggccttatgcttttatcaaatttgattcattcattcaaaagacaaagaagttgtacctggacacaagagcacaacgtaatatcgcaaaattgaatgatgaactttatgaagttcatcagataatgactcgcaatgttcaagaagttcttggtgtcggtgaaaaattagatcaggtaagtcaaatgtcaagcagattaacatctgatactcgtgcatatgctgataaagcaaaggatttgaatcgtcaggctttaattcgtaaatgggcacccgtagctattgtgattggagtggttctgctacttttctgggtcaaacaaaaaatttggtgatatcgatctactggatatagaatgggataatgacatgaagagcaaagtcattattgttataggggaaggtttctctttcactgagcactttaggtttcttttggatgatggagattaaggaaactagattcaatcatagatggtgatatcgaactcaggtgagtgtgaattttatatcttgttttcctatttaggggacatggaatggatccgttaaaaaatttatgtcattggaatagtgaatatgttacagatgttttactgattgattgattccttggatcctagaaatagtttattacagcagaaaatctactatattgatataatatattatgttttgctgcttatgccaacgttagaattataattgaatacttaaattgaactg

SEQ ID NO: 8689 - DNA, 961 bp, Petunia hybrida
aaagagttgagtgtttacaaggggagacgggtatttacccgattccgtgaatctgaacacaccaccttgaaatctatagcagtcgatcatacaaacaaaaagggggtctgcaccgacgcgtatgatagaaggaagatggtgaagttgactatgattgctcgtgtaactgatggccttcctttagctgaggggctggatgatggccgcgatgttccagatgcagatttctacaaacagcaagtcaagtccctattcaagaacctctctatgggccagaatgaggcatcaaggatgtccgttgaaactggaccttacattttccattatatcattgaaggacgtgtttgttatctgacaatgtgcgatcgctcttatccaagaaacttgcctttcaatacctggaagaccttaagaatgaattcgagcgtgtcaatgggagtcaaattgaaactgctgctagaccttatgcttttatcaaatttgatacattcatacagaagacgaagaaactataccaggataccagaactcagcgcaatatttcgaagttgaatgacgaactttatgaagttcatcagataatgactcgaaatgtacaagaagtccttggtgttggtgaaaagttggaccaggtcagccagatgtccagccgcttgacgtcagaatcccgcatatatgctgataaagcgaaagatttaaatcgtcaggctttgattcggaaatgggctcctgttgctattgtcatcggagttgttagtctactcttctgggttaaaaataagatttggtgatgctgccatcaaatatgcagctcggagaagatgttgctccagcatcggacagtgtgcaactgacatgaccacaagtgatgttataacagaagaagtgaccatgatgagctatgtttctgttgagaaatgatattactatgaattactccgcatatctttttattatgcac

SEQ ID NO: 8690 - DNA, 1601 bp, Aristolochia fimbriata
ccagctgtgccgtgcgcgtaaacggtaaatctattcgctttgtgttcctcaccgttccgtttatagtcttttatctttccttcttccgacaattaacaaatttaatccttctttctgttggaggcttcggaaggcttccccgtttccttctccgccagtctttcctttttcatttcatcgtgacctcgactttcaactactcgatctcttggcgcggtcgtcgatcacgcttcgattcgtggcgtcgcttactcaggttgaagtttgtcgggattttctactccttctcggcaagcgctaccgttttgccaaccgtgggggacaggactgagaaacaaagagaatggtgaaacttacaatgatagctagagttacagatggccttcctttagcagaaggacttgatgatggcagtgatataaaagatgctgaatactacaagcaacaggcaaaggccttgttcaagaacctctgtaaaggccagaacgaaccttccagaatgtcaattgaaactggcccttatgtttttcactacatcattgaaggcagggtatgctatcttacaatgtgtgatcggtcctatcctaagaaacttgcttttcagtatctggaagaccttaaaaatgagtttgagagagtcaatggcaatcaaattgagactgcagcaagaccttatgcttttattaaatttgatacattcatacagaagactaaaaaattatacatggacacccgcactcagcgcaatcttgccaagttgaatgatgaactttatgaggtccatcaaatcatgacccggaatgtgcaagaagttcttggtgttggtgaaaaattggaccatgttagtcagatgtccagccgattgacatctgaatctcgcatttatgcagataaagcaaaggatttgaatcggcaggctctgattcgtaaatatgctccctttgctattgtcattggagttgttctccttctcttttgggtcagaaagaagatatggtgatttggctctccttcgacttactactctaattacatctttggatgtgatggtaagggtcaccagcagctcgtttcagaattttgcgatcagatgtagtctccctcggatgctatatttcagagagcggagtattgggcactactcgattgagtgcccatcagaatgtgattcaaatttttacagcgcaacagtgtataggacaaaggagttaaattggcgaggaaaggattccaagaataggtcagacgagcaattcctttagaaagctattctgttaaagactcggaacttgacaccaaattctgcttcttctgatcattctgatttaagaagttcagtatgaggttggttttaggtggacccaattaggtagttcggttgttttgttgcaattaaaatcgatctcgttggtgagtttaggctttcgctggactgggatctacgttgggaggaataggacgacgcggtgctgctctggccttccgcagagtatccctgccacacttgcctgttgtgttcgagtttctgacatagcccaggattttgtgagtttcaaaagtctcccatttcctcatgtataatgataatatagtttttgttt

SEQ ID NO: 8691 - DNA, 1394 bp, Elaeis guineensis
cacgagctcgtgccgctcgtgccgaatcggcacgagcttttctccagctcctcctcctctccctctccgtcccactccctggccgatagcttcgtcgaagggagttcgaaggccgccatttcctcatctcaacgaaactcatacgctcagtggaccttcgccgcacgccgagatcgccggtggttttgaaagatcagtttcttcaattcttagtttaagataagatggtgaagctgacaatgatagcacgtgttactgatgggcttccgttagcagaagggttggatgatggccgtgatcagaaagatattgaattctacaagcagcaagctaagcttttatttaagaacctgtctaaaggacaaaatgaggcttcaagaatgtcaattgagactggtccttacttttttcactatatcattgaaggtcgtgtctgttacttgacaatgtgcgatcgttcttatcccaaaaaacttgcttttcaatacctagaagacctcaaaaatgagtttgagagagtcaatgggaaccaaattgaaacggcagcaaggccgtatgcttttatcaagtttgatacattcatacagaagaccaagaaattgtacttggatactcgtacccagcgcaaccttgcaaagctgaatgatgaactttatgaggtccaccaaataatgactcgcaatgttcaagaagtacttggcgtcggtgaaaaacttgatcaggttagtgaactgtcaagccggctaacatctgaatctcgcatctatgcagacaaggcaagagatctaaatcggcaggctttgattcggaagtgggctccagttgctgttgtgcttggagttgtcatgcttcttttttgggtcaaaaagaagatatggtgattccatgtattgaaagagtcaattgcgatttttgttcgtcatatacaaatgtatacatttccagctcggtaataccaatgtttagatgttgttttgcaagaacctctagacaaaaaacacacttgggtgctattcttgttttcgcctgccattagagtacattggagacaaatcggatgatgtgcttaagctctgcaaatattagtagagatagtactagatattcaaatgtcattttttccataaagagaattacttatatggtctgactttatgaaggcagcttactccatataaactgatgagggtaggctaaactttatgagcagcaccaggatttaatcgctctggttatatgattgaagaatgtcgacggacataaagctatcatgaagcatgggcctaagggggtctgtatgaactctaagctcatgtagtggtcaatttttgtaagttggctgtcagtttattgctagagtctgcgtttgtctaaaatatctatcaatgattatc

SEQ ID NO: 8692 - DNA, 1618 bp, Oryza sativa
tactctctctctctctctctctctctctctctctctgctcccgccggaggcaacggcggcggacgtgctcctctcctcccccgatcgccggcgagcgggttcgccgggggcggcgacgcggccggctcatcccaccggcgcccccacctcgcggcccgattcgaaattttgaaggtggcactttcagattgcctatgctagttcatttcacgctgcatatccaaaatggtgaagctgacaatgatagcacgtgttactgataaccttccgttagtggagggattagatgatggtcgggatctgaaggatgctgacttctacaagcagcaagctaaactgttgttcaagaacttatcgaaagggcaacatgaagcatcaaggatgtcaattgagactgggccataccttttccattacatcatcgagggccgtgtgtgctatttgacaatgtgtgactgctcttatccgaagaaacttgctttccagtacttagaagatctcaaaaatgaatttgagagggtcaatggcaaccaaattgaaactgctgcaagaccatatgcttttattaagtttgacactttcatacagaagacgaagaagttgtatttggataccagaacccaaaggaacctggccaagttgaatgatgagctttatgaggtgcaccagattatgactcgcaattttcaagaagttctcggtgttggtgaaaaactagatcatgatgaaagttttctgtttgcagaggtgagtgaaatgtccaataggttgatctctgatactagaatttatgcggagaaggcgaaggatctcaatcgtcaggcccttattcgcaagtatgcccctgttgccattgtgattggaatagtactgatgctcttttgggtcaagaacaagatatggtgactgagagtaacagtcaggcctcctgttacggtgctggaacttgagttctccgtgcaccccgaatcgattctggctcaacagatgctttgatggcttatcccgcatctgcccattcaagcgagtagtagtgtagctcttcttccgtgctttttgttttttgtttttttgttttttgcctattcctcccaacaaagatcatccaaactaaacccattgtagtataaaccctcgtcatcgacccagcctatcctgatggatgaagaagtccttgagttcttgcagcaccgatttctggctaattgttgtgtagagtcggcttttcgacctccgaaatggtatatgttctttgcaaactcaccatgtaagaattgatgtttcaggctgatggatggacaaggcacataccattcaaagctgcatggaatgtcttgtgactcagacgttttagctgcaatcgaatacgtccggttatgctgctggagaaaggtcattctcattgccagattatcagcttctgtagtcagagattttggcatgcagtgcgacaacttgagatagaacaacgttaagtatgaagggcctatttgtcttgagctcaaatgctatgctaaatatgatattttttacatgcaacaacttgagattatcttgatgtagaacatgaacaaccttgatgatacctttgagctaaaatgctactgatactctggta

SEQ ID NO: 8693 - DNA, 1295 bp, Amsonia hubrichtii
gagaaccaccacggcaccgtctcccagctccagcctcttggttagcttgccgccctccgccccagctccgcttacgggctacaaacagcagaggacattaaaggttggagaaccgattcgagatcttgcttcttggtggttctctgcatttaagatttctctgcttgggctcttcatcaagaactctggatcagcttgaggaagaaaaatggtgaaattgactatgattgctcgtgttactgatggccttccgctagtggagggcctagatgatggtcgagacgtgccagatgcagatttctacaagaagcaggccaaggccttattcacaaacctctcaaggggccagaatgaggcttctagaatgtctcttgagactggcccttattattttcattacatcatcgaaggacgtgtttgttatttgacaatgtgtgaccgtgcttatcctaagaagcttgcttttcaatatctggaagatcttaagaatgaatttgaacgtgtaaatggaagtcaaattgaaactgcagctcgaccgtatgctttcataaagttcgatacatttatacagaaaacgaagaaattgtaccaggacacaagaactcaacggaatatagcaaagctgaatgatgaactttatgaagtacaccagataatgactcgcaatgttcaagaagtccttggtgttggtgaaaagttggaccaggtcagtcagatgtctagccgcttgacttcagaatctcgcatatatgctgacaaggcaaaagatttgaatcgtcaggctttgattcgtaaatgggcacctgttgctattgtccttggtgttgtcagcctcctcttttgggtgaaaaataagatttggtgatggcgtgtaataatcacacaaggatgctcacgagactctggtttctcaccctgaattgacacatccaaggggagtacaagcatttctaggatgtctctgatagtccattataccctaaagtttttggagctgagaaatcaagctttgttgtgaacagaaagacatttaagaatcacattgtcaactgttgggagatataccctgtaggttcatacagatttgattaccatatctgttcaatgttcgtttccctctttacaatctatacatgtagcacttgttctcctactgccttggaaccataaatttgaaatctccgagattccagacaggtctttagtcttgatgcattatatgaggtaaagaatttatggctgacagtatattctagtgtatgcagtatatatgactaaatacaaagatgttcctt

SEQ ID NO: 8694 - DNA, 1211 bp, Musa acuminata
cccgtctcctccaatttccgtacccacctacgcggcgacgcatcgcctgcgacggtctcaagcccactgatcgattctccgaggattcgtctcgaggaacgcgagacgatctctcgagttcagttgtcgggtaacttctgaaggttattttgattaaaattcttcatcagttcctattcgtgtgggttaagatggtaaagttgacaatgatagcacgtgttaccgatggcctacctttagcagaaggattggatgatggtcgtgaccagaaagatgctgacttctataagcagcaagcaaagcttttatttaaaagtctctcaaagggtcactatgaggcttctagaatgtcaatcgagactggtccatactttttccactatattattgagggccgcgtttgttacctgacaatgtgtgatcgatcttatccaaagaagcttgctttccaatacttggaggacctcaagaatgagtttgagagggtcaatggaggtcaaattgaaactgctgcaagaccatatgcttttatcaaatttgatacttttatacagaaaaccaagaaactttatttggatacccacactcaacgtaatattgcaaagcttaatgatgaactttatgaagtccaccaaataatgactcgcaatgttcaggaggttcttggtgttggtgaaaagttagaccaggtcagtgaattgtcaagcaggttgacatctgagtctcgaatctatgctgacaaggcgaaagatttaaatcggcaggctttgattcgaaaatgggcgcctgttgccattgtgcttggagtagtcatgcttctcttttgggtcagaaagaagatatggtgaatcagcggatcgaacagtcatattctctcttcattatgttgtcaggtgtgtggagtcggccttgtagatatccagctcggccacaagacgtcaaaacgagcctcctctggccatacaaccacagctgggatgcactcgttttcttatcataagaatatatatgagccacaagaatccctaagacttcaacccaacgtttcccggctatgcgatattgggactgttgagcctgaacgctacagcattattattacttcattcatttttttcggacattgcacaaaatcttaatgttccattagctgattcatgaactagttttgaaaaaagcagcagacgtcgcacttgttttagcttgagaat

SEQ ID NO: 8695 - DNA, 1238 bp, Vaccinium corymbosum
gaaacacggccgcttcatttacgatctcatttccatgtacgatccgtatactaatttcataccaaaaagccctatttaacccctttctctaccttcaaattcagtcgtcatttgtcgtaaccgtccatcagatcgcagaaatcgaaaggaaaaaccaaatgcttcatctcgagcgactaatcaaggcaaagatctgagctgcgatgcgtacacgagaggctacagcttagaacttgtgaagcaaagatggtgaagctgacaatgatagctcgtgtcactgatgggcttccactagcagagggactggacgatggccgtgatttgcaggatgctgaattttacaaacagcaagtcaaggctttgttcaagaatctttcaagaggccagaatgagccttcgagaatgtcgattgaaactggcccatacgttttccattatgttatagaaggacgcgtttgttatttgacaatgtgtgatcgtgcatatcctaagaaacttgcctttcagtacctggaagatctcaagaatgagtttgagcgtgttaatggtagtcaaattgaaactgctgctagaccttatgctttcataaaatttgatactttcatacagaaaacaaggaagttgtacctggacacacgaactcagaggaatatttcaaagctgaatgacgaactctatgaggtccaccaaattatgactcgcaatgttcaggaagttctgggtgttggtgaaaagttggaccaggtcagtgaaatgtccagccggttgacatcagaatctcgcatatatgctgacaaggcaagggacttaaatcgtcaggctttgattcggaagtgggcccctgttgccattgttcttggagttgtcttccttcttttctgggtgaaaaataaaatttggtgatgtatcatcgtcacatgcagcttcctttagtttcgccaccctgccagtgatatgagacctggctttctgggtattttgtaagatgggaacaatcaagccatcaaggtacttgatggataccctgagaatgagattgaattgggaattggaacatgttaactgaaagaaacaaaaaatcgttttgagggccttagacagaattttattactcatatatgttacataatattcagtgtactctgttttacttgtatcccaatcgactacatattaaattgctggatgattggccgttggacttgtgacatatggttagtttgaatgtcggatttttt

SEQ ID NO: 8696 - DNA, 1101 bp, Solanum phureja
cttttttttttcgttttctcccaaatctctggaaaaaatcttgtaatattaattttaaaaaaagaagcgaagatcatcgatccagcagcaaagtcaatacgcttatgattgttgtatgcttgtgaaagcaagatggtgaagttgactatgattgctcgtgtgactgatggtcttcctttagcggaggggctggatgatggccgtgatattcaagatgccgatttctacaaacagcaagccaagtccttgtttaagaacctctctatgggccagattgaggcatcaaggatgtctgtagaaactgggccttatattttccattataacattgaaggccgtgtttgttatttgacaatgtgtgaccgctcttatcccaagaaacttgcttttcaatacctagaagacctcaagaatgagtttgagcgtgtcaatgggagtcaaatcgaaactgctgctaggccatatgcttttattaaatttgatacattcatacagaagacaaagaaactgtaccaggacaccagaactcagcgcaatattacaaagttgaatgatgaactctacgaagttcatcagataatgactcgaaatgtacaagaagttttaggtgttggtgaaaagttggatcaggtcagtcagatgtccagtcgcttgacatcagaatcccgcatttatgctgataaagcaagagatttaaaccgtcaggctctgattcggaaatgggcacccgtggctattgtcattggagttgttactctcctcttctgggcgaaaaataagatttggtgatgcgactatcccatatgcagcttagagaagtgtcattactctttgatacttactgattttgcaacatcaaactgtgtggcaaccgatagatcacttaacatttcaaggtgactaccgtgttgtgtgcgcaatgaagagagcttttggaagatgagacactcaagctatgagtttgataatgtaagacagataaaccatgatgagccatgttggtaaacattgacaaaatgatatcaatcttaatcctcagcatattttgtattgctaaactttaaaatttgaagtgcaacatttattgtagtgctgagttga

SEQ ID NO: 8697 - DNA, 1440 bp, Amborella trichopoda
ctcgcaattctatctctataaatcagcatttcgggttgtctctctctctctctcgctcctcttttccttcaaaggagccgagagagtccaagaagacgcgggaggaagcaaagagcagagacggtaagagcctaccatttccagtcagattgaaaaggtggttctggattataaaagcggcataggcatataaaaatggtcaagcttacgatgattgctcgcgttactgatggtcttcccttggctgagggactggatgatggtcgtgatcaaaaagatttggagttctacaagcaacaggcgaaggcattgttcaaaaatttatcgaggggtcagagtgacccttcaaggatgtcgattgaaactggtccttatattttccactatattattgaaggacgtgtgtgctacctaacgatgtgtgaccgtgcttatcccaagaaacttgcttttcaatatcttgaggatctcaagaatgagttcgagagggtcaatgcgaatcaaattgagaccgctgcccgaccatatgcttttattaaatttgatacattcatccagaagactaggaaactttatttggacacacatacacagaggaaccttgcaaagttgaatgatgatctttacgaagtccatcagataatgactcgtaatgttcaagaagttcttggtgttggtgaaaaactggatcaggtcagtcaaatgtcaagccggctgacatcagaatctcgtatatatgctgacaaggcaagagatctaaataggcaggctctgattagaaagtgggccccggttgccattgtacttggaattgtttttcttctgttttgggtccgcaacaaaatatggtgaacactactaccgttaggcccatttgagggaggctgcaatctgcattggactattattgatctcaatatactggggggatactcttgtaaggttggatctgtgtgcttgcccgagattgagaggaaagtacagccttgggtcttttttgtgcgtggggcagttattttgtgagtggatgatcattggcatgaatcttggtgcttgctaggaattcttttatcttctattgagacctttgaggagttctctcacattttttgtaagttttataatggaaatgaagcagggaatggacacccattattgggaagcctatataccatatgactaataagtagagattttttcatgtaaaggcctggccatgaaccaaccataccgtgcagtaattccattcctttttttgtttttctttctcatttttagcacttccaataacgtgttttttttctttttagcatatttcatgtactttgcattttactgtgttgcaaagtctgttggttttaaagttttaattgtttcctgctgacatcagttagaatcttgtatgccccgttttatattgatatgtaagtgtttcccaaa

SEQ ID NO: 8698 - DNA, 990 bp, Capsicum annuum
gtggcatattaattactacaattttattagtatcacacacaataaattgaaaaaattagggagggaatagaagttgcatcaacatccaagatcgggaacaagtattatttgtggatccatcagcaagcagtatacccaaatcaagactcaataaatacactgcctatgatttttgtatgcttgtgaaaccaagatggtgaagttgactatgattgctcgtgtgactgatggtcttcctttagcggaaggcctggatgatggccgtgatattcaagatgtagatttctacaagcagcaagccaagtccttgttcaagaacctctctatgggccagattgagacatcaagaatgtcggtagaaactgggccttatattttccattatatcattgaaggccgtgtttgttatttgacaatgtgtgaccgcgtttaccccaagaaacttgcttttcaatacctagaagacctcaagaatgagtttgagcgtgtcaatgggagtcaaattgaaactgctgccaggccctatgcttttattaaatttgatacattcatacagaagacgaagaaactgtaccaggacaccagaactcaacgcaatattacaaagttgaatgatgaactctatgaagttcatcagataatgactcgaaatgtacaggaagttctaggtgttggtgaaaagttggatcaggtcagtcagatgtccagtcgcttgacatcagaatcccgcatatatgctgacaaagcaagagatttaaaccgtcaggctttgattcggaaatgggcacccgtcgctattgtcattggagttgttattctcctcttctgggcgaaaaataagatttggtgaagctaccattcccatatgcagcttagaaagtgttattactcttggatacttactgattttgcagcaccaaactgtgtgggcaaccgatagaccacttaacatttcaaggtggctgtcgtgtaacgaagagaggttttttc

SEQ ID NO: 8699 - DNA, 1186 bp, Solanum lycopersicum
gtttttcacttagaaaagaaaaataaaaaaaaaaaaattaaaactttttttctcgttttctcccaaatctctggaaaataacttgtaatattaattttttttaaaaaagaagcgaagatcatcgatccagcagcaaagtcaatacgcttatgattgttgtatgcttgtgaaagcaagatggtgaagttgactatgattgctcgtgtgactgatggtcttcctttagcggaggggctggatgatggccgtgatattcaagatgcagatttctacaaacagcaagccaagtccttgtttaagaacctctctatgggccagattgaggtatcaaggatgtctgtagaaactgggccttatattttccattataacattgaaggccgtgtttgttatttgacaatgtgtgaccgctcttatcccaagaaacttgcttttcaatacctagaagacctcaagaatgagtttgagcgtgtcaatgggagtcaaatcgaaactgctgccagaccatatgcttttattaaatttgatacattcatacagaagacaaagaaactgtaccaggacaccaggactcagcgcaatattacaaagttgaatgatgaactctacgaagttcatcagataatgactcgaaatgtacaagaagttttaggtgttggtgagaagttggatcaggtcagtcagatgtccagtcgcttgacatcagaatcccgcatttatgctgataaagcaagagatttaaaccgtcaggctctgattcggaaatgggcacccgttgctattgtcgttggagttgttattctcctcttctgggcgaaaaataagatttggtgatgcaactataccatatgcagcttagagaagtgttgtcactctttgatacttactgattttgcaacatcaaactgtgtggcaacctgaagaccacttaacatttcacaatggctaccgtgttgtgcgcgcaatgaagagagttttttggcagatgagacactcaagctatgagtttgataatgtaagacagataagccatgttggtaaaacattgacaaaatgatattaatcttaaatcttctcggcatattgtcttgctaaactttaaaattttaagtgcaacatatattgtagtgttgagttgatcaacttgcaacttgtgatatatgcagtgttgatgtttagtttctta

SEQ ID NO: 8700 - DNA, 1365 bp, Eucalyptus grandis
gcttcttgagtgtcctctcctcgttcaaaaacctagagagagaaaggagagagagagagcgagacggggaccgcaggaaattcatcgacgagagccgctcgtctccgatccgccgccgcgcgatcgccgatcgatccggccggagccgtgcagagatcggtagggtagattgccgaattggggctggacctcgcgacccgcgatcgggattcggcacggaggtcctgcgcgcgatcggatctggtgggatcggtttcgaagggcgtagaaggagaagaagcaggaggaggaggaggaggagaaggaggagaatggtgaagctcacgatgatcgcccgcgtcaccgacggcctcccgctcgcggaggggctcgacgacggccgcgacgtgaaggacgccgagttctacaagcagcaagtcaaggcgctgttcaagaacctctccaagggccagaacgagccctccagaatgtcggtcgaaaccggcccttactacttccactacatcattgaagggcgtgtctgttacttgaccatgtgcgatcgatcttaccccaagaagctcgcgtttcagtacctggaggacctcaagaatgaattcgggcgcgtgaatggggcgcagatcgaaaccgcggctcggccgtacgccttcatcaaattcgatacgtttatacagaaaacaaagaaactttatcaggacactcgtacccagaggaacatttcgaagttgaatgatgaactctatgaggtccaccagattatgacccgcaatgtccaagaggtacttggcgttggcgaaaaattggaccaggtcagtgaaatgtctagtcggttaacatcagaatctcgcatatatgccgacaaggccagagacttgaatcgacaggcactaattcgaaaatgggccccagttgccattgttctgggagtggtcttccttctcttctgggtcaaatcaaagatatggtgatgtgactgccttgcctgtacttctgttctactgcagtgggctgctgggttgctgagagattcattctcaacgattttaaatggggcacgggattttcacagagaatcatatgcgttcaaaagttagtgtagttcttctaattgcattttgtattggatgcttcattccttatgcagttgtggcaatagatttgccatgttaagtagtgaatagagaaccctcccttaagacaggagcaacatcaatatcttattgtcgacaaactagcagagtgttttccgtacaggaggctgcgtataacttttgttcatcaatacctataatcatctcttatagtactgttgtctatagctttatcatattaagattatgttaggtttcatgccccttttttatc

SEQ ID NO: 8701 - DNA, 1164 bp, Vitis vinifera
tttcccttctctcccaaaaccctatttagggattctctgtctttttctttcattttctttaggtttctcgcccagatcggacgctctcttcatcgtcgaaattaaagaaagaggatcggagggaagatccgaagaggcagagggagacaaacgcatgagagctgaagacttttgaagaagtaaaagatggtgaagttgacgttgattgctcgtgttactgatgggcttccactagcagagggacttgatgatggtcgggatttgaaagatgctgaattctacaagcagcaagtgaaggccttgttcaagaacctctcaaaaggccagaatgagccctcaagaatgtcaattgaaaccggcccttatatttttcattatattattgaaggacgtgtttgttacttgacaatgtgtgatcgcgcttatccaaagaaacttgccttccaatacctggaagatctcaagaatgaatttgagcgcgttaatgggaatcaaattgaaactgctgcaagaccttatgcctttattaaatttgatacattcatacagaaaacaaagaaattgtaccaggacacccgtactcagcgtaatattgcaaaactgaatgatgagctttatgaagtccaccaaataatgactcgcaatgtgcaggaagtactgggagttggtgaaaagttagatcaggtcagtcagatgtccagccggttgacatcagaatctcgcatatatgctgataaggcaagagatctaaatcgacaggctttgattcggaaatgggctcctgttgcaatagtgtttggagtcgtcttcctcctcttctggatcagaaagaagatttggtgattccactgccagtgatgcggtttctgaaacttgttgcacaaatttctggcttcctatccatcacaacgagctgtctcttgtggcatagcattccaggctttgaagacttctgattgggtgccttattcacataaaactcctcaatcatgtttgaaggtgacctgctagtttttgcttgtggcacagtcgagtcacgaggactagtgttataggtgcctcttaagagcggaaacaaatgtggaattttgtaagaggccttctttataaagaccgccaagatatattcactaatattagaaagatcttatttcatttttcctt

SEQ ID NO: 8702 - DNA, 1395 bp, Papaver somniferum
tttttttacttcgatttgaaggaagtctttacattttctcctcctccgcttcttcttccaaagaatattcttcttctcctcttctgggtttaatcccataatcatcatcatcttcgttacaattgtgaaaccctagaaatccttgaagaagctgttacagagaaaagagatctgataaaattccaacaggaagacccaatttgagaaaaaggttttgtgaagatagagaattgtatctatataaaagatggtgaaactgacactgattgctcgtgttactgatggtcttccgttagcagaaggattagatgatggccgtgatctcaaagatgctgagttttacaagcaacaggctaaggccttgttcaagaacttgtccaaagggcataacgaagcttcaagaatgtctattgaaactggtccatttgtttttcactatatcatagaaggtcgggtgtgttacttaacaatgtgcgatcgtgcttatccaaagaaactcgcctttcaataccttgaggacctcaaaagtgaatttgaaaaagttaatgggaatcaaattgaaactgctgccagaccctatgccttcattaaatttgatacatttattcagaagactaagaagctgtacttggatacccgtactcagagaaacatttcaaaactgaatgacgaactttatgaagtccaccagataatgacacgtaatgttcaagaagttcttggtgttggtgaaaaattggaccaggtcagtcaaatgtcgagccggttgacatctgaatctcgtatctatgctgacaaagccagagatttaaatcgacaggctttgatacgtaaatgggcccctgtggctattgtacttggagttgtcttcctcctcttctgggtcagaaagaaaatctggtgatttcacaccaaattcgtgcagttccaggtagcgttcatacaatttttgcaatcatcccattggctgagcagcgtctcccagttctgttgacccgagaaagcctcttcctgagtatggatccctcacctgcaatcggacattcagtaaatgcatcccggtgttatatagtttttttttattgcttaaaagaatctagcaagcagtagttttcatgactatgactgggtgaaacttgttatgattgagggatgatagagttacaatcaagttggacaaatatttataatttttttgttgaaattagaagtcagtttgatcatccagtatggaaattgatgaactagatatatcttcttacaaatcacaaataataatgttaacaacaggagtattttgtttttcttttccatggacaatagcttcttgttgtatgtctaggtatgctccaagtaaccagatcattatcaccaaaataggtgaactattataaa

SEQ ID NO: 8703 - DNA, 1428 bp, Solanum tuberosum
gaattcccattcattacaaccttcatttcgctgaaaccgatcggagttcacgagaggatcatacaaaataggaaaccggcgatcggaagttcgacagatcaaccaacaaaggctgcaccgacgcgtatgataggatcaagttttctattcatcatctgaagctctctaactcgagcatttggattcatctatcttggagttgttgttcgcttgtttaaggaagatggtgaagttgactatgattgctcgtgtaacggatggccttccattagctgaggggctggatgatagccgtgatgttccagatgctgattactacaaacagcaagtcaagtccttattcaagaacctctctatgggccataatgaggcatcaaggatgtccattgaaagtggaccttacattttccactatatcattgaagggcgcgtttgctatctgacaatgtgtgatcgctcttatccaaagaaacttgcctttcagtacctagaagaccttaagacggagtttgagcgtgtcaatggaagtcaaattgaaactgctgctagaccttatgcctttatcaaatttgatacattcatacagaagacgaagaaactgtaccaggataccagaactcaacgcaatgttgcaaagttgaatgatgaactttatgaagttcatcagataatgactcgaaatgtacaagaagttcttggtgttggtgaaaaattggaccaggtcagtcagatgtccagccgtttgacatcagaatcccgcatatatgctgataaggcaagagatttgaatcgtcaggctctgatacggaagtgggctcccgttgctattgtcattggagttgttagtctcctcttctgggctaaaaacaagatttggtgatgctgccatcaaatgtacagcttagaaatgatgttactccagcatcggacagtgggcaactgacatgaccacagtggcctttgttttctgcggatggggagactcaagacatgtcagtttgataatgtagaacaggggatgtgaaccatgacgactgaatgtcgctaatacttgagaaatgatatttaatatgaatcgctcagcatgtatttttcttagtactcatcaacaaaacttgccttccaataggtatttgtaattctgaaatgccgttttagctactttagtatatgtttgtaaattacagtggtagcctcattgtctactattttgattcgttccagcggccgctcagggagaaaagggcatatcggatagtagaagatgcgaatgaagtgctaagcatggttcaaattgtgctgctatttcaacaattattaaactacttacacaagaaaacttatatagaagtgtctgttccttcaaagcctcctttcattgatatggttccgaacaacatggttctagtcatcagcatcacccctttc

SEQ ID NO: 8704 - DNA, 1203 bp, Solanum phureja
tacttgtgaagacgggtatttacccgattccctgaatccgatcccaattcccattcattacaaccttcatttcgctgaaaccgatcggagttcacgagaggatcatacaaaataggaaaccggcgatcggaagttcgacagatcaaccaacaaaggctgcaccgacgcgtatgatagttgttcgcttgtttaaggaagatggtgaagttgactatgattgctcgtgtaacggatggccttccattagctgaggggctggatgatagccgtgatgttccagatgctgattactacaaacagcaagtcaagtccttattcaagaacctctctatgggccataatgaggcatcaaggatgtccattgaaagtggaccttacattttccactatatcattgaagggcgcgtttgctatctgacaatgtgtgatcgctcttatccaaagaaacttgcctttcagtacctagaagaccttaagacggagtttgagcgtgtcaatggaagtcaaattgaaactgctgctagaccttatgcctttatcaaatttgatacattcatacagaagacgaagaaactgtaccaggataccagaactcaacgcaatgttgcaaagttgaatgatgaactttatgaagttcatcagataatgactcgaaatgtacaagaagttcttggtgttggtgaaaaattggaccaggtcagtcagatgtccagccgtttgacatcagaatcccgcatatatgctgataaggcaagagatttgaatcgtcaggctctgatacggaagtgggctcccgttgctattgtcattggagttgttagtctcctcttctgggctaaaaacaagatttggtgatgctgccatcaaatatacagcttagaaatgatgttactccagcatcggacagtgggcaactgacatgaccacagtggcctttgttttctgcggatggggagactcaagacatgtcagtttgataatgtagaacaggggatgtgaacaatgacgactgaatgtcgctaatacttgagaaatgatatttaatatgaatcgctcagcatgtatttttcttagtactcatcaacaaaacttgccttccaataggtatttgtaattctgaaatgccgttttagctactttagtatatgtttgtaaattgcagtggtagcctcattgtctactattttgattcgttccgtagaa

SEQ ID NO: 8705 - DNA, 940 bp, Valeriana officinalis
acctgaccttcgtacgactcctctataagctgctttctccctgattacccacgaccgtacttacttcgttccggcactatctcctctctttgggaagaagttaaggatggtgaagctgacaatgattgctcgtgttactgatggacttccattagcagagggattggatgatgggcgtgatatgcaagatgccgaattctacaaacagcaagttaaagctttgttcaagaacctctcaagaggccagaacgaagcttcaagaatgtctcttgaaactggcccatatgttttccactatatcattgaagggcgtgtgtgctatctgacaatgtgtgatcgtgcatacccaaagaaacttgcttttcaataccttgaagatcttaagaatgaatttgagcgtgtcaatggaagtcaaatcgagactgcagcaagaccttatgctttcatcaaatttgatacattcatacagaaaacaaagaaactgtatcaggacacaagaactcaaaggaatatctcaaagctgaatgatgagctttatgaagttcaccagataatgactcgcaacgtacaagaggttcttggtgttggtgaaaagttggatcaggtcagtcaaatgtctagccgtttgacatcagaatctcgcatatatgctgataaggctaaagatcttaatcgacaggcactgattcgaaaatgggcacctgttgcaattgtattgggagtagttttcctccttttctgggtgaagaagaagatttggtgatttcttggaattccatagcaccactgagatgccttgatgactctactactactactatgagttttatgtttagatggatctcaacttcttcttcttcatctcttttcacacttgattgcacaaccccgactcgctaatcgagggtggttgcatttgtaagacaatagataattatct

SEQ ID NO: 8706 - DNA, 1084 bp, Castanea mollissima
tgtcatcaccgtccctcagatccttcacatcaaaagcgaagtccaaatgatataaaccagctgaaaaggtctaagctgaagatggtgaagctaactttgattgcccgtgtaactgatggtcttccactagcagagggtctggatgatggccgtgatttaaaagatgctgaattctacaaacagcaagtcaaggctttagtttaaaaacctatcaagaggtcagaatgaggcttcaaggatgtcaattgaaactggtcccttacgttttccattatattatcgaaggacgcgtttgttacttgacaatgtgtgaccgtgcttatcctaagaaacttgcctttcaataccttgaagacctcaagaacgaatttgagcgtgttaatggggctcaaattgaaactgctgccagaccttatgccttcatcaaatttgacacattcatacagaaaaccaagaaactgtatcaggacacccgtacccagcggaatattgcaaagttgaatgatgaactctatgaagtccaccaaataatgactcgcaatgttcaggaagttcttggtgttggtgaaaagttggaccaggtcagtgaaatgtcaagtcgattaacgtcagaatctcgtatatatgctgataaggcaagagacttaaatcgacaggcgttgattcggaagtgggctcccgttgccattgtatttggagtggtcttcctcctcttctgggttaaaacaaagatctggtgaccattctgaaaacaggttgcgcatttcctctgcaattcttgtggcaaaatagtcttagactccagtttcattgccaatccccatatatacttaaaattgtgtttcaagacgaactctagttctttttggcttaggttaaggaaactagtccaataggtacctctggagatggatctgcttgtaagattgtggaagagagacctgttacctttaagaccagataaggagccaaatttattgtttgaaaatatgagaaatcttgatatatgtttgttacttctacttttgaatattttcttttattacttacattgaaatactcagagtaagatcatgttaacctt

SEQ ID NO: 8707 - DNA, 1374 bp, Amorphophallus konjac
gggtggcactccgtcctctcttcatttctcgggcgcgcacggcgcttcttcgcgtgagctccgcggcagcgctccctcaccgaccccggccttcttcccctctcgacgagcggccttcctccccgacctcggcagcggcgcatcttcctcggacggccgcatcgtctccgtcgacggcgtgtcaactctgtcggcagcgtgttgcgatgaacatggtgtaagtgaatgtgctttcaagagtgatacagttgtgatacaaaggtgaagtcaatttaagggagcttgctgccaagttgagtatacattggttgctttataaggacctacaggcaaaattttgaagtaatactgaagattttacacctttccaagctataagatggtgaagctaactatgatagcacgtgttactgatggccttccattagcagaaggactggatgataatcgggatcagaaagatgcagacttttacaagcaacaggctaagcttttgttcaagaatctttcaaaaggacataatgaagcttcaagaatgtcaattgaaactggtccctacttcttccactatattattgaaggtcgtgtctgctatttaacactatgtgatcgttcttatcctaagaaacttgcttttcaatacctagaagatctcaaaaatgaatttgagagggtcaacgggaatcaaatcgaaactgctgctagaccctatgcttttataaaatttgatacattcatacagaagaccaagaaattatactctgatacccatactcagcgtaatcttgcgaagttgaatgatgagttatacgaagtccatcaaataatgacgcgcaatgttcaagaagtcctgggtgttggtgaaaagttggatcaggtgagtgaaatgtcaagcagattgacaaatgagtctcgcatctacgctgagaaagcaaaagacctcaatcgacaggctttcattcggaagtgggctcctgttgcaattgtgattggtgtggtcacattcctcttctgggtcaagcacagattatggtgattcgaaggtggagatgatgtcggaccattttgcacttgatatggttgaccatgccagttttggcatccctccatatccagctggatgtcttgggaacacttgaagatgcgccctccgaaccacccaacaaagacccacccacccacaccaacaaacaatgctgtcaggatgccacattgagtgggcctttgtttgttctccttccatgagtatgataacggaactcatagctacattgatcgagacagatctaaaaatgaggatgatagacttgtgtgtgacttgatttgagctttcttatgattctgtcatgtatggaagtacagatttttttggac

SEQ ID NO: 8708 - DNA, 1192 bp, Gossypium hirsutum
ttacctctctttctctctccttttattttttcccttctttaagtcgtgtcggaccatcgaccgtttcctgtgcttcagatcgttgaaatcgaggagaaaatccaaatatccatattctgtaatcagtttgaagggactttgtctagctgagaaatacggtggtaaagatggtaaagatgacaatgattgcccgtgttactgatggtcttcctcttgcggagggactagatgatggtcgtgatctggtagatgctgaaatgtacaaacagcaagttaaggctttatttaagaatctctccaaaggccataatgaggcttcaaggatgtctattgaaaccggcccatatgtattccactatatcattgaaggacgtgtttgttacttgacaatgtgcgatcgatcttatcctaagaaacttgcctttcaatatctggaagacctcaagaatgaatttgagcgtgttaatggagctcaaattgaaacggctgccaggccttacgcctttataaaatttgacacattcatacagaagacaaaaaagttgtaccaggacacccgtactcaacggaatattgcaaagttgaatgatgaactctatgaagttcaccaaataatgactcgcaatgtacaagaagttctcggtgttggcgaaaagttggaccaggtcagccaaatgtccagtcgtttgacatcagaatctcgcatatatgctgacaaggcaagagatttaaatagacaggctttgattcgaaagtgggctcctgttgccattgtgttgggagttgtgttcctcctcttctgggtgaaagcaaagttatggtgattcaactgtgatccatagtgttaagaactcatcagaatttcttgggtttctctgttgctgagtaacctcttgtccacacccaagaccaaatattggagtgcattctggtttttattcatctcacaattcgcctcgtaggtacaattacaaatttgcaatgtggaattgtgtgaaagggagcatatgttcaaaacaaaaactattctttctatatgtaaaagccagaatacaacatccaaatagggaactttaaaggtattaacctattctagtgttttactttgtccaaggttttagataattaacgtgctgagccaccacctgtttgtactacctatatttgagatggaaaacccagatttttctta

SEQ ID NO: 8709 - DNA, 1208 bp, Gossypium raimondii
acctctctttctctctccttttattttttccctctttaagtcgtgtcggaccatcgaccgtttcctgtgcttcagatcgttgaaatcgaggagaaaatccaaagatccatattctgtaatcagtttgaagggactttgtctagctgagaaatagggtggtaaagatggtaaagatgacaatgattgcccgtgttactgatggtcttcctctggcggagggactagatgatggtcgtgatctggtagatgctgaaatgtacaaacagcaagttaaggctttatttaagaatctctccaaaggccataatgaggcttcaaggatgtctattgaaaccggcccatatgtattccactatatcattgaaggacgtgtttgttacttgacaatgtgcgatcgatcttatcctaagaaacttgcctttcaatatctggaagacctcaagaatgaatttgagcgtgttaatggagctcaaattgaaacggctgccaggccttacgcctttataaaatttgacacattcatacagaagacaaaaaagttgtaccaggacacccgtactcaacggaatattgcaaagttgaatgacgaactctatgaagttcaccaaataatgactcgcaatgtacaagaagttctcggtgttggcgaaaagttggaccaggtcagccaaatgtccagtcgtttgacatcagaatctcgcatatatgctgacaaggcaagagatttaaatagacaggctttgattcgaaagtgggctcctgttgccattgtgttgggagttgtgttcctcctcttctgggtgaaagcaaagttatggtgattcaactgtgatccatagtgttaagaactcatcagaatttcttgggtttctctgttgctgagtaacctcttgtccacacccaagaccaaatattggagtgcattctggtttttattcatctcacaattcgcctcgtaggtacaattacaaatttgcaatgtggaattgtgtgaaagggagcatatgttcaaaacaaaaactattctttctatatgtaaaagccagaatacaacatccaaatagggaactttaaaggtattaacctattctagtgttttactttgtccaaggttttagataattaacgtgctgagccaccacctgtttgtactacctatatttgagatggaaaacccagatttttcttaccttgattgcttatttcag

SEQ ID NO: 8710 - DNA, 1236 bp, Nicotiana benthamiana
aaaccttttttaacgtttagcccccaaatctatgcaaaaccctcttctttccccactttcctgtatcctgtattactctttttaattataaaaatcaactgaagaaaattcaagaacttccaatacaaccgaagatcgggaagtacatccctcgatcaaccaacgtagtagtcaagagtcaagacgcatatgattgttgtatgcttgtggaggaaagatggtgaaattgacaatggttgctcgtgtgactgatggtcttcctttagctgaggggctggatgatggtcgtgatgttccagatgcagatttctacaagcagcaagccaagtccttgttcaagaacctctctatgggccagattgacgcatcaaggatgtccgtggaaactgggccttatattttccattatattattgaaggccgtgtttgttatttgacaatgtgcgatcgctcttatcccaagaaacttgcctttcaatacctggaagatcttaagaatgagtttgagcgtgtcaatgggagtcaaattgaaactgctgctaggccttatgcttttattaaatttgatacatttatacagaggacaaagaaactgtaccaggacaccagaactcagcgcaatattacaaagctgaatgatgaactttacgaagttcatcagataatgactcgaaatgtacaagatgttttaggtgttggagaaaagttggatcaagtcagtcagatgtccagtcgcttgacatcagaatcccgcatatatgctgataaagcaagagatttaaatcgtcaggctctgattcggaaatgggctcctgtcgctattgtcattggagttgtcattctcctcttctgggcgaaaaataagatttggtgattctgccattccacatgcagtgtagagaagtgttattactcttgattacttcctgatttcccagcatcaaactgtgtggcaacagatagaccacttaacatttcaaaatgtagctgccgtgttgtatgcgcaatgaagagattggtttttttgggatgtgacacccaagctttgagtttcataatgtaaaacagagatagaccatgatgaacaattttggtatactttgaaaaatgatctcagtcttctcagcatattttgcatattattacataactttaaaacttgaagtgcaacgttttcttgtatctgaggagattggttgcaacattgttatatagaaatacagtataaaaattgca

SEQ ID NO: 8711 - DNA, 1171 bp, Quercus alba
atagccatattgtctcggtcagattctgagcattgtcatcaccgtccctcagatccttcacatcaaaagcaaagtccaaatgatataaaccagctgaaaaggtctaagctgaagatggtgaagctaactttgattgcccgtgtaactgatggtcttccactagcagaaggactggatgacagccgagatttaaaagatgctgaattctacaaacagcaagtcaaggctttgtttaaaaacctatcaagaggtcagaatgaggcttcaaggatgtcaattgaaactggcccttatattttccattatattatcgaaggacgcgtttgttacttgacaatgtgtgaccgtgcttatcctaagaaacttgcctttcaataccttgaagacctcaagaatgaatttgagcgtgttaatggggctcaaattgaaactgctgccagaccttatgccttcataaaatttgacacattcatacagaaaaccaagaaactgtatcaggacacccgtacccagcggaatattgcaaagttgaatgatgaactctatgaagtccaccaaataatgactcgcaatgttcaggaagttcttggcgttggtgaaaagttggaccaggtcagtgaaatgtcaagtcggttaacatcagaatctcgtatatatgctgataaggcacgagacttaaatcgacaggcgttgattcggaagtgggctcccgttgccattgtatttggagtggtctttctcctcttctgggttaaaacaaagatctggtgatcattctgaaaacaggttgcgcatttcctctgcacttcttgtggcaaaatagtcttagactccagtttcattgccaatccccatatatacttaaaattgtgtttcaagacgaactctagttcttttttggcttaggttaaggaaactagtccaataggtacctatggagatagatctgcttgtaagattgtggaagagagacctgttacctttaagaccagataaggagccaaatttattgtttgaaaatatgagaaatcttgatatatgtttgttacttctacttttgaatattttcttttgattacttacattgaaatactcagagtaagatcatgttaacctttctaactcatgtttctttgattttgacttcaattctagctgaatgatttaagta

SEQ ID NO: 8712 - DNA, 922 bp, Avena sativa
gcagcacagcacgtgcccgccaaacttgcgcttccctccggcgacccggcgatctgcttccccggagacggtcgccccatcagcttccgctgccgcgcctcctccgagtgtcgctgtaggctatcaagtatatagtttctagtgctttctggtgttcttccgaaatggtgaagctgacaatgatagcgcgggtcactgatggccttccactggcagaagggctggatgatgggcgagatcagaaggattctgacttctacaagcagcaagctaaacttctttttaagaacttgtcaaaggggcaacatgaagcctcacggatgtcaattgagactgggtcatactttttccattacatcattgaaggccgagtatgttatctaacaatgtgtgaccgttcttatccaaagaaacttgcattccagtacttggaggatctgaaaaatgaatttgagagagtcaatgggaatcaaattgaaactgctgcaaggccttatgcttttattaagtttgatacatacatacagaagactaagaaactctatttggataccagaactcaaaggaacattgcaaaattgaatgatgagctctatgaggtgcaccaaatcatgactcgcaatgttcaagaagttcttggtgtcggtgaaaagctagaccaggtcagtgaaatgtcaagtaggttgacatcggacacgagaatctatgcagataaggcgaaggatctcaatcgtcaggccttcattcggaagtatgctcctgttgccattgtgattgggttgtaataattctgttctgggcgaagaacaagatatggtgattccactaaacaaaggaaggtggtctgtggtataacacttgaggaagaacagagataaggtggattctggatcaagatatgctttgatggcttgtatcccgt

SEQ ID NO: 8713 - DNA, 986 bp, Allium cepa
aaaatacagaaaatagaggagaaaaataaatcaaacttgcctctgaatcctagattcttcaattcagatggtgaaactgacaatgatagcacgagttactgatggccttccattagcagaagggttagacgatagtcgggatgtaaaagatgctgatttttacaagcaacaagcaaaacttttgttcaaaaatttatcgaaaggacacaatgaggcttcaaggatgtcaattgaaacggggaactactatttccattatatcattgagggccgtgtctgttacttgacaatgtgcgaaagaggatacccaaagaaacttgcttttcaatacctagaagacctcaagaatgaatttgagaaagtggatgggaatcagattgagactgctgctaggccatatgcgttcatcaagtttgatacttttatccagaagactaaaaagctctactctgatacacgtacacaaaggaaccttgcaaagttaaatgatgagctttatgaagtgcatcagataatgacccgaaatgttcaagaagtgcttggtgttggtgaaaaattagaccaggtaagtgaaatgtcaagtagattgacatctgaatcccgcatctatgcagataaggctaaagatttgaatagacaggccttaattaggaagtgggcgccggttgcaattgtgcttggagttgtcatgcttctcttttgggtcagaaagaagatatattgatccccccggaagctttagcttgctttttacaagaagtaaatcaaaatgttaatcattacctacctccgaactgagcgcctccagcatgtgtgtaggtttcatcgcaaagctttctcctttaatgtggatatgagacccaattattttgcccgttttcttcagaatatatttcttcattatactgaacttcttcgtttcgatgtaaactgcttatattcctttgaacatctctagttcatctatattcactagtggattatgt

SEQ ID NO: 8714 - DNA, 790 bp, Capsicum annuum
gttgtagttgtatgcttgctgaagaaagatggtgaagttgactttgattgctcgtgtgactgatggccttcctttagccgaggggctggatgatggtcgtgatgttccagatgccgatttctacaaacagcaggtcaaggccttgttcaagaacctgtcgatgcgccaaaatgatgcttcaaggatgtctatcgaaactggaccttatattttccattatatcattgaggggcatgtttgttatctgacaatgtgtgatcgttcttatcccaagaaacttgcctttcaatacctggaggaccttaagaatgagtttgagcgcgtcaatggaagtcaaattgaaactgctgcgagaccctatgcttttattaaatttgatacattcatacagaagacaaagaaactgtaccaggatacaagaactcaacgcaatatttctaagttgaatgatgagctttatgaagttcatcagataatgactcgaaatgtacaagaagttcttggtgttggtgaaaagttggaccaggtcagtcagatgtctagtcgcttgacatctgaatcccggatatatgctgataaagcgaaagatttaaatcgtcaggctttgattcgaaaatgggctcccgttgctattgtacttggagttgtctttctcctcttctgggttaaagcaaagatttggtgaagcttccatgcagatgcagctcagtgacaacaatactgtcgaatgcctgttcctgactgtcaccatccgactgtgcacaacctagacaacccacctcagttatca

SEQ ID NO: 8715 - DNA, 1240 bp, Tabernaemontana elegans
tgtcgccctccgccacagctccacctacggcctacgagcaccagaggccatccacctacgggctatgagcactagaggccattgaaggtttgagaatcaattccagatcttgctttgttggtgttgtccgtgtttaagatttcccttttggactgtcatcaacaactctgggacagcttgggcaagaaaaatggtgaaattgaccatgattgctcgtgttactgatggccttccactagtggaggggctagatgatggccgagatatgccagatgcagatttctacaagaagcaggccaaggccttattcacaaacctgtcaaggggccagaatgagccttctagaatgtctgtagagactggcccttatatcttccattacatcattgaaggacgtgtttgttatttgatgatgtgtgaccgtgcttatcctaagaagcttgcctttcaatatctggaagatcttaagagtgagtttgaacgcctaaatggaagtcaaattgaaactgcagccagaccttatgctttcataaagtttgatacatttatacagaaaacaaagaaattgtaccaagacacgagaactcaacggaatatagcaaagctgaacgatgaactttatgaagtacaccagataatgactcgcaatgttcaagaagttcttggagttggtgaaaagttggaccaggtcagccagatgtctagccgcttgacttcagaatctcgtatatatgctgacaaggcaaaagatttgaatcatcaggctttgattcgtaaatgggcacctgttgctattgttcttggtgttgtcatcctcctcttttgggtgaaaaataagatttggtgatggtgcattgtaatcgcacaaggatgctcatgagactcggatttctcaccctgcattaacagatccaaaggagagagctgcaaggcatttttaatatttctctgatagttcattatgatcattattgtcctcatagttattttactgaagtttttgaagcagaaaatcaggctttgtcatgaatagacagataattaagaaacatattaagaactcttgggagctcactaccatatcgggttcataaagatttcattacggtatctgttcgattttgtatccatctttacaatctctacatgtagcacttgttcttctactgcatttggatcataaatttgaatttctaattgattccgaacaggtcttcaagcttgacacatcatacaaggt

SEQ ID NO: 8716 - DNA, 1279 bp, Solanum lycopersicum
atttcatataaaaaatatacgtacttttgaagacgggtatttacccaattccctgaatccgatcccaattcccattcattacaatcttcatttcgctgtaaccgatcggagttcacgagaggttgatacaaaatcggaaaccggcgatcggaagttcaacagatcaaccaacaaaggctgcaccgacgtgaatgatagttgtttgcttgtttaaggaagatggtgaagttgactatgattgctcgtgtgactgatggccttccattagctgaggggctggatgatagccgtgatgttccagatgcagattactacaaacagcaagtgaagtccttattcaagaacctttctatgggccataatgaggcatcaaggatgtccattgaaagtggaccttacattttccactatataattgaagggcgcgtttgctatctgacaatgtgtgatcgctcttatccaaagaaacttgcctttcagtacctagaagaccttaagaatgagtttgagcgtgtcaatgggagtcaaattgaaactgctgctagaccttatgcctttatcaaatttgatacattcatacagaagacgaagaaactgtaccaggataccagaactcaacgcaatgttgcaaagttgaatgatgaactttatgaagttcatcagataatgactcgaaatgtacaagaagttcttggtgttggtgaaaaattggaccaggtcagtcagatgtccagccgcttgacatcagaatcccgcatatatgctgataaggcaagagatttgaatcgtcaggctctgatacggaagtgggctcctgttgctattgtcattggagttgttagtcttctcttctgggctaaaagcaagatttggtgatgctgccatcaaatgtacagcttagaaatgatgttactccagcatcggtcagtgggcaactgacaagaccacagtggccttagttttctgaggatggggagactgaagaaatgtcagtttgataatgtagaacaggggatgtgaaccatgactaccgaatgttgctaatacttgagaaatgatatttaatatgaatcccagcatgtacttttcttgataatcaaccacaaaacttgccttccgataggtatttgtaattctgaaatgctgttttagctactttagtatatgtttgtaaattacagtggtagcctcattcgttgtctactattttgattcattccgtagaagtgcatgaacataaattctgaatatgttaccaaattagacctgtcattccaaa

SEQ ID NO: 8717 - DNA, 1150 bp, Heritiera littoralis
gattgttagatgaaatccctgttttcaactctctctctttccatttattttcacctcctaagacttgtcggaccatcggtcgttttaccttcctcagatcgttgaaatcaagaagaaatccaacaacccacatgctatttaatcagtttgaagggattttgtgtagctgagaagtaggggagtaagatggtgaagatgacaatgattgctcgtgtgactgatggtcttcctctggcggagggactagatgatggtcgtgatctggtagatgctgaaatgtacaaacaacaagttaaggctttgtttaagaatctctccaaaggccagaatgaggcttcaaggatgtctgttgaaactggcccttatgtattccactatatcattgaagggcatgtttgttacttgacaatgtgtgaccgttcttatcctaagaaacttgcctttcaatacttggaagaccttaggaatgaatttgagcgtgttaatggagctcaaattgaaacagcagccaggccttatgcctttattaaatttgatacattcatacagaagacaaaaaattgtaccaggacacccgtactcaacggaatattgcaaagttgaatgatgaactctatgaggttcaccaaataatgactcgcaatgttcaagaagttcttggtgttggtgaaaagttggatcaggttagtcaaatgtccagtcgtttgacatcggaatctcgtatatatgctgacaaggcaaaagatttaaatcgtcaggctttaattcggaagtgggctcctgttgccattgtgttaggagttgtcttcctcctcttctgggtgaaatcaaagttatggtgattcaactgcgcttcttagttttaagaactcatcatggaatttcttgggttcctctttgttgctgtgggtagcttgtgcacacctcggagaccatcactggaatgaattctggtttgttcatcacacaatttgggaaggcagagggacaaatttgcaatgtggaattttgaaagagagaccctaccttaagagcatatgttcaagacaactattctttctatatgtaaaagccagaagaattcaaccgcaaatagtaaactactaaaaagcttcttgtggtaattattttaagtactagcacattaatt

SEQ ID NO: 8718 - DNA, 1019 bp, Zostera marina
catgattcgagagtcgattattgatacctctcatctttagacctccctattttccaaatctgcaagccatcactgtgcctgccgtattcatcccactgcaccaagaaacaccggagttacgaaagtcaactgataaagatggtgaaattgacaatgatagcacgtgttactgatggtcttgctctggcagaaggtttagacgatggccgtgatcaaaaggacgctgaattctataagcagcaggctaagcttttgtttaagaatctttctaaaggacagtatgaagcttcaagaatgtctattgaaactgattctaatttcttccactatatcattgaaggccgtgtgtgttacttgaccatgtgtgatcgttcttaccctaagaaacttgcttttcaataccttgaagatttaaaaacgaatttgagaaagtcaatggagatcaaattgagactgctgcaagaccctatgcctttgtcaaatttgattctttcattcagaagacaaagaagttgtacttggacacacgtacacaacgtaatattacaaagttaaatgatgaactatatgaagtccatcagataatgacgcgtaatgttcaagaagttctaggtgttggtgaaaaattagatcatgtcagtgaaatgtcaagtagattgacatcagaatctcgcgcatatgctgacaaggcaaaggatctaaataggcaggcattgatccgtaagtgggcacctgttgcaattgtgattggagtggtttttctacttttctgggttaaaagcaagatctggtgatcttctggattaagattaccaggagattcttgcttggtattgctgtggcctgtttgcatgtgtgccgaaattttgtgatattttcagaatattctcctacaccttatggctcaactacgtgctggagttttatgtcactctttattcttcaatcttcaacccttggttttcatttggacatttttgattgttgagggaactagattgtagaatagctgtgcacag

SEQ ID NO: 8719 - DNA, 1574 bp, Conyza canadensis
gttttcttcttcaacttaactctcccctggccctcctccttaactaacaagttaacaatataaatccatccccaatttattccagcaatcaatcaaatttccttccaaaaccctaaaattttcatctcttcataatttttaacagcttttgtttttccttatcattctcattattcgctcaccgattattgcagattaaacaaacttctacctaatttaacgcatgattgttattgttaatccttgaattctaatttccggtgctactttttcaaggtaaaaatggtgaagttgacaatgattgctcgtgttattgatgggcttccactagctgaaggactggatgatgggcgtgatttgcaggatgcagagttttataaacagcaagttaaggctttgttcaagaacctttcaagaggacaaaatgaagcgtcccggatgtctatagaaaccgggccttacattttccactatattattgaagggcgggtatgttatttgacaatgtgtgatcgagcttacccaaaaaagcttgcttttcaatatctcgaagatctcaagaatgaatttgagcgtggttatgggaatcaaattgaaactgcagcaagaccttatgcttttataaaatttgatacatttatacagaggactaagaaattgtaccaggacactagaactcaacggaatattgccaaattgaatgacgaactttatgaagtgcaccaagttatgactcgtaatgtgcaggaagttcttggtgttggtgaaaaactggaccaggtcagtcaaatgtcaagtcgattaacctcagaatctcgtatctatgctgacaaagctaaagatctaaatagacaggcttttattcggaaatgggcaccagttgcgattgtccttggaatagtcattctactcttttgggtcaaaaataagatttggtgatcatggcttcttttgtctgagaaaacatgttaattgtatcccattgtatttgggcaattgagtgatttgttcttggacaacttattaatacaagaaaccaatcgacccttgaacagggagtttagactgtggccatattttcaacatagtaactagcaacagtatattggaggttaaaagatcaagtaatggggaaagtaattactttatttatactgagatttgttatggtgttgtgtgatgttaatactccctctcttgtttgatagcttacaccattttgcaaccagtgaatgatgtttactagtaggctatcattgatgaatcactcccaaccgtattaaagcaaaaatgtgaatgaaacccagaagatttatgttggtgttttggtatcaaagaataactatcagcacatttaaaatgttagcctagcaagttgatatggactaaacaaatttcaattcatttagcatactagattatgtatccagtcaattgtcaataggttattttctattgcatataaaattttatcaccatttaagcagatgcagctggtactagttagcaaaagaagtcgatcttgcctgagtgttctattcgaaataaagagactgtttttagaaagcctagcg

SEQ ID NO: 8720 - DNA, 1044 bp, Rosmarinus officinalis
atagtgaggcctcggaaaacccccgaacctccctctttaatatattctctttctagggatcagaagccgctgccaatctccgtcgagatcaccatcggaatacaccagttgcgccaccacttccaccaccttgaagtataggcgacagcttgtggaagaaagatggtgaagttgataatgattgctcgtgttactgatggtcttccgctagtggaggggctcgatgatggccgggatatgccagatgcagatttctacaagaagcaggccaaggccttatttgcaaacctctcaaggggcctaaatgatccttctagaatgtctattgagactggctcttatatgttccattacattattgaaggacgcgtttgttatttgactatgtgtgaccgtgcttatcctaagaagcttgcctttcaatatttggaagatcttaagaatgaatttgaacgtgtaaatggaagtcaaattgaaactgccgctaggccatatgctttcataaagtttgatacatttatacagaaaacaaagaaattgtaccaagacacaagaactcaacggaatatagcaaagctgaatgatgaactttacgaagtacaccaaataatgactcgcaatgttcaagaagttcttggtgttggtgaaaagttggaccaggtcagtcagatgtctagccgcttgacttcagaatctcgcatatatgctgacaaagcaaaagatttgaatcgtcaggctttgattcgtaaatgggcacctgttgctattgtccttggtgttgtcatgctcctcttttgggtgaaaaacaagatttggtgatgctgcacaacgagtccctgcttgcgaacttcattgacacatctgaggaaggagctgcaagttcttttagtatatccattgtgctcattaatgtctcccatagttgttacactgtagagtttttgaagtggagaaatcaggccttgtcctgaacggaaaacgatgaaggagcaagttcatattgacaactcaattcctgtagtgttcatactgatttctaccgta

SEQ ID NO: 8721 - DNA, 1168 bp, Gossypium hirsutum
acctctctttctctctccttttagtttttgcctctttaagtcgtgtcggaccatcgaccgtttcctgtgcttcagatcgttgaaatcgaggagaaaatccgaagatccatattctataatcagtttgaagggactttgtcttagctgagaaataggggggtaaagatggtaaagatgacaacgattgcccgtgttactgatggtctgcctctggcggagggactagatgatggtcgtgatctggtagatgctgaaatgtacaaacagcaagttaaggctttatttaagaatctctccaaaggccataatgaggcttcaaggatgtctattgaaaccggcccatatgtattccactatatcattgaaggacgtgtttgttacttgacaatgtgcgaccgatcttatcctaagaaacttgcctttcaatatctggaagacctcaagaatgaatttgagcgtgttaatggagctcaaattgaaacggctgccaggccttacgcctttataaaatttgacacattcatacagaagacaaaaaagttgtaccaggacacccgtactcaacggaatattgcaaagttgaatgacgaactctatgaagttcaccaaataatgactcgcaatgtacaagaagttctcggtgttggtgaaaagttggaccaggtcagccaaatgtccagtcgtttgacatcagaatctcgcatatatgctgacaaggcaagagatttaaatagacaggctttgattcgaaagtgggctcctgttgccattgtgttgggagttgtgttcctcctcttctgggtgaaagcaaagttatggtgattcaactgtgatccatagtgttaagaactcatcagaatttcttgggtttctctgttgctgagtagcctcttgtccacacccaagaccaaatattggagtgcattccggtttttattcatcttacaattcgcctcgtaggtacaattacaaatttgcaatgtggaattgtgtgaaagggagcatatgttcaaaacaaaaactattctttctatatgtaaaagccagaatacaacatccaaatcgggaactttaaaggtattaacctattcactttgtccaaggttttagataattaacgtgctgagccaccacctgtttgtactacctatatttgagatggaaaacc

SEQ ID NO: 8722 - DNA, 1375 bp, Gossypium hirsutum
cttcggagttcgcacggcaatctcaaaggtacaatacgctgataacacgacaccctctaaaaagcctattctatttaatttcctattttatttgattttataataaaaatcctattcttaacgccctcactttccatttatttccatctcattaagacttgtcggaccaccggtcgtttccccttcctcagatcgttgaaatcaaggagaaatccgaagacctacatgctctaatcagtttgaagggattttgtgaaagctgagaaaaaggggagtaaagatggtgaaactgacaatgattgctcgtgttactgatggtcttcctctggcggagggactagatgatggtcgggatctgacagatgccgaaatgtacaaacaacaagttaaggctttgtttaagaatctctctaaaggccataatgaagcttcaaggatgtctgtcgagactggtccttatgtattccactatatcattgaaggtcgtgtttgttacttgacaatgtgtgaccgttcttatcctaagaaacttgcttttcaatatctggaagacctcaagaatgaatttgaacgtgttaatggagctcaaattgaaactgctgccaggccttatgcatttattaaatttgatacattcatacagaagacaaaaaaattataccaggacacccgtactcaacggaatatttcaaagttgaacgatgaactctacgaagttcaccaaataatgactcgcaatgtgcaagaagttcttggtgttggtgaaaagttggaccaggtcagtcagatgtccagtcgtttgacgtcggaatctcgcatatatgctgataaggcgagagacttaaatcgacaggctttaattcggaagtgggctccggttgccatcgtgttaggagtcgtgttcctcctcttttgggtgaaagcaaagctgtggtgatttcaaccgtgcttcatggttttaacaactcatcatcaagtttcttaggtttctctgttttgctgtgggtagcttgttgtccacacccagagaccaaacattggagtgagttatggttttttgttcatcatactattcggcaaagtatagggacggatttgcaatgtggaattgtgaaggagagaccctaccttaagagcatatgttcaaagacaaaactattctttcaatatgtcaaaagccagaatagaacaacaaatagtaaactagttaaaagaaagccttttgtggtaattaatttaaattctagcacatctagtgtctattttctctttaatgcttggcccgccacgaacatgagcaggatttatgttgaagattaagataatgtcaatttagtttttactgcatgaaatagccaaatctcctcatcatgat

SEQ ID NO: 8723 - DNA, 1371 bp, Gossypium raimondii
cagacggcattgtacctttgaaacttcggagttcgcacggcaatctcaaaggtacaatcgctgataacacgacactctcaaaaagccatcatttaatttcctatttttatttgattttataaataaaaatcctattcttaacgccctcactttccatttatttccatctcattaagacttgtcggaccaccggtcgtttccccttcctcagatcgttgaaatcaaggagaaatccgaagacctacatgctctaatcagtttgaagggattttgtgaaagctgagaaaaaggggagtaaagatggtgaaactgacaatgattgctcgtgttactgatggtcttcctctggcggagggactagatgatggtcgggatctgacagatgccgaaatgtacaaacaacaagttaaggctttgtttaagaatctctctaaaggccataatgaagcttcaaggatgtctgtcgagactggtccttatgtattccactatatcattgaaggtcgtgtttgttacttgacaatgtgtgaccgttcttatcctaagaaacttgcttttcaatatctggaagacctcaagaatgaatttgaacgtgttaatggagctcaaattgaaactgctgccaggccttatgcatttattaaatttgatacattcatacagaagacaaaaaaattataccaggacacccgtactcaacggaatatttcaaagttgaatgatgaactctatgaagttcaccaaataatgactcgcaatgtgcaagaagttcttggtgttggtgaaaagttggaccaggtcagtcagatgtccagtcgtttgacgtcggaatctcgcatatatgctgataaggcgagagacttaaatcgacaggctttaattcggaagtgggctccggttgccatcgtgttaggagttgtgttcctcctcttttgggtgaaagcaaagctgtggtgatttcaaccgtgcttcatggttttaacaactcatcatcaagtttcttaggtttctctgttttgctgtgggtagcttgttgtccacacccagagatcaaacattggagtgagttatggttttttgttcatcatacaattcggcaaagtatagggacggatttgcaatgtggaattgtgaaggagagaccctaccttaagagcatatgttcaaagacaaaactattctttcaatatgtcaaaagccagaatagaacaacaaatagtaaactagttaaaagaaagccttttgtggtaattaatttaaattctagcacatctagtgtctattttctctttaatgcttggcccgccacgaacatgagcaggatttatgttgaagattaagataatatcaatttagtttttactgcatgaa

SEQ ID NO: 8724 - DNA, 1013 bp, Actinidia deliciosa
gagtctggagttgttgcaaaaccctatttaagctttctctgtcttcaatccaatcgcgctcattgtagtaaccgttgctcagatcgttgaattgaaatccaaatgaaggccagaatccagatgcttcttcaatttgaatagcaattctaagacaagatctgaacgaatcgatgcatatacatatccgtgtataaagatatacgcatgagagccaagagtgtttgaagtaaagatggtgaagctgacaatgattgctcgtgttaccgatgggcttcctctagcagaaggactggatgacggccgtgattggcaagatgctgagctctacaaacagcaaatcaaggctttgttcaagaacctttcaagaggccagaatgagccttcaagaatgtcagttgaaaccgggccatacatttttcattatattattgaaggacgagtttgttatttgacaatgtgtgatcgtgcatatccaaagaaacttgcttttcagtacctggaagaccttaaaaatgagtttgaacgtgttaatggcagtcaaattgaaactgcagctaggccttatgctttcataaaatttgatacattcatacagaaaacaaagaaactgtaccaggacacgcgaactcagcggaatatttcaaagctgaacgatgaactctatgaagttcatcaaattatgactcgcaatgtacaggaagttctgggtgttggtgaaaagttggaccaggttagtcaaatgtctagccgcttgacatcagaatctcgcatatatgctgataaggcgagagatttaaatcgacaggctttgatacggaagtgggcccccgttgcaattgtcatcggagttgtcatccttctcttttgggtgagaaagaaaatttggtgatctaccgtccacttgcagtttccaagctttgttctagttcctccaagttgcttgtgagaattcttcacactagagacttcatatgggtgccagatcctccccaacgtttaaaatatatcatctt

SEQ ID NO: 8725 - DNA, 954 bp, Liriodendron tulipifera
ctcctcctgctcaacccaaccgacgttgaaatcacggatccgacgattccgacaatgaacggtcgggatgctagtgcttgaggatgcatggaaaaagagactccagaggtgattgacaattatattctaccaactcttctgtaattcgaaggctgcatagaaaagatggtgaagctgacaatgatagctcgggttactgatgggcttccattagctgaaggactggatgatggtcgtgatcagaaagatgctgaattctacaaccaacaggctaactctttgttcaagaatctctcaaagggccacaacgaagcatcaagaatgtccattgaaactggtccttatgttttccactacattattgaaggccgtgtatgttatttaaccatgtgtgatcgttcttatccgaagaaacttgcatttcaatacctggaagacctcaaaaacgaatttgagaaagtcaatgagagtcaaatagaaactgctgcaaggccttatgcttttatcaaatttgatacattcatacagaagaccaagaaattatacttggacacccgtactcagaggaaccttgcaaagttaaatgatgaactttatgaagtccaccaaatcatgactcgcaatatacaagaagttcttggtgttggtgaaaaattggaccaggtcagccaactgtcaagccgattgacatctgaatctcgcatctatgccgataaggcaaaagatctaaatcgacaggccttcattcggaagtgggcacctgtcgccattgtgcttggcgctgtcttccttctcttttggggcagaaagaagatatggtgatttctacttgtgacaatttcatactctttgagtgatctggactggtctctgtcattcacagaaggggtgatggcatttttggtcatgctctctggacactgcaaaacaggctgcttccatggcgatcaattg

SEQ ID NO: 8726 - DNA, 1124 bp, Allium cepa
ggtcgtgcgatttacacgggttgcgatccagttcagctcttggatagggaaggctgcgatccttccaaatcgtgttttgggacatggtgaaactgacgatgatagcacgagttactgatggccttccattagcagaagggttagatgatagtcgcgatgtaaaagatgctgatttttacaagcagcaagcaaaacttttgttcaagaatttgtctaaaggacacaatgaggcttcacggatgtcaattgaaaccgggaattactatttccattatatcattgagggccgtgtttgttacttgacaatgtgtgaaagaggatatccaaagaaacttgcttttcaatacctagaagacctcaagaatgaatttgagaaagtggacgggaatcagattgagactgctgctaggccatatgcgttcatcaagttcgatacttttatccagaagactaagaagctctactcagatacgcgcacacaaaggaaccttgcaaagttaaatgacgagctttatgaagtccatcagataatgactagaaatgtccaagaagtgcttggtgttggcgaaaaactagaccaggtgagtgaaatgtcaagtagattgacatatgaatcccgcacctatgcggataaggctaaagacttgaatagacaggccttaattaggaagtgggcgccagttgcaattgtgctaggggtggtcatgcttctcttctgggtcagaaagaagatatattgattctccctaagctttaccttgctttttacaggaagtaaaccaaaatattagtcattacctacctcgaactgagcgcctcgagcatgtccaggtttcatcgtaaagtttttccctttattgtggatatgagaccgaattatttgtccatttcttcagaatatatttcttgattatactaaaccttttagttttgatataaactgcttatattcttttgaatatccctagttctgctattttatttttcattaatggatgttgcataaagtttctgtatgccaatcttcatgtgctagcacttgttgatacatgttttccttgagaaatgctggaagcaaaatttattagactatggtgtatataatacagggatttacatagagc

SEQ ID NO: 8727 - DNA, 1008 bp, Primula obconica
aggagtaagactaatttctcagccctctttctctcattatacaatctcaaaagcgtaaagcttctccgttttgctatagtaatcaataaagcttgtgaagtgaaaagagatggtgaagctgacaatgattgctcgtgttactgatgggcttcctttgtctgagggactagatgatggccgtgaactacaggaagctgaccaatacaaacagcaagtgaagcagttgttcaaaaacctttcaagaggccagaatgagccttcgaggatgtctgtagaaactggtccatacattttccactatattattgaaggacgggtttgttatttgactatgtgcgaccgttcctatccaaagaaacttgcttttcaatacctagaagaccttaagaacgagttcgaacgagttaatggggatcaaatcgaaactgcagctcgaccatatgccttcataaaatttgatacgttcatccagaaaacaaagaaactgtaccaggatactcggactcagcgaaacattgcaaagctgaatgatgaactttatgaagttcaccaaattatgactcgcaatgtgcaagaagttttgggtgtgggtgaaaagttggaccaggtcagtgaaatgtctagccgattgacctcagaatctcgcatatacgctgacaaggcgaaagatttaaatcgacaggctttgattaggaagtgggctcctgttgcaattgtcttgggagttgtaatcctcctcttttgggtgaagagaaaaatatggtgatcaattgtagttttcaagttttataatatgttatccccaagcggcatatgtgaattttcggatacatcacagaagtatatctttgaaggtggacaccagttttttattattattatgggagaattaagaaggatgttgttctgtattattttggtgtatgggaactaagcaggctgtaggtgagattgatgtagagaccctgatgacgggactccgaaccttgatagagaattatattactt

SEQ ID NO: 8728 - DNA, 1075 bp, Rhizophora mangle
tctacctatctgtctctctctacctctctctcctttcacgcacacacagatttggccatcagcatcaccgtgtttcttcctcggatccttgaagcacagagccagagggaaaagatccagatgctataatcagttatcctgcaaacctgaggaagtgcagacataaagatggtgaagttgactatgattgctcgtgtcactgatgggctacctttggctgagggactggacgatggtcgtgatatcaaggatgctgaaatgtacaaacagcaagtcaaggcactatttaagaaccttgcaacacgccagaatgagccttcaaggatgtccattgaaactggcccttatatcttccattatatcattgaaggacgcgtgtgttaccttaccatgtgtgaccgttcatatccaaagaaactagctttccaatacctggaggatctcaagaatgaatttgagcgtgtcaatggagttcaaattgaaactgctgctagaccttatgccttcattaaatttgatactttcatacagaaaaccaagaaattgtaccaggatacccgtactcagcggaacattgcaaagctgaatgatgaactttatgaagtacaccaaattatgactcgtaatgtgcaggaagtgcttggtgttggtgaaaagcttgaccaggtcagtgaaatgtcaagtcgattaacatcggaatctcgcatctatgctgacaaggctagagatttgaatcggcaggcattgattcgtaaatgggcaccggttgctattgtgttgggagttgttttcctcctcttctgggttaaaacaaagatctggtgatccagttgcttttgtggttatggaaattcatcatttctctgggtttctctgcattgccaccaccggtttgatggtcatcatggacaattgtccgaacttcatagactttatcatcttgtttcaaggagtagttaacgaggttaaagacagttgtgtttccacatgaagactctgtctgattgtgggccagacatacccaaagacttgatcatgtttcgaggtggggtttggttttttgtcttttaggcac

SEQ ID NO: 8729 - DNA, 928 bp, Tabernaemontana elegans
tctctctctttttcgtcgggacttagaagacgcagccaatctccgccgcgatcaccgtcgaagaacacctgttacgccatcgctgccaccttcgaggctatagcttgtggaagaaagatggtgaagttaaccatgattgctcgtgtcactgatggccttccactagtggaggggctagacgatggccgggatgtgccagatgcagatttctacaagaagcaagccaaggccatattcacaaacctctcaaggggcctgaatgatccttctagaatgtctattgagactgggtcttatatgttccattacattattgaaggacgcgtttgttatttgacaatgtgtgaccgtgcttatcctaagaagcttgcttttcaatatctggaagatcttaagaatgaatttgaacgtgtaaatggaagtcaaattgaaactgctgctagaccctatgctttcataaagtttgatacatttatacagaaaacaaagaaattgtaccaagacacaagaactcaacggaacatagcaaagctaaatgatgaactctatgaagtacaccagataatgacccgcaatgttcaagaagttcttggtgttggtgaaaagttggatcaggtcagtcagatgtctagccggttgacttcagaatctcgcatttacgctgacaaggcaaaagacttgaaccgtcaggctttgattcgtaaatgggcacctgttgctattgttcttggtgttgtgatcctcctcttttgggtgaaaaacaagatttggtgatgctgcataatgagtctctgcttgtccacccttcattgacgcatccaaggagagagctgcaagcattttaagacatcaccatgttcattgatgtctttatagcagttctagagtagtttttgaagtggagaaatcaggctttatcaagacagaa

SEQ ID NO: 8730 - DNA, 1295 bp, Citrullus lanatus
tttgtctaaagcacattttgcatatttgacttgtggcgagagcaatggctccattttaggagactcgatcggattctgagctgcacacaccgcggacagtaatccaattcccatcgaattcctgtcctttcacgaaccctacctttgcccctttccacaatctttcttttcagattcctccatcgtcatcacgtttccttggatctttgaagagaaccccccaatgatatagcctgttgggggacatatcaaacaaagatggtgaagcttacaatgattgcccgtgttactgatggtcttcctctagcagagggactggatgatggccgtgatatgcaagatgcagaattctacaagcagcaagtgaaggctctgtttaagaacttatcgagaggtcaaaatgaggcttcaagaatgtctatcgagacaggcccatatgtttttcactatataattgaaggaagggtctgttatttgactatgtgtgatcgtgcttatccaaaaaaacttgcctttcaataccttgaagacttgaagaatgaatttgaacgtgtcaatggggctcaaattgaaactgctgctaggccttatgcattcattaaatttgatacatacatacagaagaccaagaaattgtaccaggatacccgcactcaacgtaatattgcgaagttgaatgatgaactttacgaagtccaccagataatgacccgcaatgttcaggaagttcttggtgttggtgaaaagttagatcaggtcagtcaaatgtcaagtaggttgacttcagaatcccgcatatatgccgacaaggcgagagatctgaaccggcaggctttaattcgaaagtgggctcctgttgctattgtgtttggagttgtattcctcctattctggttcaaatcaaagatctggtgatttagttggtgttccagttaatctttttaactcattttcaggcttctctttgcttttagctttggcttaatgggttcagatatcagagacttgaaactgggctagagatgatttctagatttttcttaatggctaagatggaatcagaaaaatagtgttttggttacctccaagtgggggcggtgctgcctgtacaagtgtaagagcggtgttaaacttagtattccagattaagtagacaaaacatgttattcacattttggttacctcttcctcccaatatacattttttgttccttatacattaaagaaaaaataccattatatttattatattagtctatcttcctttggcataattcatgtggactacttaagat

SEQ ID NO: 8731 - DNA, 1176 bp, Rosmarinus officinalis
cattttcctgtcaccgttaaaaattggaacagctttagttcacgccctctcataatatcagtcaaatttggacaacatctcattactctcatttcttccattggctctgattgttatcacgatcttttgttgagatcgttcgaattttgagcgcatacctatttcaagggcacaattttgtaattgttgaaccttattgaagatcgagggttcacgaaagcacaacggaaagagctcacagacgcatgtcaaaggtgtgagctcaagaaataacaatggtcaagttgactatgatcgctcgtgttactgatggccttccattagcggagggactggatgatggacgtgacgtgtcagatgccgacttttataaacagcaagtgaagtcattgttcaaaaatctgtcaaagggccagaatgagccatcaaggatgtctatcgaaacagggccctatatatttcattatattattgaagggcgtgtgtgctacttgacaatgtgcgaccgtgcttatcctaagaagctttccttccaatatctagaagacctcaagaatgaatttgagcgtgcatatgggaatcagatcgaaactgctgcaagaccttatgcatttatcaaatttgacacattcatacagaagacgaagaaattgtaccaggacacaagaactcaacgaaatatttcaaagttgaatgatgaactctatgaagttcaccagattatgactcgcaatgtacaggaagttcttggtgttggtgaaaagttggaccaggtcagccagatgtccagtcgcttaacatcagaatcccgcatttatgcagagaaggcaaaagacttgaaccgccaggctttgattcggaaatgggcccccgttgctgttgttctaggagttgtgtttctcctattctgggtcaagaacaagctttggtgatccttcacctgtttgctgtttgatgagctctgatctggtcttgccattgcgtattgcagtttcttggcgcattctatcattttatcttttgaaccatcagaaaggatctgtcgctacgaccttccaaatttttgaggattttggaaactaagcatgtcggaaaatatagagatttcttactgtgagacgaattgattttaacatttctgagaaacatatagcctatgcgttttatcttcctaca

SEQ ID NO: 8732 - DNA, 1007 bp, Amsonia hubrichtii
tattctctttctcggactcaggagacgctgccaatctccgctgggatcaccatcggcatacaccagttgcgccaccactgctaccttgaagcaacagctcgtggaagaaagatggtaaaattgaccctgattgctcgtgttactgatggccttcccctagcggaggggctagatgatggccgggatattccagatccagatttctacaagaagcaggccaaggccttattcacaaacctctcaagaggcctgaatgatccttctagaatgtctattgagactggcccttacatgttccattacatcattgaaggacgtgtatgttatttgacaatgtgtgaccgtgcttatcctaagaagcttgcttttcaatatctggaagatcttaagaatgaatttgaacgtgtaaatggaagtcaaattgaaactgctgctagaccttatgctttcataaagtttgatgcattcatacagaaaacaaagaaattgtacaaagacacgggaactcaacggaatatagcaaagctgaatgatgaactttatgaagtgcaccagataatgacacgcaatgttcaagaagttcttggtgttggtgaaaagttggatcaggtcagtcagatgtctagccgtttgacttcagaatctcgcatgtatgctgacaaggcaaaagatttgaatcgtcaggctttgattcgtcaatgggcacctgttgccattgtccttggtattgtcacgctcctctattgggtgaaaaacaagatttggtgatgccgcataacgagtactttcccaccctttgttgacacatccaaaaggagggagctgcaagcatttttagtatatctctgatgttccattatgtccactaatgtctttcatagttgttataaagtttagttttgaagtcaagaaaaacaatgaagatgcaaattcatattgacaacactagggatctcattaccccggtagggttcatacagatttcgttaccatgtctgttcaatatt

SEQ ID NO: 8733 - DNA, 1151 bp, Malus domestica
gggatcgtagattaaactcgaataatcaaccctcatttactccgtttggtccccgaaactccccttccacatcttctctcaattcttctcgctcagattgcaccatcgtcctcaccgttcctcagatcaatgctataaacggttttcgcattgctgggaagttgtgaagtgaagatggtgaagctgacaatgattgctcgtgttactgatggtcttccactagcagagggactggatgatggccgtgatgtaaaagactcggaattctacaaacaacaagtcaaggctttattcaagaacttgtcaagaggccaaaatgagccttcaaggatgtcagttgaaactggtccttttgttttccactatatcatcgaaggacgtgtgtgttacttaacaatgtgcgaccgtgcctatccaaagaaacttgccttccaataccttgaagatctcaagaatgaatttgagcgtgttaacgggacccaaattgaaactgctgcaaggccttatgcattcattaaatttgatacattcatacagaaaacaaagaaattgtaccaggacactcgcactcagaggaatattgcaaagttgaatgatgagctctatgaagtccaccaaataatgactcgcaatgttcaggaagtgcttggtgttggtgaaaagttggaccaggttagtcaaatgtccagccgtttaacatcagaatctcgtgtgtatgctgataaagcgagagatttgaatcgacaggctctgatccgaaagtatgcacctattgccattgtgcttggagtggttttcctccttttctgggtcaaaacaaagctctggtgatcaaactgcctcatctatgttctgaatttgtgacgattttgacgggcttctgtttgttgcggtggactgcttccattccattccagacttgggaacttcagattggctgccttatcctcatgaaagatttaaatgatgttttggggttacttttgttggtcacgcggagtttgattgggaaaattaattctgtaagaacctctgcttatggggacatatccacccttatgaaagagacccctcaaaagaacaaattgagtcgtgggatcttatcagtcgtcatactactaagtaaaagggaatagattttgtcaagttca

SEQ ID NO: 8734 - DNA, 1179 bp, Aquilegia formosa
aacaaagcattttgtaccaacaaacacttttctcttctctttttattgctcaaattcaatttcatcttctcttctcaaattttctctaataaaccctaaaactcatctcttttagctttcaacatttctattataaaccctagaaactatagaagagaagaagatctaatctgtacgaagagaaacacagatcaaaccgaatcaaagaaagagtcagagatggtgaagttgacaatgatagcccgtgtgacagatggcctaccattagcagaaggcttggaagatggtcgtgatcagcaagatgcagacttctacaaacagcaggccaaagctttattcaaaaatctgtcaaaaggccagaatcatccatcaagaatgtcaattgaaacaggtccttatgtttttcactatataattgagggtcatgtttgttacttgacaatgtgtgatcgttcttatccaaagaagcttgcttttcaatatctggaggatctaaaaaatgagtttgaaaaagttgatggaagtcaaattgaaactgctgccaggccctatgcctttattaaatttgatgcattcatacagaagactaagaaactgtatttggacacccgtacgcagcggaaccttgcaaagttgaatgatgaactatatgaagtacatcaaataatgacacgaaatgtgcaagaagttcttggtgttggtgaaaagctggatcaggtcagtcaaatgtcaagcaggttgacatccgagtctcgtgtttatgctgagaaggcgagagatttgaatcgacaggcttttattcggaaatgggcccctgttgccattgtgctcggagttgtttttatcctgttttgggtcagaaagcagatttggtgattcagttactggtgcgatatttgcaagcctttcgtcagcaatggtggttgcaagtctttctgatttttcatttcagaagcattctggagaccatctatattgggcacttcactactgtatctgttgatgtaaagttactgctcaccatgaacaaagataagattttgcttacagacatagcataccctaagcaaacgtcggcatcatatctgagaattgtgagttgggggatagttgtgacaaatgtagttgaattttatattaggcttgagggcatcatacactgaagtttatatattacca

SEQ ID NO: 8735 - DNA, 1302 bp, Theobroma cacao
gccatcatttattttgtctattttctttcttataataaaacccctatttttaacgttctctttcccttttccccttatttcaacctcctaagtcttgtcggaccatcggtcgtttcgccttcctcagatcgttgaattcaagaagaaatccaaagacccacatgctataaccagtttgaagggattttgtgtagctgagaaatagggagtaaagatggtgaagatgacaatgattgctcgtgttactgatggtcttcctctggcggagggactggatgatggtcgtgatctcaaagatgctgaaatgtacaaacagcaagtcaaggctttgtttaagaatctctccaaaggccagaatgaggcttcaaggatgtctattgaaactggcccatatgtgtttcactatatcattgaaggacgtgtttgttacttgacaatgtgtgaccgtgcttatcctaagaaacttgcctttcaatatctggaagacctcaggaatgaatttgagcgtgttaatggagctcatattgagacagctgccaggccttatgcctttattaaatttgatacattcatacagaagacaaaaaaattgtaccaggacacccgtactcagcggaatattgcaaagttgaatgatgaactctatgaagttcaccaaataatgactcgcaatgtacaagaagttcttggtgttggtgaaaagttggaccaggtcagtcaaatgtccagtcgtttgacatcagaatctcgcatctatgccgacaaggcaagagatttaaatcgacaggctttaattcggaagtgggctcctgttgctgttgtgttaggagttgttttcctcctcttctgggtgaaagcaaagctatggtgactcaactgtgcttcatagttttaagaactcatcatggaatttcttgggtttctctgcattgctgtggatagcttgttgtccacacctcggagaccaaaaattgaagtgaattctggtttttgttcatcacacaattcggcgaagcatagggacaagttcgcgatgtggaattgtgaaagagagaccctcccttaagagcatatgttgaaagacaaaactattcttttctacatgtaaaagccggaacacaatagcaaatagtaaactactcaaaagcttcttgtcctaattattttaagtactagaacattattgccattttgttttgatggacttactagcttttaattactcttaatccatggcaaaaatgaggcaagatctacgaagaggatctagtaagatatattaaaagtagttcttattctatg

SEQ ID NO: 8736 - DNA, 754 bp, Brassica napus
agatggtgaaaatgacattgatagctcgtgttaccgacgggctgcctctagctgagggtctcgatgatggacgtgacttacctgattccgacatgtataagcaacaggtcaagtctctgtttaagaatctttccagaggtcataacgaagcttcaagaatgtctgttgagactggcccttatattttccattacatcatagaaggacgtgtctgctacttgacaatgtgtgaccgctcttacccgaagaaactggcgtttcaatacctggaagatctcaagaacgagttcgaacgtgtcaatgggtctaacattgaaacagctgctagaccttatgcctttattaaattcgatacattcatacagaaaaccaaaaaactgtaccaagacacacgtacgcagcgaaatatcgctaagctgaatgacgaactctatgaggtccatcagataatgacgcggaatgtgcaggaagtcctaggtgttggtgaaaagctggaccaggtgagcgagatgtcgagccggctaacttctgaatctcgtgtatatgctgataaggctaaagatttgaaccgtcaggctttgatcaggaaatgggcaccagtagcgatcgtgttgggtgtcgttttccttcttttttgggtcaagaacaagctctggtaaagaaaggaggaacatgaggctattttcgtaatctagcagacttctccggtccatatatcagaccgccggcgcaaatcttcttctttcagagtgaa

SEQ ID NO: 8737 - DNA, 1234 bp, Cucumis sativus
tggcgagagcaatggctccattttaggagactcgatcggattctgagctgctcaaaccgcggtcagtaatcccattcccatccaattcctgtcctttcacgaaccctagcttctctttcttttcagattcttccatcgtcatcacggttcctcggatctttgaaaagataatccccccaatgattttatcctcagttgggggacatatcaaattaaagatggtgaagcttacaatgattgcccgtgttaccgatggtcttcctctagcagagggactggatgatggccgtgacatgcaagatgcagagttctacaagcagcaagtgaaggctctgtttaaaaacttatcaagaggtcaaaatgaggcttcaagaatgtctgtcgagacagggccatatgtttttcattatataattgaaggaagggtctgttatttgactatgtgtgaccgtgcttatcctaagaaacttgcctttcaataccttgaagacctgaagaatgagtttgaacgtgttaatggggctcaaattgaaaccgctgctaggccttatgcattcattaagtttgatacatacatacagaagaccaagaaattgtatcaggatacacgcactcaacgtaatattgcaaagttgaatgatgagctttacgaagtccaccagataatgactcggaatgttcaggaagttcttggtgttggtgaaaagctagaccaggtcagtcaaatgtcaagtaggttgacatcagaatcccgcatatatgctgacaaagcgagagatttaaaccggcaggctttgattcgtaagtgggcacccgttgctatcgtgtttggagttgtattcctcctattctggttcaaatcaaagatctggtgattcagttaatcttttgaactcattttcaggcttctcttttacttttttagctttggcttaatggattcagatatcagagacttgaaactgagttagaggtgacttctagattttacttaaatggctaagatgggatcagaaaagttagtgttttggtttacctccaagtgggggcggtgctgcctgtacaagtgtaagagcgatgttaaacttagtattccagattaagtagacaaatactttaccatgtttattcacattttgattacctcttcctcccaatatacattttttgttccttatacattgaaaaaaaaataccattatatttattatattagtccatcttcctttggcat

SEQ ID NO: 8738 - DNA, 1038 bp, Cucurbita pepo
gctagagcaatggctccattttaggagactcgatcggaccctgagctttacacaccgcgcggacggtaatccaattcccatccaattcctgttctttcactaaccctaccttctcctccatcgtcatcacggttcctcggatctttggaaggggaaccccccaatgttatagcctgttgggggacggatcgaactgaagatggtgaagcttacaatgattgctcgtgttactgatggtcttcctctagcagagggactggatgatggccgtgatatgcaagatgcagaattctacaagcagcaagtgaaggctctgtttaagaacttatcaagaggtcaaaatgaggcctcaagaatgtctatcgagacaggcccatatgtttttcactatataattgaaggaagggtctgttatttgactatgtgtgatcgcgcgtatccaaagaaacttgcctttcaataccttgaagacctgaagaatgaatttgaacgtgttaatggggctcaaattgaaaccgctgctaggccttatgcgttcattaaatttgatacttacatacagaagaccaagaaactgtaccaggatacacggactcaacgtaatattgcaaagttgaatgatgaactttatgaagtccaccaaataatgactcgcaatgttcaggaagttcttggcgttggtgaaaagttagaccaggtcagtcaaatgtcaagtaggttgacatctgaatcccgcatatatgcggacaaggccagagatttaaaccgacaggctttaattcggaagtgggctcccgttgctatcgtgttcggagtcgtattcctcctattctggttcaaatcaaagctctggtgatttggttgccgttccacataaatccttgactcattttcaggcttctcttgctttttacctttggcttataatcggctcagacatcagagacgtgaaactgggctagaggtgacttctagatttacttaatggctaagatggtaactgaaaatagtgttttggttatatagctccaagtgggg

SEQ ID NO: 8739 - DNA, 1383 bp, Lupinus angustifolius
gtagcaatagctagacaccagaagcgtttcttgtcttaaaatctgaatctaccgtttccttttggttcaaaacgacatagcaccacgccaaaattctcattccccattttcatttcattgaaccaaagcaacatttacacacttcctcttcatcgatcggatcggttccatccacgccgcccatagctgcggcagctccggcaacctattccttcttctttctcagagttgtagacagggagattgtgaattaagaaagatggtgaagttgactatgattgctcgtgttacggatggtcttccactagctgaaggactggatgatggtcgggatatgaaagatgcggaattttacaaacagcaagttaaggcattgtttaagaatctctccagaggacataatgaggcatcaaggatgtcgattgaaactggtccttatgttttcaattatattatagaaggacgtgtctgttacttgacaatgtgtgatcgtgcataccctaagaagctagcttttcaatatcttgaagatctcaagaatgagtttgagcgtgttaatgggtctcaaattgaaactgctgccagaccatatgccttcattaagtttgacacatttatacagaaaacaaagaaactttaccaggatacccatactcagcgcaatattgcaaagttgaatgatgaactctatgaagtccaccagataatgactcgaaatgtgcaggatgttctcggtgttggtgaacagttggaccaggtcagccaaatgtccagtcgactatcatcagaatctcgcatttatgctgataaggctaaagacttgaatcgtcaggctctgattcggaagtgggctcctgttgctattgttttgggagttgtctttgtacttttctggctaaaaaataaaatttggtgatcaagctcagtatgacatttaaaacctgactttgctgttgtagcttctttcttttctcacatagtatccagatttgcagagattcgcgggaacccggtatgcatgaatgatgtctactttttgttgacaattttggtttagaaaaagtgactatcctccattacatctgatcatggtggatcatgcattctggaacatgaacaatttactttataaggagccaagatatgagaaaacttgatgtccttagttgatgcatatatagacatttcttctccttctcattattttcaggattatttctttaatgtgttaaatatacttcaccttgaattttattgtttctgtagaagtttctgttgaagtagaattatgttttatacgtgtgtactataatcagtagtttgatctctgaaatgcttgttcttattggtaaacttaaattgatttcacttttagttttcact

SEQ ID NO: 8740 - DNA, 1257 bp, Cucumis melo
tggcgagagcaatggcttcattttaggagagactcgatcggattctgagctgctcacaccgtggtcagtaatcccatcccatccaattcctgtcctttcacgaaccctagcttctctttcttttcagattcttccatcgtcatcacggttcctcggatctttaaaaagagaatccccccaatgatatagcctgttgggggacatatcaaattaaagatggtgaagcttacaatgattgcccgtgttactgatggtcttcctctagcagagggactggatgatggccgtgacatgcaagatgcagaattctacaagcagcaagtgaaggctctgtttaaaaacttatcaagaggtcaaaatgaggcttcaagaatgtctgtcgagacagggccatacgtttttcattatataattgaaggaagggtctgttatttgactatgtgtgaccgtgcttatccaaagaaacttgcctttcaataccttgaagacctgaagaatgagtttgaacgcgtcaatggggctcaaattgaaaccgctgctaggccttatgcattcattaagtttgatacatacatacagaagaccaagaaattgtaccaggatacacgcactcaacgtaatattgcaaagttgaatgatgagctttacgaagtccaccagataatgactcggaatgttcaggaagttcttggtgttggtgaaaagctagaccaggtcagtcaaatgtcaagtaggttgacatcagaatcccgcatatatgccgacaaggcgagagatttaaaccggcaggctttgattcggaagtgggcacccgttgctatcgtgtttggagttgtattcctcctattctggttcaaatcaaagatctggtgattcagttaatcttttaaactcattttcaggcttctctttgcttttttagctttggcttaatggattcagatatcagagacttgaaactgagctagaagtgactcctagattttacttaaatggctaagatgggatcagaaaaattagtgttttggtttacctccaagtggggcggtgctgcctgtacaagtgtaagagcgatgttaagcttagtattccagattaagtagacaaatactttacatgtttattcacattttggttacctcttcctcccaatatacattttttgttccttatacattgagaaaaaaataccattatatttattatattagtccatcttcctttggcataatccatgttgacaacttcagatttaaa

SEQ ID NO: 8741 - DNA, 1403 bp, Carica papaya
accgtaaaaacaaacccaaagcctttcttgctttcttcctcgttccccactaaaatcgaaatctcaagcgtgtggccttctgctggaccctccaaggaccctgcccttttccttccgagactgtcttctttctcatttctctccatccgaagtagtttctgtagtcgtcgagaatcgtccctattctttcccttcacagagcccgatctcgtttcttcggacggagctttgacgagagagtcagagaccggaggtgggagtggctgaaaagctacgccagattgcttctctctgccacgccttagccttgttgcagtcgcaaggcccgatttcttcaggaagcaatattgatagctgacaagaattagtgaagatggtgaagatgacaatgattgctcgtgtcactgatggcctaccgttggctgagggactggatgatgggcgtgatttgaaagatgctgaaatgtacaagcagcaagttaaggctttgtttaagaatctttcaagagggcagaatgaagcatcaaagatgtcaatagaaactggtccttatgttttccactacctcattgaagggcgcgtttgttatttgacaatgtgtgaccgtgcttatcccaagaaacttgcctttcagtatttagaggatctcaagaatgaatttgagcgtgttaacgggaatcaaattgaaactgcggcccgaccttatgcattcattaaatttgataccttcatacagaaaaccaagaaattgtaccaagatactcgtactcaacgaaatattgccaaattgaatgatgaactctatgaggtccaccagataatgactcgcaatgtgcaggatgtccttggtgttggtgaaaagttggatcaggtcagccaaatgtccagcaggttaacatcggaatcacgaatatatgctgaaaaggcaaaagatttgaaccgacaggctctcattcggaaatgggctcctgttgccatagtgttgggagtcgtcttccttctcttctgggtcaagacgaagatatggtgatcctgccacctttctggattttggaaattagttgaaccttcttcctgtgtttgattccattgctatggacatcttgccttcgggttgttatccagactttttccaagatttgagattcaggcggccagcacaatctggttaaaaagatgttccctgggttacctttttagtagttgagatacggtttaccgtgtaaaattgtgggagagaggcccgttaataggaccaaggttaaggtgatcgtattatgcagaactctaattcggggagtgttataggccatttcattgatctagatattcgattgctatctatgttcaactaaattagcttacactgcaacatatatatttatatatatacaaacactatt

SEQ ID NO: 8742 - DNA, 1056 bp, Silene vulgaris
aagttggactcttttaaccatcgtgggtaatcgatctcattttttgtcgccattgatcctagatcttctcaatttccatgttccgtgatctcaattgaagtcgcaaattgcagagaaacaatggtgaaagtgacgatgattgcgcgtgttactgatggtcttccattagcagaaggattagatgacgggcgtgatgtacaagatgctgattactacaaacaacaaattaaagctttgtttaagaatctttccaaaggtcaaaatgatccttccagaatgtccgttgaaaccggtccttatgtctttcactatattatcgagggacgtgtttgctacctgacaatgtgtgatcgtgcttacccaaagaagcttgcatttcaatacttggaagatttgaagaatgaatttgaacgtgtaaatgggaatcagatagagacagctgctagaccgtatgcattcatcaagtttgacacatttatacagaaaacaaagaagttgtaccaagacacccgaactcagaggaacatgtccaaactaaatgatgagctttatgaagtccaccaaattatgactcgaaacgtacaagaagttcttggtgttggtgaaaaactagaccaggtcagccaaatgtccagccgtttaacttcagaatcacgtatatatgctgacaaggcaaaagacttgaatcgtcaggccttgatccggaaatgggcacctgtagccatcgtgataggagtagtggtgctactcttctgggtaagaaagaagatttactgaactaccatcccttgatggcttgagggaagaatgtttaagatctttgctcgacttgaacatacggcatcactgctaagagtgtagcttttcatccagtgactggaacttgcagaaagtcagaagtaagaggttcttttcaatgatactgaaaactatatgtgtgaattgtactgtagtagatcatatattttgatggcggaagcggagaatattaggtgatttagacttttgagcgccattgtcatagttaattggtcttccatcagattgacatcaaag

SEQ ID NO: 8743 - DNA, 695 bp, Vinca minor
aagtataggcgacagcttgtggaagaaagatggtgaagttgaccatgattgctcgtgttactgatggccttccactagtggaggggctagatgatgggcgggatttgccagatgcagatttctacaagaagcaggccaaggcattgttcgcaaacctctcaaggggtctgagtgatccttctagaatgtctattgagactggctcttatatgttccattacattattgaaggacatgtttgttatttgacaatgtgtgaccgctcttatccaaagaagcttgcttttcaatatctagaagatcttaagactgaatttgaacgtgtaaatggaagtcaaattgatactgcagctagaccatatgctttcataaagtttgatacatttatacagaagacaaagaaattgtaccaagacacaagaactcaacggaatatagcaaagctgaatgatgaactttatgaagtacaccagataatgactcgcaatgttcaagaagttcttggcgttggtgaaaaattggaccaggtcagtcagatgtctagccgcttgacctcagaatctcgcatatatgctgacaaagcaaaagatttgaatcgtcaggcttttattcgtaaatgggcacctgttgccatcgtcctcagtgtggtcatacttctcttttgggtgaaaaacaagatttggtgatgctgcaaa

SEQ ID NO: 8744 - DNA, 677 bp, Citrullus lanatus
tagttaaatcaaaaatggtgaagctgacaatcattgcccgtgttactgacggtcttccccttgctgagggactagatgatggtcgtgatttgggagatgctgattattacaagcagcaagccaaagcgttgtttaagaacttatcaagaggacagaatgaaccttccaggatgtctattgaaaccggctcttatgtctttcattatataattgaagggcatgtttgctatttgacaatgtgtgaccgtgcttacccaaaaaaacttgctttccagtaccttgaagaccttaagaatgaatttgagcgtgttaatggggctcacattgaaactgctgctaggccatatgcatttatcaagtttgatacattcatacagaaaatgaagaagctgtaccaagacacccgtacccagcggaatattgcaaaattaaatgatgaactctatgaagtgcaccaaataatgactcgaaacgttcaggaagttcttggtgtgggtgaaaagttagatcaggttagtgaaatgtcaagtcgattaacatcagaatctcgcatttatgctgacaaggcaaaagatttgaaccgacaggctttgattcggaagtgggcaccagtagctatcgtgcttggagtcgttgttctcttattctgggtgaaatcaaagatttggtaacccaat

SEQ ID NO: 8745 - DNA, 1186 bp, Nicotiana benthamiana
tcctacttttagtataatatgacatgattacgacagtactatatactgttcatttctctgaaacattcgagatttacagaactagcgattcacattcttaacaaatttatcaaaacaagcggatcgggaactgcaatttaaggggtcacacgcgtgtgatcgatcgttatatgcttgcagaagaaagatggtgaagttgactctgattgctcgtgtgactgatggccttccgttagcggaggggctggatgacggtcgtgatgttccagatgcagatttctacaaacagcagtcaaggccttattcaagaacctggcaatgcgccaaaatgacgcttcaaggatgtctattgaaactggaccttatatcttccattatatcattgaaggacatgtttgttatttgacaatgtgtgatcgctcttatcccaagaaacttgcctttcaatacctggaggaccttaagaatgagtttgagcgtgtaaatgggagtcaaattgaaactgctgctagaccctatgcttttattaaatttgatacattcatacagaagacgaagaaactgtaccaggatacaagaactcaacgcaatatttctaagttgaatgatgagctttatgaagttcatcagataatgactcgaaatgtacaagaagttcttggtgttggtgaaaagttggatcaggtcagtcagatgtctagtcgcttgacatctgaatcccggatatatgctgacaaagcgaaagatttgaatcgtcaggctttgattcggaaatgggcgcccgttgctattgtccttggagttgtcattctcctcttctgggttagaacaaagatttggtgatgttgccaaaaggatgcagctcagtgatgatgatacttttgattgcctcttctgtcaccattcagctgtggacaacccagactatcacctgagatttcagctgtccagcacgtgttgtgtctgctttccagctgttggctgcaagttgagccataccaattttatagtgtaaaagagaggaaatgaagcgtgatgggtgaactatgtcgctaaactttcagaaatgatatcaatcttatggttctttttttggtcttattagttaatttcagaactcccgacgaggttattgtacttccagagatgaaaggtcgcgactttgtgaatttacagcaaaagtaaa

SEQ ID NO: 8746 - DNA, 776 bp, Hordeum vulgare
atctctattcgccatcagccatatagtttgtagtggtttctgctgttcttcacaaaatggtgaagctgacaatgatagcgcgtgtcactgatggccttccgctggcagaagggctcgatgatgggcgggatcagaaggactctgatttctacaagcagcaagctaaacttcttttcaagaacttgtcaaaggggcaacatgaagcctcacggatgtcaattgagaccggatcatactttttccattacatcatagaaggccgagtatgttatctaacaatgtgtgaccgttcttatccaaagaaacttgcattccagtacttggaagatctgaaaaatgaatttgagagagtcaatgggagtcaaattgaaactgctgcaaggccttacgcttttattaaatttgatacatacatacagaagactaagaaactgtatttggataccagaacccagaggaacattgcgaaattgaacgatgagctctatgaggtgcatcaaatcatgactcgcaatgttcaagaagttcttggtgtcggtgaaaagcttgatctaactgtttaccattcttgtgtatttccattttttgcagaggttagtgaaatgtcaagtaggttgacatctgacacgagaatctatgctgataaggcaaaggatctcaatcgccaggccttcattcggaagtatgcccccgttgccatcgtgatcggggttgtaataatactgttctgggccaagaacaagatatggtgattccaccaaacaaggtagccggcc

SEQ ID NO: 8747 - DNA, 1295 bp, Rosmarinus officinalis
agaaagaaaatgagaggaaatgaattttaggaaaagttgtccaaaacaaaacgtaaatgcattttcctgtcaccgttaaaaattggaacagctttagttcacgccctctcataatatcagtcaaatttggacaacatctcattactctcatttcttcaattggctctgattgttatcacgatcttttgttgagatcgttcgaattttgagcgcatacctatttcaagggcacaattttgtaattgttgaaccttattgaagatcgagggttcacgaaagcacaacggaaagagctcacagacgcatgtcaaaggtgtgagctcaagaaataacaatggtcaagttgactatgatcgctcgtgttactgatggccttccattagcggagggactggatgatggacgtgacgtgtcagatgccgactattataaacagcaagtgaagtcattgttcaaaaatctgtcaaagggccagaatgagccatcaaggatgtctatcgaaacagggccctatatatttcattatattattgaagggcgtgtatgctacttgacaatgtgcgaccgcgtttatcctaagaagctttcctttcaatatctagaagacctcaagaatgaatttgagcgtgcatatgggaatcagatcgaaactgctgcaagaccttatgcatttatcaaatttgacacattcatacagaagacgaagaaattgtaccaggacacaagaactcaacgaaatatttcaaagttgaatgatgaactctatgaagttcaccagattatgactcgcaatgtacaggaagttcttggtgttggtgaaaagttggaccaggtcagccagatgtccagccgcttaacatcggaatctcgcatttatgcagagaaggcaaaagatttgaaccgccaggctttgattcgcaaatgggcccccgttgctgttgttctaggagttgtgtttctcctcttctgggtcaagaacaagctttggtgatccttcacccatttgctgtttgatgagctgctccaatcttgctaacatggtattgcagtttcttggtgcattttgtcattttatcttttggaaccactagaaaagatctgtttgaaacgagcttccaatttttgaggattttggaaactaagcatgtcggaaaatatagagatttcttactgtgaggacgaattgattttaacatttctaagaaacatatagcctatgcgtttaatcttcctacaccccaactagttatccaactctgcgtgtcccattttataacaaaaattacgagtattcg

SEQ ID NO: 8748 - DNA, 899 bp, Malus domestica
gcaacctcataccactcagaaaaccaacccttatttgctctgtttggtcctcgaaaaccccttttgttttcccagagcttcaatcaattcttctcgctcagattgcaccatcgtcctcaccgttcctcagatcaatgctataagcagttaatttcgcattgctaggaagttgtgaagtgaagatggtgaagctgacaatgattgctcgtgttactgatggtctcccactagcagagggactggatgatggccgtgatgttaaagactcggaattctacaaacaacaagtcaaggctttattcaagaacttgtcaaccggacaaaatgagccttcaaggatgtcagttgaaactggaccttttgttttccactatatcatcgaaggacgtgtgtgttacctgacaatgtgtgaccgtgcctatccaaagaaacttgccttccaataccttgaagatctcaagaatgagtttgagcgtgttaatgggacccaaattgaaactgctgcaagaccttatgcattcattaaatttgatacattcatacagaaaacaaagaaattgtaccaggacactcacactcagcggaatattgcaaagttgaatgatgagctgtatgaagtccaccaaataatgactcgcaatgttcaggaagtgcttggtgttggtgaaaagttggaccaggtcagtcaaatgtcgagccgtttaacatcagaatctcgcatatatgctgataaagcaagagatttgaatcgacaggctctgatccgaaagtacgcgcctattgccattgtgcttggagttgttttcctccttttctgggtcaaaacaaagctctggtgatcaaactgcttcatctatgttctgaatttgtggcaattttgacgggcttctgtttgttgc

SEQ ID NO: 8749 - DNA, 1071 bp, Arabidopsis lyrata
aaaccctttaattaaaaaaaaaaattacttctctttccttggatcatcgtcttcctctggttctcagatctttgaatcgagaagaaccaattttaaagctcgtttcagtgaatttattattggagaagatttaaggcaaagatggtgaaaatgacattgatagctcgtgttactgacgggttgcctctagcagaggggctcgatgatggacgcgacttaccagattcagatatgtataagcaacaggtcaaagctttgttcaagaatctttccagaggtcaaaatgaggcttcaagaatgtcggttgaaactggcccctatgttttccattacatcatcgaaggacgtgtttgctacttgacaatgtgtgaccgctcttacccaaagaaactcgctttccaatacctggaagatctcaagaatgaatttgaacgtgtcaatggacctaacattgaaacagctgctcggccttatgcctttattaaatttgatacattcatacagaaaaccaagaaactgtaccaagacactcgtacacaacgaaatattgccaagttgaatgatgaactctatgaggttcatcaaataatgacgcggaatgtgcaagaagtcttaggtgttggtgaaaagctggaccaggtgagcgagatgtcgagccggttaacatctgaatctcgtatatatgctgataaggctaaagatttgaaccgtcaggctttgatccggaaatgggcaccagtcgcaattgtcttcggtgtagtcttcctccttttctgggtcaagaccaagctatggtaaaaaaaaaaagaaacctaagaggctattttcgtttgccagacatatatcgacctcagcgaccgccggctcaagtctcagattctggcacccaaaatatcttctttctttcaaagagaaactttgacacattttgtacttctgtagtatgcaaactttatgagactggttatattatcatcccttatactcttcaaaccttcattgtcattttctcaggcttctttaaattgaattagaaccacaattgaatcaaaccggattgtgtttgcattc

SEQ ID NO: 8750 - DNA, 991 bp, Arabidopsis thaliana
aaacaaattacttctctttccttcgatcatcgtcttcctctggttctcagatctttgaatcgagcagaagcaattttaaatctcctatcagtgaatttttattactggagaagtaataaggcaaagatggtgaaaatgacattgatagctcgtgttactgatgggttacctctagctgaggggctcgatgatggacgtgacttaccggattcagatatgtataaacaacaggtcaaagctttgtttaagaatctgtccagaggtcaaaatgacgcttcaagaatgtccgttgaaactggcccctatgttttccattacatcatagaaggacgtgtttgctacttgacaatgtgtgaccgctcttacccaaagaaactcgctttccaatacctggaagatctcaagaatgaatttgaacgtgtcaatgggcctaacattgaaacagctgctcggccttatgcctttattaaatttgatacattcatacagaaaaccaagaaactgtaccaagacactcgtacgcaacgaaacatcgccaagttgaatgatgaactctatgaggttcatcaaataatgacccggaatgtgcaagaagtcttaggtgttggtgaaaagctggaccaggtgagcgagatgtcgagccggttaacatctgaatctcgtatatatgctgataaggctaaagatttgaaccgtcaggctttgatccgaaaatgggcaccagtcgcaattgtgttcggtgtagtcttcctccttttctgggtcaagaacaagctatggtaaaaaaaaaaggaggaatctaaggctattttcgtaatttagcggacttctccagacatatgtcgacctcccctaccggactcaagtctcagattccggcacccaaaatatcttctttctttcaaagagaaactttgacacattttgtacttctgtagtatgcaaactttatgagactggtcatagtatcatccattatactcttttcaaa

SEQ ID NO: 8751 - DNA, 977 bp, Brassica juncea
aattaacaaatcacctccttgataaaccctttcattaataaaaataataattatctttccttggatcatcgtcttcctcctggttctcagatcctatcgagaagaaccattcagttagctttgttgttggataagaagggagtaaggtcaagatggtgaagatgacattgatagctcgtgttacagacgggttgcctctagctgagggtcttgatgatggacgtgacttgccagatgccgacatgtacaagcaacaggtcaaggctttgtttaagaatctctccagaggtcataacgaagcttcgagaatgtctgttgagactggcccctatattttccattacatcatagaaggacgcgtttgttacttgacaatgtgtgaccgctcttacccgaagaaactggcgttccaatacctggaagacctcaagaatgagtttgaacgtgtcaatgggcctaacattgaaacagctgctcgaccttatgcctttattaagtttgatactttcattcagaaaacgaagaaactgtaccaagacactcgtacgcaacgaaatatctctaagctgaatgatgaactctacgaggttcatcaaataatgacgaggaatgtgcaggaagttctaggtgttggtgaaaagctagaccaggtgagcgagatgtcgagccggctaacatctgaatctcgtatatatgctgacaaggctaaagatttgaaccgtcaggctttgatcaggaaatgggcaccagtagcgatcgtgttgggtgtcgttttccttcttttctgggtcaagaacaagctctggtaaaagaacggaggaacatgaggctattttcgtaatttagcagacttctccggtcataaatcagaccgccggcgcaaatcttctttctttcagagtgaaactttgacacattttctacttctgtagttatgcaaactttatgagactggtcatagactcgtagaatcatcc

SEQ ID NO: 8752 - DNA, 3006 bp, Brassica oleracea
gtttccgatttgctcatgaaccgaccggtttaatcagactaacgagtcaagcgttatcaaacgcgccatgtcatcaagacatgtcagcaagacgcgtcagaagcccaatcacgtgaggccacagcattgacgagtcatcataaataacatttcgaccaacaaaaactaaaaaaaaaaaactattaaaaataataattcactaccttcgatcatcgtccatctcctggctctctcatcagatccttgaatcgagaagaaccgtttgaatactcgcatcagtgagtttgttattggagaggaagggataaggcggagatggtgaaaatgacattgatagctcgtgttactgacgggttgcctctagcagagggactcgacgatggtcgtgacttaccagattccgacatgtataagcaacaggtcaagtctctgttcaagaatctctccagaggtcataacgaagcttcgagaatgtctgttgaaactgggccctatgttttccattacatcatagaaggacgtgtttgctacttgacaatgtgtgaccgctcttaccccaagaaactcgcgttccagtaccttgaagatctcaagaatgagtttgaacgtgtcaacgggcctaacattgagacagctgctcgaccttatgcctttattaaatttgatactttcatacagaaaacgaagaaactgtaccaagacactcgtacgcaacgaaatattgctaagctgaatgatgaactctatgaggtccatcagataatgacgcggaatgtgcaggaagtccttggtgttggtgaaaagctggaccaggtgagcgagatgtcgagtaggctaacttctgagtctcgtatatatgctgataaggctaaagatttgaaccgtcaggctttgatccggaaatgggcaccagtagcgatcgttttgggtgtcgttttccttcttttctgggtcaagaacaagctatggtaaatgaaaggaggaacttaaaaggctattttcataatttagcagacttggccggctcacatctcctgattccggcacccagaatatcttctttcttttaaagagaaacttcgacacattttgtacttctgtagtatgcaaacggttatgagactgctcatattatcaccatccgttatactctttaaacttgatcctcattttctaaaatatggacttcatagatgacaataaccttagcatctcattcacgaagccagctcgtcccaagataaacaaaactgagttgtatgtgatcatatctcgtttacattgccactctttcatctcctcagttatcataaggaccttgacgatctgtcgagacttggcaaatgcaagaatgattatgtttatcactattcacctacagggaagagaagactgatacacaaagcagctctctgtgaaagctctgcaagaaggttattgaaaaccgaaacaggcaaacaaatgttctcgtcttgtaaggactgcaacacgtcatatgcagcagagagatttccatctcttctataatgtcatttccaggttttgatttgtaagggacgtgcttggtctacaatgaatgacaaatatacaaataactgagctatttgctaaaccgtttcaaactttagtgactaaaacgataaataagcaaaagttcaaaagcaaaggtagaaagatgacagacctgccgacttcaactttccttcatcgtcaggttttgattttttcaagagaattgttctggctaaaatagcaaatgtataagtaatcggctattttataaaacatttaaaactacagggactaaaaggataaatctacaaaaattcaaaagcgaggtagttgagtagatgtcatacctgcctatttcctcctcctcaaggacttgaactttccttcttcgtatttgccgacggcaaggaaagttctcgaggatgcagcatctactcttcgcggttgtactcgccgaggtcgcggtgatactcgcgctctctttcaaaacgccgattcggaagctcctgatcatgagcctggatcgcgcgaagcgcggacgcggaccggtggtggtccagacggtttccgcgacggtgtgcgtggttctggtggcgagcgtgtacagtatgatgaagatccagaagcgctgggtcgaggagggtgcaatgaacccgacggatgaggtcatcatgtctaagcatctccttgaatcgactctcatgggtgggtttcttttccttgggctgatgatagacaggctgcaccactacatgagagagctacgcatgagaaggaagaccatggaagttataaagaaggaaggatcggttttggaaggtgaaaaggccagagcttcagatgaagtcaaaagcttgaaacaagaaatcacggcgcttcaggaaaaacaaaagcagctggctgctgagatcgaggcaaagtctaaagaaatccgtactgaagaaacaagtggaatcgctctacagaagcaatctgaagggttcctgatcgagtttaaccggttgtctgaggaaaaccaggatcttcgaaaccaattgcacactgtggattcaagaatctcgcgttcaagcatcaagaagaatacttgagccgtctctacttcccaacatttaaaaaaacttgtttgtgataacgtttgaagtttgttaatagggtgatttgttgcttggtaattgaatcttgtgttaaccatatggaaggtgatggaagcaatcagaaggaataccaaaaaaaaacaccaggataggtttgtttcttcttgtccgagttgttagctaaagttgaaatgatcaaatgatctatatctcagatgcctatacgagttggttcttattttcttccatattatattacagtatctgcaagagtaactcaaaatcatctacatagcaagagtctgcatacacaagatatgatttgtcaaactcaaacagctttttatttactattggcctgattactctcactaaacaaaaaatcatagcttactaattt

SEQ ID NO: 8753 - DNA, 976 bp, Brassica oleracea
ctttttaataattaaaaaaaaaagaaagaaatacagtacttgcatctccttggatcatcctctttctttcacctggtttctcagatcatgagaagaaccattggaaagctcgtatcagtgacatttgttattggggaaggaataaggcaaagatggtgaaaatgacgttgatagctcgtgttaccgacgggctgcctctagctgagggtctcgatgatggacgtgacttgcctgattcagatatgtataagcaacaggtcaaggctctgtttaagaatctttccagaggtcataacgaagcttcaagaatgtctgttgagactggcccctatattttccattacatcatagaaggacgtgtgtgctacttgacaatgtgtgaccgctcttacccaaagaaactggcgttccaatacctggaagatctcaagaacgagttcgaacgtgtcaatgggcctaacattgaaacagctgctagaccttatgcctttattaaatttgatacattcatacagaaaaccaagaaactgtaccaagacactcgtacgcaacgaaatatcgctaagctgaatgatgaactctatgaggtccatcagataatgacgcggaatgtgcaggaagtcctaggtgttggtgaaaagctggaccaggtgagcgagatgtcgagccggctaacttctgaatctcgtgtatatgctgataaggctaaagatttgaaccgtcaggctttgatcaggaaatgggcaccagtagcgatcgtgttgggtgtcgttttccttcttttctgggtcaagaacaagctctggtaaggaaaggaggaacatataaggctattttcgtaatctagcagacttctccggtccatatatcagaccgccggcgcaaatcctctttctttcagagtgaaactttgacacattttgtacttctgtagttatgcaaactttacgagactggtcatagactcgtagaatca

SEQ ID NO: 8754 - DNA, 790 bp, Brassica oleracea
cttcctccaggttctcagatcctcaaatcgagaagaacaattcagtgaggttgttgttggagaaggaggagtaaggctaagatggtgaagatgacattgatagctcgtgtcactgacgggttgcctctagctgagggacttgacgatgggcgtgacttgccagattccgacatgtataagcaacaggtcaaggctctctttaagaatctctccagaggtcataacgaagcttcgagaatgtctgttgaaactggcccctatattttccattacatcattgaaggacgtgtttgctacttgacgatgtgtgaccgctcttaccctaagaaactcgcgtttcaatacctggaggacctcaagaatgagtttgaacgtgtcaatgggcctaacattgaaacagctgctcgaccttatgcctttattaagtttgatactttcattcagaaaacgaagaaactgtaccaagacactcgtacgcaacggaatattgctaagctgaatgatgaactctatgaggttcatcaaataatgacgaggaatgtgcaggaagtactcggtgttggtgaaaagctagaccaggtgagcgagatgtcgagccggctaacatctgaatctcgtatatatgctgacaaggctaaagatttgaaccgtcaggctttgatcaggaagtgggcaccagttgccatcgtgcttggggtcgtgttccttcttttctgggtcaagaacaagctatggtaagaaagtggctagacttctccggacatattccttctttcaaagcgaaactatg

SEQ ID NO: 8755 - DNA, 672 bp, Brassica rapa
atggtgaaaatgacattgatagctcgtgttactgacggtttgcctctagcagagggactcgacgatggtcgtgacttaccagattccgacatgtataagcaacaggtcaagtctctgttcaaaaatctctccagaggtcataacgaagcctcgagaatgtccgttgaaactggcccctatgttttccattacatcatagaaggacgcgtttgctacttgacaatgtgtgaccgttcttacccgaagaaactcgcgtttcagtacctggaagatctcaagaatgagtttgaacgtgtgaacgggcctaacattgagacagctgctagaccttatgcctttattaaatttgataccttcatacagaaaaccaagaaactgtaccaagacactcgtacgcaacgaaatatcgctaagctgaatgatgaactctatgaggtccatcagataatgacgcggaatgtgcaggaagtcctaggtgttggtgaaaagctggaccaggtgagcgagatgtcaagtaggctaacttccgaatctcgtatatatgctgataaggctaaagatttgaaccgtcaggctttgatccggaaatgggcaccagttgcgatcgttttgggtgtcgttttccttcttttttgggtcaagaacaagctatggtaaatgaaaggaggaacc

SEQ ID NO: 8756 - DNA, 2233 bp, Brassica rapa
gtaacgcagaacgtagatcgtcataaataacaattcgaacaacagcgaaaaaaaaaccaacagatcgtgaatttttaattcacccccttgaatgataaaaccctttttaataataataaaaagaaatacagtacttgcatatctccctggatcaacctctttctttaacccggttctcagatcctgagaagaaccattagaacgacactcgtatcactgaatttgttactggagaaaaggaataaggcaaagatggtgaaaatgacattgatagctcgtgttaccgacgggctgcctctagcagagggtctcgatgatggacgtgacttacctgattccgacatgtataagcaacaggtcaagtctctgtttaagaatctttccagaggtcataacgaagcttcaagaatgtctgttgagactggcccctatattttccattacatcatagaaggacgtgtttgctacttgacaatgtgtgaccgttcttacccaaagaaactggcgtttcaatacttggaagatctcaagaacgagttcgaacgtgtcaatgggcctaacattgaaacagctgctagaccttatgcctttattaaatttgatacattcatacagaaaaccaagaaactgtaccaagacacacgtacgcaacgaaatatcgctaagctgaatgatgaactctatgaggtccatcagataatgacgcggaatgtgcaggaagtcctaggtgttggtgaaaagctggatcaggtgagcgagatgtcgagccggctaacttctgaatctcgtgtatatgctgataaggctaaagatttgaaccgtcaggctttgatcaggaaatgggcaccagtagcgatcgtgttgggtgtcgttttccttcttttttgggtcaagaacaagctctggtaaagaaaggaggaacatgaggctattttcgtaatctagcagacttctccggtccatatatcagaccgccggcgcaaatcttcttctttcagagtgaaactttgacacattttgtacttagttatgcaaactttatgagactggtcatagtatcatccatcaatacattttttcaaaaccttgattgtcattctatcaggttcttcatgtcaaaccaaaatcaaaattttgttttgatttcattacatatgcctaaccaaaatgaaacacacagctgcttaaaacaagagcctatagactttttagcgtctatgtggtctcaagtgtcgtttgaaatctagtggacctgccaaatctaatgctgaagtgtttttcaactcatctgaaagctgcaacgccctgctaaactctcctgtcttcttcagacaatcgattaatgctctgtagacataaacagatagtcgaatctcccgctgtttcatctcatcgaaaagcctcaacgcttcctttgtgttccctgaccgacccaaactgtctatcactgctgtataactaagcagatcaggctcaatcccacactgaaccatttcttcatacaacaccaaacacatatcgaacctacaagctttcctcatcccgtttaacaccgtgttgtatgtaatgatgtttagagacacatcgcaatcttccttcatcgatgacaatagcctgagcatctccttaacaaggccagctcgtcccaagatatctaaaacagagttgtaagtgatcacatccggtttacattcccactctctcatcttctcaagtatcataagcaccttatcgacctgcctagactcagcgaaagcaaggatggttctgtttattactattaacctacacggaagagaagactccgacacttctttgagaaggttcaacaagtgtacacaatcatctgcgttgataaaggctctagcgaggttgagataacaatctgaactcaaaggcatacccgcttggaccaacatcattctaaaagctctgcaagagagcttcgtatcgttctgctcacccgctgctgcaagaaggttcttgaaaaccgcaaaagggaagcatatgttcttgtcttgcaatgactgtaacaagtcatacgcagcagagaggttcccttctcttctatacttctccacaagactcgtgtaatcgattctgctgatgaactttggaccactatcactattctcagccgttttcttcagggcttctcctcctgtgtctatcaaagagtgcatcgcagagaaggagcactcagcaggagcgtacaccatatgtttctgcaatg

SEQ ID NO: 8757 - DNA, 993 bp, Brassica rapa
cctttattaaaaaaaaacattttaatttatctttccttggatcattgtctcctcctccaggttcccagatcctcaaatcgagaagaaccattcagtgagttttacataaggagggataaggcgaagatggtgaagatgacattgatagctcgtgtcactgacgggttgcctctagctgagggtcttgacgatgggcgtgacttgccagattccgacatgtataagcaacaggtcaaggctctctttaagaatctctccagaggtcataacgaagcctcgagaatgtctgttgaaactggcccctatatcttccattacatcattgaaggacgtgtatgctacttgacgatgtgtgaccgctcttaccctaagaaactcgcgtttcaatatctggaggacctcaagaatgagtttgaacgtgtcaatgggcctaacattgaaactgctgctcgaccttatgcctttattaagtttgatactttcattcagaaaacgaagaaactgtaccaagacactcgtacgcaacggaatattgctaagctgaatgatgagctctatgaggttcatcaaataatgacgaggaatgtgcaggaagtccttggtgttggtgaaaagctggaccaggtgagcgagatgtcgagccggctaacatctgaatctcgtatatatgctgacaaggctaaagatttgaaccgtcaggctttgatcaggaagtgggcaccagttgccatcgtgcttggggtcgtgttccttcttttctgggtcaagaacaagctctggtaagaaggaaagaacctcaggctagacttctccggacatatatcgaccggcaccaaaaaatatctttttttttgaagtgaaacattgacacccattttgtacttctgtagtaatgcaaactttatgagactagtcatatgaatcatccatcaatacacttttttaaaccttgattttcattttataagtttcttcaaatcaaaccaaactcca

SEQ ID NO: 8758 - DNA, 2109 bp, Brassica rapa
acgtgaggccagagcgttgacgagtcatcataaataacatttcgaccaacagaaactaaaaaaaaaaaactattaaaaataataattcactcccttggatcatcgtccatctcctggctctctcatcagatccttgaatcgagaagaaccgtttgaatactcggatcagtgagtttgttattggagaggaagggataaggcggagatggtgaaaatgacattgatagctcgtgttactgacggtttgcctctagcagagggactcgacgatggtcgtgacttaccagattccgacatgtataagcaacaggtcaagtctctgttcaaaaatctctccagaggtcataacgaagcctcgagaatgtccgttgaaactggcccctatgttttccattacatcatagaaggacgcgtttgctacttgacaatgtgtgaccgttcttacccgaagaaactcgcgtttcagtacctggaagatctcaagaatgagtttgaacgtgtgaacgggcctaacattgagacagctgctagaccttatgcctttattaaatttgataccttcatacagaaaaccaagaaactgtaccaagacactcgtacgcaacgaaatatcgctaagctgaatgatgaactctatgaggtccatcagataatgacgcggaatgtgcaggaagtcctaggtgttggtgaaaagctggaccaggtgagcgagatgtcaagtaggctaacttccgaatctcgtatatatgctgataaggctaaagatttgaaccgtcaggctttgatccggaaatgggcaccagttgcgatcgttttgggtgtcgttttccttcttttttgggtcaagaacaagctatggtaaatgaaaggaggaacctaaggctattttcgttatttagcagacttggccggcgcacatctcctgattccggcacccaaaatatcttctttctttaaagagaaacttcgacacattttgtacttctatagtatttaaactgttataagactgctcatattatcatcatccgttatactctttaaaccttgattctcattttctcagttgtccttcatcggtgaaaataaccttagcatctcattctcattttctctgaaaggcttttagtgaaagctctgcaagaaggacttgaactttccttcttcgtatttgccgacggcaaggaaagttctcgagatcacatcccctcatccacgatgcagcatctactcttcgcggttgtactcgccgaggtcgcggtgatactcgcgctctctttcaaaacgccgattcggaagctcctgatcatgagcctggatcgcgccaagcgcggacgtgggcccgtggtggtacagacggtttccgcgacggtgtgcgtggttctggtggcgagcgtgtacggtatgatgaagatccagaagcgctgggtcgaggagggtgcaatgaacccgacggatgaggtcatcatgtctaagcatctccttgaatcgactctcatgggtgggtttcttttccttgggctgatgatagacaggctgcaccactacatgagagagctacgcatgagaaggaagaccatggaagctataaagaaggaaggatcggttctggaaggcgagaaagccagagcttcagacgaagtcaaaagcttgaaacaagagatcacggcgcttcaggaaagacaaaagcagctggctgctgagatcgaggcaaagtctaaagaaatccgtactgaagaaacaagtgggatcgctctacagaagcaatctgaagggttcctgatcgagtttaaccggttgtctgaggaaaaccaggatcttcgaaaccaattgcacactgtggattcaagaatctcgcgttcaagcatcaagaagaatacttgagccgtctctactccaacatttttatggtttgaacttgtttgtgatatgatgcttggagtttgttaataggggtgattgctacttggtaattgaatcttgtgttaacatatggaagatgatgggagtaaaatcagagggaatacaaaaacacaaggacaggtttgtttctttttgagtgttgttagctgaagttgaaatgatcaaatgatcttatctcatacttgt

SEQ ID NO: 8759 - DNA, 952 bp, Brassica napus
gattattaaaaataataattcactcccttggatcatcgtccatctcctggctctctctcatcagatccttgaatcgagaagaaccgtttgaatactcgcatcagtgagtttgttattggagaggaagggataaggcggagatggtgaagatgacattgatagctcgtgttactgacgggttgcctctagcagagggactcgacgatggacgtgacttaccagattccgacatgtataagcaacaggtcaagtctctgttcaagaatctctccagaggtcataacgaagcttcgagaatgtctgttgaaactgggccctatgttttccattatatcatagaaggacgtgtttgctacttgacaatgtgtgaccgctcttacccaaagaaactcgcgttccagtaccttgaagatctcaagaatgagtttgaacgtgtgaacgggcctaacattgagacagctgctcgaccttatgcctttattaaatttgatacgttcatacagaaaacgaagaaactgtaccaagacactcgtacgcaacgaaatattgctaagctgaatgatgaactctatgaggtccatcagataatgacgcggaatgttcaggaagtcctaggtgttggtgaaaagctggaccaggtgagcgagatgtcgagtaggctaacttctgaatctcgtatatatgctgacaaggctaaagatttgaaccgtcaggctttgatccggaaatgggcaccagtagcgatcgtgctcggtgtagttttccttcttttctgggtcaagaacaagctatggtaaatgaaaggaggaacttaaaggctatttccataatttagcagacttggccagcgcacatctccttattccggcactcaaaatgtcttctttcttttaaagagaaacttcgacacattttgtacttctatagtatgcagacttttatgagacctggt

SEQ ID NO: 8760 - DNA, 886 bp, Brassica napus
taaggcgaagatggtgaagatgacattgatagctcgtgtcactgacgggttgcctctagctgagggacttgacgatgggcgtgacttgccagattccgacatgtataagcaacaggtcaaggctctctttaagaatctctccagaggtcataacgaagcttcgagaatgtctgttgagactggcccctatattttccattacataatagaaggacgtgtttgctacttgacaatgtgtgaccgctcttaccctaagaaactggcgttccagtacctggaagaccttaaaaatgagtttgaacgtgtcaatggacctaacattgaaacagctgctcgaccttatgcctttattaagtttgatactttcattcagaaaacgaagaaactgtaccaagacactcgtacgcaacggaatattgctaagctgaatgacgaactctatgaggtccatcaaataatgacgaggaatgtgcaggaagtcctaggtgttggtgaaaagctagaccaggtgagcgaaatgtcgagccggctaacatctgaatctcgtatatatgctgacaaggctaaagatttgaaccgtcaggctttgatcaggaagtgggcaccagttgccatcgtgcttggggtcgtgttccttcttttctgggtcaagaacaagctctggtaagaaggaaagaacctcaggctagacttctccggacatatatcgaccggcaccaaaaaatatcttttttttttgaagtgaaacattgacacccattttgtacttctgtagtaatgctaaactttatgagactagtcatatgaatcatccatacatactactttttaacttatgtttctttactaaaacgtaaaaaaaaccgtaaaacgtggaacggtccta

SEQ ID NO: 8761 - DNA, 1006 bp, Brassica napus
tcagtgcatctccttggatcatcatcctctttctttcacctggtttctcagatcctgagaagaaccatcggaacgctcgtatcagtgacatttgttattggagaaggaataaggcaaagatggtgaaaatgacgttgatagctcgtgttaccgacgggctgcctctagctgagggtctcgatgatggacgtgacttgcctgattcagatatgtataagcaacaggtcaaggctctgtttaagaatctttccagaggtcataacgaagcttcaagaatgtctgttgagactggcccctatattttccattacatcatagaaggacgtgtttgctacttgacaatgtgtgaccgctcttacccaaagaaactggcgttccaatacctggaagatctcaagaacgagttcgaacgtgtcaatgggcctaacattgaaaccgctgctagaccttatgcctttattaaattcgatacattcatacagaaaaccaagaaactgtaccaagacactcgtacgcaacgaaatatcgctaagctgaatgatgaactctacgaggtccaccagataatgacgcggaatgtgcaggaagtcctaggtgttggtgaaaagctggaccaggtgagcgagatgtcgagccggctaacttctgaatctcgtgtatatgctgataaggctaaagatttgaaccgtcaggctttgatcaggaaatgggcaccagtagcgatcgtgttgggtgtcgttttccttcttttctgggtcaagaacaagctctggtaaggaaaggaggaacatataaggctattttcgtaatctagcagacttctccggtccatatatcagaccgccggcgcaaatcctctttctttcagagtgaaactttgacacattttgtacttctgtagttatgcaaactttacgagactggtcatagactcgtagaatcatccaccaatacattttgtaaaccttgattatcattctatcaggttctgcaaatcaaaaccaac

SEQ ID NO: 8762 - DNA, 889 bp, Daucus carota
gaatagccatcaaataaaaaccctaagaaatctcatcctttacaattgtgctcttctctcagctcagatcgttgaattccattagaattactagctgagagctgttaaaggatggtaaagttaacgatgattgctcgtgtcactgatggtctcccactagtggagggtttggatgatggccgtgatgttcagaatgctgatatctacaaacaacaagtcaaggctttgtttaagaacctttcaagaggtcacaatgaagcttcaagaatgtctgttgaaactggcccctatatgttccattatataattgaagggcgtgtctgttacttgacaatgtgtgatcgtgcttatccaaagaaactcgcctttcaatacttggaagatcttgctaacgaatttgagcgtgttaatgggagtcaaattgaaactgctgcgagaccttatgctttcataaaatttgatacgttcattcagaaaacaaagaaactgtatcaggacacaagaacccagcgtaacatttcaaagctaaatgatgaactctatgaagttcaccaaataatgactcgtaatgtacaggaagttcttggtgttggtgaaaagctagatcaggtcagtcaaatgtccagccggttgacatcagaatctcgcatatatgctgataaggcaaaagatttgaatcgacaggctctgatccggaaatgggctcctgttgcaattgtcttaggaatagtctttcttctattctgggtgaggaagaagatttggtgattttccggattgatgcactttagaatacatgttctgctttttactccggcgctttaggttgcctgttcaaaattcttgagaaaccagagattttgtataaatatatatattttgacatgga

SEQ ID NO: 8763 - DNA, 1497 bp, Citrus clementina
actaatgcctcgcagggttgtacttttcgagcttcaccttcaatttctcaaacgtacaatccatatcagctttgatccctgcaaccgtacatattagaaagtccgccttcgtacatacaatcccttcatttgatacacagctcttttctctctctgtcgacccttgtcttctctcttcttcagatcgttgaattcgcgtagaaaatcccaaatgcaaaaagggtgatttggtgtagcagaggaattttaaagtgagccaaaaatggtgaagatgacgatgattgcccgtgttactgatggtcttccattggcggagggactggatgatggtcgtgatttgagagatgctgagatgtacaagcaacaagtcaaggccttgtttaagaatctctcgagaggccagaatgaggcttcaaggatgtcaattgagacaggaccttatgttttccattatatcattgaaggacgtgtttgttacttgacaatgtgcgaccgtgcttatcccaaaaagctggcctttcaatacttggaagacctcaagaacgaatttgagcgtgttaatggggctcagattgaaactgctgccaggccttacgctttcataaaatttgatacattcatacagaaaacaaagaaattgtaccaggacacgcgtacccagcggaatattgccaagttgaatgatgaactttatgaggtccaccagataatgacccggaatgtgcaggaagttcttggtgttggtgaaaagttggaccaggtcagtgaaatgtccagtcggttgacatcagagtcgcgcatttatgctgataaggcaaaagatttgaatcgacaggctttaattcggaaatgggctcctgtggccattgtgttgggggtggtcttcgttgtcttttggctcaaaacaaagctatggtgattcagttgccctaatgcggatctaatagttgcacattttgcctgggttcctctgcgtcaatgtgggttgctggtgttcatggcttggtgtcaacacttcagaggcatcagatttcatcgacacttgtttctgttcttgatacaatttaatagtccagttggtacgtcataggagtacggataaatctaccctgtggaattgtgtaagagagaccccttttagaatgttcgatgcgccaaagtatattatgtacaaatttttgaaaactctagcctcaggcctttaacgaggctttattgataccattcctatgttcttttgcattacattcaattcttcgagctgcttgatattgtcagaagcaacttttggttttggagatgtactttcctagtgacgcatagtataccatgcttttaaggaagtttgattgtttctatggtgcaattgatcaacttgaattcattctgtaaatctgcttcatggtaaggcgtttgtcaaaggattttagtggtgctggtaaacatgaaactggagaaactgatttcttgccttaccgatgcctatttattactgta

SEQ ID NO: 8764 - DNA, 1257 bp, Humulus lupulus
ttccgagtttattaaacaagccataaaatggtttccgatctctctcccccactccaatcctctggtttctcgatctctctcactccatttgagttttttcgagttatatcgctctcccagtctctgactccatagatactgtatgagtttttcatttttccgatctgtctaatttgagcgtctgtcatcttccttttgctctcctgttactcagtttggttccctgggttggagcattaatttcattcagttaaagtttgatatctgggaatttgggttctcaggatggtgaagctaacaatgattgctcgggtcactgacggtcttccactggcagagggactcgatgatggccgtgatattagagatgttgaattttacaaacagcaagtcaaagctttgtttaagaacctctcaagaggccaaaatgagccgtcaaggatgtcagttgaaactgggccttacatcttccactatataatagaagggcgtgtctgttacttgacaatgtgtgaccgtgcctacccaaagaaacttgcttttcaataccttgaagacctcaagaatgaatttgagcgtgttaatggggcacaaattgaaactgctgccagaccttatgccttcattaagttcgatacattcatacagaaaacaaagaaattgtaccaggacactcaaactcagcggaatatttcaaagttgaatgatgagctctatgaagtccaccaaataatgactcgaaatgtgcaggaagtccttggcgttggtgaaaagttagaccaggtcagtcagatgtccagtcgtctaacatcagaatcacgcatatatgctgataaggcaagggatctaaatcgtcaggcgttaattcgaaagtgggctccagttgccattgttcttggtgttgtgttcctcctcttctgggttaaaaacaagctctggtgatcaggttgagttattattttggagtatgatgttttcactgggctatatatagcggactaacttttgcgttgtccaaacgttatgattgggaatttagatttggtgccacaggctcatgaatgattacgtgttgttacaagttcatcttaattgatggttgaggttgtgaacttgtaactgagtgcggagaggagacccttgttatcagattaactagtaaattacagtattgtaagtgaatagaattttcatttttggtacattgtatctgtcattcattcagtttcaattttaatagaacggcatttgaggaat

SEQ ID NO: 8765 - DNA, 1521 bp, Petroselinum crispum
gcaaggaaaaggaaatgaagaatgaatgagtacccaaaaagaggtgcgtaaatagaaaattgtgaataaccatcaaaattcaaaaccctaataaatctcatcctctacaattgtcttcatctctcagctcagatcgttaatttccattacaattactagctgagcgcattgaaggatggtaaagttgacgatgattgctcgtgtcactgatggtctcccgctagtggagggtttggatgatggacgtgatgttcaaaatattgatatattcaaacaacaagtcaaggcattgtttaagaacctctcaagaggtcacaatgaagcttcaaggatgtctgttgaaaccggcccctatatgttccattatataatcgaagggcgtgtctgttacttgacaatgtgtgatcgtgcttatcccaagaaacttgcctttcaatacctggaagatctcgctaatgaatttgagcgtgttaatgggagtcaaattgaaactgctgcaagaccctatgctttcataaaatttgatacgttcattcagaaaacaaagaaattgtaccaggacacaagaactcagcgaaacattgcaaagctcaatgatgaactctatgaagttcaccaaataatgactcgaaatgtacaggaagttcttggtgtaggtgaaaagttagaccaggtcagtcaaatgtccagccgattgacatcagagtctcgcatatatgctgataaagctaaagatttgaatcgacaggctttgatccggaaatgggctcctgttgcaattgtcttgggaatagtcttcctcctattctgggtcaggaacaagatttggtgatcttccatatttctgcactgctagaatcatcaccctgctttttatcctgtacgctagattgactgcttaaaatcttttgaccccagagattttgtagtggtatatgattctaagtggaagcttatcatctgtttaaggcattcagttggaatacacctttagaggacctggggccaattaatcctacatgatctttttggttgtaccatatgcggataaagtattattagtatatgaaatacatactagtgaattacatatgtgtttttatctgtttgttcctacagaaaatacactttgcaattgtcagcatatgaaatattgtacgctgattcttagtagttcactagttctgttgacgtaaattgagcagccgaacatattaaggagttaagtgatcccctttgattatgatgaactgtatgggaatgtttcgctcttgtttagcaaaggtacatcgacactaatgtagaattgagtagaatagtacccttctactacgtaatatatgtaaattaatatactctaaagcataactattctaaatttgtatttaaacaattgatcacaagttgccgaatctggacattggtacacgagaatttctcaaatgtaacaacttttctaacatgaaattttttctaattccgtccccatctggtgaacggcggccgtgactataacagttg

SEQ ID NO: 8766 - DNA, 1161 bp, Arachis hypogaea
gaaagaaagaaagaaagaggaccctaattccacaaacagagaagagaaagacactcgcagcggtggcaccggcgcattcccagtcggaattagcattttgcggcggcgatctcttcctctccgtctctctccctctcgagccagttccaccacgttttctgtgtattttggatttgttacaaaggtatagactgtaaaagatggtgaagttgactatgattgcccgtgtcactgacggccttccactagctgaaggactggatgatggtcgcgatcttaaagatgctgaattctacaaacagcaagttaaggctttatttaagaatctctcaagagggcacaatgaggcgtcgaggatgtcaattgaaactggcccttatgtcttccattatataatagaaggacgtgtatgttacttgacaatgtgtgatcgtgcataccctaagaaactagcttttcaatatcttgaagagctaaggaacgagtttgagcgtgttaatggatctcaaattgaaactgctgccagaccttatgccttcattaagtttgacacatttatacagaaaacaaagaaactttaccaggatacccatacacagcgcaatatttcaaagttgaatgatgaactctatgaagtccaccagataatgactcgaaatgtgcaggaagttcttggtgttggcgaacaattggaccaggtcagccaaatgtccagccgtttatcatcagaatcccgcatgtatgctgataaggctagggatttaaatcgacaggctctaattcggaagtgggctcctgttgctattgttttcggagttgtcttcgtccttttctggctcaaaaacaaactttggtgatcaagcacagtatattaggttttaaacccaggattttgctgcgctgtggcttcttgcttttcacacatgattgtcaagacttgcacagatcggtgagaaactcttatatgtgtagatgatgcctacttgtgtggacactcagtttaggataaaagaaaagaaagaaaaaaaaaagggattatcgtgtttgttacgtcaggctaactggaacaggaatcttctagccttatgttattgttaagtagtaaagatatgagaaacttgaggtccttgtggatgcatatagatatttctttagtatttt

SEQ ID NO: 8767 - DNA, 770 bp, Petunia hybrida
actattcattcattctccgaaagaggggaattggcgatacaaatttatcaaatcagcgattgagaactgcaatttaagggatcacatacgtgtttaatcgatcgttgtatgcttgcgggaaaaagatggtgaagttgactttgattgctcgtgtgaccgatggcctccctttagctgaggggctggatgacggtcgtgatgttccagatgcagatttctacaaacagcaggtcaaggccttgttcaagaacttgtcaatgcgccaaaatgatgcttcaaggatgtctatcgaaactggtccttatatcttccattacatcattgaagggcatgtttgttatctgacaatgtgtgatcgctcttatccaaagaaacttgcctttcaatatctggaggaccttaagaatgagtttgagcgcgtcaatgggaatcaaattgaaactgctgctagaccttatgcttttataaaatttgatacattcatacagaagacgaagaagttgtaccaggataccagaactcaacgcaatatttctaagttgaatgatgagctttacgaagttcatcaaataatgactcgaaatgtacaagaagttcttggtgttggtgaaaagttggaccaggtcagtcagatgtctagccgcttgacatctgaatcccggatatatgctgataaagcgaaagatttgaatcgtcaggccttgattcggaaatgggcacctgttgctattgtcattggagttgtcattctcctcttctgggttaaacaa

SEQ ID NO: 8768 - DNA, 1299 bp, Lippia dulcis
caatttgagggaattgattttagggaaaagttgtcaaatgaaacgtagttgaattttcctgaaattgataacagcaaaataaaaagttaacgccctctcataaatttagtcaaaattaggacaacatctcattaccctcaaatttctcaaattgctatcgcgatagttccttcagatcgttcgaattttgagcggaggatctatttgaggggcacaattctgtaaattgtagatcggggattcgcgaaaagcacaccggaaggagctcacagacgcatgtcaaaggtgtgagctcaggaaacaaaaatggtgaagttgactatgattgctcgtgttactgatggccttccattagcagagggattggatgatggacgtgatgtatccgatgcagacttttataaacaacaagtgaagtctttgttcaaaaatctgtcaaggggtcataatgaggcatcaaggatgtctgtcgaaacagggccttatatatttcattatattattgaagggcgtgtatgctacttgacaatgtgcgaccgtgcttatcctaagaagcttgcctttcaatatctcgaagacctcaagaatgaatttgagcgtacatatgggaatcagatcgaaactgctgcaagaccttatgcttttatcaaattcgacacatttatacagaagacaaaaaaattgtaccaggacacacgaactcaacggaatatttcaaagttgaatgatgaactctatgaagttcaccagataatgactcgcaatgtacaagaagttcttggtgttggtgaaaagttggacgaggtcagccagatgtccagtcgcttaacttcagaatcccgcatttatgcagataaggcaaaagatttaaaccgtcaggctctgattcggaaatgggcccctgttgctattgttctaggagttgtgtttctcctcttctgggtcaagaacaagctttggtgatcgttctcccattcgctgtttgatgagctgctctgatcttgctaacgtggtattgcagtttcttggctcattctatcatttcatcttttgaaaccactagaaaagggacctgtctcctaattttttttgcgtaattttggaaactaagcatgtcggaaaatatagagatttcgtactatgtgacgaattgatttcaagatgtctgagaaacatatagcttatgcttgttatcttcctctgtttcccattttataagaaaaaacatgagtattctagttttgtgcattgatcttaataccccgcctgcatcttgctcggatgattttgaaaaaagaa

SEQ ID NO: 8769 - DNA, 821 bp, Sesamum indicum
ggctcacatacgcatgttataggtgtgagctcgtgaaataaagatggtgaagttgactatgattgctcgtgttactgatggccttcctctagcagaaggactggatgatggtcgtgacgtgccagattctgacttttacaaacagcaagttaagtctttgttcaaaaacctctcaaggggccaaaatgagccttcacggatgtcgattgaaacagggccatatatattccattatattattgaaggacgtgtctgctatttgacaatgtgtgatcgctcttaccccaagaagctttcgtttcaatatctggaagacctcaagaatgaatttgagcgtgcatatgggaatcaaattgaaactgctgcaagaccttatgctttcatcaaatttgatacattcatacagaagacaaagaaattgtaccaggatacaagaactcagcggaatattgcaaaattgaatgatgaactttatgaagttcaccagataatgactcgtaatgtacaggaagttcttggtgttggtgaaaagttggaccaggtcagtcagatgtccagtcgattgacatctgaatcccgcatatacgctgataaggcaaaagatttgaaccgccaggctttgattcggaaatgggctcctgttgctgtcgtcctaggagttgtcttcctcctcttctgggtcagaaagaagttctggtgatgctgcagccatttgtagtggacgagttctttcagtcttgctaacttctttgctgctcctcggttcacaactgtatttcatcttcagagatcaagatctgattaaaggacttcttcttcaa

SEQ ID NO: 8770 - DNA, 1023 bp, Helianthus annuus
atttcatttcatccggttcgatccgtttatctgcatgctcatcgatcaatgtggatcaagataaagatatacgcatgataaatacataaatatatacaatttcaggttttgttgaatttcataaagtgtatagcttcttaaggtaaatatggtgaagttgacgatgattgcgcgtgttaccgatggccttccgctagctgaaggattagacgatgggcgtgatctgcaggatgcagagttttataaacagcaagttaaggccttgtttaagaatctttcaagaggacaaaacgaagcttctcggatgtctgtggaaaccggcccgtacatttttcactatattattgaagggcgggtgtgttatttaacgatgtgtgatcgagcttatccaaagaagcttgcttttcaatatcttgaagatcttaagaatgaatttgagcgcggttatgggaatcaaatcgaaactgctgcaagaccctatgcttttataaaatttgatacatttatacagaggactaagaaactgtaccaggacactagaactcaaaggaatattgctaagttgaatgatgagctttatgaagtacaccaaataatgactcgtaacgtgcaggaagttcttggtgttggtgaaaagttggaccaggtcagtcaaatgtcaagccgattaacctcggagtctcgcgtctatgctgacaaagctagagatctaaatcgtcaggcattgatcaggaagtgggctccggttgcaattgttcttggagttgtcattctgctattttgggccagaaataagatatggtgatcaatgatctgtaatcagttgttttgtgagggattaagaaattataaatcatttgagccttaaactagaaaaagtttataaattaaggctgaattttcagcatatatagttgctagctatagcctatatagaggtggttatctaaaagaaacctttgtgttaaagtatttactttatctttgttggatttatggattaatacatgagtttgttgtggt

SEQ ID NO: 8771 - DNA, 1005 bp, Helianthus annuus
attcatcatccttccaaaccctacaatttcatttcatttcgtttcatccggttcgatccgtttatctgcatgctcatcgatgaatgtggatcaagataaagatatacgcatgataaatacttaaatatatacaatttcaggttttgttgaatttcatatagtgcatagcttcttaaagtaaatatggtgaagttgacaatgattgcgcgtgttaccgatggccttccgctagctgaaggattagacgatgggcgtgatctgcaggatgcagagttttataaacagcaagttaaggccttgtttaagaatctttcaagaggacaaaacgaagcttctcggatgtctgtggaaaccggcccttacatttttcactatattattgaagggcgggtgtgttatttaacgatgtgtgatcgagcttatccaaagaagcttgcttttcaatatcttgaagatcttaagaatgaatttgagcgcggttatgggaatcaaatcgaaactgctgcaagaccctatgcttttataaaatttgatacatttatacagaggactaagaaactgtaccaggacactagaactcaaaggaatattgctaagttgaatgatgagctttatgaagtacaccaaataatgactcgtaacgtgcaggaagttcttggtgttggtgaaaagttggaccaggtcagtcaaatgtcaagccgattaacctcggagtctcgcgtctatgctgacaaagctagagatctaaatcgtcaggcattgatcaggaagtgggctccggttgcaattgttcttggagttgtcattctgctattttgggccagaaataagatatggtgatcaatgatctgtaatcagttgttttgtgagggattaagaaattataaatcatttgagccttcaactagaaaaagttataaattaaggctgaattttcagcatatatagttgctagctatagcctatattgaggtggttatctaaaagaaacctttgtgttaaagt

SEQ ID NO: 8772 - DNA, 2063 bp, Eutrema parvulum
atgcagtgaatttgttattggagaagggatacggccaagatggtgaaaatgacattgatagctcgtgttactgacgggttgcctttagcagagggtcttgatgatggacgtgacttaccagattcagacatgtataagcaacaggtcaaggctctgtttaagaatctttccagaggtcaaaatgaagcttcaagaatgtcggttgaaactggcccctatgttttccattacatcatagaaggacgtgtttgctacttgacaatgtgtgaccgctcttacccaaagaaactcgcgttccaatacttggaagatctcaagaatgaatttgaacgtgtcaatgggcctaacattgaaacagctgctcgaccgtatgccttcattaaatttgataccttcatacagaaaaccaagaaactgtaccaagacactcgtacacaacgaaatattgctaagctgaatgatgaactctatgaggtccatcaaataatgactcggaatgtgcaggaagtcctaggtgttggtgaaaagctggaccaggtgagcgagatgtcgagtcggctaacatctgaatctcgtatatatgctgataaggctaaagatttgaaccgtcaggctttgatccggaaatgggcaccagttgccatcgtgctcggggtcgttttccttcttttctgggtcaagaccaagctatggtaagaaaggaggaacctaaagctattttcgtaatttagcgaacttgtccggacacatatcgaccgctggcgcaaatctcctgattccggcacccaaaatatcttccttctttcaaagagaaactttgacacattttgtacttctgtagtatgcaaactttatgagactagtcacattatcatccttcatactcttgattgtcattttctcaggtttcttcaaatcaaatcataatcaaaatcaaactatcccgattgcgttttgatttcattacatattcctaaccgaaatgaaatatatgaacacacagctcctcaaaactagaggccttttagcgtctatgtggtctcaagtgtcgtttgaaatcttgtggacctgccaaatctaatgaggaagtgttgttcaactcatctgaaagcagcaatgctctctgataatctcctgacttcttcagacaatcaattaatgctcggtagacgtaaaccgatggtcgaatccctcgctgtttcatctcatcgaaaagcctcaatgaatcctttatgttccctgatcgacccaaactgtctatcgctgcggtataactaagcaaatcaggttcaattccacactgaaccatttcgttgtataacaccagacacatatcgaaccgacaagctttcctcaacccgtttaataccgtgttgtatgtaatgatgttcaagaatacatcacaatcctccttcatcgatgaaaataacccgagcatctcgttcgcaaggccagctcggcccaagatatccaaaaccgaattgtatgtaattacatctggtatacattgccactctttcatttgctcaagtatcataaggaccttattgatctgtctagattcagcaaatgcaaggatggttctgtttatcactattaacctacatggaagagaagactgcgatacttctttgagaagactcaacaactgtacgcaatcatcggtttcaataaaggctctagcgagattgagataacaatctgaactcaaaggcttacccgcttgtactaatagctctctgaaagctctgcaagagagcttcatatcgttctgctcacccgctgctgcaagaaggttcttgcaaaccgaaacaggcaagcaaatgttcttgtcttgtaaggattgcagcaaatcatatgcagcagagagatttccatctcttctatacttctctacaagattcgagtaatcgatcctgctgatgaccttcgaaccagtttcactattgtcagccattttcttcagggcttcttcgtcttcttctcctgtgtttatcaacgagtgcagagcgaaggaagagcagctccagctaaactcagcaggagctaacaccatatgtttc

SEQ ID NO: 8773 - DNA, 1159 bp, Nicotiana tabacum
gataagagtttacgagaggatcaaacaaaatcaaaatcaaagatcgaggaattagaaataccacagatcaacaaacaaagcgtgcaccgacgtgtatgatagttgtgcgcttgtttaaggaaaatggtgaagttgactatgattgctcgtgtaactgatggccttcctctagctgaggggctggatgatagccgcgatgttccagattcagatttctacaaacagcaagccaagtccttattcaagaacctctctatgggccagaatgaggcatcaaggatgtccgttgaaactggaccttatattttccattatatcattgaagggcacgtttgttatctgactatgtgtgatcgctcttatccaaagaaacttgcctttcagtacctggaagaccttaagaatgagtttgagcgtgtcaataggagtcaaatcgaaactgccgctagaccttatgcctttatcaaatttgatacattcatacagaagacgaagaaactgtaccaggataccggaactcagcgcaatatttcgaagttgagtgatgaactttatgaagttcatcagataatgactcgaaatgtacaagacgttcttggtgtcggtgaaaaattggaccaggtcagtcagatgtccagccgcttgacatcagaatcccgcatatatgttgataaggcgagagatttaaatcgtcaggctttgattcggaaatgggctcctgttgctattgtcattggagttgttagtctcctcttctgggttaaaaataagatctggtgatgctgccagaagatgtacagcttagcggagatgttactctcacattggacagtgcacaaccgacataaacacaatggtgtttgcttttctgtgcatggggcaagtcaagcaatttcagttgaaaatgtaaaacagagaaagtaaaccatgacgagccatgtcgctgatacatgagaaatgatattgatacgaattgctcggcatgttttttctcattactcaaccacaaacttgccctccaataggttattgtaactctgaaatgacgactagctatgcagtaaattacagtggaggcctcatagtgtactattttgatttgtttagtagaaatgcatgatcatgatttctgaagattataaagaggttctttctatct

SEQ ID NO: 8774 - DNA, 1278 bp, Rosmarinus officinalis
agttcacgccctctcacaatttcagtcaaaatttggacaacatcttattactctcattttgtttttatcactggcccagattgttatcgcgatctttcgttcagatcgttcgaattttgagcgcaggatctattttaggggcgcatttttgtaatcgttgaacctgattgaagatcggggctcacgaaaagtacacctggaggagctcacagacgcatgtcaaaggtgtgagctcaagaaataacaatggtgaagttgactatgattgctcgtgtcactgatggccttccattggcggagggactggatgatggacgtgacatgtcagatgcggactattataaacagcaagtgaagtctttgttcaaaaatctgtcaaggggccagaatgagccatcaaggatgtctatcgaaacagggccttatatatttcattatattattgaagggcgtgtatgctacttgacaatgtgcgaccgcgtttatcctaagaagctttcctttcaatatctagaagacctcaagaatgaatttgagcgtgcatacgggaatcagatcgaaactgctgcaagaccttatgcttttatcaaatttgacacattcattcagaagacaaaaaaattgtaccaggacacaagaactcaacggaatatttcaaagttgaatgatgaactctatgaagttcaccagattatgactcgcaatgtacaagaagttcttggtgttggtgaaaagttggaccaggtcagccagatgtccagtcgcttaacatcagaatcccgcatttatgcagagaaggcaaaagacttgaaccgccaggcgttgattcggaaatgggcccccgttgctgttgttctaggagttgtgtttctcctattctgggtcaagaacaagctttggtgatccttcacctgtttgctgtttgatgagctctgatctggtcttgccattgcggtattgtagtttcttggcgcattctatcattttatcttttgaaccatcagtatagatctggtattgcagtttcttggcgcattctatcattttatcttttgaaccatcagaaaagatctgtcgctacgcccttccaaatttttgaggattttggaaactaagcatgtcggaaaatatagagacttcttactatgagacaaattgattttaacatttctgagaaacatatagcctatgcattttatcttcctacacccccaactagttatccaactctgtgtgtcccattttataacaaaaattacgagtattcgagttttactg

SEQ ID NO: 8775 - DNA, 1058 bp, Arnica chamissonis
accctataattcaattcgattcgattccgttatctccatgttgtgcattatcgtatacctcgatcatcgatcaatgtagatcaaaaagcttaaaccaggaaagatctggtcatccatacgcatgataaatactcgatacaaaatttcaggttatagcttctcgaagtaattatggtgaagctgacaatgattgctcgtgttactgatggccttccactagctgaaggattagatgatggacgtgatatgcaggatgcagagttctataaacagcaagttaaggccttgtttaaaaacctttcaagaggacaaaatgaagcttctcgaatgtctattgaaacgggaccttacattttccactatattattgaagggcgggtatgttatttaacgatgtgtgatcgtgcttatccaaagaagcttgcttttcaataccttgaagatcttaagaatgaatttgagcgtggttatgggaatcaaattgaaactgccgcaagaccttatgcttttataaaatttgatacatttatacagaggactaagaaactgtaccaggacacacgaactcaaagaaatattactaagttgaatgatgaactttatgaagtacaccaaataatgacccgtaatgtgcaggaagttcttggtgttggtgaaaagttggaccaggtcagtcaaatgtcaaaccgattaacctcagaatctcgcatctatgctgacaaagcaagggatctaaatcgacaggcattgatcaggaagtgggctcctgttgcaattgttcttggagttgtcattctactcttctgggccaaaaataagatatggtgatcacttgtatttggggggcttaacaaattataaattatttgagccttcaactggctgtatttttcagcatggtatatggagaggttaactaatagaaacctttgtgtttagaaagtatttactctttgtgttagattaatggagtcatatgaggatttgttatgcaacattattaatggtctcctttacactgttgttcaactaaagaatggttgaggtgttaaaaccca

SEQ ID NO: 8776 - DNA, 1130 bp, Artemisia annua
tactccgacgggattcaacgttgagtcatacaactcattcattttttcccccaatttcatcaaatccaccaaaaccctaatcccaaatccatcaaatccatcaaatctcaaacacccatttcatcaattcatcatcaccacatgatccaatcttgaaacccaattttcagtaaagatggtgaagctgacaatgattgcgcgtgttacggatggtcttccgttagccgagggacttgacgatgggcgcgatatgcaagatgctgatttttataagcagcaagttaagtctttgtttaagaatctttccagggggcaaaatgatgcctcgaggatgtcggttgagaccgggccttatgtttttcactatatcattgaagggcgggtatgctatttaacaatgtgcgatcgtgcttatccaaagaaacttgcgtttcaatatctcgaagatcttaagaatgaatttgagcgtggttatgggaatcagattgaaactgctgcaagaccttatgctttcataaaatttgatacatttatacaaaggactaagaagttgtaccaggacacaagaactcagcggaatatctctaagctgaatgatgaactttatgaagttcaccaaattatgactcgtaatgtacaggaagtccttggtgttggtgaaaagttggaccaggtgagtcaaatgtcaagccgcttaacatcagatactcgcatatatgctgataaagcaagagatctaaaccgtcaggctttgattaagaagtgggctccggttgcaattgtgctcggagttgttttcctattgttctgggccagaaacaagatatggtgatcgcggcttcattagtttaacatgtggaaatatttttttccatttcgttgagttattacagttacagggtctgcactttagttgaattatataaatttgcatcgtgaattggagaattttgtttgtgtttaatatttagacaagttcaatccatcaagaagcattcgctatattgacaaaacctcacatttgtgttggtcttcagtttttatttatgtaatgctgatgaatacaccgttccaaaatgttcacaactgcacgtttattcgtacagtgagatttgccaaactacagtgct

SEQ ID NO: 8777 - DNA, 888 bp, Fagus grandifolia
caatacctcaaagcaagccttctctctttttgtccttcaaatccaaaaccctctattttagacatttttttctcgctcagattctgagcatagtcatcatcgtctctcagatccttcaacatcaaaagcaaagtacaaatgatataaaccagctgcaaaggtgtaagctgaagatggtaaagctaacattgattgctcgtgtaactgatggtcttccactagtagagggactggatgatgcgcgcgatttaaaagatgcggaatactacaaacagcaagtcaaggctttgtttaaaaacctctcaagaggtcagaatgaggcttctaggatgtcaattgaaactggcccttatattttccattatattattgaaggacgtgtctgttacttgacaatgtgtgaccgtgcttatcctaagaagctcgcctttcaataccttgaagacctcaagaatgagtttgagcgtgttaatgcggctcaaattgaaactgctgccagaccttatgccttcatcaaatttgacgcattcatacagaaaacaaagaaactgtatcaggacacccgtacccagcggaatattgcaaagttgaatgatgaactctatgaagtccaccaaataatgacgcgcaatgttcaggaagttcttggtgttggtgaaaagttggaccaggtcagtgaaatgtccagtcggttaacatcagaatctcgtatatatgctgataaggcaagagacttaaatagacaggcgttgattcggaagtgggctcctgttgccattgtgtttggagttgtcttcctcctcttctgggtcaaaacaaagatctggtgatcattctgaaaactgttgtgcattttctctgcacttctcgtggcataatagtctagac

SEQ ID NO: 8778 - DNA, 1322 bp, Cannabis sativa
ctcaaatctgtaagtcttgctatataattttgagcttatataactgttgacagattgcagttaaagtttgatctctgggaattcgggtatccaggatggtgaagctaacaatgattgctcgtgttactgatggtcttccactagcagagggacttgatgatggccgtgatattagagatgttgaattttacaaacagcaagtcaaagctttgtttaagaacctctcaagtggccaaaatgagccgtcaaggatgtcagttgaaactggaccttacattttccactatataatagaaggtcgtgtctgttacttgacaatgtgcgaccgtgcctacccaaagaaacttgcttttcaataccttgaagacctcaagaatgaatttgagcatgttaatggggcacaaatcgaaactgctgccagaccttatgccttcattaagttcgatacatttatacagaaaacaaagaaattgtaccaggacactcgtactcagcggaatatttcgaagttgaatgatgaactctatgaagtccaccagataatgactcgaaatgtgcaggaagtccttggcgttggtgaaaagttagaccaggtcagtcaaatgtctagtcgtttaacatcagaatcgcgcatatatgctgataaggctagggatctaaatcgtcaggctttaattcgaaagtgggctccagttgccattgttcttggtgttgtgttcctcctcttctgggctaaaaacaagctctggtaatctagttgagctattattttggagaggataatgttttcactgggctataggactgacgtttggttacttgtccaaacattacgacttgggagtcaggtttggtgcctgactctgaggctcatgaatgattacgggatgtcagttacaagttcatcttagttgatggttcaggtaatgaaacctgtaactgacttcggagaggagacccttatatcaaattaactagtaaattacagtaatataatactacaacaattactattgtaagtgaatagaattttcatttttgatacattctatgggttatattcattcagtttcaattttaatagaacggctttggtgtgatgacaatttccagttaaacggatatgtggaaagctgtctgagcacaattactgtatgtttcgataagtggtaataattctcagcaattcttggcatcggactgtgtttatgtcgtgtcattgcaggtttgcttgtctagttgatcaattttaatccaccccacaccatttatgattcatattaagaaatttcaaaccttggtccatcaactcattgtgttcg

SEQ ID NO: 8779 - DNA, 976 bp, Brassica napus
attaaaaataataattcactcccttggatcatcgtccatctcctggctctctcatcagatccttgaatcgagaagaaccgtttgaatactcggatcagtgagtttgttattggagaggaagggataaggcggagatggtgaaaatgacattgatagctcgtgttactgacggtttgcctctagcagagggactcgacgatggtcgtgacttaccagattccgacatgtataagcaacaggtcaagtctctgttcaaaaatctctccagaggtcataacgaagcctcgagaatgtccgttgaaactggcccctatgttttccattacatcatcgaaggacgcgtgtgctacttgacaatgtgtgaccgctcttacccgaagaaactcgcgtttcagtacctggaagatctcaggaatgagtttgaacgtgtgaacgggcctaacattgagacagctgctagaccttatgcctttattaaatttgatactttcatacagaaaacgaagaaactgtaccaagacactcgtacgcaacggaatattgctaagctgaatgatgaactctatgaggtccatcagataatgacgcggaatgtgcaggaagtccttggtgttggtgaaaagctggaccaggtgagcgagatgtcaagtaggctaacttccgaatctcgtatatatgctgataaggctaaagatttgaaccgtcaggctttgatccggaaatgggcaccagttgcgatcgttttgggtgtcgttttccttcttttttgggtcaagaacaagctatggtaaatgaaaggaggaacctaaggctattttcgttatttagcagacttggccggcgcacatctcctgattccggcacccaaaatatcttctttctttaaagagaaacttcgacacattttgtacttctatagtatttaaactgttataagactgctcatattatcatcatccgttatactctttaaacc

SEQ ID NO: 8780 - DNA, 943 bp, Daucus carota
ccctgcatctcatcctctaccttactctctctctgggctgagatcgttgatctgaaaagaaataggtgagcgaaaaatcatttcttctcaaaggaggagctcaggaggatctgaatattcaccaccatccgtttcttctttactccaggtaattccttttgaagtatggtgaaacttacaatgattgcccgtgtcactgatggtcttccactagtggagggtttggatgatggacgtgatgttcaaaatgtggactattacaaacaacaagttaaggcgttgtttaagaacctctctagaggtcacaatgaagcttcaaggatgtctgttgaaaccggcccctatatattccattatataattgaaggccgtgtctgttatttgacaatgtgtgatcgtgcttatccaaagaaactcgcctttcaatacttggaagatcttgctaacgaatttgagcgtgttaatgggagtcaaattgaaactgctgcgagaccttatgcattcataaaatttgatacgttcattcagaaaacaaagaaactgtatcaggacacaagaacccagcgtaacatttcaaagctaaatgatgaactctatgaagttcaccaaataatgactcgtaatgtacaggaagttcttggtgttggtgaaaagctagatcaggtcagtcaaatgtccagccggttgacatcagagtctcgcatatatgctgataaagcaaaagatttgaatcgacaggctctgatccggaaatgggctcctgttgcaattgtcttaggaatagtctttcttctattctgggtgaggaagaagatttggtgattttccggattgatccaattctagaatacttgttctgcttttttactccggcactctaggttgcctgttcaaaattcttgagaaaccagagattttgtataaatatatatatttcgacatg

SEQ ID NO: 8781 - DNA, 1237 bp, Daucus carota
ctgggaatagccatcaaataaaaaccctaagaaatctcatcctttacaattgtgctcttctctcagctcagatcgttgaattccattagaattactagctgagagctgttaaaggatggtaaagttaacgatgattgctcgtgtcactgatggtctcccactagtggagggtttggatgatggccgtgatgttcagaatgctgatatctacaaacaacaagtcaaggctttgtttaagaacctttcaagaggtcacaatgaagcttcaagaatgtctgttgaaactggcccctatatgttccattatataattgaagggcgtgtctgttacttgacaatgtgtgatcgtgcttatccaaagaaactcgcctttcaatacttggaagatcttgctaacgaatttgagcgtgttaatgggagtcaaattgaaactgctgcgagaccttatgcattcataaaatttgatacgttcattcagaaaacaaagaaactgtatcaggacacaagaacccagcgtaacatttcaaagctaaatgatgaactctatgaagttcaccaaataatgactcgtaatgtacaggaagttcttggtgttggtgaaaagctagatcaggtcagtcaaatgtccagccggttgacatcagagtctcgcatatatgctgataaagcaaaagatttgaatcgacaggctttgatccggaaatgggcccctgttgcagttgtcttgggaatagtcatcctcctgttttgggtcaggaagaagatttggtgatcttccatatgtttgcactgctagaatgatcaccctgcttttaatcctgcacgctagattgactgttttaaatctatagaagccagagatttcgtattggtatatgattcgactttagttaaaggattcagttcaaatacacctttagaggaggattgttggccaattaaacctatatgatctttttggttgtaccatatgcggattaagtactgttagtatctgaaatacagtagtgaattacatgtgtctgtatctgtttgttcctttggaaaatacacttgacagttgttagcatatgaaatagacttaattgcatattgttggcttatggtgtaaattttttgcatgttattggcagacttttgagtttttaaagtgaacaatcgtggggctgactaattgtttttaagccgagaagttgcttcgcccaaaacaggcagacggcgtcaacgtaattgaggg

SEQ ID NO: 8782 - DNA, 1048 bp, Centaurea maculosa
tttctctctactgtttctattcccatccatccccaattcatcaaaataccaaaaccctaattattcttattattacaatcctaagatcggatcatcaatacgcatgataactacttgaaattctccaccgcttctcaaagtaaagatggtgaagctgacgatgattgctcgtgtcattgatggccttccactagcggagggattggatgatggtcgtgatttgcaggatgcagagttctacaaacagcaagtcaaggctttgttcaagaacctttcaaggggacaaaacgaagcctcgaggatgtctgttgaaactggcccttatattttccactatattattgaagggcgggtgtgttatttgacaatgtgtgatcgtgcttatccaaagaaacttgcctttcaatatcttgaagatcttaagaatgaatttgagcgaggttatgggaatcaaattgaaactgctgcaagaccatatgctttcataaaatttgatacatttatacagaggactaagaaactgtaccaggatacaagaactcagcggaacattgctaagttgaatgatgagctctatgaagttcaccaaataatgactcgtaatgtacaggaagtccttggtgttggtgaaaagttggaccaggtcagtcaaatgtcaagccgcttaacatcagatactcgcatatatgctgacaaagcaagagatctaaatcgacaggctttgatcaagaagtgggctcctgttgcaattgttcttggagttgttatcctactgttctgggctagaaagaagatatggtgatcatggcttccattgtttcatttttcgctgtgttccagttccggggatttaagttaattcttcttgcaccacttgcactttagttattatctattttcaccttgaactggaaattttgtttatgtgccttaaacatttagacgagtttaatgcggcattcacaaacctcacttttgtcacatgaatttggtgtaatgttactgattactctttcggatttggtggaggcatattataatctagcaa

SEQ ID NO: 8783 - DNA, 1094 bp, Centaurea maculosa
cgggggtttcggtaggagggtattctgcgtttcttcatccggtcatctctctctactgtttgtattcatccccaattaatcgaaatccaaaaccctattcttattctttattgcaattgcaattttataagatcggatcatcaaatacgcatgataactagttgaaaattctccatcgcttctcaaagtaaagatggtgaagctgacgatgattgctcgtgtcattgatggccttccactagcggagggattggatgatggtcgtgatttgcaggatgcagagttctacaaacagcaagtcaaggctttgttcaagaacctttcaaggggacaaaacgaagcctccaggatgtctgttgaaactggcccttatattttccactatattattgaagggcgggtgtgttatttgacaatgtgtgatcgtgcttatccaaagaaacttgcctttcaatatcttgaagatcttaagaatgaattcgagcgaggttatgggaatcaaattgaaactgctgcaagaccatatgctttcataaaatttgatacatttatacagaggactaagaaactgtaccaggatacaagaactcagcggaacattgctaagttgaatgatgagctctatgaagttcaccaaataatgactcgtaatgtacaggaagtccttggtgttggtgaaaagttggaccaggtcagtcaaatgtcaagccgcttaacatcagatactcgcatatatgctgacaaagcaagagatctaaatcgacaggctttgatcaagaagtgggctcctgttgcaattgttcttggagttgttatcctactgttctgggctagaaagaagatatggtgatcatggcttccgttgtttcatttttcgctgtgttccagttctggggatttaagttaattcttcttgcaccacttgcactttagttattatctattttcaccttgaactggaaattttgtttatgtgccttaaacatttagacgagtttaatgcggcattcacaaacctcacttttgtcacatgaatttggtgtaatgttactgattactctttcggatttggtggaggcatattataatctagc

SEQ ID NO: 8784 - DNA, 934 bp, Chrysanthemum coronarium
cacaaaatttcatcaaaatccaccaaaaccctaatcccaaatcaaccaaatcccaaaaacccaattcatcaattcatgatccaatcttgaaaatccatttttcagtgaagatggtgaagctgactatgattgcgcgtgttacggatgggcttccattagccgagggacttgacgatgggcgcgatatgcaagatgctgatttttataagcagcaagttaagtctttgtttaagaatctttccagggggcagaatgatgcgtcaaggatgtcgcttgaaaccgggccttatgtttttcactatatcattgaagggcgggtatgttatttaacaatgtgtgatcgtgcttatccaaagaaacttgccttccaatatctcgaagatcttaagaatgaatttgagcgtggttatgggaatcagattgaaactgctgcaagaccttatgctttcataaaatttgatacattcatatcaaggactaagaaattgtaccaggacacaagaactcagcggaatatctctaagttgaatgatgaactttatgaagttcaccaaattatgactcgtaatgtacaggaagtccttggtgttggtgaaaagttggaccaggtgagtcaaatgtcaagccgcttaacatcagatactcgcatatatgccgataaagcaagagatctaaaccgccaggcgttgattaggaagtgggctccggttgcaattgtgctcggagttgtttttctgctgttctgggctaaaaagaagatatggtgatcgcagcttctatttttctatttcgttgagttattacagttacaggccgggtctaagttaaattctattcgcaccatctgcactttagttgaattatataaaattcgcatcgtgaattggagagttttgttaatgtgtttaatatttagaccaagttcaatccacca

SEQ ID NO: 8785 - DNA, 1176 bp, Chrysanthemum coronarium
caggtaatcatcctttcttcatcaagtcataaactcttcaatttttccccaaaatttcatcaaaatccaccaaaaccctaatcccaaattcatcaaatccctcaaatctcaaacacccatttcatcaaatcatcatcaccacatgatccaatcttgaaacccaattttcagtgaagatggtgaagctgacaatgattgcgcgtgttacggatggtcttccgttagccgagggacttgacgatgggcgcgatatgcaagatgctgatttttataagcagcaagttaagtctttgtttaagaatctttccagggggcaaaatgatgcctcgaggatgtcggttgagaccgggccttatgtttttcactacatcattgaaggtcgggtatgttatttaacaatgtgcgatcgtgcttatccaaagaaacttgccttccaatatctggaagatcttaagaatgaatttgagcgtggttatgggaatcagattgaaactgctgcaagaccttatgctttcataaaatttgatacatttatacaaaggactaagaaattgtaccaggacacaagaactcagcggaatatctctaagttgaatgatgaactttatgaagttcaccaaattatgactcgtaatgtacaggaagttcttggtgttggtgaaaagttggaccaggtgagtcaaatgtcaagccgcttaacatcagatactcgcatatatgctgataaagcaagagatctaaaccgtcaggctttgattaagaagtgggctccggttgcaattgtgctcggagttgttttcctgttgttctgggccagaaacaagatatggtgatcgcggcttcattagtttaacatgtggaaatattttttccattccgttgagaaattacagttacagggttctaagttaattctattcgcaccacctgcacttcagttgaattatataaatttgcatcgtgaattggagaattttgtttgtgtttaatatttagacaagttcaatccaccaagaagcattcgctatattgacaaaacctcacatttgtgttggtcttcggtttttatgtatgtaatgctgatcgccttccaaaatgttcacaactgcatgtttattcgtacagtgagattcgcatatctttttagggataatttcataatatagcaccttgttg

SEQ ID NO: 8786 - DNA, 1144 bp, Chrysanthemum coronarium
ggtattcatcctttcttcatcaagtcacaaattttcatcaaaatccaccaaaaccctaatcccaaatcccccaattccatcaaatcccaaaaacccaattcatcaattcatgatccaatcttgaaaacccaattcatcaattcatgatccaatcttgaaaacccatttttcagtgaagaagatggtgaagctgacgatgattgcgcgtgttacggatgggcttccgttagccgagggacttgacgatgggcgcgatatgcaagatgctgatttttataagcagcaggttaagtctttgtttaagaatctttccagggggcagaatgatgcgtcaaggatgtcgcttgagaccgggccttatgtttttcactatatcattgaaggccgagtatgttatttaacaatgtgtgatcgtgcttatccaaagaaacttgccttccaatatctcgaagatcttaagaatgaatttgagcgtggttatgggaatcagattgaaactgctgcaagaccttatgctttcataaaatttgatacattcatatcaaggactaagaaattgtaccaggacacaagaactcagcggaatatctctaagttgaatgatgaactttatgaagttcaccagattatgactcgtaatgtacaggaagtccttggtgttggtgaaaagttggaccaggtgagtcaaatgtcaagccgcttaacatcagatactcgcatatatgccgataaagcaagagatctaaaccgtcaggcgttgattaggaagtgggctccggttgcaattgtgctcggagttgtttttctgctgttctgggccaaaaagaagatatggtgatcgcagcttcattagtttaacatgtggaaatatttttccatttcgttgagttattacagagttacaggccgggtctaagttaaattctattcgcaccatctgcactttagttgaattatataaaactcgcatcgtgaattggagagttttgttaatgtgtttaatatttagaccaagttcaatccaccaagaagcattcgctatattgacggaacctcacatttgtgttggtcttgagtttttatttatgtaatgctgataaatacgcgttcctaaatgttcccgactgcatgtttattcgtatga

SEQ ID NO: 8787 - DNA, 1141 bp, Cichorium intybus
cgttttacttttaccagtattttaaggtattctgcgtttcttcatcgagtcgtcatcgtactgtatgcccaattacccttcttccaaaaccctatcatcgttttcgattccattcaatttctcgattttggaccttctcgttattaatcaattttacatccgtagaattgcgaaccactacagattggatcatcatacgcatgataagtacttgaaattatcagcttctcaaagtaaagatggtgaagctgacaatgattgcccgtgtcactgatggccttccgctagcagaaggactggatgatggccgtgatatgcaggatgcagagttctacaaacagcaagtcaaagcattgtttaagaacctttcaaggggccaaaatgaagcttcaaggatgtccattgaaactggcccttacgttttccactatattattgaaggtcgtgtatgctatttgacaatgtgtgatcgtgcttacccaaagaaacttgcattccaatatcttgaagatctaaagaacgaatttgaacgtggttacgataatcaaatcgaaactgctgcaagaccatatgctttcataaaattcgatacatttatacagaagactaagaaattgtaccaggacacaagaactcagaggaacatttctaagttgaatgatgaactctatgaagttcaccaaataatgactcgtaatgtgcaggaagttcttggtgttggtgaaaagttggaccaggtgagtcaaatgtcaagccgcttaacatcagatactcgcatatatgctgataaagcaagagatctaaatcgacaggctttgatcaagaagtgggcccctgttgcagttgttgttggatttgttatcttactgctctgggccaaaaataagatatggtgatcatggcttcctttgttgcatggaaatatttttccatttaatgagagtttaagttacagaggggttttaagttgattctagtttattatcgatttgcaccttcaactagaaagttttgtttaacatttagacaagttcaatccaccacataggtttttataatttacatgaatctgttcttatttctgtaatatttataatactctctgaaatttgctctcaacatatttcgtctgtttaaaagt

SEQ ID NO: 8788 - DNA, 1205 bp, Cirsium arvense
caaaaaaaaaggtaggagatggcattggcagcccacatatgaggtaaatttatattgttttaattttatcttatttaattatttgtattaatttcctcataggaggtgttctgcgtttcttcatccggtcatctctctctactgtttgtattcatccccaattcatcatcgaaatccaaaaccctattcttattctttattgcaattgcaattttataagatcggatcatcaaatacgcatgatacctacttgaatttctccaccgcttctcaaagtaaagatggtgaagctgacgatgattgctcgtgtcattgatggccttccgctagcggagggattggatgatggtcgtgatttgcaggatgcagagttctacaaacagcaagtcaaggctttgttcaagaacctttcaaggggacaaaacgaagcctccaggatgtctgttgaaaccggcccttatattttccactatattattgaagggcgggtgtgttatttgacaatgtgtgatcgtgcttatccaaagaaacttgcctttcaatatcttgaagatcttaagaatgaattcgagcgaggttatgggaatcaaattgaaactgctgcaagaccatatgctttcataaaatttgatacatttatacagaggactaagaaactgtaccaggatacaagaactcagcggaacattgctaagttgaatgatgagctctatgaagttcaccaaataatgactcgtaatgtacaggaagtccttggtgttggtgaaaagttggaccaggtcagtcaaatgtcaagccgcttaacatcagatactcgcatatatgctgacaaagcaagagatctaaatcgacaggctttgatcaagaagtgggctcctgttgcaattgttcttggagttgttatcctactgttctgggccagaaagaagatatggtgatcatggcttccattgtttcatttttctctgtgttccagttccgggggtttaagttaattcttcttgcaccacctgcactttagttattatctattttcaccttgaactggaaagttttgtctatgtgccttaaacttttagacgagtttaatgcggcattcacaaacctcacttttgtcacatgaatttggtgtaacgttactaatttctctttcggatttggtggaggcatattataatctagcaagcaggcacctttctttcttt

SEQ ID NO: 8789 - DNA, 1025 bp, Cirsium arvense
tttattatcctcgtaaacctcgatcgccgatcaatgtagatccacaaactcaaacaggaaagataaatacttcttcaataaataaatctggggagtggttattagagtaaagaagatggtgaagttgacgatgattgctcgtgtcactgatgggcttcctctagctgaaggactggacgatgggcgtgatatgcaggacgcagagttctataaacagcaagttaaggctttgtttaagaacctttcaagagggcaaaatgaagcgtcaaggatgtctgttgagaccggcccgtacatttttcactatatcattgaagggcgggtatgctatttgacaatgtgtgatcgtgcttatccgaagaagctggcattccaataccttgaagatcttaagaatgagtttgagcgtggttatgcgagtcaaatcgaaactgcagcaagaccttatgccttcataaaatttgacacatttatacagaggactaagaaattgtaccaggacacgagaactcaaaggaatattgccaagttgaacgatgaactttatgaagtacaccaaataatgactcgtaatgtgcaggaagttcttggtgttggtgaaaagttggaccaggtcagtcaaatgtcaagccgattaacatcagaatctcgcatctacgctgacaaagcaagagatctaaatcggcaggccttgatccggaaatgggctcctgttgcaattgtccttggagtagttatcctactcttctgggccagaaacaagatatggtgaattgatgattaagcattctacttaacacaagaattattcaactttagttggaatggaacccaagtgtactaaaggaacctttttgacttgagagattttgttaattgtggaatttatagagagagatttgttatggtgttgttgctactactactactactactcatgctctttaaatgatattggttgtgaagcaaaaaagaaaaaagtaaccgactgcgactctcataataaataactctctcattctcac

SEQ ID NO: 8790 - DNA, 1261 bp, Vigna unguiculata
ggacgtggcatttttctaacaccattttcatttcattccaatttcaatcctctctgtgcatcgatcgactcggctggactatccacgccgccgttttccgcggcagctccggccaccctctcatcgacattcagtgtattttggtttagttgcaaagttttagagtgtgagtggaggattgtgaagctaagaaacatggtgaagttgactatgattgcccgtgttactgatggtcttccgctagctgagggactggatgatggtcgtgatcttaaagatgcggaattttacaaacagcaagtcaaggctttgtttaagaatctctcaagaggacattatgaagcatcaaggatgtcagttgaaactggaccttacgtttttcattatatcatagaaggacgggtctgttacttgacaatgtgtgaccgtgcataccctaagaaactagcctttcagtatcttgaagagctcaggaacgagtttgagcgcgttaatgggtcacaaattgaaactgctgccagaccttatgccttcattaaatttgatacatttatgcagaagacaaagaaactttaccaggatacccatactcagcgcaatattgctaaattgaatgatgaactttatgaagtccaccagataatgactcgtaatgtgcaggaagttcttggtgttggtgaacagttggaccaggtcagccaaatgtccagtcgcttatcatcagaatctcgcatatatgctgataaggccagagatttaaatagacaggctctgattcggaagtgggcccctgttgctattgtttttggagttgtcttcgtacttttctggatcaaaaataaaatatggtgatcgatctcagtgtctgacatttaagtcctggattgccttactgtggcttctcccatgattatccagattttgaacagattggtgggaaacctagatgcatgagatgatgtctagtttttctggacaactttggtttagaaaaaaaaaaaaaaagactatcctctgtgacatctaaacatggctggatgagtctttctgaaacaggaaccattaacttttatagtaagggagccaggatatgagaaaactatatcccattggggatccatataggcatttcttctttatacttatcaattattttcaggattattgtgttaatgaattacatatattacctcttcgatgtattgtttccatctgagccgccgaattagatttgcgttttacatacacctagtataatgat

SEQ ID NO: 8791 - DNA, 1015 bp, Taraxacum officinale
gggggcgtttgttcgtacagtcttcctactgtatccccaatatatcgattacccgtcttccaaaccctatcatcgacttcgattcccattcaaaattttctgaattttgaacgttctccttgtatatcaattttatccgtggaattacgatctactatagattggatcatcgaaacgcatgctaagtacttgaaactttcagcttctcaaagtaaagatggtgaagctgacaatgattgcccgagtcactgatggccttccactagctgaaggactggatgatggtcgtgacatgcaagatgcagagttctacaaacagcaagtcaaggcattgttcaaaaacctttcaagaggacaaaatgaagcctcacgaatgtccatagaaactggcccttatgttttccattatatcattgaagggcgagtgtgttatttgacaatgtgtgatcgtgcttacccaaagaaacttgccttccaatatcttgaagatctaaagaacgagtttgaacgtggttatgaaaatcaaattgaaactgctgcaagaccatatgcattcattaaattcgatacatttatacagaggactaagaaactataccaggacacaagaactcagaggaacatttctaagttgaatgatgaactctatgaagttcaccaaataatgacccgtaatgtgcaggaagttcttggtgttggtgaaaagttggaccaggtgagtcaaatgtcaagccgcctaacatcagatactcgcatatatgctgataaagcaagagacttaaatcgacaggctttgatcaagaaatgggcacctgttgcaattgttgttggatttgttatcctactgttatgggctaaaaacaagatatggtgaaagccctttttcttacatggaaatatttttccattttaattatgttacagagggttttaagttataatttccgttgccttatctatttgcaccttcaactgaaagttttgttaagaagtatttaattttgcaagaaaaaaa

SEQ ID NO: 8792 - DNA, 1449 bp, Euonymus alatus
taaccgttcgtttgggttcattgactcattgtacctgtagataaagacggacacaaatctactgtttggaaatcgaagaaagttaaaaccatagagagagccatcattaatttcttcttggatcgacaaaagcccccaaaagttgctctctctcgtatagagagatactgcgatcgtccttctcattccattcagatcgaaatccccaatgcgatagccagattattgcactcaattgtgatctggcgtagcaaaggggttgcatagtaaaaatggtgaagatgacaatgattgctcgtgttaccgatggccttccactggcagagggactggatgatggccgtgatatgcaagattctgaaatttacaagcagcaggtcaaggctttatttaagaacctttccaaaggacagaatgaggtctcaaggatgtctattgaaacagggccttatgtttttcattatatcatagaggggcgggtttgttatctgacaatgtgtgaccgttcttatccaaagaaacttgcctttcaataccttgaagacctcaaaaatgagtttgagcgtgtgaatggggctcaaatagaaacagctgctagaccttatgccttcattaagtttgatacattcatacagaggacaaagagattgtaccaggacactcgtacacagcggaatattgcaaaactgaatgatgaactttttgaagtccaccagataatgactcgcaatgtgcaggaagttcttggtgttggtgaaaaattggaccaggtcagtcaaatgtcaagtcgtttaacatcagagtctcgcatatatgccgacaaagcaagagacttgaatagacaggctttaattaggaaatgggcacctgttgccattgtgttaggtgttgttttcctcctcttctgggtcaaaacaaagctatggtgattcaactaccctttagggttattattcgtgggtttctccatgtagcttttggttgcctgtttctttcactagtgtccatgcttctgggacctcagattcaatgcacattgggcctcaaacatgtttcaaggtgaccttttgatttggtcatggcgcgatctcagtgagactgagtgcttaagctactctagagtcaatttgcgatatggaattatgaaagagagaccctttgcctttcaaacacatgaaggaaccagacatttaaatacaacgttaaggaatttgtaccagagtgtctctatagagccgttcattgatcatcatattcgatactagataatcttatcctatccaatttttgcatttcctcttaatttttgctcttcctattactattttacctcttggagtctctatacttgttgctttacagatgttaacataataaccggaaagtgctctgttctgggtcaatatagaaatgcatacccaggtgaagaaaaaaaaaaaaaaaaggccg

SEQ ID NO: 8793 - DNA, 1145 bp, Flaveria ramosissima
taatttgatccaattgaatcatttaatcccataatctgcattttgtgcattgttgtaacgctcgatcatcgatcaatgtagatcaagaaacttaaaagaagaaagatttgatcattcatacgcgtgatacatacttaaaaatcaaatttttaggttttcttgaatttcatatagtttatagcttctcaaagtaaatatggtgaagctgacgatgattgctcgtgttattgatggccttccactagctgaaggattagacgatgggcgcgatatgcaggatgcagagttttataaacagcaagttaaggccttgtttaaaaacctttcgaggggacagcacgaagcttcacggatgtctgttgaaacgggcccttacattttccactatattattgaagggcgggtatgttatttgacgatgtgtgatcgtgcttatccaaagaagcttgcttttcaataccttgaagatcttaagaatgaatttgagcgtggttatgggaatcaaattgaaactgctgcaagaccttatgcttttataaaatttgatacatttatacagaggactaagaaattgtaccaggacacacgaactcaaaggaatattgctaagttgaatgatgaactttatgaagtacaccaaataatgacccgtaatgtgcaggaagttcttggtgttggtgaaaagttggaccaggtcagtcaaatgtcaaaccgattaacctcggaatctcgcgtgtatgctgacaaagcaagagatctaaatcgacaggctttgatcaggaagtgggctcctgttgcaattgttcttggagtggtcattctactcttctgggccaaaaataagatatggtgatcaatggtctgtattcagttgttattgagaggattaagaaattataaatatttgagccttcaactggaaatgttataagttatgactgtattttcatcatatatagttgctagctatatggaggttaacacatgaaatctttgtgtttagaaagtatttcctctatcttgtgtttcgattaatggatttatacatagatttgttgtggtgttgtactgttgtgtaatatttactcttggtacattgttgtgcgactagagaatgttaatgctctaatattatgcaattcaat

SEQ ID NO: 8794 - DNA, 1039 bp, Flaveria ramosissima
catttaatcccataatctgcattttgtgcattgttgtaacgctcgatcatcgatcaatgtagatcaagaaacttaaaagaagaaagatttgatcattcatacgcgtgatacatacttaaaaatcaaatttttaggttttcttgaatttcatatagtttatagcttctcaaagtaaatatggtgaagctgacgatgattgctcgtgttattgatggccttccgctagctgaaggattagacgatgggcgtgatatgcaggatgcagagttttataaacagcaagttaaggccttgtttaaaaacctttcgaggggacagcacgaagcttcacggatgtctgttgaaacgggcccttacattttccattatattatcgaaggtcgggtatgttatttgacgatgtgtgatcgtgcttatccaaagaagcttgcctttcaataccttgaagatcttaagaatgaatttgagcgtggttatgggaatcaaattgaaactgctgcaagaccttatgcttttataaaatttgatacatttatacagaggactaagaaattgtaccaggacacacgaactcaaaggaatattgctaagttgaatgatgaactttatgaagtacaccaaataatgacccgtaatgtgcaggaagttcttggtgttggtgaaaagctggaccaggtcagtcaaatgtcaaaccgattaacctcggaatcccgcgtctatgctgacaaagcgagagatctaaatcgacaggctttgatcaggaagtgggctcctgttgcaattgttcttggagtagtcattctactcttctgggccaaaaataagatatggtgatcaatggtctgtattcagttgttattgagaggattaagaaattataaatatatgagccttaaagtggaaatgttataagttatgactgtattttcagcatatatagttgctagctatatggaggttaacatatgaaacctttgtgtttagaaagtatttactctatcttgtgttcgattaatggatttatacatagatttgttgt

SEQ ID NO: 8795 - DNA, 1240 bp, Lactuca sativa
tttttatttatcgacaaaatatgaaaattaaattctttaacgaatagacaataatttaatgaatggcaacacattttggaaattcgcgttttactagtatttcggtattctgcgtttcttcgtagagtcgttctcctactgtatccccaaatatcaattgccctttcaaaaaccctattatcgtcttcgattaccattcaatttttcaggattttgaacattctcgttgtatatcaattttatatccgtagatacgatccactatagattggatcatcaaaacgcatgataagtacttgaataattcagatctgtaaacgaatgcttgtgtgattgatagcttctcaaagtaaagatggtgaagctgacaatgattgcccgtgtcactgatggccttcctctggctgaaggactggatgatgggcgtgatatgcaggatgcagagttctacaaacagcaagtcaaggcattgttcaagaacctttcaaggggacaaaacgaagcctcaagaatgtctatcgaaactggcccttatgttttccactatataattgaagggcgagtatgttatttgacaatgtgtgatcgtgcttatccaaagaaacttgccttccaatatcttgaagatctaaagaacgagtttgaacgaggttatgaaaatcaaattgaaactgctgcaagaccatatgccttcattaaatttgatacatttatacagaggactaagaaactgtatcaggacacaagaactcagaggaacatttctaagttgaatgatgaactctatgaagttcaccagattatgactcgtaatgtgcaggaagttcttggtgttggtgaaaaattggaccaggtgagtcaaatgtcaagccgtttaacatcagatactcgtgtatatgctgataaagcaagagacttaaatcgacaggctttgatcaagaagtgggcacctgttgcaattgtccttggagttgttatcgtactgttctggctcaaagggaagatatggtgataattcatggcattggcatggaaatgttcttccatttttaattagttccatttacagaggggttttaagttaatttctgctgcttatccatttgcaccttagaatggaatttttttgtttttacatttcaccgacaagtatttacttttgcataggtttttacatgaatttgttcttatataatgttttttttatcaaactcttttaaatttattctcaacatatccc

SEQ ID NO: 8796 - DNA, 1202 bp, Momordica charantia
gcaagttttgagaagcacattttgcaaaattgacttgtggcgagggcaatgactccattttagggaattcgatctgatcccgagcgacacacgctgcagacatcaagcaatccaattcccgtctccatcgaattcctgtcctttcacagatcccttaccttcgcctttccaccttctttctcctcagattcctccatcgtcaccgcggttcctcggatcccccaatgatataacctgttgggggacatatcaaactaaagatggtgaagcttacaatgattgctcgtgttactgatggtcttcctctagctgagggactggatgatggccgtgatatgcaagattcagaattctacaaacagcaagtaaaggctctgtttaagaacttgtcgagaggtcaaaatgaggcttcaagaatgtctgtcgagacaggcccatatgtctttcactatataattgaaggaagggtctgttatttgaccatgtgtgatcgagcttatccaaagaaacttgcctttcaataccttgaagacctgaagaatgaatttgaacgtgtcaatggggctcaaattgaaactgctgccaggccttatgcattcattaaatttgatacatacatacagaagacgaagaaattgtaccaggatacacgtactcaacgtaatattgcaaagttgaatgatgaactttatgaagtccaccaaataatgactcgcaatgttcaggaagttcttggtgttggagaaaaattagaccaggtcagtcaaatgtcaagtaggttgacatcagaatcccgcatatatgctgacaaggctagagatttgaatcgacaggcattaattcggaaatgggcgcctgttgctatcgtgtttggagtcgtattcctcctgttctggtttaaatcaaagctctggtgatccagttgccgttccattccagataatcttaagctcattttcaggcttctgttgatggcttctagagatgggatcagaaaattagttgtttttttggtacctctaaagtgtaagagacacattcaacttagtaaatccagattaagtagagaaaacgtgtttatgtacccccttcctctcctctcaaatataccttttttgttcgttttacattaaaaaataccattatattttttgtattagtctatcgttttttgacgtaattcatgttaagatttacatacc

SEQ ID NO: 8797 - DNA, 1984 bp, Mimulus guttatus
gccatttatccaattttgcgaaaaccctatttcttctcttgttttgcaattccgcgaaatcacaattctgtaatctgcatttatcatctaaatccttacttcggatcgctcaaatttccattcaaggatccattgaaggctcaaatttcgtagttgaagatcgggattctcgtacggcgcatctgaccgagggctcacattcgcatgcgattggtgtgagctcataataaagatggtgaaaattacgatgatagctcgtgtgactgatggccttcctctagtagaaggactggacgatggtcgtgatatgcctgatgcagacttctacaagcagcaagttaaggctttgttcaaaaacctctcgaggggtcagaatgaaccgtcaagaatgtcaattgaaacagggccatacatatttcatcatatcattgaagggcgtgtgtgctatttgacaatgtgcgatcgttcttatcctaagaagcttgcttaccaatatctagaagaccttaagaatgaatttgagcgtgtatatgggaatcagattgaaactgctgcaagaccatatgcttttatcaaatttgatacattcattcagaagacaaagaaactgtaccaagatacaagaactcaacggaatgtttcaaagttgaatgatgaactctatgaagttcaccagataatgacccgcaatgtacaagaagttcttggcgttggtgaaaagttggatcaggtcagtcagatgtccagtcgcttgacatccgagtcccgcatatacgcagataaggcaaaagatttgaaccgccaggctctgattcggaaatgggcacctgtcgctgttgttctaggagttgtcttcttcctcctctgggtcaaaaagaagatctggtgattgtgcatccatttgcagatgaaggagctgtctcaattaacattttgtgcagtggcctctggtttcacataatatgcctttctcgaccttttcaaggtttacttgcaaaatcgattacaaaaactacgttttttgaggatacaacaaactaagccataatggataaatatgaatatatatgatcaagaggtaaaatgatattaatgtgtcgtaagaacctgctcgtacagacttttatagaccggtctatctacttacatgttactgttttgaacatctttagctactactttgttactgttttgacaatagtaagtacaggttatatgcactttgtgatttagaggtgttgtgattcaagttagactatgctgcggaatctgctatatttggtttaaagaagtaattactttttgatactataaatgattttctgaagcattatagttaatatttcttgatgtataattatgtaatagaaaccaataaaaatgcatttttgcaatacaaacaacttcgataaagtgcatgtcaatttccttctagtaaataaagaaattcaaaactattttgaaaccaggttagctacatgtttttgagttgtcgtgtcctagctgcaactagaaacgtaacgagctcaaaccaaaaagaattaaaaaaaaaatatcatttatacgacaacacctacttgcaataacggggttgaatttgaaatttttagcatacataaataaatcagcataataaaacagatgggaaaaaaatgtcagctactgaacttccataatacagatgtattgaattgttgttcatcacttatctactaagagataagtgatgtattgaattgttacagagagctggctagtactgaagacggtgtaaaaacttgttgctgtttccgacctcttgtaaaaactgctgcttcgctgtgcactgtgcaaatcaagaattcggcccatcctcgagatccatcccatatattgtatagtttcgttcgaataataggagttcctgtatataaaacattttatgataatcagttggttgaaattttgaactaaaaataatcagcagctcacaatttatgatagt

SEQ ID NO: 8798 - DNA, 1196 bp, Quercus alba
tctctactgggtgtggtttctaccaaaattcaaattgacgaaataagaaaagaaaagaaagcgaaattttgattttgaaacgcgtcgcggtcaaggtcaccagagggttactgatttggacttagtttggggaggctagagatatggtgaagttaaccatgatagctcgtgttactgatggcctaccattagcagaagggctggatgcaggtcgggatccacaagatgaattctacaagcagcaggctaaatccatattcaaaaatttgtcaaagggccataacgaatcctcaagaatgtcgatagaaactggtccctatatattccactacatcattgaaggccgtgtttgttatctgactatgtgtgatcgttcttatccaaaaaaattagcttttcagtacttggaagagctcaagaatgagtttgagagagtcaatggggatcaaattgaaactgcagctagaccttacgcattcattaaatttgatacatatatacagaaaattaagaaattgtatttggacacccgctctcaacggaatattgcaaagttgaatgatgaactctatgaagttcagcaaataatgacccggaatgtgcaggaagttcttggtgttggtgaaaagttggaccatgtgagtgagatgtccagtcgtttgacttctgaatctcgcatatatgctgataaggcaagagatctaaatcgacaggcgttgatccggaagtgggcgccagttgggattgtcattgctgttgttcttctcctcttttgggtaaaaaacaagatatggtgatcctttttgctcgtacatttcagctggcatcattgtcaattatcactcgccggatggagtatgtttcaggattgtgcagagttttggtgtggggtacatatccattctaaggaagagcagtggatattatcaggtgggcaagcctcaattatataagtcgattaaagggaaaaatgtacttggtaaaatttagaagagatcgatcctcttattgttattacttttataatataactaaacaaattaggctcatagttcatacagacatgtatctactcggtttcgatgatatattctaaaaaggagaaatttcaattactttgtttcttttcctccttgtactaaatggcccaaccagaaatgatttatttgttgtccataaaaaaaaagacacgcgag

SEQ ID NO: 8799 - DNA, 1121 bp, Olea europaea
tcaggaaatgtgaatgagaattagcgagtggcgtctgctcactgctgattctacagctgtgagttcgtgaagtaaaagatggtgaaactgactatgattgctcgtgtcactgatgggcttccactggtagagggactggatgacggccgtgatgtgccagatgctgacttctacaaacagcaagtcaaggctttgttcaaaaacctctcaaggggccagaatgagccttcaagaatgtcgattgaaacaggcccatatgtcttccatcatatcattgaagggcgtgtttgttatttgactatgtgcgatcgtgcttatcctaagaagcttgcctttcaatatctggaagaccttaagaatgaatttgagcgtgtctatggaaatcagattgaaactgctgcaagaccttacgcttttattaaattcgatacattcatgcagaaaacaaagaaattgtaccaggatacaagaacccagcggaatatcgcaaaattgaatgatgaactttatgaagtccaccagataatgactcgcaatgttcaggaagttcttggtgttggtgaaaagttagaccaggtcagtcagatgtcgagtcgcttgacgtctgaatctcgcatatatgcagaaaaggcaaaagatttgaaccgccaggctcttattaggaaatgggctcctgttgctgttgttcttggagttgttttcctcctcttctgggtcagaaataaattctggtaatgctgccattgatgtgcagctgatagtcactgtttcagtatctttaatatgctcgcagatcgttgagggccagaacatttgtgtcggttgcctggttcacctatgcatttcatctttggaggtgaccggcaatttttggtacaaaaactacctttctaattctgggagaaatcaaaccatgttgatgttgagaatagaaatatattattttagagacgaattgatacatcatccgttgtgggccggaacagatttcagtaatacatgcatttgatattattctgcatccttattttctaatattgcgtttttggccgactgcaataagatgagtgttacaggtattgtattaaattgtgatgggaaaaggtgaatgatttcaaatt

SEQ ID NO: 8800 - DNA, 1203 bp, Lippia dulcis
catccagattctcatcttccaatttctcccaattcaatctcgtaaattcagatcggattatcatagtccgcagatcggatcgttaggatttttgagctgaggatatactcgggaggcgccgccccatcgtagagttgctgttaaaaattgaacccaattaaaatcgaggatacccgcattcgcagagataggggctcacatacgcatgcaaaggtgtgagctcgtgaataaagatggtgaaattgactatgattgctcgtgttactgatggtcttccgcttgcagagggtctggatgatggtcgtgatgttccggaatctgacttttacaaacagcaagttaagtctttgttcaagaacctctcaaggggccagaatgaaccatcaagaatgtcagtggaaacagggccatatatattccattatattattgaagggcgtgtgtgctatttgacaatgtgtgatcgtgcttatcctaagaagcttgcctttcaatatctggaagacctcaagaatgaatttgagcgtgcgtatgggaatcagattgaaactgctgcaagaccatatgcttttattaaatttgatacattcatacaaaagacaaagaaattgtaccaggatacaagaactcagcgaaatatttcaaagttgaatgatgaactttatgaagttcaccagataatgactcgcaatgtacaagaagttctcggtgttggtgaaaagttggaccaggtcagtcagatgtccagtcgcctaacatccgaatcccgcatatatgcagataaggcaaaagatttgaaccgccaagctttgattcggaaatgggctcctgtcgcagtcgttctaggagttgttttcctcctcttctgggttaaagtgaagatctggtgatgatgccacacatcaatgtgcagttgatgagctgtttcgatcttgccagtatgctatgcagtttccggctttacagttacatttcattttttgcgatcaccggcaagagtcttacgattatcgccccctcccccacttttttcttcgaactcgagatttagcatatccgaagattgcttaagatatatatcaacagaacattttacaggaaccaggttgcgtcagtcttatacacattttgtctacttagtaaactaatcatgttcacatttaaattttggagatattttcagaatgatgatttggccaaaag

SEQ ID NO: 8801 - DNA, 1438 bp, Cajanus cajan
gaaagttagaagtgaatgcatttatattgtgttttccttttgatttaaaacgacgtggcacttgcccaaatttctaaattctaacaccccattctccttcatttcaattctctgttcggctggactttgctgcggcagctccggccaccctctcatcgccattcagtttagttgaaaagttttatagttcgagtggaagattgtgaactaagaaagatggtaaagttgactatgattgctcgtgttactgatggtcttccactagctgaaggactggatgatggtcgtgatcttaaagatgcggaattttacaaacagcaagtcaaggctttgtttaagaatctctcgagaggacattatgaagcatcaaggatgtctgttgaaactggcccttatgtttttcattatattatagaaggacgggtctgttacttgacaatgtgtgatcgagcttatcctaagaaattagcctttcaatatcttgaagagcttaggaacgagtttgagcgtgttaatggatctcagattgaaactgctgctagaccctatgccttcattaagtttgatacatttatacagaagacaaagaaactttaccaggatacccatactcagcgcaatattgccaaattgaatgatgaactctatgaagttcaccagataatgactcgaaatgtgcaggaagttcttggtgtcggtgaacagttggaccaggtcagccaaatgtccagtcgcttatcatcagaatctcgcatatatgctgataaggctagagatttaaatcggcaggctctgattcggaagtgggcccctgttgctattgtttttggagttgtcttcgtacttttctggatcaaaaataaactatggtgatctagctcattgtctgacatttaaaacctggattacgtttgctgtggcttcttgctttcctcacatgattatccagattttcacagattggtggaaaccctatatgcatgagatgataccgacctttttctggacaactttggtttagaaaaaaagactatcctctgttacatctaagcatggctggatcagcctttctggaacaggaacctttaacatttgtagtaaggagccgaaatatgagaatacttgatccccatggggatgcgtatagcatttcttatttctagttctcaattattttcaggattattgcgttaatgaattaaatatattacctcttcaattttattgtttccatttgagccgctgaattagaattgcgttatatatcgctggtataatgataattagtagtgtggaatacttgttgtaaaactgggaaaccttatctcattttgtttttacatttccctgatacttatcagtataatagaatattcagatctggattcttagtgttttgttgcatttagaataaggtaagtttatcaatattttttta

SEQ ID NO: 8802 - DNA, 1523 bp, Populus trichocarpa
tcaaatgggagaataaaacataagcccaataacattagagtgggtcaagtctaaaagtaaaaagagcatatcttatttttgaaattacttgttgcagacagacaggcagacacacaaatagataggaattgcgcagcttaccttaagatctccgttattttggtgtgcggtttttttttctttcaattttattacacatagatttttactaccatcgtatctcttcttcctcaaatcccttagtccaaaaccaaatagtcacttgctatataatcagttactttgcatatctgaggaagtaaaaaagtaagtaaagatggtgaagctgacaatgattgctcgtgttacggatggtcttccgctagcagagggactggatgatggtcgtgatgtgaaagatgctgaaatgtacaaacagcaggtcaaggcacttttcaagaaccttgcatctggccacaatgatgcttcgaggatgtcaattgaaactggcccttatattttccattatattattgaaggacgtatttgttacctcactatgtgcgaccgttcttatcctaagaagcttgcctttcaatacctagaagaccttaagaatgaatttgagcgtgtcaatgggcctcaaattgaaactgctgctagaccatatgccttcattaaatttgatacttttatacagaaaacaaaaaaattgtaccaggacacccgcacccaacggaatattgctaagttgaatgatgagctgtatgaagtccaccaaataatgactcgcaatgtgcaggaagttctgggtgttggtgaaaagctggaccaggtcagtcaaatgtcaagccggttaacatcagaatcccgcgtatatgctgacaaggcaagagatttgaatcgacaggccttaattcgaaagtgggcccctgttgccattgtgctaggagttgtcttcctcctcttttggattaaaacaaagctctggtgatccaatggccttttgtggtttctgagaaatgttgcatgttttcctgggtttctcttgcattgtagttgttcgcctgtgttcgtgatataagttcaaacttcagattggagactggacacacatgaaggcttcatcatgtttcaaagtggactctagtttttgttcatggcaggcattagttaaaaggactggttctttatgtacgtccaaactacatatggaaatgtgaaagagaaacccctgatgttacagttaggcaaggatcaaatatatattggtacagtatgaggattttccgaattctcaacactctatataggccttatataaatatctataattcatcaatgtccaataatgctctagattacattgatatacagcctgcaattcataattcaccttcgtgattcatgtgtgcacacctctcgtttatttaccacaaaatttttggtaaagcattataaccatacagtttgctggaagttttcaggtgccatatgccatgatacgccgtagtccacttggtgaattttgctaatatttttga

SEQ ID NO: 8803 - DNA, 1860 bp, Populus trichocarpa
ggcgctgtgatacactttcatggacccttgttactcaagcccaataccagagactgggtcaagcctagaaagaccagatcctcgtatttacttcgtgttgtgtaccatcttcgaattactcgtgacagacaaatagaaattgcagcttaccttaataatataacaactgccctctcttcgatctgtcttttgtttttgttatttatttattgatattgtacatatattttcaccatcatagtctcttgttcctcggatcctttaatccgaaaccacaaatccacatgctataatcagttattttgtatatctgagggagtgaagaagtaaagatggtgaagctgacaatgatcgcgcgtgttactgatggacttccgctagcagagggactggatgatggtcgtgatgtgaaagatgctgaaatgtacaagcagcaggtcaaggcacttttcaagaaccttgcatctggccacaatgacgcatcgaggatgtccgttgaaactggtccttatgttttccattatatcattgaaggacgtgtttgttaccttactatgtgtgaccgctcttatcctaagaaacttgcctttcaatacctggaagaccttaagaatgaatttgaacgtgtcaatggggctcaaattgaaactgctgctagaccatatgccttcattaaatttgatactttcatacagaaaacaaagaagttgtatcaggacacccgcacccagcggaacgttgcaaagttgaatgatgagctgtatgaagtccaccaaataatgactcgcaatgtgcaggaagttttgggtgttggtgaaaagctggaccaggtcagtcaaatgtcaagtcggttaacatcagaatctcgcatatatgctgaaaaggcaagagatttgaatcgacaggccttaattcgaaaatgggcccctgttgctattgtgctaggagttgtcttcctcctcttttgggttaaaacaaagctctggtgatccaatggccttctgtggtttctgagaaatgttgcatatttttcctgggtttctctgcgttgcagtcagttgcctgtgttcgtggtataagttcaaacttcagagacttcatattggggactggacacgcacatgaaggcttaatgtttcaaagtggactctagtttttgcccatggcacgctagttaaaaggactctagttctttatgtacacatctgaacaaaatatggaaatgtgaaagagaaaccctttatcgtacaattaggcaaggatcaaaatatattggattaaatttgaggattttccgaattctcgacactttatagaggccttataaatatccataattcatcagtatccaatatgtgctctagattacattgatatgctgcctgcaattcttattttaccttaatgatttattccgcacccctcttgttgtttagttaccagtcaccactactttttatgtaagcattataaccatatagtttgctggaagttttcaagtgtcattatgctatgatccgcctcagtccacatggtgaagtttgccaatatttggacaacgtattttctcggataaggacaacccttgatgactttatggtttgttgatgattgagtttacgagtagccttgaaattgccgtgtactgcagcccatgaatggtaaaaatactcgacatggatttgcttccctttttctgctgaaagagaatgacatttcttcctcattttattaccaggaatcatgcgaggctccaatccatgctctaatgcctttttgaatccttggagaagtatgctccggatggcttccaataatcagccataaacaaacaatttaccacaataacaagagaatatt

SEQ ID NO: 8804 - DNA, 1013 bp, Raphanus sativus
gggtagatcgtcatcagtaacgttccgaacgacagaaaaaaaagtaaaacgaaatttcagatcgtgaccctcttgaatgataaacccctttttaaatttaaaaaaaaaacacagtacttgtaataacttggatcatcctctttctctcgtgttctcagatcctgagaaccatttgaacactcgtatcagtgacttttgttattggagaaggaggaataataagggcaaagatggtgaaaatgacattgatagctcgtgttaccgacgggctgcctctagctgagggtctcgatgatggacgtgacttgcctgattccgacatgtataagcaacaggtcaaggctctgtttaagaatctttcccgaggtcataacgaagcttcaagaatgtctgttgagactggcccctatattttccattacatcatagaaggacgtgtttgctacttgacaatgtgtgaccgttcttacccgaagaaactggcgttccaatacctggaagatctcaagaacgagttcgaacgtgtcaatgggcctaacattgaaacagctgctagaccttatgcctttattaaatttgataccttcatacagaaaacaaagaaactgtaccaagacacacgtacgcaacggaatatcgctaagctgaatgatgaactctatgaggtccaccagataatgacgcggaatgtgcaggaagtactaggtgttggtgaaaagctcgaccaggtgtgcgagatgtcgagccggctaacttctgaatctcgtgtatatgctgataaggctaaagatttgaaccgtcaggctttgatccggaaatgggcaccagttgcaatcgtgttgggtgtcgttttccttcttttctgggtcaagaacaagctctggtaaataaaggaggcaattttcgtaatttagcaaatcttcttttattcagagtgaaactttgacaaaatttgtactttctgtagtagtaatgcaaactttatgagactggttatagtatatcatccatca

SEQ ID NO: 8805 - DNA, 887 bp, Raphanus sativus
ttcagtgagctttgttgttattggagaagaagggaagggagtaaggtctaatcaagatggtgaagatgacattgatagctcgtgttaccgacggcttgcctctagccgaaggtcttgacgatggacgtgacttgccagattccgacatgtacaagcaacaggtcaaagcactctttaagaatctctccagaggtcacaacgaagcttcgagaatgtctgttgagactggcccctatgtgttccattacatcatagaaggacgggtttgctacttgacaatgtgtgaccggtcttaccccaagaagctggcgttccagtacctggaagacctcaagaacgagttcgaacgtgtcaacgggcctaacattgagacagctgctcgaccttatgccttcattaagtttgatactttcatacagaaaacgaagaaactgtaccaagacactcgtacgcaacggaatatctctaagctgaatgatgaactctatgaggtccatcaaataatgacgaggaatgtgcaggaagtcctaggtgttggtgaaaagctggaccaggtgagcgagatgtcgagccggctaacatctgaatctcgtatatatgctgacaaggctaaagatttgaaccgtcaggctttgatcaggaagtgggcaccagttgccatcgtgttaggagtcgtgttccttcttttctgggtcaagaacaagctttggtaagaaggaaagaacctgaggctagacttttccagacatatatcgaccggcaccaaaaaaatatttttgtttttttttttttttgaaagtgagacattgacacacattttgtagtaatgcaaactttatgagactaagtcattaaatcatcccatcaatacactttttaaacctttg

SEQ ID NO: 8806 - DNA, 887 bp, Silene vulgaris
tttgatccgccattgatccaaaatcatcactaattccaaaccttgcgatccaaagttcatcatcatcatcaacaaattcagctctaatttcacttaattttcaattcagaaaatcatggtgaaagttacaatgattgcgcgtgtaactgatggtttaccattagcagaaggattagatgatgggcgtgatgtacaagacgttgattattataagcaacaaattaaagctttgtttaagaatctctctaaaggtttaaatgatccttcaagaatgtcggtcgaaagcggtccatatgtttttcactatattatcgagggccgtgtttgttacctgacgatgtgtgaccgtgcttacccgaaaaagctggcatttcaatacttggaagatctgaaaaatgaatttgagcgcgtgaatgggaatcagatagagacagctgctagaccttatgcattcatcaagtttgacacatttattcagaaaacaaagaagttatatcaggatacacgtacgcagaggaatatgtccaaactaaacgatgagctgtacgaggtccatcaaattatgactcgaaatgtacaagaagttcttggtgtcggtgaaaaattggaccaggtcagccaaatgtccagccgtctaacatcagaatcacggatttatgctgacaaagcaaaagacctaaatcgtcaggccttgatccggaaatgggcacctgttgctattgtgattggagttgtggtgctacttttctgggtcaaaaagaagatctactgatctacagtcccctctatggctttgagaaggcctattgctgaactagaacacgtgtcgcgccacctcaaaggacttggctaccgatctggtgtgtggaacttagagagacgtcaaa

SEQ ID NO: 8807 - DNA, 1042 bp, Eutrema halophilum
aaaccctttattaaaaaattacttctctttccttcgatcatcgtcttcctctggttctcagatctttgaaacgagaagaaccattttaatgcttgaatcagtaaatttattattggagaaggaataaggcaaagatggtgaaaatgacattgatagctcgtgttaccgacgggttgcctctagcagagggcctcgacgatggccgtgacttgccagattctgacatgtataagcaacaggtcaaggctctgtttaagaatctttccagaggtcaaaatgaagcttcaagaatgtcggttgaatctggcccctatgttttccattacattatagaaggacgcgtttgctacttgacaatgtgtgaccgctcttacccaaaaaaactcgcgttccaatacctggaagatctcaagaatgaattcgaacgtgtcaatgggcctaacattgaaacagctgctcgaccttatgcctttattaaatttgataccttcatacagaaaaccaagaaattgtaccaagacactcgtacgcaacgaaatatagccaagttgaatgatgaactctatgaggtccatcaaatcatgacgcggaatgtgcaggaagtcctaggtgttggtgaaaagctggaccaggtgagcgagatgtcgagccggctaacatctgaatctcgtatatatgctgataaggctaaagatttgaaccgtcaggctttgatccggaaatgggcaccagttgcgatcgtgttcggggttgttttccttcttttctgggtcaagacgaagttgtggtaagaaaggaggaacctaaggctgtttcgtaatttaggagacttgtccggacatatatcaaccgccgccggtgtagatctcctgattccggcacccaacatatcttctttctttcaaagagaaactttgacacattttgtactccttagtatgcaaactttataagactggtcatttatcatcatcatactctttaaactttgattgtcatttattttctcaggtttcttcaaatcaaaaccaaaatcaaactt

SEQ ID NO: 8808 - DNA, 1186 bp, Triphysaria pusilla
ataaaactactcgtctacatcgtattttagccgatttttcagaaaacctttgtgtgttcttctaatcctgcaatttccgatttatcaaatccatcgttagatcattcaattgttaagccgacgatctgttttgagggacaacaatcgtataattagaaagcttaattgaagatcggagccttagattccccagctgaggggcttcatgttttaggcgtgtgatttcaagaaataaagatggtgaaattgactttgattgctcgtgttactgatggccttccgctggcagagggactggatgacggacgtgatgtccctgattccgacttctacaagcagcaggttaaatctttgttcaaaaacctttcaagtggccagaatgagccttcaagaatgtcgatcgaaacagggccatatatattccattatatcattgaagggcgtgtttgctatttgacaatgtgtgaccgtgcttaccctaagaagctcgcatttcaatatcttgaagatctcaaaaatgaatttgagcgtgcatatgggaatcaaactgaaactgctgcaagaccttatgcttttatcaaatttgatacgttcatacagaagacaaagaaactttaccaggatacgaggactcaacggaatgttgcaaagttgaatgatgagctgtatgaagttcaccagataatgactcgcaacgtacaagaagttcttggtgttggtgaaaagttggaccatgtcagtcaaatgtccagtcgtttgacatctgaatctcgcatatatgcagagaaggcaaaagatttgaaccgtcaggctttgattcggaagtgggccccagtagctatcgtgctaggagttgttttcctcctgttttgggtcaaaaacaaattatggtgatcatgcatccatctgcagataattatatgttttggttatgctaatatattttgcagtttcctgttgcaattcatctttcaaggtcacaggcaagattattaagtgttagagctttgaactttttatatttatttttcgttttctttgtgaggtgcaccgcattataacgtgttggaaagtagagatattttgattaagggacaaattgagttgaacatctcagaaaaacatggttgcatcatggtcttatatacacactttatctacatatgtaaatgtaatatgtcaaata

SEQ ID NO: 8809 - DNA, 848 bp, Triphysaria pusilla
gccaatttttcaagccgacgatctgttttcagaggcttaatcgaagataggagccctagatttccctaccgaggggcgtgcatgtcataggtgtgtgagatctagaaataaagatggtgaaattgactttgattgctcgtgttactgatggtcttcccctggcagagggactggatgatggacgtgatgtccccgattccgacttctataagcagcaggttaagtctttgttcaaaaacctctcaagtggccagaatgagccttccagaatgtcaattgaaactgggccatatatattccattatattattgaagggcgtgtttgctatttgacaatgtgtgaccgagcttatccgaagaagctcgcatttcaatatcttgaagatctgaagaatgaatttgagcgtgcgtacgggaatcaaactgaaactgctgcaagaccttatgcttttatcaaatttgatacgttcatacagaagacaaagaaactataccaggatacgaggactcaaaggaatgttgcaaagttgaatgatgagctgtatgaagttcaccagataatgactcgcaatgtacaagaagttcttggtgttggtgaaaaattggaccatgtcagccaaatgtccagtcgtttgacatctgaatctcgcatatacgcagagaaggcaaaagatttgaaccgccaggctttgattcggaagtgggccccagtagcaatcgtgctaggagttgttttcctcctgttttgggtaaaaaacaagttatggtgatcatgcatccgtttgcagataatgatatgttttggttatgctaatatattttgcagtttcctattgcaattcatcttt

SEQ ID NO: 8810 - DNA, 1051 bp, Cucurbita pepo
cgaaccctaccttcgcctgttttcgtcatctttctgctcagattcatccatcgtcatcacggttcctcggatctttgaaatcaaaacagaacctcccgcctgttgggagacatatcaaactaaagatggtgaagcttacaatggttgctcgtgttactgatggtcttcctctagcagagggactggacgatggccgtgatatgcacgatgcagaattctacaagcagcaagtgaaggctctgtttaaaaactttcaagaggtcaaaatgatgcttcaagaatgtctatcgagacaggcccatatgttttcactatataattgaaggaagggtctgttatttgacaatgtgtgatcgtgcttacccaaagaaacttgcctttcaataccttgaagacctgaagaatgaatttgaacgtgtcaatggggctcaaattgaaaccgctgctaggccttatgcattcattaaatttgatacattcatacagaagaccaagaaattgtaccaggatacacgtactcagcgtaatattgcaaagttgaacgatgaactttatgaagtccaccaaataatgactcgcaatgttcaggaagttcttggtgttggtgaaaattagaccaggtcagtcaaatgtcaagtaggttgacatcagaatcccgcatatatgctgacaaggctagagatttaaaccggcaggcattaatccgaaagtgggcacctgttgctattgtgtttggagttgtattcctgctattctggttcaaatcaaagatctggtgattcagttgctgttccagataaatctttaactcattttcaggcttctgttgcttttagctgtggctcaatcggtttgaatatcagagacttgaaactgggcttgaggtgacttctagatctactcataataatgatggctaagatgggatcggaaaaatagtgtttttgttacctccaagagggtgcggtgccgtatgtacaagtttaagatagcagattaagtagagaaaacatgtttattattcacatcttcctctcaatatacaattttt

SEQ ID NO: 8811 - DNA, 1108 bp, Nicotiana benthamiana
aaatcttttttccatcccatttactgcagctaatatacgacagtactatatactgttcatttctctgaaaaattcgagaattacagaactagcgattcaaattcttatcaaatttatcaaaaccagcggatcgggaactgcaacttaaggggtcacatacgcgtatgatcgatcgttatatgcttggggaagaaagatggtgaagttgactctcattgctcgtgtgactgatggccttccattagcggaggggctggatgacggtcgtgatgttccagatgcagatttctacaaacagcaggtcaaggccttattcaagaacctggcaatgcgccaaaatgacgcttcaaggatgtctgttgaaactggaccttatatcttccattatatcattgaaggacatgtttgttatttgacaatgtgtgatcgctcttatcccaagaaacttgcctttcaatacctggaggaccttaagaatgagtttgagcgtgtaaatgggagtcaaattgaaactgctgctagaccctatgcttttattaaatttgatacattcatacagaagacgaagaaactgtaccaggatacaagaactcaacgcaatatttctaagttgaatgacgagctttatgaagttcatcagataatgactcgaaatgtacaagaagttcttggtgttggtgaaaagttggatcaggtcagtcagatgtctagtcgcttgacatcagaatcccggatatatgctgataaagcgaaagatttgaatcgtcagctttgattcggaaatgggcgcccgttgctattgtccttggagttgtcattctcctcttctgggttagaacaaagatttggtgatgttgccataaagatgcaggatgaagatacttttgatatgcccttctgtcacccagactaccacctgaaagttcagttgtccagcatgtgtagtgcgtactttccacctgtggttgctagttgagccatgctagttttttagtgtaaaagagaggaaatgaagcgtgatggatgaactatgttgctacattttcagaaatgacatcaattttcattgtctttgacatatagtccttttttgggtcttattagttaa

SEQ ID NO: 8812 - DNA, 1474 bp, Prunus mume
atgggcggcccgacgcgttgtcgttcacgagcccgactgcatttagatgttgtaccttggaaatttcaagctttgctcttcacgtacaacacctataccgcaggagatcgcagattaaactcaaagaccaaccctcgttttctccttttggtcctcgccaagcccttcttcacagcttcgaattcttctgcctcagattgcaccatcgtcctcaccgttcctcaggtcaatgctataagcagtcattttcgcattgctgggaagttgtgaagtgaagatggtgaagctgacaatgatcgctcgtgttactgacggtcttccactagcagagggactggatgatggccgtgatatacaagactcggaattctacaaacaacaagtcaaggccctattcaagaacttgtcaagaggtcaaaatgagccttcaaggatgtcagtcgaaaccggcccttacgttttccactatatcatagaaggacgtgtctgttacctgacaatgtgtgaccgtgcctatccaaagaaacttgccttccaataccttgaagatctcaaaaatgaatttgagcgtgttaatgggacccaaattgaaactgctgcaagaccttatgcgttcattaaatttgatacattcatacagaaaacaaagaaattgtaccaggacactcgcactcagcggaatattgcaaagttgaacgatgagctctatgaagtccaccaaataatgactcgcaatgttcaggaagttcttggtgttggtgaaaagttggaccaggtcagtcaaatgtctagccgtttaacatcagaatctcgcatatatgctgataaggcgagagatttgaatcgacaggctctgatccgaaagtgggctcctgttgccattgtgctaggacttgttttcctccttttctgggtaataaagctccgatgatcaaaactacttcatctttgttctgaaactgtgacgattttgacgggcatctgtttgttgcggtggactgcttccatctggtataatcaatgggttgggaacttcagattggctgggttatccgcaggaaagatttaatgatgttttgggcttacttttattggtgaccgagtttgattgagaaaattaatctgtaagaacctctgctgatgggtacatatccaccctatggaagagagaccctcaagaacagcttgaggaatcagatcttatcatactactagttaaagggaatagattttgctatttatatatacattctcaatttcattcattcctgtctattattgtttgttttttatgcagcctgctctgtagctttagtcttatcctgtttatgaactttggtattctgataagccatgtgaaatgagcttccagttaaattcgaaatgcttaagtgacaactcgaaatgttttttttaacttccgttgaacgtttattgtaatccaagttatggcattttgcctacattgtcatac

SEQ ID NO: 8813 - DNA, 1255 bp, Prunus persica
atgttgtacctaggaaatttcaagttttggtcttcaccttcgaattcttctgcctcagattgcaccatcgtcctcaccgttcctcaggtcaatgctataagcagtcattttcgcattgctgggaagttgtgaagtgaagatggtgaagctgacaatgatcgctcgtgttactgacggtcttcctctagcagagggactggatgatggccgtgatatacaagactcggaattctacaaacaacaagtcaaggccctattcaagaacttgtcgagaggccaaaatgagccttcaaggatgtcagtcgaaaccggaccttatgttttccactatatcatagaaggacgtgtctgttacttgacaatgtgtgaccgtgcctatccaaagaaacttgccttccaataccttgaagatctcaaaaatgaatttgagcgtgttaatgggacccaaattgaaactgctgcgagaccttatgcattcattaaatttgatacattcatacagaaaacaaagaaattgtaccaggacactcgcactcagcggaatattgcaaagttgaacgatgagctctatgaagtccaccaaataatgactcgcaatgttcaggaagttcttggtgttggtgaaaagttggaccaggtcagtcaaatgtctagccgtttaacatcagaatctcgcatatatgctgataaggcgagagatttgaatcgacaggctctgatccgaaagtgggctcctgttgccattgtgctaggacttgttttccttcttttctgggtaataaagctccgatgatcaaagctacttcatctttgttctgaaactgtgacgattttgacgggcatctgtttgttgcggtggactgcttccatctggtataatcaatgggttgggaacttcagattggctgggttatccgcaggaaagatttaatgatgttttggggttacttttgttggtcacggagtttgattgagaaaattaatctgtaagaacctctgctgatgggtacatatccaccctatggaagagagaccctcaagaacagcttgaggaatcggatcttatcatactactagttaaagggaatagattttgctatttatatttatacattctcaatttcattcattcctgtctattattgtttgtttttatgcagcctgctctgtagctttagtcttatcctgtttatgaactttggtattctgataggccatgtgaaatgagcttccagttaaattcgaagtgcataag

SEQ ID NO: 8814 - DNA, 1044 bp, Glycine max
ctccttttcaatcctctgttcatccgtcgatcggctcggctggaccatccttgccgccgtttgccgcggcatctccggccactctctctcatcgccattcagtgtattttggtttagttgcaaagttttagagttggattggaagattgtgaactaagaaagatggtgaagttgactatgattgcccgtgttactgatggtcttccgctagctgaaggactggatgatggtcgtgatcttaaagatgcagaattttacaaacaacaagtcaaggctttgtttaagaatctctcaagaggacattatgaagcatcaaggatgtcagttgaaactggcccttatgtttttcattatattatagaaggacgtgtctgttacttgacaatgtgtgatcgtgcataccctaagaaactagcctttcaatatcttgaagagctgaggaatgagtttgagcgtgttaatgggtctcaaattgaaactgctgctagaccttatgccttcattaagtttgatacatttatgcagaagacaaagaaactttaccaggatacacatactcagcgcaatattgcaaaattgaatgatgaactctatgaagttcaccagataatgactcggaatgtgcaggaagttcttggtgttggtgaacagttggaccaggtcagccaaatgtccagtcgcttatcatcagaatctcgcatatatgctgataaggctagagatttaaatcggcaggctttgattcggaagtgggcccctgttgctattgtttttggagttgtcttcgtacttttctggatcaaaaataaactatggtgatcgagctcagtatgacatttaaaacatggattgcgatgctgtggcttcttgcttttctcgcatgattgtccagatttgcacagattggtgagaaccctttatgcataagatgatgccgaccttttcttgacaactttggtttagaaaaaacaaaaaagactatcctttgttacatctggatcagtctttctggaacagaaacctttgacctttatagtaaggagc

SEQ ID NO: 8815 - DNA, 1074 bp, Beta vulgaris
atttctccaagatcttcagaaattctgaagtttatagatctgaagatcatcgattaaatttcgatttagttggaaaaggtaaaattgagtagaaatggtgaaagtaacgatgattgcgcgtgtaatggatggtctaccattagcagaaggtttagatgatgggcgtgatgtgcaagatgtagaatattacaagcagcaaatcaaagctttgtttaagaatctctcgaaaggtcaaaatgatccttctagaatgtcagttgagagtggaccgtatatatttcactatatcattgagggaagcgtttgctatttgacaatgtgtgatcggtcttatccaaagaagcttgcatttcagtacctagaagatctcaagaatgaatttgagcgtgtaaatgggaatcagatagaaactgctgctagaccttatgcattcattaagtttgatacatttatacaaagaacaaagaaattgtaccaggacacccgtacccagaggaacattgccaaactgaatgatgagctttatgaagtgcaccaaataatgactcggaatgtacaagaagtccttggtgttggcgaaaagttggaccaggtcagccaaatgtccagtcgcttaacatctgaatcgcggatctacgctgataaggctagagacctaaatcgacaggccctaatcaaaaaatgggctcctgtagccattgtaattggaattgtggttctactcttctgggtcaaaaagaagatctggtgatgcacactggcttttggtggcatcctgaaaaaatctatccatctacagacatctccattatttcagcggtttacacttcgaagatatgggcatcatcacactagttcagcttctgatttcgtgtttggaaaatgaactagacagacatgacatgttcttttagtgatatggaaactgtatacatcgactttgttgtagattacatatactcattttgatgttaaaattttgagatagcgaaacttgaaggctcagagttatagtaaagactaaagagctttcagcaaatcattttcgagtcgttttggtattccttgaacaaa

SEQ ID NO: 8816 - DNA, 1169 bp, Manihot esculenta
tttcaccatcggctctctctcttccccagatctcttgcatcatcgaaaccataattccagatgctgtagtcagttattctgtatatttgaggaagatagaaagtaaaaatggtgaagctgacaatgattgcccgtgtcactgacgggcttccactagctgagggattggatgatggtcgtgatgtgaaagaaattgaaatgtataaacaacaagtgaaggctttgtttaagaatctcactacacgccaaaatgagccttcaaggatgtccattgaaactggtccttatgtcttccattatattattgaaggacgtgtttgttacctcacgatgtgtgaccgtacttatcctaagaagctggcctttcagtacttggaagacctgaaaaatgaatttgagcgtgttaatggggttcagattgaaactgctgctcgaccttatgccttcataaagttcgatactttcatacagaaaacaaagaaattgtaccaggacacccgtactcagcggaatattgcaaagttgaatgatgaactctatgaagttcaccaagtaatgactcgcaatgtgcaggaagtacttggtgttggtgaaaaactagaccaggtcagcgaaatgtcaagtcggttaacatcagaatctcgtatatatgctgacaaggcgagggatttgaatagacaggccttaattagaaagtgggctcctgtcgctatcgtgttgggagttgtcttcctccttttctgggttaaaacgaagatctggtgatccagttgccttccatggtttctgagaattgttgcatcattttcctgggtttctctgtattgctgtcaattatttgtgttcatgggaatcattttgaacttgagggacttctgattggggctagatgcaggtaaagacttgaatcatgtttcaagttgagctgtagtttttgttcaggggacactctgtttaaaaggacttgtactttaaggagccccgacaaccatttggagctgttaaagagagaccctttgatttacaagttaaggagctaaaatacattggacacaagcaaatttatatattctcaatgctttatagagactatatattggtctacatggttatggccatcagtatgtgatctacaattacatttatacacttcctagaagttttaaatt

SEQ ID NO: 8817 - DNA, 931 bp, Centaurea maculosa
tctaatctttttggtagtatttttaaaattttatgttgctttctgtttgtgggtattaatccttttagtcaaattttcaatccaatcccaaaacctaataatttgatttcatttcttttattatcctcgtaaaccacgatcgccgatcaatgtagatccacaaactcaatcaggaaagataaatacttgttcaataaataaatctggtgagtggttattagagtaaagaagatggtgaagttgacgatgattgctcgtgtcactgatgggcttcctctagctgaaggactggacgatgggcgtgatatgcaggacgcagagttctataaacagcaagttaaggctttgtttaagaacctttcaagagggcaaaacgaagcgtcgcggatgtctgttgagaccggcccgtacattttccactatatcattgaagggcgggtatgctatttgacaatgtgtgatcgtgcttatccgaagaagctggcattccaataccttgaagatcttaagaatgaatttgagcgtggttatgcgagtcaaatcgaaactgcagcaagaccttatgccttcataaaatttgacacatttatacagaggactaagaaattgtaccaggacacgagaactcaaaggaatattgccaagttgaacgatgaactttatgaagtacaccaaataatgactcgtaatgtgcaggaagttcttggtgttggtgaaaagttggaccaggtcagtcaaatgtcaagccgattaacatcagagtctcgcatctacgctgacaaagcaagagatttaaatcggcaggccttgatccggaaatgggctcctgttgcaattgtccttggagtagttatcctactcttctgggccagaaagaagatttggtgatgcatgatgatttgattaagcattctacttaacacaagaatta

SEQ ID NO: 8818 - DNA, 1442 bp, Cicer arietinum
tattgatgtagattttccgtttttacgctcacttctatcgtctcttacttccatctaccctttcacccaaaactccaaaaccatcccgactttgccatcacccaagaccaccgacattcccctttccgtcagcttcttcgggcaatccggcaccgtccttccttctttctcaatcgtttagctctgtgtgttttggtttagttgcaaagttcaagactttgagagggagattgtaaactgttaaatatggtgaagttgactttaattgctcgcgttactgatggacttccactagctgaaggactggatgatggtcgtgatcttaaagatgctgaattttacaaacagcaagttaaggctttgtttaagaatctctcaagaggacataatgatgcatcaaggatgtcggttgaaactggtccttatgttttccattacattatagaaggacgggtctgttacttgacaatgtgcgatcgtgcataccccaagaaactagcatttcaatatctcgaagagctcaggaatgaatttgagcgtgttaatgggtctcaaattgaaaccgctgcaagaccttatgccttcattaaatttgacacatttatacagaagacaaagaaactttaccaagatacccatacacagcgtaatattgcaaagttgaatgatgaactttatgaagtccaccaaattatgactcgaaatgtgcaggaagttcttggtgttggtgaacagttggatcaggtcagccaaatgtccagtcgcctatcatcagaatctcgcatatatgctgacaaggctagagatttgaacagacaggctcttattcggaaatgggctcctgttgctattgtttttggagttgtctttgtacttttctggctcaagaacaaaatttggtgatcaagcttagcatttgacttcatagaactggactctatgaccaaggcttcttgtctttctcatatatcactatcaagatttacacagttttgtgagaaccctatataaactaggtgatgtctactttttgtggacaatttatgaaaaaaaagactatcctctgttacttctgagaaagactggatccgattttctggaatagatacattttacctttatattaaggagccaagacatgagaaaaatagatacccttgggtttggatatagacatttcttcttactactttccaattattttcaggattattgcgttaatgggttattactgcgacttccatattttgtttttcccccttcaattgagcacctgatatagaactgcattttgtgtggtcagtataatgtgattagtgtggaattcttggtcttagattgttaaaccttttttcatttcgtctatgcattttactttcaaataatgcaatgaccaagatctgctggatcctatatctacttttcttaaatgatgatacggc

SEQ ID NO: 8819 - DNA, 1001 bp, Chrysanthemum coronarium
atccaccaaaaccctaatcccaaatcaaccaaatcccaaaaacccaattcatcaattcatgatccaatcttgaaaatccatttttcagtgaagatggtgaagctgactatgattgcgcgtgttacggatgggcttccattagccgagggacttgacgatgggcgcgatatgcaagatgctgatttttataagcagcaagttaagtctttgtttaagaatctttccagggggcagaatgatgcgtcaaggatgtcgcttgaaaccgggccttatgtttttcactatatcattgaagggcgggtatgttatttaacaatgtgtgatcgtgcttatccaaagaaacttgccttccaatatctcgaagatcttaagaatgaatttgagcgtggttatgggaatcagattgaaactgctgcaagaccttatgctttcataaaatttgatacattcatatcaaggactaagaaattgtaccaggacacaagaactcagcggaatatctctaagctgaatgatgaactttatgaagttcaccaaattatgactcgcaatgtacaggaagtccttggtgttggtgaaaagttggaccaggtgagtcaaatgtcaagccgcttaacatcagatactcgcatatatgctgataaagcaagagatctaaaccgccaggctttgattaagaagtgggctccggttgcaattgtgctcggagttgttttcctgttgttctgggccagaaacaagatatggtgatcgcggcttcattagtttaacatgtggaaatattttttccattccgttgagaaattacagttacagggttctaagttaattctattcgcaccaccagcacttcagttgaattatataaatttgcatcgtgaattggagaattttgtttgtgtttaatatttagacaagttcaatccaccaagaagcattcgctatattgacaaaacctcacatttgtgttggtcttcggtttttatgtatgtaatgctgat

SEQ ID NO: 8820 - DNA, 930 bp, Cirsium arvense
agaggaaatttacattctcaatctcaggtattctgcgtttcttcgtccggtcatctttccctcctactgtatccatccccaatttatcatccaaaaccctattcttattcttattcttatcatctgtccttcgtttttctacaatagatcggatcatcaatacgcatgataagtacttgatttttttttcagcttctcaaagtaaagatggtgaagctgacgatgattgctcgtgtgactgatgggcttccactagctgagggactggatgatggtcgtgatatgcaggatgcagagtactacaaacagcaagtcaaggctttattcaagaacctttcaaggggacaaaatgaagcctcaaggatgtctgttgaaactggcccttatattttccactatatcattgaagggcgggtgtgttatttgacaatgtgtgatcgtgcttatccaaagaaactggcgtttcaatatcttgaagatcttaagaatgaatttgagcgtggctatgggaatcaaattgaaactgctgcaagaccatatgctttcataaaatttgatacatttatacagaggactaagaaattgtaccaggatacaagaactcaacggaacattgctaagttgaatgatgagctctatgaagttcaccaaataatgactcgtaatgtacaggaagtccttggtgttggtgaaaagttggaccaggtgagtcaaatgtcaagccgcttaacatcagatactcgcatatatgctgataaagcaagagatctaaatcgacaggctttgatcaagaagtgggctcctgttgcaattgttcttggagttgttatcctactgttctgggccagaaagaagatatggtgatgatgaattctgttttaagttaattctccttgcattatccattttcaccttagaacgggaaagttt

SEQ ID NO: 8821 - DNA, 1430 bp, Trifolium pratense
agggatttcatttcatttcatttcttttcaaagtaaacataacaacaaaatcttccgaaactttcatcgatcggctcggttcggctggaccatcgacgccgccgattgttgcggcagctccggccacctttccaccaccaccattcattcattcttcttcttcttcagtgtgtgttttggtttagttgcaaagtttaagactctgagagggagattgtgaactgagaaagatggtgaagttgactatgattgctcgtgttactgatggtcttccacttgctgaaggactggatgatggtcgtgatcttactgacggtgaattttacaaacagcaagccaagtcgttgtttaagaatctatcaagagggcataatgaggcatccagaatgtcagttgaaagtggtccttatgttttccattatatcatagaaggacgggtctgttacttgacaatgtgtgatcgggcataccccaagaaactagcatttcaatatcttgaagacctcaggaatgagtttgagcgtgttaatggatcgcaaattgaaactgctgccagaccttatgccttcattaagtttgacacatttatacagaagacaaagaaactttaccaggatacccatacacagcgcaatattgcaaagttgaatgatgagctttatgaagtccaccaaattatgacccgaaatgtgcaggaagttcttggtgttggcgaacagttggatcaggtcagccaaatgtccaatcgcctatcgtcagaatctcgtgtatatgctgacaaggctagagatttaaatagacaggctctgattcggaaatgggcccctgttgctattgtttttggagttgtctttgtacttttctggctcaagaacaaaatttggtgatcaagcttagcacggctttacaaacctagactgtgtggctatgacttcttgtcttcctcatgactatcaagatttgctcagttttgtgggaaccctacataaactaggtgatgtctacttctgtggacaatttatgaaaacaaactatcctgtgtacttctgagaaaggctggatccgactttctggaatagaaactttttacctttatattaaggagccaagacatgagaaaactggatccctttggggatgcatatagatatttcttcttactacccaccaattattttcaggattactgcgttcatgagttatatattgccccctcgatatttttttccctccccttcatttgaacacctgaaatagaactgcatcttgtatggttagtatgatgagttagtgtgaaatgtttgttcttagacagtaaaccttttgcaatttcgtttatacgagtttacttgcaaataatgcaatttcttatatgttgatatactgctgttgtttaaaccagtcattgtatttatgcatgtatagtttga

SEQ ID NO: 8822 - DNA, 1387 bp, Trifolium pratense
ttcgttttcttgtgcttttggcgaaaatctcacactccattttcatttcaacgtaaacataatactaacatcttccaaaagtttcatcgatcggctcggctggaccatcgacgccgccgattgttgcggcagctccggcctccttctcatcaccattcattcattcttcttcagtgtgtgttttggtttagttgcaaagtttaagactctgagagggagattgtgaactgagagaagatggtgaagttgactatgattgcccgtgttactgatggtcttccactggctgaaggactggatgatggtcgtgatcttactgacggtgaattttacaaacagcaagccaagtcgttgtttaagaatctatcaagagggcataatgaggcatccaggatgtcagttgaaagtggtccttatgttttccattatatcatagaaggacgggtctgttacttgacaatgtgtgatcgggcataccccaagaaactagcatttcaatatcttgaagacctcaggaatgagtttgagcgtgttaatggatcgcaaattgaaactgctgccagaccttatgccttcattaagtttgacacatttatacagaagacaaagaaactttaccaggatacccatacacagcgcaatattgcaaagttgaatgatgagctttatgaagtccaccaaattatgacccgaaatgtgcaggaagttcttggtgttggtgaacagttggatcaggtcagccaaatgtccaatcgcctatcgtcggaatctcgtgtatatgctgacaaggctagagatttaaatagacaggctctgattcggaaatgggcccctgttgctattgtttttggagttgtctttgtacttttctggctcaagaacaaaatttggtgatcaagcttagcatgactttataaacctagagtgtgtggctatggcttcttgtcttcctcacgactatcaagacttgctcagttttgtgggaaccctacttaaactaggtgatgtctacttttgtggacaatttatgaaaaaaaaaactatcctgtgttacttctgagaaaggctggatccgactttcttgaatagaaactttttacctttatattaaggagccaagacatgagaaaactggatccctttggggatgcatatagatgtttcttcttactacccaattattttcaggattactgcgttcatgagttatatattgccccctcgatatttttttccctcccctgaatttgaacacctgaaatagaactgcattttgtatggttagtataatgagttagtgtggaatgtttgttcttagaccgtaaaccttttgcaattccgtttatacgagtttacttgaaaataatgcaatttcttttatgttgat

SEQ ID NO: 8823 - DNA, 1333 bp, Trifolium pratense
gggatttcatttcatttcatttcttttcaaagtaaacataacaacaaaatcttccgaaactttcatcgatcggctcggttcggctggaccatcgacgccgccgatcgttgcggcagctccggccacctttccaccatcattcttcttcagtgtttgtttaggtttagttgcaaagtttaaggctgagagggaaattgtgaactgagaaagatggtgaagttgactatgattgcccgtgttactgatggtcttccactggctgaaggactggatgatggtcgtgatcttactgacggtgaattttacaaacagcaagccaagtcgttgtttaagaatctatcaagagggcataatgaggcatccaggatgtcagttgaaagtggtccttatgttttccattatattatagaaggacgggtctgttacttgacaatgtgtgatcgggcataccccaagaaactagcatttcaatatcttgaagacctcaggaatgagtttgagcgtgttaatggatcgcaaattgaaactgctgccagaccttatgccttcattaagtttgacacatttatacagaagacaaagaaactttaccaggatacccatacacagcgcaatattgcaaagttgaatgatgaactttatgaagtccatcaaattatgactcgaaatgtgcaggaagttcttggtgttggtgaacagttggatcaggtcagccaaatgtccaaccgcctgtcgtcagaatctcgtgtatatgctgacaaggctagagatttaaatagacaggctctgattcggaaatgggcccctgttgctattgtttttggagttgtctttgtacttttctggctcaagaacaaaatttggtgatcaagcttagcatttgacttcataaactaggtttggctatggtttcttgtcttcctcatgactatgaagaattgctcaagttttgtgggaaccctgcataaactaggcgatgtctactttttgtggacagtttaaaacaaaaactatcctgtgttatttctgaaaaatgctggatccgactttctgaatagaaaccttttacctttatattaaggagccaagacatgagaaaactggatccccttggggatgcatatagacatttctttcttactacccaattattttcaggattacttcgatattttttccttctcttaatttgaacacctgaaatagaactgcattttgtatgtgtagtataatgaatcagcgtggaatgtttgtttagactggtaaaccttttgcaatttcttttatacgagttcacttgcaaataatgcgatgatcaagatccattgatcct

SEQ ID NO: 8824 - DNA, 1134 bp, Coffea canephora
agccccatcttgtctggccttctccctctctttggaaaacttgtcgcaggcgtatcccctaatcactatcggatctcccaaatttcgcgtcattccggcaagccctagctcggatcatcggaattttgtagctgtaaccgattacaattgctgccaattcgaattgaggatcgaaatctacataccttccacatacgtgtgcgtctacccattgcggagccgcgtatgcgtatgaaaagaacctgatcgactcacataattcaggctcaggatagagttccaggaagaaaaatggtgaaattgactatgattgctcgtgttactgatggccttccattagtggaggggctggatgatggccgagatatgccagacgtggattactacaaaaagcaggccaaggcgttgttcacaaatctgtcaaggggccagaatgaggcttccagaatgtctattgaaaccggtccttatgttttccattatatcattgaagggcgagtttgttatctgacaatgtgtgaccgtgcttatcctaagaagcttgcttttcaataccttgaagaccttaagaatgaatttgaacgtgtaaatggtagtcaaatcgaaactgctgccagaccttatgcttttataaaatttgatacattcatacagaaaacaaagaaactataccaggatacaagaacccagcggaacattgcaaagttgaatgatgaactttatgaagtacaccagattatgactcgcaatgtacaagaagttcttggtgtcggggaaaaattggaccaggtgagtcagctttctagccgtttgacttctgaatctcgcatatatgctgaaaaggcaagagatttgaatcgccaggccttgattcgtaaatgggcacctgtagcggtagtgctcggcgttgtaatcctcctgttctgggttaggaagaagatttggtgatggatgtcagggagcctttgcttaatttgcatgaagatgccacctacagaggcagaagaaagtcatctctcacgtgttccattatactggcttatctcaagtggttctaccccttgtttgagaatcaaaagatacaaacagaagcaagttattattgacaactttagggagctcattgtcattgta

SEQ ID NO: 8825 - DNA, 982 bp, Euphorbia peplus
cgtgaaggggcttcaaagtggatcgggattacttaagagagctgcatctcaaacgcgctcagggaaaaagattggtccatttgaaatcctccatatcccaataccagatgatataacaagccaacaaagaaagagagaatggtgaagctgactatgattgcacgtgtcaccgatgggcttccactagctgaaggactggatgatggccgtgatttgaaagacattgaattgtacaaacagcaagtaaaggctttatttaagaaccttgctacacgccagaatgagccttcaaggatgtccattgaaactggccctttcgtcttccattacatcattgaaggacatgtttgttacctcacgatgtgtgaccgatcttatcccaagaagctagcatttcaatacttggaagacctcaagaatgaatttgagcggacaaatgggtctcaaatcgaaactgctgccagaccatatgccttcattaaatttgatacttttatacagaaaacaaagaaattgtaccaagatacccgtactcaaagaaacatttcaaagttgaatgatgaactctatgaagttcaccagattatgactcgcaatgtccaggaagtgcttggtgttggtgaaaaactagaccaggtcagtgagatgtccagtcgattaacatcagaatcccgtatatatgctgacaaggccagagatttgaatcgtcaggcatttattagaaagtgggctccagtagcaatcgttttaggtgttgtcttcgtcttgttctgggctaaaaacaagatatggtgatcggaatacttcggaagaatttctgaaaactgtggcatcattttcttggttttgtacttagatgcacacaaagacttggtcatgtttgaaggtggagtgtagctttggtactgaggaacactgagatcttgttcttaatatacacatgaatagtcgttaagttaaggaccccaaaaaatttgggtac

SEQ ID NO: 8826 - DNA, 887 bp, Linum usitatissimum
aaagatggtgaagcttacaatgatagcccgtgtcactgacggtctcccactggcggaaggtctggatgatggtcgtgatgtcaaagatattgaattgtacaagcagcaagtcaaggccttgttcaagaatctcgccattcgccagaatgagccttcaaggatgtccatcgagactggcccttacgtcttccactatattatcgaaggacgagtatgctaccttacaatgtgtgaccgtgcatatcctaagaaacttgcgttccaatatcttgaagacttgaaaaatgaatttgagcgtgtcaacggggctcaaattgaaactgctgccagaccttatgcctttatcaagtttgatacttttatacagagaacaaagaaattgtaccaggacacacatacccaacgaaacattgctaagttgaatgatgaactctatgaagtccatcagataatgacccgtaacgtgcaagaagttttgggagttggtgaaaagcttgaccaggtcagtgaaatgtccagtagattaacatctgaatctcgcgtatatgcggacaaggctagagatttgaatcgacaggcgttgattcggaaatgggctccggtggccatagtgttcggagtggtgttcctcctcttctgggttaaaacgaagatctggtaattgatacgaatgttatgcgagggatggatgtaatgggtagaaagaatcatggatgggttgagtagatggacccgtaggaagagtgtaaaagagtgatgattggacaaaaatggctatagggtacaaaaacatggcgagctaactctagtgagtgattggctatgcggtatttggttgatgtttctttctagagttttaaccgtcgagaaaactggactaatctgcc

SEQ ID NO: 8827 - DNA, 1041 bp, Lupinus angustifolius
cagtgtaaagttgtagactgagagagagattgtgaattaagaaagatggtgaagttgactatgattgctcgtgttacggatggtcttccactagctgaaggactggatgatggtcgtgatattaaagatgcggaattttacaaacagcaagtgaaggccttgtttaagaatctctcaagaggacataatgaggcatcgaggatgtccgttgaaactggtccttatgttttccattatattatagaaggacgtgtctgctatttgacaatgtgtgatcgtgcataccctaagaagctagcttttcaatatcttgaagagctcaggaatgagtttgagcgcgttaatgggtctcaaattgaaactgctgccagaccatatgccttcatcaagtttgacacatttatgcagaaaacaaagaaactttaccaggatacccatactcagcgcaatattgcaaagttgaatgatgaactctatgaagtccatcagataatgactcgaaatgtgcaggaagttcttggtgttggcgaacagttggaccaggtcagccaaatgtccagtcgattatcatcagagtctcggatttatgctgataaggctagagatttgaatcgccaggctctgattcggaagtgggcccctgttgctattgttttgggagttgtctttgtacttttctggctcaaaaacaaaatttggtgatcaagctcattatatgacatttaaacctgagactttgctgctatagcttcttgcttttctcacatcactatccagatttgcagagattcaggggaaccctatatgcatgaatgatgtctactttttatgtacaattttggtttagaaaatgtgaatatcctccattacattcgaacatagctggatcaggcattctggaataggaacaacttacctcttttgtgaggagccaagatatgagaaaacttgatgtccttagggatgcatgtagacatttgctctccttcccattatttttagggttattgcttcagtggcatatatttgaccacctatata

SEQ ID NO: 8828 - DNA, 1282 bp, Tropaeolum majus
agatcaaagattgaatctcaaatccttttccatcgaaaaccctatataacattttctctctccatctctctcgcgaccatcgtcttctctgtttctttctcagataattgaaatcaatcaattagagaattcttgaatgctttaagcaggaagcttaatagcttagaaataaaaaaaagtaacaatggtgaagatgacaatgattgctcgtgtaactgatggccttccattagcagaggggctggatgatgggcgtgatttgagagatgctgaaatgtacaagcagcaagtgaagtctttgttcaagaatctctcaagagggcagactggggtttccagaatgtcagttgaaactggtccttatgtgtttcactatatcattgaaggtggtgtttgttacttgacgatgtgtgatcgtgcttatccaaagaaactcgcttttcaatatttggaagaccttaggaatgaatttgaacgtgttaatggtggtcaaattgaaacagcagcccgaccttatgccttcattaaatttgatacattcatacagaaaaccaagaagttgtaccaggacacccgcactcagcggaatattgctaagttgaacgatgaactttatgaggtgcaccaaataatgactcgcaatgtgcaagaagttcttggtgttggtgaaaagttggatcaggtcagccaaagatctagtcggttaacgtcagaatcgcgtatatacgctgataaggctaaagatttgaatagacaggcgttgattcggaaatgggcccctgttgcaatagtcttaggagttgtcttcctcctcttctgggtgaagaaaaagatctactgatgcaacaaacttgtagagtttctggaaacaacagctgcagcacattttccagggttttctcgacatccccacggtatatctgattatactgtgagaattttaaaaatttaagatgggaacgaaacacagatcttggtaatgtagtatatgagatcaatttaccatgtgaaaggagagacaattcccccatgaagaaagattacaatgtgtgaagaactaatatgatactgtgaatcttatgtttgggggaatatctatagaggatttcattcgtctatatatattgattactatccaatatgttatatgttccattgaattacagataaaagaggacatactttgttgttgttgtagttcttatattgcttttctagtctttctttcttattgtgtttggtactaagttgtaggttaactaaaaaaaaaaaaaaaaggaac

SEQ ID NO: 8829 - DNA, 960 bp, Petroselinum crispum
ttctgatcgtagcacaggatctgcataccttttcaataactaagctatatttgactaccatcccccgttttacattattcaaggtaagtgcttttgaagttaggatggtgaagctgacaatgattgctcgtgtcactgatggtctcccactagttgagggtttggatgatggtcgtgatgttcaaaatgtagattattacaaacaacaagttaaggcattgtttaagaacctctcaagaggtcataatgaagcttcaaggatgtctgttgaaaccggccccttcatattccattatattattgaaggccgtgtctgttatttgactatgtgtgatcgtgcttatccaaagaaacttgcctttcaatacttggaagatcttgcgaatgagtttgagcgtgctaatgggagtcaaattgaaactgctgcgagaccttatgcatttataaaatttgatacgttcattcagaaaaccaaaaaattgtaccaggacacaagaactcagcgaaatattgctaagcttaacgatgaactctatgaagttcaccaaataatgactcgcaatgtacaggaagttcttggtgttggtgaaaagttagatcaggtcagtcaaatgtccagccggttgacatcagagtctcgcatatatgctgataaggcgaaagatttgaatcgacaggctttgatccggaagtgggctcctgttgcaattgtcttgggaatagtcattcttctattctgggtgaggaagaagatttggtgatcttctgtcattgcacttttagaatacttgccatgcttttttgtttattaatccggcactccagactgcctgttcaaaattcttgagaaaccagagtttttgtatatgtttgcttgtagtttaaatacaactctggatggctgggaaacctcttggtccttgaagatctttgcgcttatactgtatgcttatcaactat

SEQ ID NO: 8830 - DNA, 1134 bp, Lippia dulcis
aaaattaaaacagtcccccctttcctatattcattctattcaaaccctggttccatttcaaatcaacgaaatctcgtaatctttaaacctaatcgaggattggagattaccgtacgcgtacgcatcccgatcgaggagctcacattcgcatgcgatttggtgtgagctcgtgatataaggatggtgaaactgacgatgatagctcgtgttactgatggccttcctttagtagagggactggatgatggccgtgatgtgccagatgcagatttttacaaacagcaagtgaaggcgctgttcaaaaacctctcaacaggccagaatgagccgtcaagaatgtcaattgaaacaggcccatacatattccattatatcattgaaggtcgtgtttgctatttgacaatgtgtgatcgtgcttatcctaagaaactttccttccaatatctggaagacctcaagaatgaatttgagcgtgtatatggaaaccagattgaaacagctgcaagaccatatgcttttatcaagtttgatacatttatacagaagacaaaaaaattgtaccaggatacaagaacccagcgaaatatttcaaagttgaacgatgaactttatgaagttcaccagataatgactcgcaatgtacaagaagttcttggggttggtgaaaagttggaccaggtaagtgagatgtccaatcggttgacatctgaatctcgaatatatgcagataaggcaaaagatttgaaccgccaggccctgattcggaaatgggctccagttgcagttgttctaggagttgtttttctcctcttctgggtcaaaacaaagttatggtaaggctgctgcattcatttgcagttgatagactttaacgagtgcagtttcgtggtacaagcgcatttcttcaagttgagccatcttgggtaaatagtactatgagataggcggctaaggaaatagtaacatgagcttatgcacatccccatttatatcccaacaagatttactacgcaaaagaaaaagtattatattcctactagtttacttgcgttcactttatttgtattataagtatctcatagaagaacttctagtaggattttggcatttagcttctgaatgaaggtttattta

SEQ ID NO: 8831 - DNA, 1108 bp, Solanum tuberosum
ttattaccagctccgattcaagctcttaacaatttatcaaaggcggtcagcgatcggcgactggattccgagcagtcacgcaagcgtatgatcgatcgctgtctgcttgcgggaaaatatggtgaagttgactttgattgctcgtgtgactgatggtcttcctttagccgaggggctggatgatggtcgtgatgttcaaaatgcagatttctacaaacagcaggtcaaggccttattcaagaacctgtcaatgcgccaaaatgacgcttcaaggatgtctattgaaactggaccttacgtcttccattatatcattgaagggcatgtttgttatctgacaatgtgtgatcgctcttatcccaagaaacttgcctttcaatacctggaggaccttaagaatgagtttgagcgcgccaatgggagtcaaattgaaactgctgctagaccatatgcttttattaaatttgatacattcatacagaagacgaagaaactgtaccaggatactagaactcaacgcaacatttctaagttgaatgatgagctttacgaagttcatcagataatgactcgaaatgttcaagaagttcttggcgttggtgagaagttggaccaggtcagtcagatgtctagtcgcttgacatctgaatcccggatatatgctgataaagcaaaagatttaaatcgccaggctttgattcgaaaatgggctcctgttgctattgtgcttggagttgtcattctcttcttctggcttagaacaaagatttggtgattcttccatacagatgcagctcagtgacaaccatactgtcgaatgcttcttcttgtttgtcaccatcagactgtgcacaacccagggaaccacctcacattacagttgtccagcatgtgttgtgacatatcagttttatagtgtaagagaggaaaggaaccgtgatgaattatgtcccttaaccttgagaaattacattaattttggttctcctttatatattgtcttgttagtttagcttcaaaactccaagaggtagctcattgtagtttcagctatgaaactaacgactttcagaatatacagcaaatataaacaatccttcagactgct

SEQ ID NO: 8832 - DNA, 1227 bp, Chenopodium quinoa
cttaaaaccctacaaaatatttatgttcatttccttcggaaaaatcaaccacgtttttccaattctccgagatcttcacgaattctaagctcagagatctgaagatcatcgatttgaattttgtttcagttgattaaagtaggaaaaaatggtgaagttaacgatgattgctcgagtaatggatggtctaccattagcagaaggattagatgatgggcgtgatgtgcaagatgctgaatattacaagcagcaaatcaaagctttgttcaaaaatctttcgaaaggtcaaaatgatccttctagaatgtctgttgagagtggaccttacatatttcactatatcattgagggccctgtttgttatttgacaatgtgtgatcgggcttacccaaagaagcttgcatttcagtacctggaagatctcaagaatgaatttgagcgtgttaatgggaatcagatagaaactgctgctagaccttatgcgttcattaagtttgatacatttatacagagaacaaagaagttgtaccaggatacccgtacccagaggaacatttccaaactgaatgacgaactctatgaagtgcaccaaatcatgacccgaaatgtgcaagaagtccttggtgttggagaaaaattggaccaggtcagcgaaatgtcaagccgcttaacatctgaatcacggatttacgctgataaggcaaaagacctaaatcgacaggctctgatccggaaatgggcgcctgtagcaattgtaatcggagttgtggtgctactcttctgggtcaaaaagaagatctggtgatgcactggccttttttggcttcctgaaaaactattcagacatatctgctgattacgatgtttactctttaaacatatgggcaaccagtcaaccacactacaggactaggcttcttattcggtgtctggaactagatagacacgaaatgttttttcagtgatatggaaaagctatatatatgcatgactttgttgtatatcatataaactccattttgatgtcaaaattcgagatagtgaaacttgaaagctcaaaatccatagtaaatgggctttctgcgaattcgagtaatttgttttgttaaatagattcgaacatcaaaactgtttctcttggtagttttattctcacttgtcagttgtcactacctgaattatttagtacttcgcatttaaattgtaaatctttactttatatttggg

SEQ ID NO: 8833 - DNA, 1244 bp, Chenopodium quinoa
aaaaaatatttatgttcatttccttcggaaaaatcaaccacgttttcccaattctccgagatcttcacgaattctaagctcagagatctgaagatcatcgatttgaattttgtttcagtcgtaaaagtaggaaaaaatggtgaagttaacgatgattgctcgagtaatggatggtctaccattagcagaaggattagatgatgggcgtgatgtgcaagatgctgaatattacaagcagcaaatcaaagctttgttcaaaaatctttcgaaaggtcaaaatgatccttctagaatgtctgttgagagtggaccttacatatttcactatatcattgagggccctgtttgttatttgacaatgtgtgatcgggcttacccaaagaagcttgcatttcagtacctggaagatctcaagaatgaatttgagcgtgtaaatgggaatcagatagaaactgctgctagaccttatgcgttcattaagtttgatacatttatacagagaacaaagaagttgtaccaggatacccgtacccagaggaacatttccaaactgaatgacgaactctatgaagtgcaccaaatcatgacccgaaatgtgcaagaagtccttggtgttggagaaaaattggaccaggtcagcgaaatgtcaagccgcttaacatctgaatcacggatttacgctgataaggcgaaagacctaaatcgacaggctctaattcggaaatgggcgcctgtagcaattgtaatcggagttgtggtgctactcttctgggtcaaaaagaagatctggtgatgcactggccttttttggcttcctgaaaaaactagtcagacatatctgctgattacgatgtttactctttaaacatatgggcaaccagtcaaccacactacagaactaggcttcttattcagtgtctggaactagatagacacgaaatgttttttcagtgatatggaaaagctatatatatgcatgactttgttgtatatcatataaactccattttgatgtcaaaattcgagatagtgaaacttgaaagcccaaaatccatagtaaatgggctttctgcgaattcgagtaattttgtttgttgaatagattcgaacatcaaaaaactgtttctcgtggtagttttattctcacttgtcactacctgaattatttagtacttcgcatatttttaaaattgtaaatcttacttttatatttcggtacttataaatttataatcgatacacaa

SEQ ID NO: 8834 - DNA, 743 bp, Secale cereale
gactctcgtcctaaaaagcgcttgccctcctagtagtggtgtcctctctcttcttcggcttctctttcgcctctctctatctctcacccaaagcgaaccagaacccgacgcgaggcgtggttcgccgcgagatggtggcacttttacattagctatgctagtttgtgtcttgttatcttttcaaaatggtgaagctgacaatgatagcccgcatcactgatggccttccattggcggaggggttagatgatggtcgagatctgaaggatgctgacttctacaagcagcaagcaaaactgttgttcaaaaacttatctaaaggccaacacgaatcatcaaggctgtcaattgagactggaccgtactatttccattacatcattgagagccgtgtatgctatttgacaatgtgcgaccgttcttatcccaagaaacttgcattccagtatttagaagatctaaaaaatgaattcgagagggtcaatggcagccaaattgaaactgctgcaaggccatatgctttcatcaaatttgatacattcatacagaaaacaaggaaactatatttggataccagaacccaaaggaaccttgccaagttgaatgatgagctctatgaggtgcaccagattatgactcgcaatgttcaagaagttcttggtgtgggtgaaaaactagatcaggttagtcaaatgtctagtaggttgacctctgatacgagaatgtatgcagacaaggcaaga

SEQ ID NO: 8835 - DNA, 847 bp, Carthamus tinctorius
ggcgggggcgtttcttcatccggtcatctctcttccatccccaattcatcaaaatccaaaaccctatttttattattcttacaattctaagatcggatcatcaatacgcatgatacccacttgaaattctccaccgcttcttcaaagtaaagatggtgaagctgacgatgattgctcgtgtcattgatggacttccactagcggagggactggatgatggtcgtgatatgcaggacgcggagttctacaaacagcaagtcaaggctttgttcaagaacctttcaaggggacagaatgaagcctcgaggatgtctgttgaaactggcccttatatcttccactatattattgaagggcgggtgtgttatttgacaatgtgtgatcgtgcttatccaaagaaacttgcctttcaataccttgaagatcttaagaatgaattcgagcgaggttatgggaatcaaattgaaactgctgcaagaccatatgctttcataaaatttgatacatttatacagaggactaagaaactgtaccaggatacaagaactcagcggaacattgctaagttgaatgatgagctctatgaagttcaccaaataatgactcgtaatgtacaggaagtccttggtgttggtgaaaagttggaccaggtcagtcaaatgtcaagccgcttaacatcagatactcgcatatatgctgacaaagcaagagatctaaatcgacaggctttgatcaagaagtgggctcctgttgcaattgttcttggagttgttatcctactgttctgggccagaaagaagatatggtgatcatggcttccattgtttcatttttctctgtgttccag

SEQ ID NO: 8836 - DNA, 1263 bp, Glycine max
aaaacgacgtggcatttgcccaaatttctaacacgccattctcctccttttcaatcctctgttcatccgtcgatcggctcggctggaccatccttgccgccgtttgccgcggcatctccggccactctctctcatcgccattcagtgtattttggtttagttgcaaagttttagagttggattggaagattgtgaactaagaaagatggtgaagttgactatgattgcccgtgttactgatggtcttccgctagctgaaggactggatgatggtcgtgatcttaaagatgcagaattttacaaacaacaagtcaaggctttgtttaagaatctctcaagaggacattatgaagcatcaaggatgtcagttgaaactggcccttatgtttttcattatattatagaaggacgtgtctgttacttgacaatgtgtgatcgtgcataccctaagaaactagcctttcaatatcttgaagagctgaggaatgagtttgagcgtgttaatgggtctcaaattgaaactgctgctagaccttatgccttcattaagtttgatacatttatgcagaagacaaagaaactttaccaggatacacatactcagcgcaatattgcaaaattgaatgatgaactctatgaagttcaccagataatgactcggaatgtgcaggaagttcttggtgttggtgaacagttggaccaggtcagccaaatgtccagtcgcttatcatcagaatctcgcatatatgctgataaggctagagatttaaatcggcaggctttgattcggaagtgggcccctgttgctattgtttttggagttgtcttcgtacttttctggatcaaaaataaactatggtgatcgagctcagtatgacatttaaaacatggattgcgatgctgtggcttcttgcttttctcgcatgattgtccagatttgcacagattggtgagaaccctttatgcataagatgatgccgaccttttcttgacaactttggtttagaaaaaacaaaaaagactatcctttgttacatctggatcagtctttctggaacagaaacctttgacctttatagtaaggagccaggatatgagaaaactttatccccgtggggatgcatataggcatttcttctttataattctcaattattttcaggattattgcgttaatgaattacctcttggattttattgtttccgtttgagccgctgaatgagtataatgatagtgagtagtgtggaatacttgttctaaaa

SEQ ID NO: 8837 - DNA, 1336 bp, Fragaria vesca
attccaccttcgcttccttaatgtacaacctgtaacgcagagatcgtagatttgattacaacaaaccaacccctcaattataaaaccctaacattctcacctccgattgcaccctcctcgtcctccgatcaaccccatacccagggtacatataattgttacttttgcattgctgagaagttgtgaagcgaagatggtgaagttgacgatgattgctcgtgttactgatggtcttccactagcagagggactggatgatgggcgtgatattaaggattcggaattctacaaacaacaagtcaaggctctattcaagaacttgtcaagaggccagaatgagccttcaaggatgtcagttgaaagtggaccttatatattccattatattattgaagggcgtgtgtgttacttgacaatgtgtgaccgagcctatccaaagaaacttgcctttcagtacctggaagatctcaagaatgaatttgagcgtgttaatggagcccagattgaaactgctgcaagaccatatgctttcattaaattcgatacgttcatacagaaaaccaagaaattataccaggatactcgtactcagcggaacatttcaaagttgaatgatgaactctatgaggtccaccaaataatgactcgcaatgttcaggaagttcttggcgtcggtgaaaagttggaccaggtcagtcaaatgtccaatcgtttaacatcagagactcgtgcatatgctgaaaaggcgagagacttgaatcgacaggctctgatccgtaagtgggctcctgttgccattgttcttggagttgttttccttgttttctgggtcaaaacgaagctgtggtgatcagactgcttcaactttctgaaacttgtgacaatttcatggggttcctgttcattgttgtgactgcttccatctgatatagtcatgcagacttttggggcttcagaatggctactttatcctcaagtgagaggtttaaatgatgtttcggggttattttttttgggtggcggagttcgatgaagaaatttagttctgtaagaacctctgctattggggacatacccattatatggaagagactcaggaacagatctaggagtcgaatcttatcatacagctggtaaaagagaataatttctcatttatatatacattgtcaattttattctcgcgtattctgtctactactatttgtgatgattagttgattattatgagaggacttccgtgtgaaatgagcttgcacttgaaatggtagcaatcctctttactttctttcgaagctcagaccataaaagaaaagatgaaagagccaagttcctg

SEQ ID NO: 8838 - DNA, 1205 bp, Solanum lycopersicum
acctcttcaaatctcagcaaactcagcaaaacccctctttgttcctatcccatttattcccagctccgattcaaactcttaacaagtttatcaaaggcggtcagcgatcggcgactggattccgagcagtcacgcaagcgtatgatcgatcgctgtatgcttgcgggaaaatatggtgaagttgactttgattgctcgcgtgactgatggccttcctttagctgaggggctggatgatggtcgtgatgttcaaaatgcagatttctacaaacagcaggtgaaggccttattcaagaacctgtcaatgcgccaaaatgacgcttcaaggatgtctattgaaactggaccttacgtcttccattatatcattgaagggcatgtttgttatctgacaatgtgtgatcgctcttatcccaagaaacttgcctttcaatacctggaagaccttaagaatgagtttgagcgcgccaatgggagtcaaattgaaactgctgctagaccatatgcttttattaaatttgatacattcatacagaagacgaagaaactgtaccaggatactagaactcaacgcaacatttctaagttgaatgatgagctttacgaagttcatcagataatgactcgaaatgttcaagaagttcttggagttggtgaaaagttggaccaggtcagtcaaatgtccagccgtttgacatctgaatcccggatatatgctgataaagcaaaagacttaaatcgtcaggctttgattcgaaaatgggctcctgttgctattgtgcttggagttgtcattctcttcttctggctcagaacaaagatctggtgatgcttccatacagatgcagctcagtgacgacaatactgtcaaatgttttattcatatttgtcaccatcagactctgcacaacccagagaaccacctcacattacagttatccagcatgtgttgtgccatatcagttttatagtgtaaaagaggaaaggaaccgtggtgaattatgtcccttaaccttgagaaattacattaattttggctctcttttatatattgtcttgttagtttagcttcaaaactccaacaagtagctcattgtagtttcagctatgaaactaacgtatttcagaatatacagcaaatataaacaatccttcagactgttatgcacaggagtttggtcctttgtttaccaactctaagttgc

SEQ ID NO: 8839 - DNA, 1072 bp, Vicia sativa
agaaaaatggtgaagttgacaatgattgctcgtgttactgatggtcttccactagctgaaggattagatgatggtcgtgatcttaaagatggtgaattttacaaacagcaagtcaaggcgttgtttaagaatctatcaagagggcataatgaggcgtcgaggatgtcagttgaaagtggtccttacattttccattatattatagaaggacgggtctgttacttgactatgtgtgatcgggcataccctaagaaactagcatttcaatatcttgaagagcttaggaatgagtttgagcgtgttaatggggctcaaatcgaaactgctgccagaccttatgccttcattaagtttgacacgtttatacagaagacaaagaaactttaccaggatacccatacacagcgcaatattgcaaagttgaatgatgaactttatgaagtccaccagattatgactcgaaatgtgcaggaagttcttggtgttggtgaacagttggatcaggtcagccaaatgtccagtcgcctatcatcagaatctcgcatatatgccgacaaggccaaagatttaaatagacaggctctgattcgaaaatgggcccctgttgctattgtttttggagttgtctttctgcttttctggctcaaaaacaaaatttggtgatcgtgcttagcatgacttcgtaaacctggattgtgtggccatgaattgtcttcctcatataggactatcaaaatttgttcagttttgtaggaaccctacataaagtaggcggtgcctactttttgtagacagattatgaaaaaaaaaaactatcctgcgttacttctgagaaggttggacctggatctgactttctggtatagaaaccttttaccttttatattaagggagccaagacatgagacaaactggatccccttggggattcatagacatttcttcctactacccaattatttttcaggaatattgtgttaaacagttatatattgccccctctatattttgttccccatacttataatagaactgcatttttcagtccaatatattttgtttctagactggt

SEQ ID NO: 8840 - DNA, 1268 bp, Cichorium intybus
aatggaaacaattttaactcttgacttctctggaaatcctgatattaataattgggagttttgggaattcaagatccaagactacggtcgagtataaattttaggaccgaagggggcaataacctttcccattacgtttcttcttccagtcattgatctcttcttgaaggacaagaaaccatccccaattttcaaatcatccttccaaaaccctataatttgatttgatccctttctacggagtttgctcgttctcgtaaacctcgctcaccgatcaatgtggatcaaggaactctaagcaggaaagatccggtcatccatacgcatgatatatacttgacaaaattccagctgacagcttctctaagtaaagatggtgaagctgacaatgattgcacgtgtcactgatggccttccactagctgaaggacttgatgatgggcgtgatatgcaagatgcagagttttacaaacaacaagtcaaagctttgttcaagaacctttcaagaggacaaaatgaagcatcccggatgtctgttgaaaccggcccttacattttccactatattattgaagggcgagtatgttatttgacaatgtgtgatcgtgcttacccaaagaagcttgctttccaataccttgaagatctcaagaatgaatttgagcgtggttatgccaatcaaattgaaactgcagcaagaccttatgcttttataaaatttgatacatttatacagaggacgaagaaattgtaccaggacactagaactcaaaggaacatttcaaagttgaatgatgaactttatgaagtacaccaaataatgacacgtaatgtgcaggaagttcttggtgttggtgaaaagttggaccaggtgagtcaaatgtcaagcagattaacctcagaatctcgcatctatgctgataaagcaagagatctaaatcgacaggccttgatcaagaaataggctcctgttgcaattgtggttggagtagttattatactcttctgggttaaaaacaagatatggtgatgaattatggcgtggcttcttttgtctgataaaacatatcttttttttttttttatgtattccatttgtttccgggggcttaagctacttacaaatacaaaaaatcatttgagttttgaagtgggaagttttaggttatatggaggttgtttttcaacctaagtgttgtgggtaactaaaagaaagtatttacttaattttgttgcggatttatggatttatatactgagatttcttc

SEQ ID NO: 8841 - DNA, 980 bp, Castanea mollissima
gagggttactgatttggacatagtttggagaggctagagatatggtgaagttaaccatgatagctcgtgttactgatggcctaccattagcagaagggctggatgcaggtcgggatccacaagatgaattctacaagcagcaggctaaatccatattcaaaaatttgtcaaggggccataacgaatcctcaagaatgtcgatagaaactggtccctatatattccactacatcattgaaggccgtgtttgttatctgactatgtgtgatcgttcttatccaaaaaattagcttttcagtacttggaagagctcaagaatgagtttgagagagtcaatggggatcaaattgaaactgcagctagaccttacgcattcattaaatttgatacatatatacagaaaattaagaaattgtatttggacacccgctctcaacggaatattgcaaagttgaatgatgaactctatgaagttcagcaaataatgacccggaatgtgcaagaagttcttggtgttggtgaaaagttggaccatgttagtgagatgtccagtcgtttgacttctgaatctcgcatatatgctgataaggcaagagatctaaatcgacaggcattgatccggaagtgggcgccagttgggattgtcattgctgttgttcttctcctcttttgggtaaaaaacaagatatggtgatcctttttgctcgtgcgtttcagctggcatcattgtcaattaccactcgccggatggagtaagtttcaggattgtgcagagttttggtgtggggtacatatccatactaaggaagagcagtggatattatcaggtgggcaagcctgaattatataagtcgattaaagggaaaaatgtacttggtaaaatttagaagagatcgatcctcttattgttattacttttataatataactaaacaaactaggctcatagttcatacagcaatgtatctactcggatccga

SEQ ID NO: 8842 - DNA, 889 bp, Fraxinus spp
ggagaaattggagttttgaatattattttgatctacgaaagagataaatttcagatttcttgatttgattcaattgatcagctgtgagctcgtgaagtaaagatggtgaaactgactatgattgctcgtgtcactgatggacttccagtggcagagggactggacgatagtcgtgatgtgccagatgctgacttctacaagcagcaagtcaaagctttgttcaaaaacctctcaaggggtcagaatgagccttcaagaatgtcgattgaaacaggcccatatatctttcatcatattattgaagggcgtgtttgttatttgacaatgtgtgatcgtgcttatcccaagaaacttgcctttcaatatctggaagaccttaagaatgaatttgagcgtgtctatggaaatcagattgaaactgctgcaagaccttatgcttttattaaatttgatacattcatacagaaaacaaagaaattgtaccaagatacaagaacccagcggaatattgcaaagttgaacgatgaactttatgaagtccatcagataatgactcgcaatgtacaggaagttcttggtgttggtgaaaagttggaccaggtcagtcagatgtcaagtcgcttgacatctgaatcccgcatatatgctgaaaaggcaaaagatttgaaccgccaggctctgattagaaatgggcccctgtcgctgttgttctaggagttgttttcctcctcttctgggtcagaaagaagttctggtaatactgccattgatctgcagttgatagtcactgtttcagtatcttaaatatgcatttcatcttttgaggtgtgtagcaattttttgtacaaaactaccttctaaggctgggacaaatcgaatcatgacagaa

SEQ ID NO: 8843 - DNA, 1011 bp, Glycine max
gccgcgacacccaccttccccttccggacctccgtgcgacccccccccctccgccgtgttttagttgcaaagttttagagttggattggaagattgtgaacttagaaagatggtgaagttgactatgattgctcgtgttactgatggtcttcctctagctgaaggtctggatgatggtcgtgatcttaaagatgcggaattttacaaactgcaagtcaaggctttgtttaagaatctctcaagaggacattatgaagcatcaaggatgtcagttgaaactggcccttatgtttttcattatattatagaaggacgggtctgttacttgacaatgtgtgatcgtgcataccctaagaaactagcctttcaatatcttgaagagctcaggaacgagtttgagcgtgttaatgggtctcaaattgaaactgctgcaagaccttatgccttcattaagtttgatacatttatgcagaagacaaagaaactttatcaggatacccatactcagcgcaatattgcaaagttgaatgatgaactctatgaagtccaccagataatgactcggaatgtgcaggaagttcttggtgttggtgaacagttggaccaggtcagccaaatgtccagtcgcttatcatcagaatctcgcatatatgctgataaggctagagatttaaaccggcaggctctgattcggaagtgggcccctgttgctattgtttttggagttgtcttcgtacttttctggatcaaaaataaactatggtgatcgagctcagtatgaaatttaaaacctggattctgtggcttcttgcttttctcacatgattatccagatttgcacagattggtgggaaccctttatgcatgagatgatgtcaactttttcttgacaacttcggtttagaaaaaaaaaaaagactatcctttgttacatctggatcagtctttctggaacaggaaccttttgacctttatagtaaggagccaggatatgagaaaactttatccccg

SEQ ID NO: 8844 - DNA, 1264 bp, Spinacia oleracea
aaaaaggtattattaagcagaaaagatggtgaagctgacgatgattgctcgtgtaatggacggtctaccattagcagaagggttggatgatgggcgtgatgtgcaagatgctgagtattacaaacagcaaatcaaagctttgttcaagaatctttctaaaggtcaaaatgatccttctagaatgtctgttgagagtggaccttatatatttcactatatcattgagggccctgtttgttatctaacaatgtgtgaccgggcctatccaaagaagctttcatttcagtacctggaagatctcaagaatgaatttgagcgagtgaatgggaatcagatagaaaccgctgctagaccttatgcgttcattaagtttgatacatttatacagagaacaaagaagctttaccaggacactcgtacacagaggaacatttccaaactgaacgacgagctctatgaagtgcaccaaatcatgacacggaatgtgcaagaagtccttggtgttggtgaaaagttggaccaggtcagccaaatgtccagccgcttaacatctgagtcacggatttacgctgacaaggcaagagacttaaatcgacaggctctgatccggaaatgggcccccgtagcaattgtaattggagttgtggtgctactcttctgggtcaaaaagaagatctggtaattccctccccgaaaatcatttagacatctctgatgtttacacttcgaacatatgggggaaatcacacaaggggcgaggcttctgatttgatgtatgtggctagatagacctgaaatgttttttcagtgatatggaaaagatatgtgcacgactttgttgtatatttatataaactccattttgatgttaaaattcgagatagtgaaacttgaaagctcagaatcatagtgtatgggctttctgcgaaattgagtaattttgttatcccttggactgattcagacatcaaagaacctgacacagcagaaatatctaacaatgacagtggtccactgacaaaagtttttactttgaaagagctaacagatgcagcaaagaagtgtagtcgcaaatgcccgattgatgtaggcagcttcggaaaagtttacagagggaaactcggagaaactggagaggtgacgatgctgagccttcttaaacatccaaatctgatcaatcttataggatactgtgctgaaggaaatgagagaattttagttcatgaatatctgcctttgggatccctagaccagcatctacacg

SEQ ID NO: 8845 - DNA, 1110 bp, Amaranthus tuberculatus
acacttcttcaagatcttctcaaattgcagagctcagcgatctggaattaagcgaacacaatttcatttcagctgaaaaaacgtagaatcaagcagaaaatggtgaaggtaacaatgcttgcacgtgttatggatggactaccattagcagaaggattagatgatggacgtgatgtacaggatgttgaatattacaaacagcaaattaaagctttgtttaagaatctctctaaaggtcaaaatgatccttcgagaatgtccgttgaaagtggaccttatatttttcactatatcattgagggaagtgtttgttacctgacaatgtgtgatcggtcttatccaaagaagcttgcatttcaatatctggaagatctcaagaatgaatttgagcgtgtaaatgggaatcaaattgaaactgcagctagaccttatgctttcatcaagtttgatacatttattcagagaacaaagaaattgtaccaagatacgcgtacccagaggaacattgctaaactaaatgatgagctctatgaagtgcaccaaataatgacaaggaatgtacaagaagtacttggtgttggtgaaaaattggatcaggtcagccaaatgtccagccgcttaacatctgaatcacggatatatgccgataaggcaagagatctaaatcgacaggccttaattaggaaatgggctcccgttgcaattgtgattggagttgtggttcttctcttctgggttaagaagaagatttggtgaagcactggactcttgcggctccttcctagaaacctattcgcagacatcacaggatgattccgttgctcacacttggaccatacggcaccatgctacaaagggacagtccagtggttttgaacgtagtatatggttaaatgtttttagagaaaaactatatatatatgctcgactttgttgtaggttacatataactccattttgatgtcaaaaattcgagatagtgaaatttgattgccttcaatcatattaattcaagctttctttatttttccttgaacactttcgtatgtcaaagaaccttgcgaagttattttttgtaacagttactagtcgtgggaggcaaggcacaca

SEQ ID NO: 8846 - DNA, 920 bp, Ambrosia trifida
tcatttattattccatcctcttatctgcattttgtgcattctccctcatcgatcaatgcagatcaagaaactttaagacagtaaagaattcaaaacttagatttaaaaaaaaaaaactttaaatcaaattcagtttatagcttctgaaactaaatatggtgaagcttacaatgattgctcgtgttaccgatggccttccgctagctgaaggattagacgatgggcgtgatatgcaggatgcagagttttataaacagcaagttaaggccttgtttaagaacctttctagaggacacaatgacgcttcgcggatgtctgtagaaaccggtccttacgttttccactatattattgaagggcgggtgtgttatttgacgatgtgtgatcgcgcttatccgaagaagcttgcttttcaataccttgaagatcttaagaatgaatttgagcgtggttatgggaatcaaatcgaaactgctgcaagaccctatgcttttataaaatttgatacatttatacagaagactaagaaactgtaccaggacacaagaactcaaaggaatatttctaagttgaatgatgagctttatgaagtacaccaaataatgacccgtaatgtgcaggaggttctcggtgttggtgaaaagttggaccaggtcagtcaaatgtcaagccgattaacctctgaatctcgcgtctatgctgacaaagcaagagatctaaatcgacaggcgctgatcaggaagtgggcgccggttgcaattgttcttggagttgtcattctgctattctgggccagaaataagatatggtgatcaatggtctgtcttcagttgtttttgggggattaagaaatataagttatttgagccttcaactagaaaagttataaattaaggctgtattttcagcatatatagttg

SEQ ID NO: 8847 - DNA, 944 bp, Ambrosia trifida
catttattattccatcctcttatctgcattttgtgcattctccctcatcgatcaatgcagatcaagaaactttaagcagtaaagattcaaaacttagatttaaaaaaaaaactttaaatcaaattcagtttatagcttctgaaactaaatatggtgaagcttacaatgattgctcgtgttaccgatggccttccgctagctgaaggattagacgatgggcgcgatatgcaggatgcagagttttataaacagcaagttaaggccttgtttaagaacctttctagaggacacaatgaagcttcgcggatgtctgtggaaaccggtccttacgttttccactatattattgaagggcgggtgtgttatttgacgatgtgtgatcgcgcttatccgaagaagcttgcttttcaataccttgaagatcttaagaacgaatttgagcgtggttatgggaatcaaatcgaaactgctgcaagaccctatgcttttataaaatttgatacatttatacagaggactaagaaactgtaccaggacacgagaactcaaaggaatattactaagttgaatgatgagctttatgaagtacaccaaataatgacccgtaatgtgcaggaggttcttggcgttggtgaaaagttggaccaggtcagtcaaatgtcaagccgattaacctctgaatctcgcgtctatgctgacaaggcaagagatctaaatcgacaggcattgatcaggaagtgggctcctgttgcaattgtacttggagtagtcattctgctattctgggtcagaagaaagatatggtgatcaatggtctgtatccagttctttttgggggattaaaatataagttatttgagccttcaactagaaagttataaattaaggctgtattttcagcatatatatggttgctagctatagcctatatagaggtggttaac

SEQ ID NO: 8848 - DNA, 994 bp, Ambrosia trifida
atcccaattttctataatttacttcaaacctaatataataatattattattatttctatcttcattttattattccatcttcttatctgtcattttgtgtattctccctcatcgatcaatgcagatcaagaaactttaagcagtaaagattcaaaacttagatttaaaaaaaaactttaaatcaaattcaggtttcttgaattttatatagtttatagcttctgaaactaaatatggtgaagcttacaatgattgctcgtgttaccgatggccttccgctagctgaaggattagacgatgggcgcgatatgcaggatgcagagttttataaacagcaagttaaggccttgtttaagaacctttctagaggacacaatgatgcttcgcggatgtctgtagaaaccggtccttacgttttccactatattattgaagggcgggtgtgttatttgacgatgtgtgatcgcgcttatccgaagaagcttgcttttcaataccttgaagatcttaagaatgaatttgagcgtggttatgggaatcaaatcgaaactgctgcaagaccctatgcttttataaaatttgatacatttatacagaagactaagaaactgtatcaggacacaagaactcaaaggaatatttctaagttgaatgatgagctttatgaagtacaccaaataatgacccgtaatgtgcaggaagttcttggtgttggtgaaaagttggaccaggtcagtcaaatgtcaagccgattaacctctgaatctcgcgtctatgctgacaaagcaagagatctaaatcgacaggcgctgatcaggaagtgggcgccggttgcaattgttcttggagttgtcattctgctattctgggccagaaataagatatggtgatcaatggtctgtcttcagttgtttttgggggattaagaaatataagttatttgagccttcaactagaaagttataaattaaggctgtattttcagcatatatag

SEQ ID NO: 8849 - DNA, 1356 bp, Aquilegia formosa
tccatttgatcgtctctctcccttttctctgaagtttgattatttcttcttccagaaaaaaccctaaaaaaataattcttatttccatcgaaacgaagagaaagacagatcgtattaaatcaaaaggaatcagagtcaaagatggtgaagttgacaatgatagctcgtgtgacagacggtctagcattagcagaaggattggaagatggtcgtgatcagaatgatgcagacttctacaagcatcaagccaaggatttatttaaaagcctatcgaaaggccagaaccatccttcaagaatgtcaattgaaactggtccttatgtttttcactatattattgaaggtcatgtctgttacttgacaatgtgtgatcgttcttatccaaagaagcttgcttatcaatatttggaggacctaaagaatgagtttgaaagagttaatgggaatcaaattgaaacggctgccagaccctatgcttttattaaatttgatacatatatacagaagaccaagaaactgtatttggacactggtacacagcgcaatcttgcaaagttgaatgatgaactttatgaagtacatcaaataatgacacgcaatgtacaagaagttcttggtgttggtgaaaagttggatcaggtcagtcaaatgtcaagcaggttgacatctgaatctcgtgtctatgctgaaaaggcaagagatttgaatcgacaggctttcattcggaaatgggccccttttgccattgtgtttggagttgttttcctcctgttttgggctaaaacgaagatttggtgattcaattccagattgccctactccttatgtgacattggagtgcgtcatcagcaatggtgattacaaagtctttgtgatttttcttttgtagaagcttcattctggagacctaagtcgtgcgcttcactactgtagctcggtgttgtaaacttttgtcacagtgaacaatgataagaaatttctgacagtcactggataatctaagcacaagtcaggcagcatacttgtgattatactataagaatatttttgattttaaggcaacggggaacatactgcacctataggcatcggaatttgagcagagagaaagagagaacaaacttcatgtgatttaccacaatggaaaaatgaacatgtcagatttgactgttctccctgggagaaacttcctccatgtgatgggatatggttggaaggagacctcagtgtttggtgtatgtattttccctgtattagccaaagtatgttattctggatggatgtaacactatgtcactatggacaagaatcacatatatgggtagatgtcacagactcttcttggaaagagttatt

SEQ ID NO: 8850 - DNA, 1314 bp, Phaseolus vulgaris
gttgtcttttcctttcgatttaaaacgacgtggcatttgcctaaatttccaacaccattttcatttcatttcaatttcaatttcaattctctctgttcatcgatcgactcggctggaccatccacgccgccgtttttcacggcagctccggccactctctcatcgccattcagtgtattttggtttagttgcaaagcttttgagtctgagtggaagattgtgaagctaagaaacatggtgaagttgactatgattgcccgtgttactgatggtcttcccctagctgaaggactggatgatggtcgtgatcttaaagatgcggaatattacaaacagcaagtcaaggctttgtttaagaatctctcaagaggacattatgaagcatcaaggatgtcagttgaaactggaccttatgtttttcattatattatagaaggacgggtctgttacttaacaatgtgtgatcgtgcataccctaagaaactagcctttcaatatcttgaagagctcaggaacgagtttgagcgtgttaatgggtctcaaattgaaactgcagccagaccttatgccttcatcaagtttgatacatttatacagaagacaaagaaactttaccaggatacgcatactcagcgcaatatttctaaattgaatgatgaactctacgaagtccaccagataatgactcgtaatgtgcaggatgttcttggtgttggtgaacagttggaccaggtcagccaaatgtccagtcgcttatcatcagaatctcgcgtatatgctgataaggctagagatttaaataggcaggctctgattcggaagtgggcccctgttgcaattgtttttggagttgtcttcgtacttttctggatcaaaaataaaatatggtgatcgagctcagtgtctgacatttaaaacctggattgcgttactgtggcttctcccatgatcatccagattttgaacagattggtgggaaccctataatgcatgatatgatgtcgactttttctggacaactttggtttagaaaaaaaagactatcctctatgacatctaagcatgctggatcagtctttctggaacaggaacctttaacctttatagtaaggagccaggatatgagaaaactttatccctgcggggatgcatataggcatttcttctttatacttctcaattattttcaggattattgtgttaatgaattaaatatattacctcttcgattttattgtttccatctgagccgctgaattagaattgcgttttatatacagctagtataatgataataagtagtatgttaccagt

SEQ ID NO: 8851 - DNA, 1109 bp, Ricinus communis
atttcaccatcatcctttctatatctcttccccagatcttcttctgcagatgctataatcagttaattagtacatataaatatctgaggaagggagaaagttacaatggtgaagctgacgatgattgcgcgtgtcactgatgggctaccgctagctgaaggattggatgatggccgtgacgtgaaggatattgaaatgtacaaacagcaagtaaaggcactgtttaagaatcttgccacacgccaaaatgagccttcaaggatgtctattgaaagtggctcttatgtcttccattatatcattgaaggacgtgtttgttacctcacaatgtgtgaccgctcatatcctaagaaactagccttccaatacttggaagacctcaagaatgaatttgagcgtgtcaatggggctcaaattgaaaccgctgctagaccatatgcttttattaagtttgatactttcatacagaaaacaaagaaattatatcaggacactcggactcagcggaatattgcaaagttgaatgacgaactgtatgaagttcaccaaataatgacccgcaatgtgcaggacgtactaggtgttggcgaaaaactagaccaggtcagtgaaatgtccagccggttaacatcagaatctagaatatatgctgataaggcaagagatttgaatcggcaggcattaattagaaagtgggctccagttgctatagtgttaggagttgtgttccttcttttctgggttaaaacgaagctatggtgactcggatgctttctgagaattgttgcatcatattgctgggtttctctacattgccatcagttaccttcatgggaattgtccaaacttaagggacttctgtctggggaccagatgcacgtaaagacctcgtgtttggagctggactatagtttttgttcacggaagactcagggagtgcttgttctttaagtacctcccagcgaccatgtggaaatgtgaaagagggacccttcggtttaaaaatacgttggatacaagaaaatttctatatttttgataatttatagagaaacttaattgatctacatgacaatgtcaatcagtatgtgatctagaactacatttac

SEQ ID NO: 8852 - DNA, 999 bp, Centaurea maculosa
caaaccctaattatttgattcatttctttcattatcctcgtaaacctcgctccccgatcaatgtagatccagaaactcaaacaggaaagataaatccttgtttcataaaaaaatctggggagtggttattagagtaaaaagatggtgaagttgacgatgattgctcgtgtgactgatgggcttcctctagctgaaggactggatgatgggcgtgatatgcaggacgcggagttctataaacagcaagttaaggctttgttcaagaacctttcaagagggcacaatgaagcgtctcggatgtctgttgagaccagcccgtacatttttcactatatcattgaagggcgggtatgctatttgacaatgtgtgatcgtgcttatccgaagaagctggcattccaatacctcgaagatcttaagaatgaatttgagcgtggttatgcgagtcaaatcgaaactgcagcaagaccttatgccttcataaaatttgacacatttatacagaggactaagaaattgtaccaggacacgagaactcagaggaatattgccaagttgaacgatgaactttatgaagtacaccaaataatgactcgtaatgtgcaggaagttcttggtgttggtgaaaagttggaccaggtgagtcaaatgtcaagccgattaacatcagaatctcgtatctacgctgacaaagcaagagatctaaatcggcaggccttgatcaggaaatgggctcctgttgcaattgtctttggagtagttatcctactcttctgggccagaaacaagatatggtgaagtgatgattaagcattctacttaacaaaagaattaattaactttagttggaatggaacccaagtgtaccaaaggaagagattttgttaaattgtggaatttatacagagagatttgttatggtgttgttactactactaactactaactcatgctctttaaatgatattggttggaagttggaaaccaaaaaaagaaaaa

SEQ ID NO: 8853 - DNA, 1377 bp, Trifolium pratense
gtgtttttggcgaaaatctcacactccattttcatttcaacgtaatcataacatcttcttccgaaagtttcatcgatcggctcggctcggctcggctggaccatcgacgccgccgatcgttgcggcagctccggccacctttccaccatcattcttcttcagtgtttgtttaggtttagttgcaaagtttaaggctgagagggaaattgtgaactgagaaagatggtgaagttgactatgattgcccgtgttactgatggtcttccactggctgaaggactggatgatggtcgtgatcttacagatggtgaattttacaaacagcaagccaagtctttgtttaagaatctatcaagagggcataatgaggcatccaggatgtcagttgaaagtggtccttatgttttccattatattatagaaggacgggtctgttacttgacaatgtgtgatcgggcataccccaagaaactagcatttcaatatcttgaagacctcaggaatgagtttgagcgtgttaatggatctcaaattgaaactgctgccagaccttatgccttcattaagtttgacacatttatacagaagacaaagaaactttaccaggatacccatacacagcgcaatattgcaaagttgaatgatgagctttatgaagtccgccaaattatgacccgaaatgtgcaggaagttcttggtgttggtgaacagttggatcaggtcagccaaatgtccaatcgcctatcgtcggaatctcgtgtatatgctgacaaggctagagatttaaatagacaggctctgattcggaaatgggcccctgttgctattgtttttggagttgtctttgtacttttctggctcaagaacaaaatttggtgatcaagcttagcatgactttataaacctagagtgtgtggctatggcttcttgtcttcctcacgactatcaagacttgctcagttttgtgggaaccctacttaaactaggtgatgtctacttttgtggacaatttatgaaaaaaaaaactatcctgtgttacttctgagaaaggctggatccgactttcttgaatagaaactttttacctttatattaaggagccaagacatgagaaaactggatccccttggggatgcatatagacatttctttcttactacccaattattttcaggattactgcgttcatgagttatatattgccccctcgatatttttttccctcccctgaatttgaacacctgaaatagaactgcattttgtatgtgtagtataatgaatcagcgtggaatgtttgtttagactggtaaaccttttgcaatttcttttatacgagttcacttgcaaataatgcgatgatcaagatccattgatcct

SEQ ID NO: 8854 - DNA, 1166 bp, Panax ginseng
ggcccacaatctcatcatgtacatcaaggcatccaggtacctcacttcaatgaaaaaataaaacatccggctatccctgcagaaccctaaattaccgactttgtgacattacgacaattgtcgtaatctctggtcagatcgttgaaatcagtagaaaatggtcaaagagctatatctaatcgttcaacaaacgaaggagaagatctgaagccatctttgaagctgagagcttttgaagtaaagatggtcaagctgacaatgattgctcgtgtcactgatggccttccgctagtagagggtctggatgatggtcgtgatgttcaaaatgtagagttctacaaacaacaagtcaaggttttgttcaaaaacctctcaagaggccacaatgaagcttcaagaatgtctgttgaaactggcccctatatattccactatgtaattgaagggcgtgtgtgttatttgacaatgtgtgatcgtgcttatccaaagaaacttgccttccaatacctggaagatcttgccaatgaatttgagcgtgttaatggaagtcaaattgaaactgctgcgagaccttatgctttcataaaatttgacacattcatacagaaaacaaagaaattgtaccaggacacaagaactcagcgaaatattgcaaagcttaatgatgaactctatgaagttcaccaaataatgactcgcaatgtacaagaagttcttggtgtcggtgaaaagttggaccaggtcagtcaaatgtctagtcgcttgacgtcagaatctcgcatatatgctgataaggcaagagatttaaatcgacaggcttttattcggaaatgggcccccgttgcaattgtcattggagttgttatcctccttttttgggtcaggaagaagatttggtgacttgcacacgtcagatgaaagctcttgctgatttttgtcacgctctcccgattgcctgttccatatttccagaaattagagtttcatattggtgtgtgtgaccctcatgaacccttaatatcaaatagactggaatttatttatttatattactttttatcttttggtcataattcaattcaaggatgggctttaatatgggacttgggcaaatcaagccttgtgaaagtttgaaccttatcttttgtaactagacaagattgaag

SEQ ID NO: 8855 - DNA, 1154 bp, Panax ginseng
caatctcatcatgtacatcaaggcatccaggtacctcacttcaatgaaaaataaaacatccggctatccctgcagaaccctaaattaccgactttgtgacattacgacaattgtcgtaatctctggtcagatcgttgaaatcagtagaaaatggtcaaagagctatatctaatcgtccaacaaacggaggagaagatctgaagccatctttgaaactgagagcttctgaagtaaagatggtcaagctgacaatgattgctcgtgtcactgatggccttccgctagtagagggtctggatgatggccgtgatgttcaaaatgtagagttctacaaacaacaagtcaaggctttgttcaaaaacctctcaagaggccacaatgaagcttcaagaatgtctgttgaaactggcccctatatattccactatgtaattgaagggcgtgtgtgttatttgacaatgtgtgatcgtgcttatccaaagaaacttgccttccaatacctggaagatcttgccaatgaatttgagcgtgttaatggaagtcaaattgaaactgctgcgagaccttatgccttcataaaatttgacacattcatacagaaaacaaagaaattgtaccaggacacaagaactcagcgaaatatttcaaagcttaatgatgaactctatgaagttcaccaaataatgactcgcaatgtacaagaagttcttggtgtcggtgaaaagttggaccaggtcagtcaaatgtctagtcgcttgacgtcagaatctcgcatatatgctgataaggcaagagatttaaatcgacaggctttgattcggaaatgggcccccgttgcaattgtcattggagttgttatcctccttttttgggtcaggaagaagatttggtgacttgcacacgtcctactgatttttgtcacgctctcccgattgcctgttccatatttccagaaattagagtttcatattggtgtgaccctcatgaacccttgatatcaaatagactggaattttttattttttatttattactttttatctttttggttcataattcaattcaaggatgggctttaatatgggacttgggcaaatcaagccttgtgaaagtttgaaccttatcttttgctactagacaagattgaactactt

SEQ ID NO: 8856 - DNA, 1228 bp, Tropaeolum majus
ctttaccaacattcagccgttaaaacattgcattttcgtgttgtgcctttctaaaatcaaagattcaaggtacaacttcaaacagcttggtcgcctcaaatcataaaatcaaaaatccaaatacaataattaccccttttcaatctcaaaaataaaatctatctccctcttttttcgatcatcgtcttctctctttctcggattccttgaaaccaagaagaaaaaaatcttgcaagctatataaccagaaatcttgatatctgagaaataataaattaaaagatggtgaagatgacaatgattgctcgtgtcactgatggtctgccactggcagagggattggatgatggccgtgatttgcaagattctgaaatatacaagcagcaggtcaaagctttgtttaagaatctgtcaagaggccagaatgaggcttcaaggatgtcagttgaaactgggccttatgtattccattacatcatcgaagatagtgtatgttatttgactatgtgtgaccgtgcttatccaaagaaacttgcctttcaatatttggaagacctcaaaaatgaatttgggcgtgttaatgggggtcaaattgaaacagctgcccgaccttatgccttcattaaatttgatacattcatacagaaaacaaagaagttgtaccaggatacacgaactcagagaaatattgcaaagttgaatgacgaactctttgaggtccaccaaataatgactcgcaatgtacaggaagttcttggtgttggcgaaaagttagatcaggtcagccaaatgtccagtagattaacatcagaatctcgtatatacgccgacaaggctaaagatttgaatcggcaggctttgattcggaagtgggcgcctgttgccgtggtgttgggagttgtctttcttctattctgggtcaagatgaagatgtggtgatgcaaacacatttatggtttttttaagtaaattacttttttatgggtttctcaatattcccaaggttagtgtacgtgatatggttaagaggttttttttagcattgagttgtgaagagatgattatggttacaaaaatatatgccctgttatatatgtgattggtgatcttggtgcttgtaagcagcgaggatggtcaaggttgtcgggaggtggattttatagtatacttatattctctctatttttatttaagggaagcacatacattgttttaatgaaaaaaaaaa

SEQ ID NO: 8857 - DNA, 1096 bp, Olea europaea
gggcgtaatttcctctatttgtaagcccaatttcctatcaaatgatagccaagtctgtttagcaaggggagtagcctaggttttctttctcagtgatttcttctcttcttcatcatcaaacttggaagctttgagcttgtgaagtaaagatggtgaaactgactatgatcgctcgtgtcattgatgggcttccactggtagagggactggacgatagtcgtgatgtgccagatgctgacttctacaaacagcaagtgaaggctttgttcaaaaacctctcaaggggtcagaacgagccttcaagaatgtcgattgaaacaggcccatatatcttccatcatattattgaagggcgtgtttgttatttgacaatgtgtgatcgtgcttatcccaagaaacttgcgtttcaatatctggaagaccttaagaatgaatttgagcgtgtctatggaaatcagattgaaacggctgcaagaccttatgcttttattaaatttgatacattcatacagaaaacaaagaaattgtaccaggatacaagaacccagcgaaatattgcaaagttgaatgatgaactttatgaagtccaccagataatgactcgcaatgtacaggaagttcttggtgttggtgaaaagttggaccaggtcagtcagatgtcaagccgcttgacatctgaatcccgcatatatgctgaaaaggcaaaagatttgaaccgccaggctctgattaagaaatgggcccctgttgctgttgttctaggagttgttttcctcctcttttgggtcagaaacaagttctggtaaatactgccattgatctgcagttgatagtcactgtttcggtatcttaaatatgcatttcatcttgagatgactagcaattttttgttacaaaactaccttcctaaggctgtgagacatcgattcatgacgagaaaagaaatatatattatttagagataaatagatagaacttctgttgtgggccgaaacagattcagtaacgcatacatatgttattattttgtatccttattttcagatattgcgttttagactgcactaagacaggacaaggttaatgatactaaaaa

SEQ ID NO: 8858 - DNA, 889 bp, Raphanus sativus
cagtgagctttgttgttattggagaagaagggaagggagtaaggtctaatcaagatggtgaagatgacattgatagctcgtgttaccgacggcttgcctctagccgaaggtcttgacgatggacgtgacttgcctgattccgacatgtacaagcaacaggtcaaggctctgtttaagaatctctccagaggtcacaacgaagcttcgagaatgtccgttgagactggcccctatgttttccattacatcatagaaggacgtgtttgctacttgacaatgtgtgaccgctcttaccctaagaaactggctttccagtacctggaagacctcaggaacgagtttgaacgtgttaatgggcctaacattgagacagctgctcgaccttatgcctttattaagtttgatacattcatacagaaaacgaagaagctgtaccaagacactcgtacgcaacggaatatctttaagctgaatgatgaactctatgaggtccatcagataatgacgaggaatgtgcaggaagtcctaggtgttggtgaaaagctcgaccaggtgagcgagatgtcgagccgcctaacatttgaatttcgtatatatgctgacaaggctaaagatttgaaccgtcaggctttgatcaggaagtgggcaccagttgccatcgtgctcggagtcgtgttccttcttttttgggtcaagaacaagctttggtaagaacgcacgaacctgaggctagacttctccagacatatatcgaccggcaccaaaaaatatcttgttttttttttttttgaaagtgagacattgacacacattttgtagtaatgcaaactttatgagactagtcatatgaatcatcccatcaatacactttttaaacctttgatttcca

SEQ ID NO: 8859 - DNA, 1025 bp, Solanum phureja
caaatctcagcaaaacccctctttgttcccatcccatttattaccagctccgattcaagctcttaacaatttatcaaaggcggtcagcgatcggcgactggattccgagcagtcacgcaagcgtatgatcgatcgctgtatgcttgcggaaaaatatggtgaagttgactttgattgctcgtgtgactgatggccttcctttagccgaggggctggatgatggtcgtgatgttcaaaatgctgatttctacaaacagcaggtgaaggccttattcaagaacctgtcaatgcgccaaaatgacgcttcaaggatgtctattgaaactggaccttacgtcttccattatatcattgaagggcatgtttgttatctgacaatgtgtgatcgctcttatcccaagaaacttgcctttcaatacctggaggaccttaggaatgagtttgagcgcaccaatgggagtcaaattgaaactgctgctagaccatatgcttttattaaatttgatacattcatacagaagacgaagaaactgtaccaggatactaggactcaacgcaacatttctaagttgaatgatgagctttacgaagttcatcagataatgactcgaaatgtccaagaagttcttggcgttggtgaaaagttggaccaggtcagtcagatgtctagccgcttgacatctgaatcccggatatatgctgataaagcaaaagatttaaatcgtcaggctttgattcgaaaatgggctcctgttgctattgtgcttggagttgtcattctcttcttctggcttagaacaaagatttggtgattcttccatacagatgcagctcagtgacaacaatactgtcgaatgcttcttcctgtttgtcaccatcagactgtgcacaacccagggaacctcacattacagttgtccagcatgtgttgtgacatatcagttttatagtgtaagagaggaaaggaaccgtgatgaattatgtcccttaaccttgagaaattacattaattttggttctccttt

SEQ ID NO: 8860 - DNA, 1764 bp, Glycine max
ctcacgttctccttcgtctctcctcacattttttcttcttctttcttctttcttttgggcgccgttcctgtctctcctcacatttttcttctctcttctctctcctcggcgccccaccgcgcgacccctcctttccccctcccccttcgcctccgccgcgacacccaccttccccttccggacctccgtgcgacccccccccctccgccgtgttttagttgcaaagttttagagttggattggaagattgtgaacttagaaagatggtgaagttgactatgattgctcgtgttactgatggtcttcctctagctgaaggtctggatgatggtcgtgatcttaaagatgcggaattttacaaactgcaagtcaaggctttgtttaagaatctctcaagaggacattatgaagcatcaaggatgtcagttgaaactggcccttatgtttttcattatattatagaaggacgggtctgttacttgacaatgtgtgatcgtgcataccctaagaaactagcctttcaatatcttgaagagctcaggaacgagtttgagcgtgttaatgggtctcaaattgaaactgctgcaagaccttatgccttcattaagtttgatacatttatgcagaagacaaagaaactttatcaggatacccatactcagcgcaatattgcaaagttgaatgatgaactctatgaagtccaccagataatgactcggaatgtgcaggaagttcttggtgttggtgaacagttggaccaggtcagccaaatgtccagtcgcttatcatcagaatctcgcatatatgctgataaggctagagatttaaaccggcaggctctgattcggaagtgggcccctgttgctattgtttttggagttgtcttcgtacttttctggatcaaaaataaactatggtgatcgagctcagtatgaaatttaaaacctggattctgtggcttcttgcttttctcacatgattatccagatttgcacagattggtgggaaccctttatgcatgagatgatgtcaactttttcttgacaacttcggtttagaaaaaaaaaaaagactatcctttgttacatctggatcagtctttctggaacaggaaccttttgacctttatagtaaggagccaggatatgagaaaactttatccccgtggggatgcatgtaggcatttcttctttatacttctcaattattttcaggattattgcgttaatgaattaaatatattacctcttcgattttattgtttccatttgagccgctgaattaaaattgcgtttttatatacagctaacataatgataatgagtagtgtggaatactcgttctaaaacggggaaattttcgcttttacaatttaccttatagagtatattcaagatctgagctttttgtattttgttgcatttagatgaacaagtttatcaatattatttttattaactgatgttgatgtagccctgttgtttaaatgaattattgtaagattattgtttgaatcaagcaataattatcattcaagattttgaaaggaaaaataaaagtaaacagaacatttcggtcttttaaggatgaatgttttgtaagatattgcaaatgagcagttgcacttcaagaggtggcaacatcttagagtagctgggcgttttctttgcttctgtgaaaaaaaaaacaaaaagaggctacacaaggagaatgaactatacaaaagggatgagacaataagcaccgcgtgggggtgcagctaag

SEQ ID NO: 8861 - DNA, 1071 bp, Euphorbia esula
tcacgtgacccgccttcaaagaggttcaggtttacataagagagctgcatctcaaacacgcatagggagaaagattggtccatttaaaattctccaaatcccaataccagatgatataacaagtttgcatagccaataaagaaagagaaaatggtgaagctgacaatgattgcccgtgtcacggatgggcttccactagctgagggactggatgatggccgtgatttgaaagacattgaattgtacaaacagcaagtaaaggcattgtttaagaacctcgctacccgccagaatgagccttctaggatgtccattgaaactggccctttcgtcttccattacattattgaaggacatgtttgttacctcacaatgtgtgacagatcttatcccaagaagctatcatttcaatacttggaagatctcaagaatgaatttgagcgggtaaatggggttcaaattgaaactgcagccagaccatatgccttcattaaatttgatactttcatacagaaaacaaagaaattgtaccaggatacccgtactcaaagaaacatttcaaagttgaatgatgaactctatgaagttcaccagattatgactcggaatgtccaggaagtgctcggtgttggtgaaaaactagaccaggtcagtgagatgtccagtcgattaacatcagaatcccgtatatatgctgacaaggcaagagatttgaatcggcaggcgtttattagaaagtgggctccagtagcaattgttttaggcgttgtcttcgtcctgttctgggcaaaaaacaagatatggtgatcgaaatgcttcggaagaatttctgaaaatttgaatgtgcacaaagacttggtcatgtttgaaggtgggagtgtagttttggtgctaaggaacactgagatcttgttcttaatatacacattatgaatagtcatgaattgagtgttatcatacattattactagttaaggaccccaaaaaaagttgggtaccggaaaatttatatattatcgatcttaatgatatgaatattccgcatataatttagattaaatttgtatactt

SEQ ID NO: 8862 - DNA, 1929 bp, Cannabis sativa
ttctcagatggtgaaatggaaaatccatagattgggtttggactcaaatcattacaacttgcttgccaagccaacttgtaaataagcgaagtgtattggcgaggctataatccaatttcttctaccatctttgctatgttttgtgatggctatttctgcaattatgcattgggggtctagattaattattataaaagagagggactttttagcaagctccactgaagctccgctcgctgtcacgcgctgtgtcgccgactagaacccgccaacattggcctcgtatggctattcgaagttgccgttcggcaatattccggctgtagagaagtgcggttgagactatcatgccgtggcgaagccacattggctattctagtcgccgttgagagggacgacgcggtgagtagtagactttcctcaactcgaaaattcacttcagatacgtctgaggaggactctttccgacgagctcggttctcgagaggatagactcgatttagtttaagtactagagcaaggtatttgggtactcaagatgtttaagtactagagcaaggtatttgggtactcaagatggtaaagctaacaatgattgcccgagttactgatggtcttccactagcagaggggctcgatgatggccgtgatataacagatgttgaattctacaaacagcaagtcaaagcattgttcaaaaacctctcaagaggtcacaatgagccgtcaaggatgtcagttgaaactgggccttacattttccactatataacagaaggacgtgtctgttacttgacaatgtgcgaccgtgcctacccaaagaaacttgcttatcaataccttgaagacttgaagaatgaatttgagcgtgttaacggggtggggcaaattgaaactgctgccagaccatacgccttcattaagtttgatacattcatacagaaaacaaagaaattgtaccaggacactcatactcaacggaatatttcaaagttgaatgatgagctctatgaagtccaccaaataatgactcgaaacgtccaggaagtccttggcgtcggtgaaaagttggaccaggttagccaaatgtccagtcgattaacatctgaatcacgcatatatgctgataaggcgagggatcttaatcgacaggctttaattcggaagtgggccccagttgccattgttcttggagtagtgttcctcctcttctgggttaaaaacaagctctggtgatcaagctgccttatcccgattttggaggttatgaagttttcaacgggatattgatattgactattgaggaatgggtgcggggttactttccagacttgaatgcttgaggctcatggaggattaatttgatggctgagtttgttaacttgtaattgagttcatagaggtaccctttgttgtcaaattaaatagtatactgttttccaaagaaaaaacaaaaatagaaaacctaccgtaccataaatacaatttaaagttatcagaaatttcttttttgttatcttctgtcattttcattctattgtcagttttaaattttgaatagaatgacttttgtggacacaaccaactttcaaactttcacgagtgggtgccttttaaatgttaatggacattgtaatttattatgaattgtttcgtagtacaaattttgaggacacaaataaaactaaacatgttcatttgttatgctaaaactagtatggagaagttgaaccatgaaatagttcttgaaatatgtggtttatagtgctctcatattaagtcgaaaactgaagaacaagttggcacaacactattattgggagatcaatgatagaattacacattttgtgaacaacaaagcttacaaaagcaagtcttttaattttcattcttctttggaagtgaaaatactaggtgataattaggtca

SEQ ID NO: 8863 - DNA, 1098 bp, Distylium racemosum
gaaataatattacacggatcttgctcaagaagcagaaatttgggggatttggttgaaagagagaagatttcacggtgaaatctatcggaaacagaagtcgaaattgtattagcaatcaaatcgaattgaattgaatagggaaaaatggtgaagctaaccatgatagcgcgggtgaccgatggtctccctctggcagaaggattggacgacggtcgcgagcagagggatctggaattctacaagcagcaggccaaatctctcttcaagaaattgtcgcagggtcagcatgaaccctccagaatgtcaattgaatcggggccgtatgtctttcactacatcattgaagctcgggtttgttatttaaccatgtgtgaccgatcttatcccaaaaagcttgcatttcaatatctggaggatctcaagaatgagtttgaaaaggtgaaccactctcaaattgaaactgtggcgaggccctatgcttttattaaatttgatacatttattcaaaagaccaggaagctgtatttggatacccagacacaaaggaaccttgccaagttgaatgatgacctgtatgaagtgcaacaaattatgactcggaatgttcaagaagttcttggagttggtgaaaaattggaccaggtcagtcagatgtctagtcggttgtcatctgaatcacggatctatgcggacaaagccaaggatctaagcagacaggccttgatcaggaagtgggcacctgtggcaattgttctgggagttgtctttatgctgctatggttgcgaggttatatttggaagtaactgtttctgaaactgcatgtgttttttccaacatgacaagaaggaaagccggtgtgctaataaaacccataacttgttggtttatgaaatggaggaccactatcagctgaacatttttggagttgctatttaaatgcaaggaccaattcaatggcatagaactgaggttgaagacggatgaacttcttgtccaaggaggacaaaagagatgggcctagtcaatgagctaaagtcattgcattgtattgtagtttggtacggatatggttttagaattgtagaggtagattctcc

SEQ ID NO: 8864 - DNA, 789 bp, Artemisia annua
tactccgacgggtgggtcgtgccttatgagttttttgaaattgaaatgctgatagcttcttaaagtaaagatggtgaagctgacgatgattgctcgtgtcactgatggccttccgttagctgaaggaatggatgatgggcgcgatatgcaagatgcagacttctataaacagcaagttaaggccttgtttaagaacctttcaagaggacacaatgaagcgtctcgaatgtctgttgaaactggcccttaccttttccactatattattgaagggcgggtatgttatttgactatgtgtgaccgtgcttatccaaaaaagcttgcttttcaataccttgaagatcttaagaacgaatttgagaggggttatgcggatcaaattgaaaccgcagcaagaccttatgcttttatcaaatttgatacatttatacaaagaactaagaagttgtatcaggacacgagaactcaaaggaatgtttccaagttgaatgatgagctttacgaagtacatcagattatgacccgtaatgtgcaggaagttcttggtgttggtgaaaagttggaccaggtcagtaaaatgtcaagccgattgacttcagaatctcgtatctatgctgacaaagcaagagatctaaaccgacaggccttgatccggaaatacgctcctgttgcaatcgtcctcgcagtagtcattctactcttctgggtcagaaacaagatatggtgattctgagaaaccatcttcctaaattccaatgtttttaggtgcttaagtaaattgttcttgta

SEQ ID NO: 8865 - DNA, 757 bp, Brassica napus
cattgatagctcgtgtcactgacgggttgcctctagctgagggtcttgacgatgggcgtgacttgccagattccgacatgtataagcaacaggtcaaggctttgtttaagaatctctccagaggtcataacgaagcttcaagaatgtctgttgaaactggcccctatatcttccattacatcattgaaggacgtgtatgctacttgacgatgtgtgaccgctcttaccctaagaaactcgcgtttcaatatctggaggacctcaagaatgagtttgaacgtgtcaatgggcctaacattgaaactgctgctcgaccttatgcctttattaagtttgatactttcattcagaaaacgaagaaactgtaccaagacactcgtacgcaacggaatattgcgaagctgaatgatgaactctatgaggttcatcaaataatgacgaggaatgtgcaggaagtactcggtgttggtgaaaagctagaccaggtgagcgagatgtcgagccggctaacatctgaatctcgtatatatgctgacaaggctaaagatttgaaccgtcaggctttgatcaggaagtgggcaccagttgccatcgtgcttggggtcgtgttccttcttttctgggtcaagaacaagctctggtaagaaggaaagaacctcaggctagacttctccggacatatatcgaccggcaccaaaaatatctttttttttgtaagtgaaacattgacacccattttgtacttctgtagtaatgc

SEQ ID NO: 8866 - DNA, 1056 bp, Echinacea purpurea
ttagaaaattacggtatcagtatcctccgtttcttcgtggagtcatctttttatttctatttctactgtatccctaattaccaaaaccctattattcaattccccttcaattctaaatcagttttgaatccgtatcatccctacgcatgatcataagcacttgatcattccagtaacagcttcatagagtaaagatggtgaagctgaccatgatcgcacgtgtcactgatgggcttccgttagctgagggacttgatgatggccgtgatatgcaggatgcagagttctacaaacagcaagttaaagcattgttcaagaatctttcaagaggacaaaatgaagcctcaaggatgtctgttgaatctggcccctatgttttccactatatcattgaagggcgggtttgttatttaacgatgtgtgatcgtgcgtatccgaagaaacttgcattccaatatcttgaagatcttaagaatgaatttgagcggggttatgggaatcagattgaaactgctgcaagaccgtatgctttcataaaatttgatacttttatacagaggactaagaaattgtaccaggacacaagaactcaaaggaacatctctaagttgaatgatgaactatatgaagttcaccaaataatgacccgtaatgtacaagaagttcttggtgttggtgaaaaattggaccaggtcagtcagatgtcaagccgcttaacatcagatactcgcgtatatgctgataaagcaagagatctaaaccgacaggctttgatcaagaaatgggctcctgttgctattgttcttggagttgttattctactgttttgggccagaaagaagatatattgatcatggtttggtctatttcataggaatgtgattctatttctcccagttcagttacagagtttttaagttaattttccttgcaccccctgcactttagttatgctatccatttgcaccttcaacttgacatttttgttcatgtactcttttacatttaaacgagtttaatccaccaagaagcgttcacaatcttgacaaaccctta

SEQ ID NO: 8867 - DNA, 968 bp, Flaveria ramosissima
atcatctatacgcatgataactacttcaaaattgcagtgacagcttctcaaagtaaagatggtgaagctgacgatgattgcacgtgtcactgatggtcttcccttagctgagggacttgatgatggccgtgatatgcaggatgcagagttctacaaacagcaagttaaagcattgtttaagaatctttcaaggggacaaaatgaagcctcaaggatgtctgttgaaactggcccttatgttttccactatattattgaagggagagtttgttatttaacaatgtgtgatcgtgcttatccaaagaaacttgcgtttcaatatcttgaagatctcaagaatgaatttgaacgtggttatggaaatcaaattgaaactgcagcaagaccttatgctttcataaaatttgatacattcatacagaggactaagaaattgtaccaggacacaagaactcagaggaacatttctaaactgaatgatgaactatatgaagttcaccaaataatgactcgtaatgtacaagaagttcttggtgttggtgaaaaattggaccaggtcagtcaaatgtcaagccgcttaacatcagaatctcgcatatatgctgataaagcaagagatctaaaccgccaggctttgatcaagaaatgggctcctgttgcgattgtcattggagttgttattctactgttttgggccagaaagaagatatattgatcatggtagtagttggtgcatggagatatcaaatatgattctatttctccagaattccagttacagagttttaagttagtttcccttgcaaccccctgcactttagttacattatccatttgcaccttctacttcaaagttttgtttgtgtgctatttacatttaaacaggttaatccaccaagaagcattcacaatcttgacaaacctcacttctgtgtcagtttaacatcttatttatgtaatgttaatga

SEQ ID NO: 8868 - DNA, 889 bp, Flaveria ramosissima
ttcttctcgcttgtagatcaatttcaaatccctagatcctatcatccatacgcatgataactacttcaaaattgcagtgacagcttctcaaagtaaagatggtgaagctgacgatgattgcacgtgtcactgatggtcttccgttagctgagggacttgatgatggccgtgatatgcaggatgcagagttctacaaacagcaagttaaagcattgtttaagaatctttcaaggggacaaaatgaagcctcaaggatgtctgttgaaactggcccttatgttttccactatattattgaagggagagtttgttatttaacaatgtgtgatcgtgcttatccaaagaaacttgcgtttcaatatcttgaagatcttaagaatgaatttgagcgtggttatggaaatcaaattgaaactgcagcaagaccttatgctttcataaaatttgatacattcatacagaggactaagaaattgtaccaggacacaagaactcagaggaacatttctaagctgaatgatgaactttatgaagttcaccaaataatgactcgtaatgtacaagaagttcttggcgttggtgaaaaattggaccaggtcagtcaaatgtcaagccgcttaacatcagaatctcgcatctatgctgataaagcaagagatctaaaccgccaggctttgatcaagaaatgggctcctgttgcaattgttattggagttgttattctactgttttgggccagaaagaagatatattgatcatggttttagttgttgcatggagacatcaaatatgattctatttctccagagttccagttacagagttttaagttagtttccttgcaaccccctgcactttagttacattatccatttgcaccttctacttc

SEQ ID NO: 8869 - DNA, 1229 bp, Panax ginseng
gtaacaattttactcggccctcaatctcatcatgtacatcaaggcatccaggtacctcacttcaatgaaaaaataaaacatccggctatccctgcagaaccctaaattaccgactttgtgacattacgacaattgtcgtaatctctggtcagatcgttgaaatcagtagaaaatggtcaaagagctatatctaatcgttcaacaaacggaggagaagatctgaagccatctttgaagctgagagcttttgaagtaaagatggtcaagctgacaatgattgctcgtgtcactgatggccttccgctagtagagggtctggatgatggtcgtgatgttcaaaatgtagagttctacaaacaacaagtcaaggctttgttcaaaaatctctcaagaggccacaatgaagcttcaagaatgtctgttgaaactggcccctatatattccactatgtaattgaagggcgtgtgtgttatttgacaatgtgtgatcgtgcttatccaaagaaacttgccttccaatacctggaagatcttgccaatgaatttgagtgtgttaatggaagtcaaattgaaaccgctgcgagaccttacgctttcataaaatttgacacattcatacagaaaacaaagaaattgtaccaggacacaagaactcagcgaaatattgcaaagcttaatgatgaactctatgaagttcaccaaataatgactcgcaatgtacaagaagttcttggtgtcggtgaaaagttggaccaggtcagtcaaatgtctagtcgcttgacgtcagaatctcgcatatatgctgataaggcaagagatttaaatcgacaggcttttattcggaaatgggcccccgttgcaattgtcattggagttgttatcctccttttttgggtcaggaagaagatttggtgacttgcacacgtcagatgaaagcccttactgatttttgtcacgctctcccgattgcctgttgttccatatttccagaaattagagtttcatattggtgtgaccctcatgaacccttgatatcaaatagactggaatttattttttttattattattactttttatcttttggtcacaattcaatccaaggatgggctttaatatgggacttgggcaaatcaagccttgtgaaagtttgaaccttatcttttgctactagacaagattgaactacttatgcatatcaaattatcaactgttctcagaagttactca

SEQ ID NO: 8870 - DNA, 1475 bp, Panax ginseng
taagcagtggtatcaacgcagagtacatggggagggtgttaaatgacttccaaaaataaatgctactagtactaattactaatactggtctgtctcgtaacaattttactcggccctcaatctcatcatgtacatcaaggcatccaggtacctcacttcaatgaaaaaataaaacatccggctatccctgcagaaccctaaattaccgactttgtgacattacgacaattgtcgtaatctctggtcagatcgttgaaatcagtagaaaatggtcaaagagctatatctaatcgttcaacaaacgaaggagaagatctgaagccatctttgaaactgagagcttctgaagtaaagatggtcaagctgacaatgattgctcgtgtcactgatggccttccgctagtagagggtctggatgatggtcgtgatgttcaaaatgtagagttctacaaacaacaagtcaaggctttgttcaaaaacctctcaagaggccacaatgaagcttcaagaatgtctgttgaaactggcccctatatattccactatgtaattgaagggcgtgtgtgttatttgacaatgtgtgatcgtgcttatccaaagaaacttgccttccaatacctggaagatcttgccaatgaatttgagcgtgttaatggaagtcaaattgaaactgctgcgagaccttatgccttcataaaatttgacacattcatacagaaaacaaagaaattgtaccaggacacaagaactcagcgaaatatttcaaagcttaatgatgaactctatgaagttcaccaaataatgactcgcaatgtacaagaagttcttggtgtcggtgaaaagttggaccaggtcagtcaaatgtctagtcgcttgacatcagagtctcgcatatatgctgataaggcaagagatttaaatcgacaggctttgattcggaaatgggcccccgttgcaattgtcattggagttgttatcctccttttttgggccaggaagaagatttggtgacttgcacacgtcctactgatttttgtcacgctctcccgattgcctgttccatatttccagaaattagtgtgtgtgaccctcatgaacccttgatatcaaatagactggaatttatttatttttattattttttatcttttggtcacaattcaattcaaggatgggctttattaatatgggacttgggcaaatcaagccttgtgaaagtttgaaccttatcttttgtaactagacaagattgaagccccccctatgcatatcaaattatcaactactcgcttattttaaagatgattgacatttttaaaattaaaaaaaaaaaaaaaacaaaaaaaaaaaaagaaaaaaaaaaaaagaaaaaaaaaaagaaaaaaaaaaaagaaaaaaaagaaaaaaaagaaaaaagaaagaaagaagaagagaagagagaagagagagagaagggagaagagaggagagggggg

SEQ ID NO: 8871 - DNA, 873 bp, Ipomoea batatas
ccgatcttttcaaaccctcctgctcatttctccgattccggtgcgacggaaccttggtcatcggaaggcaaagaggatacgaatctactggaagtttcgtggagatcgagatcggcggtacatatacgtatgatagctttgctctcgtgaaagaaagatggtgaaactgactatgattgcccgtgttattgatggcctccctttagttgagggattggatgatggccgtgatgtaccagatgcagatctctacaaacagcaggtcaaaagcttgttcaagaatctcgcacgaggccaaaatgagccttctagaatgtcaattgagactggcccttatatgttccattatattattgaaggacgtgtgtgttatctaacaatgtgtgagcgttcttatcccaagaaactcgcctttcaatatctggaagaccttaagaatgaacttgagcgtgtcaatgggaatcaaattgaaactgctgctagaccttatgcttttattaagtttgacacatttattcaaaagacaaagaaactgtaccaggacacaagaactcagcgcaatatctcaaagttgaatgatgagctttatgaagttcatcaaataatgactcgcaatgtacaagaagttcttggcgttggtgaaaagttggaccaggttagccaaatgtccagccgcttaacatcagaatctcgtgtttatgcggataaagcaaaagatttgaaccgtcaggctttgattcggaaatgggcccctgtagctgtcgtccttggagttgtttttctccttctgtgggtgagaaagaagctttggtgatgctgctgtgacatctcccgctaacacaagatatcaagattgccgggctattcctttat

SEQ ID NO: 8872 - DNA, 3100 bp, Rosmarinus officinalis
gacggaaatattttcaggcctcatggtgacccacagatgatgcgctttggtgcacacttagtattggtacttcgctacttgctcgcagatcaaatgaaagatactttcaaagagaaaatgatgacagttggtgatttaattattcacatgtatgcaatgttcttgttcactacgcagcatgaggagttggttggaatttatgcttctcagcttgctcgccatcgctgtgttgatctgtatgtccatatgatggagttgaggcttaatagcagtgtgcatgtcagatacaagatctttctttcagctattgagtatttacctttttctcccgatgatggcttgaaaggtagttttgaggaaataattgagagaattttgtcccgatctcgtgaaattagttctggaaagcatgacaagtcctctgatgttgcagagcatcatcgcttgcaaagccaacagaaagctatggttcttcagtggctttgctttacacctccttccacaattaatgatgccaaagctgttactgcaaaacttgtccttcgtgcactaatgcatagcaatttactcttccgggagtttgctcttatatctatgtggagggtacctgcagtaccaattggggctcacacggtgcttagtttacttgctgagcctttgaaacaacaaacagaagttctccattcaaccatggatcgtgatgtttctgagagtttcagagaattccaggactggagtgagtacttctcttgcgatgcaaaatatcgcaactggctaaaaatcaaactagaaaatgctgaggtttcacctgatgaactttcacttgaggaaaaaaggagggaagttactgcagctagagaatctcttgagtcttcactttctctgctacaacgaaacaatgatccttggctcattccaactcaagatcatttgcacgaatcaatggaacctttgtacctggaactgcatgctacagctgttttatctctaccttctggtgagtgtatgacacctgatgctacattgtgcacaacattgacaagcgctctttactcatcagtaagcgaggaggaagttctgcatcgagaattaatggcaaatgttgccatctctcctggagataactcttgtattgaagttgttcttcggtgcatggctgcagagggtgatgggcttggacctcatgatctcaatgatggtggaattctggctacaatcatggcggctggcttcaaaggggagcttgctcgatttcaagctggagtaacattggagatctcccgcttggatgcttggtattcaagtgccaatggctctctggatgggccagcaacatatgtagtccgtggcctctgtcgcaagtgttgcatcccagagattgttcttcgatgtatgcaggtctctgtttcactagtggagtctggctatcgactagagaggcatcatgagttgattgagctagtcacctctcctgaaactgattttctccatttattcagccagggccagttgcaggaactcctcttgtttgagagagactattcaataaatgagatggatcttgaggaattgccaagctcttgagtagcacaattgggcattccgtgaactgcgcagcaatgcatagggacaaggtgaaacctactataggaaaatctacggcattcttcacttgaatagtcttacctaccagccctgacatgctcataacttttgacagaaagagtgcaacaactttacaagtcaccattatcttcgtatatggtacagaaatttgaagctcttaacttttatgatctggtttggtttgttgtggtgatctaggttgagatgttaaaggctggtcaagcacatattggtgtttcgtatgaaatttgatgtaatctattgaatctgtttttaacttttttgagcagttgtgtgaacttgcaatgtacaagtatatacattactggtgctcgtatcttattgttcactcatttgatcaaaatttacaatagctcgccgacacttctaaattttaataaggcatataaatgcaagcaagttaattgccgagacatacaagagtacagtgagatctgttccaattgtctgatcataactaaagtattgtccttttaacagattttttctagacatcttttaaactcctttcgatgaatcaacaaaatgcaaatgatgttttgtgcacaaggatgcagcatcaccagaacttgtttctgacatagaggaggaggaagacaactcctagaacaacagcaaccggtgcccatttccgaatcagagcctgtcggttcaagtcctttgccctatctgcatatatgcgggattcagaactcaagcgactggacatctggctgacctggtccaacttttcaccaacgccaagaacttcttgtacattgcgtgtcattatctggtggacttcatagagttcatcattcaactttgcaatatttcgttgagttgtagtatcctggtacagtttctttgtcttctgtatgaatgtatcaaatttgataaaagcatatggtcttgcagcagtttctatctgattcccatatacacgttcaaattcatttttgaggtcttctagatattgaaaggcaagtttctttggataagcacgatcacacattgtcaaatagcatacacgctcttcaatgatataatggaatatatatggccctgtttcaatcgacattcttgatggctcattctgtccccttgaaaggtttttgaacaaagctttaacttgttgtttgtaaaagtcagcatctggcaagtcacggccatcatccaacccctctactaacagaaggccatcaacagcacgagctatcattgtcagtttcaccatctttgtcccgtctgatggcaatcacatgcgaaggtgagcgcctcgtttgatgatgcgtacgcaaatccccgaactccaattaggttaaccaacagccaacaaatcgcagccttccaattcgattgtcagctagagatttgaacgatctgcgggaaactatttgtgatgcagaatatgcaatatacagaattgatatttgggggaaatgcaaatgtgagaatataaattggggtttta

SEQ ID NO: 8873 - DNA, 1080 bp, Humulus lupulus
agggatcgcagcctgggctgcatttattgtctcacttggtctcgtaaataaccctcaaactattttcttcttgttgctccgaatcagaattactatcaccatccttgctctgtttctccctgaaatcaatgccatactcagtttgagtgttagagcaaggaatttggatactcaagatggtaaagctaacgatgattgcccgagttactgatggtcttccactggcagaggggcttgatgatggccgtgatattagagatgttgaattctacaaacagcaagtcaaagcattgttcaaaaacctctcaagaggccacaatgagccgtcaaggatgtcagttgaaaccggaccttacatttttcactatataatagaagggcgtgtctgttacttgacaatgtgcgaccgtgcctacccaaagaaacttgcttatcaataccttgaagacctcaagaatgaatttgagcgtgttaatggggcggggcaaattgaaactgctgccagaccatatgccttcattaagtttgatgcattcatacagaaaacaaagaaattgtaccaggacactcatactcagcggaatatttcaaagttgaatgatgagctctatgaagtccaccaaataatgactcggaatgtgcaggaagtccttggcgttggtgaaaagttggaccaggttagtcaaatgtccagtcgtttaacatctgaatcacgcatatatgctgataaggcgagggatctaaatcgacaggctttaattcggaagtgggccccagttgccattgttcttggagtagtgttcctcctcttctggcttaaaaacaagctctggtgatcaaagctgccttatccctgttttggaggtcatgaagttttcaatgggatattgagaaatgcctgctgggttttacttctccaaacttgaggacttgagggttcagatttgggtgcctgaggctcatgaaggattgattgatggctgagttttttcacttgttattgagttcatagaggtacccctttttgtcaatttaaatagtaaactgcttttgaacgaaagaaagaaccaaaaaaaaaga

SEQ ID NO: 8874 - DNA, 1209 bp, Fagopyrum esculentum
ttcaaactaatcctcaaaatcttgaacaccgattcagagaaccactccgctcttggttttggtaggtttttgcaattctgctacctctctacttcgaatctcctttcgaattttgactagttttgacttgtaaatcgtaaggaagaggttcgccacaaaccgaattctcatttgcgtcatctctttctgccaagccctaaagctgaccctaacagtcttaagatggttaaggtgacaatgatcgcgcgtgttacagacggtcttcctctagcagagggactagatgatggtcaggctgtgcctgatgctgaatattacaagcagcaaatgaagtctttgtttaagaatctttctaaaggccaccatgaagcctcaagaatgtcagttgaaagtggtccatatgtgtttcattatattattgaaggccgggtttgttatttgacaatgtgtgatcgtgcttatccaaagaaactagcttttcaatacctagaagacctaagaaatgaatttgaacgtgttaatgggagccaaatagaaactgctgcaaggccatatgcctttatcaagtttgatacattcatacaaaacaaagaaactataccaggatacacaaacccaacgtaacattgcgaaactaaacgatgagctttatgaggtccaccagattatgacacgtaatgtgcaggaggtccttggcgttggtgaaaagctggatcaggtcagccaaatgtccaaccgtttgacatcagagtcccgtgtatatgctgacaaggcacgcgatctgaatcgacaggccttgatcaagaagtgggcaccggtggctatcgtgattggtgttgtaatactgctcttctgggtcaggaagaagatctggtgaatctgggtcatgaatatcttatttttcctaatgcaggctttagaattttacgatagtggctgcttgagtgagaatgaacatcagatcagtgcaagagccagattagcttatttgtttaacgcaaccgtgatgacattccttgcatttctagttaactggaatacaagaggtagatgtgggaaaggcattaatgcttgtgtggccttatggagcatggactcgattgaggatataaagatcatgtagagttgtgacttgatggtcagaatacctttattcccttagaagagaggaaaacaaacttatgtctaggaatatacgggcaaacttgg

SEQ ID NO: 8875 - DNA, 878 bp, Amaranthus tuberculatus
gaaaacagtcgaccacaattccaattcagctgaaaaacgtagaatttagtagaaaatggtgaaggtaacaatgcttgcgcgtgttatggatggtctaccattagcagaagggttggatgatgggcgtgatgtacaagacgttgaatattacaagcagcaaattaaagctttgtttaaaaatctctctaaaggtcaaaatgatgcttcaaggatgtcagtcgaaagtggaccttatgtttttaactatatcattgagggtaatgtttgttacctgacaatgtgtgatcgggcttatccaaagaagcttgcatttcagtatctggaagatctcaaaaatgaatttgaacgtgtgaatgggaatcaaatagaaactgctgctagaccttatgctttcattaagtttgatacattcatccagagaaccaaaaaattgtatcaggacactcgtacccaaaggaacattgccaaactaaatgatgagctttatgaagtgcaccaaataatgacaaggaatgtacaagaagtccttggtgttggtgaaaagttggatcaggtcagccaaatgtccagccgcttaacatcagaatcgcggatttatgctgataaggccagagatctaaatcgacaggcgttaatcaggaaatgggctccggtagcaattgtaatcggagttgtggttcttctcttctgggttaagaagaagatttggtgatgcaccggcctttttctatcgaaacctattcgcagacatctacatgtttattccttcgtttacacatggattatacaacaccacgctacaaaggagcaacctggtgatttagaactgcatcgcgaaagtcttctttcaatgaaaaactatattttatctgtaagct

SEQ ID NO: 8876 - DNA, 765 bp, Daucus carota
atgattgctcgtgtcactgatggtcttccactagtggagggtttggatgatggccgtgatgttcaaaatgtggactattacaaacaacaagttaaggcattgtttaagaacctctctagaggtcacaatgaagcttcaaggatgtctgttgaaaccggcccctatatattccattatataattgaaggccgtgtctgttatttgacaatgtgtgatcgtgcttatccaaagaaactcgcctttcaatacttggaagatcttgcaaatgaattcgagcgtgttaatgggagtcaaattgaaactgctgcgagaccttatgctttcataaaatttgatacgttcattcagaaaacaaagaaactgtatcaggacacaagaactcagcggaacattgctaagcttaatgatgaactatatgaagttcaccaaataatgacgcgtaatgtacaggaagttcttggtgttggtgaaaagttagatcaggtcagtcaaatgtccagccggttgacatcagaatctcgcatatatgctgataaggcaaaagatttgaatcgacaggctctgatccggaaatgggctcctgttgcaattgtcttaggaatagtctttcttctattctgggtgaggaagaagatttggtgattttccggattgatccaattctagaatacttgttctgcttttttactccggcactctaggttgcctgttcaaaattcttgagaaaccagagattttgtataaatatatatatttcgacatgga

SEQ ID NO: 8877 - DNA, 1157 bp, Cirsium arvense
tgtagcattttactcgagtcatcgtcgcctcatctgcctattcttgaaggacaagaaatcattcccaattattcatccttccaaaaccctataatttatttgtccagatttttatcatcctcgtatacctcgctcaccgatcaatgtagatcaagaaactcaaagcaggaaagattgggtcatccataaatacttcttcaataaaaaattcagggggcaacttattaaagtaaagatggtgaagttgacgatgattgctcgtgtcactgatgggcttcctctagctgaaggacttgatgatggccgtgatttgcaggatgcagagttctataaacagcaagttaaggctttgttcaagaacctttcaagaggacataatgaagcgtcccggatgtctgttgaaaccggcccttttatcttccactatattattgaagggcgggtatgttatttgacaatgtgtgaccgtgcttatccaaagaagcttgccttccaataccttgaagatcttaagaatgaatttgagcgtggttatgcgaatcaaatcgaaactgcagcaagaccttatgcctttataaagtttgacacatttatacagaggactaagaaattgtaccaggacacaagaactcaaaggaatattgccaagttgaatgatgaactttatgaagtacaccaagtaatgactcgtaatgtgcaggaagttcttggtgttggtgaaaaattggaccaggtgagtcaaatgtcaagccgattaacctcagaatctcgcatatacgctgaaaaagcaagagatctaaatcggcaggccttgatccggaaatgggctcctgttgcaattgttcttggggtagttatcctactcttctgggtcagaaagaagatatggtgatgactaaattaattgttgttatttaacaaagagttattcaaggttagatattaagtgtcttaggtaagtatactgacttgagagattttgttgtggaatttatacagagatttgttgttactacttttaaaattgatgtttgctgtttgtgatggtttctttttttatctatgaacaaaagcaaactttgtaaactaaaagctccagagagattattacattacatggtgttgtaataaataatgatcaagacagaagttgattc

SEQ ID NO: 8878 - DNA, 947 bp, Linum usitatissimum
ccaaattcggtttcgttgttcgtcgatccatcgatctactcctcagatcctctcccaccaacccagaatttcccaaaatctgcaaatcagttgcatttcatatctgaggaattcgccaacggaaagatggtgaagcttacaatgatagctcgtgttactgacggtcttccactggcggaaggtctggatgacggtcgtgatgtcaaagatattgaattgtacaagcagcaagtcaaggccttgttcaagaatctcgccattcgccagaatgagccttcgaggatgtcggtcgagactggcccttatgtcttccactatattatcgaaggacgagtatgctaccttacgatgtgtgaccgtgcatatcctaagaaactcgcctttcaatatctcgaagacttgaaaaacgaattcgagcgtgtcaatggggctcacatcgagactgctgccagaccttatgcctttatcaagtttgatacttttatacagagaacaaagaaattgtaccaggacacacatacccagcggaacatttttaagttgaacgatgaactctatgaagtccatcagattatgacccgtaatgtgcaagaggttctaggagttggtgaaaagcttgaccaggtcagtgagatgtccagtcggttaacatctgaatctcgtgtatatgcggacaaggctagagatttgaatcgacaggcattgatccggaagtgggctccggtggccattgtgttcggagtcgtgttcctcctcttctgggttaaaacgaagatctggtaaattcatcatttccccggaaggtgattacaattgtgagggatgtaatggctatagaatcatgggtggatgtatactggttcattagatgaacccgtaggaacagtgtaaaagagtgatgtgtatgtgttcatcaaactatttgtgttttcagtgaaaatcacagt

SEQ ID NO: 8879 - DNA, 1224 bp, Panax ginseng
aaaattaccaaatcaaaacactcgtcaaaccttagtcttcccgatttcttcgtcataaagatcaaggggtgaaaaatataggttaatttgtagactggagtttgaagatggtgaagttgacaatgatagctcgtgtaactgatggccttccattagcagaaggactggataatggtcgtgatccacaagatgaattctacaagcagcaggccaaatccatattcaagaatctctcgaaaggccataacgaggcttcaagaatgtcactagaaactggtcctcttgtttttcactacattatcgaaggccgcgtttgttatttaacattatgtgatcgatcttatccaaagaaattagctttccaatacctggaagatctgaagaatgaatttgagagagtcaatggaagtcaaattgaaactgcagctaggccctatgcattcatcaaatttgatacattcatacagaaaaccaagaaattgtattcagacacccgcactcaaaggaacatcggaaaattgaatgatgaactctacgaagtccaacagataatgacacggaatgtccaggaagttcttggagttggagaaaaattggagcaggtgagtgaattgtcaaaccgtttgacctcagaatctcgtatttatgctgacaaggcaagagatctgaatagacaggctttgattcggaaatgggctccggttgccattgtgctcggagttgtctcccttctcttttgggtcaaaggaaaaatttggtgattttattactcatcgatggttggcatggcaagatgtggaacgcagacagcagctcaaacatttcgcatcgacttgaaaaaagaacagaaaagttatttgcaagattccaagtttgaacttgatcacaagatcctccagatgacattatattagatagagagaggttaaccccgtagagcgagcgatcgagcttgtattaatctcattataaaatttatagtatataataatattctactttttgggaatattaacaactcaaagaaatattgcctttattacatacattattcttatagtaaagttaaaaaaaaaaaaacaaaaaaaaaaaaacaaaaaaaaaaacaaaaaaaaaaacaaaaaaaaaacaaaaaaaaaacaaaaaaaaacaaaaaaaaacaaaaaaaacaaaaaaaacaaaaaaacaaaaaacaaaaaacaaaaacaaaacaaacaacaacaa

SEQ ID NO: 8880 - DNA, 1272 bp, Lupinus angustifolius
aagagcaattctaactcagcttcctttctcgttcaaaattctgaaagaccattttgatttctttgaaccaaccaagatttccacttcctcttccccacttcatccataactgcgccaacccattccttctcctttctcagtgtgaagttgtagactgagagagattgtgaaataagaaagatggtgaagttgactatgattgctcgtgttatggatggtcttccactagccgaaggactggatgatggtcgtgatattaaagatgcagaattttacaaacagcaagttaaagcgttgtttaagaatctctcacgaggacataatgaggcgtcaaggatgtcggttgaaactggcccttatattttccattatattatagaaggacgtgtctgttacttgacgatgtgtgatcgtgcataccctaagaagctagcttttcaatatcttgaagagctcaggaatgagtttgagcgcgttaatgggtctcaaattgaaactgctgccagaccatatgccttcattaagttcgatacatttatacacaaaaccaagaaactttaccaggatacccatactcagcgcaatattgcaaagttgaatgatgaactctatgaagtccaccagataatgactcgaaatgtgcaggaagttcttggtgttggtgaacagttggatcaggtcagccaaatgtccaatcgattatcatcagagtctcgcatctatgctgataaggctagagatttgaatcgtcaggctctgattcggaagtgggcccctgttgctattgttttgggagttgtctttgtacttttctggctcaaaaacagaatttggtgatcaagctcactatatgacattataacctggactttgctgttcttgcttcttgcttttctcacatgactatccagatttacggagaatctggcgaaccctgtatgcatgaatgatgcctaccttttgtgggcaattttggtttagaaaagagtgaatatcctccattacatttgagcatgcctggatcaggcattctggaacaggacatgttatctcttttttaaggagactaggtatatgagaaaatttcatgtccttagggatgcatatagacatttcttcaccctacttcccattattttcaggattatttcttttaatgggtcaaatatattttaccttgcattttattgtttctttgtactgctatctgtgaaatgcttgttcttagattggttataacttaatttgatttcatttttatatttcacgtga

SEQ ID NO: 8881 - DNA, 906 bp, Papaver somniferum
tggtgattagtgatcatatcaagtattctgaagatggtgaagctcacaatgatagcccgtgttactgatggtcttctattagtagaaggattggatgatgtacgtaatctacaagatgctgatgtttacaagcaccaggctaaggcgttgtttaagaacctgtcaagtggtcagaatgatgcgtcaagaatgtcaattgagactggtccttttgttttccactatattattgaaggccatgtttgttacttgacaatgtgtgatcgttcttatcctaagaagcttgctttccaatacctggaggacttgagaaatgaatttgaacgtgttaatggaaatcaaatagaaacagctgccagaccctatgcgtttatcaaatttgatacttttatacagaagaccaagaaactgtacttggatactagtactcaacggaaccttgccaagttgagtgatgaactttttgaggtgcaccaaataatgactcggaacgttcaagaagttcttggtgtcggtgaaaaattggatcagatcagtcaaatgtcgagtcacttaacctctgaatctagcatatatgcggataaggcaagagatctaaatcgacaggcgttgattcgtaaatgggcgccagttgccatagtgtttggtattgtcatcctcctcttttgggtcaagacaaagatatggtgattctaccatcactagtggtgcactgccagttctagctgagtttgtagtttttgataattgtaaaatgccaatgtagatttctcacccgcaatttagactggtccagttctctccgtaataagtaatgactatgttctagtttttttgtttgcacatctacaatatattaactaagtccatcatattacacctcaatgcatatattacagatctggg

SEQ ID NO: 8882 - DNA, 903 bp, Arnica chamissonis
gagtcatctttctactgtgtatccccaattaatttatcgatcaccaaaaccctcttattcgccttcaattctattctcaattcggaccttcttcttgctctcgcttgtagatcaatttttaccaagatcgtatcatccattcgcatgataagtactttaaaatttcagtgacagcttctcgaagtaaagatggtgaagctgacaatgatcgcacgtgttatcgatggtcttccattagctgagggacttgatgatggtcgtgatatgcaggatgcagagttctacaagcagcaagttaaagcattgttcaagaatctttcaagaggacaaaatgaagcctcaaggatgtctgttgaaactggcccttatgttttccactatattattgaagggcgagtctgttatttaacaatgtgtgatcgtgcttatccaaagaaacttgcgttccaatatcttgaagatcttaagaatgaatttgagcgtggttatggaaatcaaattgaaactgctgcaagaccttatgctttcattaaatttgatacatttatacagaggactaagaaattgtaccaggacacgagaactcagaggaacatttctaagttgaacgatgaactttatgaagttcaccaaataatgacgcgtaacgtacaagaagttcttggtgttggtgaaaagttggaccaggtcagtcaaatgtcaagccgcttaacatcagaatctcgcatatatgctgataaagcaagagatcttaaccgccaggctctgatcaagaaatgggctcctgttgcaattgttcttggagttgttattctactgttctgggcgagaaagaagatatattgatcatgttgcattctcctgagttccagttacagagttttaagttaattttccttgcac

SEQ ID NO: 8883 - DNA, 907 bp, Euonymus alatus
agattattgcactcaattgtgatctggcatatcaaaggggttgcatagtaaaaatggtgaagatgacaatgattgctcgtgttaccgatggtcttcttttggtagagggactggatgatggccgtgatatacaagattctgaaatgtacaagcagcaggtcaaggctttgtttaagaacctctccaaaggacacaatgaggcctcaaggatgtctattgaaacagggccttatgttttcaattatatcattgaaggacgagtttgttatctgacaatgtgcgaccgttcttatccgaagaaacttgcctttcaataccttgaagacttaaaaaacgagtttgagcgtgtgaatggggctcaaatagaaacagctgccagaccttatgccttcattaagtttgatacgttcatacagaggacaaagaaattgtaccaagacactcatactcagcggaatattgcaaaactgaatgatgaactttttgaagtccaccagataatgactcgcaatgtgcaggaagttctcggtgttggtgaaaaattggaccaggtcagtcaaatgtccagtcgtttaacatcagagtctcgcatatatgctgacaaagcaagagacttgaatagacaggcttttattcggaagtgggcacctgttgccattgtgttaggggttgttttcctcctcttctgggtcaaaacaaagctgtggtgatccaactaccctttcatggttattgcgagtcgacgaatattatttgtgggattctccacgtagcttttggttcctggatctagagtccatgcttcagagacctcagtgcacccccaatcaggcctcaaacatttgtgaaggtgacttttttcatttggtcatgccgctaactcattgaatttgagaccagttgtgcc

SEQ ID NO: 8884 - DNA, 1428 bp, Lotus japonicus
aaaattaaagattttatctcatctctgcagtgtagatcgatctgttttggtttaaaacgacgtggcgttgggtcagaattctcttctcacatcaaacaacacaacacattttcatctccgtttccatcgatctcgactcggctggaccatccacgcacgcacgctgccagtagctgcggcagctccggccaccaccctctcatctccattcttcttcagtgtgtttttggttagtgcaaattttagactctaagtgggagattgtgaactggtcaagatggttaagttgactatgattgctcgtgttactgatggtcttccactagctgaaggactggatgacggtcgtgatatgaaagattctgagtattacaaacaacaagtcaaggctttgtttaagaatctttcaagagggcataacgaggcatcaaggatgtctgttgaaagtggcccttattttttccactatattatagaaggacgggtctgttacttgacaatgtgtgatcgtgcttaccctaagaaactagcctttcaatatcttgaggagctcaggaatgagtttgagcgtgtaaatggctctcaaattgaaactgctgccagaccttatgccttcattaagtttgacacgtttatacagaagacaaagaaactttaccaggatacccatactcagcgtaatatttcaaagttgaacgatgaactctatgaagtccatcagattatgactcgaaatgtgcaggaggttcttggtgttggtgaacagttggatcaggtcagccaaatgtctagtcacttatcatctgaatctcgcatatatgctgataaggctagagatttaaatcgacaggctctgattcggaagtgggcccctgttgctattgtgttaggagttgtttttgtacttttctggctcaagaataaaatttggtgatccagctagtacgtgactataaacctggattttgcggctgtacctttttgctttctcacatgactatccagatttgcacaaattggcgggaaccctatatgcacgagttgatgtctacgttttgtgggcaactttggtctaggaaaaaaactatcttctattacttctgagcatgactgaatcgggctttctggtgcacaaaccaagttatggtaaaacttgatctctttggggatgcatatatacattacttgctagttcccaattattttcaggattattgcgttaacgagttaaatatattaccccttcgattttggtgtttccgtttgagctgctgaattagacgttttagctgcttgttcttaagatggtaaaccttatgtcatttggtatatacattttacaccttatacagcatttatattttaatgaatcattgtacgtgtatagtttgaactatctattcattttcattgaagatacaaatgctt

SEQ ID NO: 8885 - DNA, 897 bp, Orobanche aegyptiaca
gtgaccttcgaaaaccaacaaaaaccaatcggcattgcgatttcagtcaaattttcagaaaaccccttttatgtccgaatattacccaaatccttccttcaaatcaatgcaaatttcaagccgatgatctgtatataactacgaagcataactgaagatcgaagcagagattccccaaaacgcgtaggggagaggggctcacatgtgcatgtcatagttatcctacaggtttgcgaggttgaagaagtaacgatggtgaaattgactatgattgcacgtgttactgatggacttccgctagcagagggattggatgatggacgtgatgtaccagattccgatttctacaagcatcaggttaaatctctgttcaaaaacctctcaaggggacagaatgagccttcaagaatgtcagttgaaacagggccatatgtattctattatattattgaagggcgtgtctgttatttgacaatgtgtgatcgtgcttaccctaagaagcttgcctttcaatatctggaagatctcaagaatgaattcgaacgtgcgtatgggaatcagattgaaactgctgcaagaccttatgcttttatcaaatttgatacattcatacagaggacaaagaaattgtaccaggatacgaggactcaacgtaatattgcaaagttgaatgatgaactgtatgaagttcaccagataatgacccgcaatgtacaggaagttcttggtgttggtgaaaagctggaccaggtgagtgagatgtccagccgcttgacatctgaatcccgtatatacgcggacaaggcaaaagatttaaaccgccaggctttgattcggaaatgggccccggtagctgttgtgctaggagttgttttcctactcttgtgggtcaaaaac

SEQ ID NO: 8886 - DNA, 974 bp, Plantago ovata
catataacgtcgaaacctaggaattctattctcgcatccacaatccacatcgatccgagctcacatacgattttgtgataggtgtgagctcgtgaatcaaaatggtgaagttgaccatgattgctcgtgttactgatgggctacctctagcagagggactggatgacgggcgtgatgtgccggattccgacttttacaagcagcaagttaagtctttgttcaaaaacctttcaagaggtcacaatgaggcttcaagaatgtcaattgaaactgggtcatacatattccactatatcattgaagggcgggtttgctatttaacaatgtgtgatcgtgcttatcctaagaaacttgcatttcaatatctggaagacctgaagaatgaatttgagcgtacctacgggaatcagattgaaactgctgcaagaccttatgcttttatcaaatttgatactttcattctgaaaacaaagaaattgtaccaggataccagagctcagcgtaatattgataagttgaatgatgaactctatgaagttcaccagattatgactcgcaatgtgcaagaagttcttggtgttggtgaaaaattggaccaggtcagccagatgtctagtcgcttgacttctgaatcccggatatatgcagataaggcaaaagatctgaatcgccaggctctgattcgtaagtgggctcctgttgctgttgtccttggagtggttttcttcctgttgtgggtcagaaaaaagttatggtgatgcctgcagcgagccattaggtgcccgatgaatccgtttagtctctcttaacatgtctatttgggtgatgatacctaattggatttcatctatgaaccaatactggcaggcaatagctgtcatgaggattactatgagaaaggaatttgtaagaaatgaactgttgctgggtgctaggagaatgttttatcatgaagtaaaaagttacagttggca

SEQ ID NO: 8887 - DNA, 1322 bp, Podocarpus macrophillus
ttttccagaagctattaaattttattttacaacaacaatcgaaaacgcagatcttgcacaggagaaagaaattcacgagggtttggttaagcagatcggaaattcgcgagggttttgatagatgagaactagagattgtctgttttgttgaaataaggaggagatcttctcaatttaggagggaattggcgagggtttgttgcaaaacaaacgatttagttaggtttagaggcaggaattcgaaaaccaattgagattttttgttattagtggagaaaatggttaagttgacgatgatagcgagggtgaccgatgggcttcctttagcggaaggattggatgatggccgtgagcagagagatatggagttttacaagcaacaggcgaaatcgttgttcaagaaattgtcacagggtcaacacgagccctccagaatgtcaattgaatcgggcccatatgtttttcactacatcattgaagctcgtgtttgttatttaaccatgtgcgatcgagcttatccaaagaaacttgcatttcaatatctggaagatctcaaaaacgagtttgaaaaggtgaaccactctcaaattgaaactgtggcaagaccttatgctttcattaaatttgatacattcattcaaaagacaaggaagctgtacctggatacccagactcaaagaaaccttgccaagttgaatgatgacctatatgaagtgcaacagattatgactcgtaatgttcaagaagttctgggggttggtgaaaaattggaccaggtcagtcagatgtctagtcggttgtcatctgaatcacggatatatgctgacaaagccaaggatctaaacagacaggcatttatcaggaaatgggcacctgttgcaattgttcttggagttgtttttgtgttgctttggctgcgtggctatatttggaagtaactagcgtttgggaattcaagcagtttttcaattgcaggaagaaggaaagcctatattgctattaaaaatcacaacttagtttgaggaattgaagcactgccagcaactgaccattttttttggagatgctatctaaatgcaagtgtcaagtttatggggtagatctgacattgaagacacccactggttgtccaagaggagacttgagatgagcccagtcaatgagctgaagttgaatacaaaatgtattttagttggtacaatacactttagtagtggagagttagcttttctaagttgcaaagtagattattaacaagttggaaatcagtttagcatgtaattttatatatgaaaattctattggttgccgctttgtttggg

SEQ ID NO: 8888 - DNA, 802 bp, Rosa hybrid cultivar
agattgatacaacaaacccacccctcatttataaaaccctaatctcaccttctctctcttctcgctccgattgccccatcgtcccccgatcaatcccataaaccaggggacatataacagttatttttgcattgctgggaagtggggaagtgaagatggtgaagctgacgatgattgctcgtgttactgatggtcttccactagcagagggactggatgatggccgtgatattaaggattcggaattctacaaacaacaagtcaaggctctattcaagaacttgtcaagaggccaaaatgagccttcaaggatgtcagtcgaaagtggaccttatatattccattatatcattgaaggacgtgtctgttacttgacaatgtgtgaccgagcctatccaaagaaacttgcctttcagtatctcgaagatctcaggaatgaatttgagcgtgttaatggagcccagattgaaactgctgcaagaccatatgctttcattaaattcgatacattcatacagaaaaccaagaaattgtaccaggacactcgtactcagcggaatatttcaaagttgaatgatgaactctatgaagtccaccaaataatgactcgcaatgttcaggaagttcttggcgtcggtgaaaagttggaccaggtcagtcaaatgtccagtcgtttaacatcagagactcgtgcctatgctgataaggcgagagacttgaatcgacaggctctgatccgtaagtgggctcctgttgccattgttcttggagttgttttccttgtttctgggtcaaaacgaag

SEQ ID NO: 8889 - DNA, 808 bp, Sciadopitys verticillata
cagatctgatcaaggaaggaagagatttggagggttaagttggaaataaagagaatttgaattggttaaaagaaagaaatccaagtgcaattagaagagaagaggagagaaattcgctatggtgaagctgacgatgatagcacgggtgaccgatgggctccctttggcagaaggattggatgacggtcgcgagcagagagatctggagttctacaagcagcaggctaaatctctcttcaaaaaattgtcgcagggacagcacgaaccttccagaatgtcaattgagtctggcccctacgtatttcactacatcatcgaagctcgggtttgctacttaaccatgtgtgaccgatcttatccgaaaaagcttgcatttcaatatctcgaggatctcaaaaatgagtttgaaaaagtgaactattctcaaattgaaactgttgcgaggccctatgctttcatcaaatttgatacatttattcaaaagacaaggaagctatacttggacacccagacacaaagaaaccttgccaagttgaatgatgacctgtatgaagtgcaacagattatgactcggaatgttcaagaagttttgggagttggtgaaaaattggaccaggttattcagatgtctagtcggttgtcatcagagtctcggatatatgctgacaaagccaaggatctaagcagacaggccttaatcaggaagtgggcacctgtggcaattgttcttggagttgtctttgtgctcctatggctgcgaggctatatttggaaataactttgcctgaaatatttaagtacttttccc

SEQ ID NO: 8890 - DNA, 1166 bp, Taxus baccata
tagaagaaaaaaatcccaactccaagggtaaaatggttaagctgacaatgatagcaagggttaccgatggtctccctctagcggaagggttagatgatggccgcgagcagagggatctggagttttacaagcaacaggctaaatctctgttcaagaaattgtcgcagggccagcacgagccctctcgaatgtcaattgaatcgggtccctatatatttcactacatcattgaagctcgggtttgttacttaaccatgtgtgaccgatcttatccgaaaaagcttgcatttcaatatctggaggatctcaaaaatgaatttgaaaaggtgaaccactctcaaattgaaactgtggcgaggccctatgcttttattaaatttgacacatttattcaaaagacaaggaagctgtacttggatacacagacacaaagaaaccttgccaagttgaacgatgacctgtatgaagtgcaacagattatgacccgaaatgttcaagaagttttgggagttggtgaaaaattggaccaggtcagtcagatgtctagtcggttgtcatctgagtctcggatatatgctgagaaagctaaagatctaagcagacaggccttaatccggaagtgggcacctgtggcgattgttcttggagttgtattcgtgcttctatggctgcgaggctatatatggaaataaccgtgacggaaatatgaaagttttttaatccattgtggcaagaaggaaagtctgctttgctaataaaacccattattcgacttgcgaaatggaaggactgctatcaactgaacagttttttgggagttgctatttacatgcaagtgtcaaatgtatggatagatatgaggttgaaagacatgcaaatttcttatctgacaagagggggagaagtgacgggctagtaaatgagcaaaagttgaatacattatattgtagttggtacaaatatgttttacaagtggagaaagattttccgacagagatatttgataccaaggccgaattggatatagcctaactgtgaattttatcgattacgaatgtctttagtagaatggactcttcgtataatttttctgaggttaatgttgaataaacactaacttttcttctgttttgtacaataagaagcataggcattttagattccac

SEQ ID NO: 8891 - DNA, 898 bp, Tragopogon dubius
tatttcaggtattctgcgtttcttcatcgagtcatcctcctactgtatccccaatttatcgattacccttcttccaaaaccctattaccgtcttcgattccattaaattttctggattcttgacgttctcgtctaaaaatcaatttcatattcgtagatatacgaagcattatagattggatcatccatacgcatgataagtacttgaattttcagtggttgatagcttctcaaagtaaagatggtgaagctgacaatgattgcccgtgttactgatggccttccgctagctgaaggactagatgatgggcgtgatatgcaggatgcagagttctacaaacagcaagtcaaagcattgttcaagaatctttcaagaggacaaaatgaagcctcaaggatgtcgattgaaactggtccttatgtttttcactacattatcgaagggcgggtatgttatttaacaatgtgtgatcgtgcatacccaaagaaacttgcattccaatatcttgaagatttaaagaacgaatttgagcgtggttatgaacatcaaattgaaactgctgcaagaccatatgcttttataaaatttgatacatttatacagaggactaagaaattgtaccaggacacaagaactcaacgcaacatttctaagctgaatgatgaactctatgaagttcaccaaataatgactcgtaatgtacaggaagttcttggtgttggtgaaaagttggaccaggtgagtcaaatgtcaagccatctaacatcagaatctagcaaatatgctaataaagcaagagatctgaatcgacaggcattgatcaagaagtgggcacctgttgcgattgttcttggagttgttattctactgttctgggcaagaaacaagatatggtga

SEQ ID NO: 8892 - DNA, 1369 bp, Trigonella foenum-graecum
ggaaggaatttcatttcatttcatttcctttcgtttcaacgtaaacacaaataacatcttccaaaagtttcatcgatcggttcggctcggctccaccatcgacgccgccgatcatcacggcagctccggccacctccgccattcttcagtgtgtgttttggtttagttgcaaagttcaagactctgagaaggagattgtgaaagatggtgaagttgactatgattgcccgtgttactgatggtcttccattggctgaaggactggatgatggtcgagatattaaagatggtgaattgtacaaacagcaagtcaagtctctgtttaagaatctatcaagagggcataatgaggcatccaggatgtcagttgaaagtggtccttatgttttccattatattatagaaggacgagtctgttacttgacaatgtgtgaccgggcataccccaagaaactagcatttcaatatcttgaagagctcaggaatgagtttgagcgtactaatgggtctcaaatcgaaactgctgccagaccttatgccttcattaagtttgacacatttatacagaagacaaagaaactttaccaggatacccatacacagcgcaatattgcaaagttgaatgatgaactttatgaagtccaccagattatgactcgaaatgtgcaggaagttcttggtgttggtgaacagttggatcaggtcagccaattgtccagtcgcttatcatcagaatctcgcatatacgctgacaaggctagagatttaaatagacaggctctgattcggaaatgggcccccgttgctattgtttttggagttgtctttgtacttttctggctcaagaacaaaatttggtgatcgagcttagcgtttgacttcatacacctagactgtggttatggctacttgtcttcctcatatatgactatcaatagtttctcagttttgtgggaaccaaaccctacataaactaggtgatgtctactttttgtggacaatttatgaagaaaaaaaaactatcctctgttacttctgagaaaggctggatccgactttctggaatagaaacattttacctttatattaaggagacaaggcatgagaaaactggattcccttggggatgcatatagacatttcttcttacaactgagttattttcaggattactgcattaattagttatatattgcccatcgacatttcgtttttcacccccttaatttgagcacctgaaatagaactgcattttgtatggttagtataacgagttagtgtggagtgtttgttgttagacaggtaaaccttttgcaatttcatttatacgattttacttgcaaatgatgcaatgataaagatctattgg

SEQ ID NO: 8893 - DNA, 1193 bp, Vinca minor
ttttccatttctcggaatcagaagaagacgctgcaaatctccgccgccgagatcaccatcggaaaacaccagttgcgccaccacatatcaccacctcgaagtataggcgacagcttgtggaagaaagatggtgaaattaaccttgattgctcgtgttactgatggccttccgctagtggaggggctagatgatggccgggatttgccagatgcagatttctacaagaagcaggccaaggccttgttcgcaaacctcccaaggggtctgaatgatccttctagaatgtctattgagactggctcatatatgttccattacattattgaaggtcatgcttgttatttgacattgtgtgaccgtgcttatcctaagaagcttgcttttcaatacctggaagatcttaagaatgaatttgaacgtgtaaatggtagtcaagttgatactgctgctagaccctatgctttcataaagtttgatgcatttatacagaaaacaaagaaattgtaccaagacacaaaaactcaacggaatatagcaaagctgaatgatgaactctatgaagtacaccagataatgactcgcaatgttcaagaagttcttggcgttggtgaaaaattggaccaggtcagtcagatgtctagccgcttgacctcagaatctcgcatatatgctgacaaagcaaaagatttgaatcgtcaggcttttattcgtaaatgggcacctgttgctattgtcctcggtgtggtcatgcttctcttttgggtgaaaaacaagatttggtgatgctgcaaacgagtctctacttgcctactcttcattgacacatctaaggagtgagtgctgcaagtgttcattattgtctctcatagcagtaacactgtagagttttttgaaccgaagaaatcagacttttgtcctaaacggtaaaacaactaaagggagctcattttccctgtagttttcatacagatttctatcatatccgttcaacgtttcttctgtcttcccaatacatttatatatagaagttattaaaaccctaaattcgaaatctcgtagagattcatggtagatctctaatctttgtgctgcattatatgaggtaacggattcttgtacacttctgggcacaggacagtatatgaaagcgtatgtagaatatatatctctatccagggtaaagaatagtatg

SEQ ID NO: 8894 - DNA, 1025 bp, Fagopyrum esculentum
cagaccattacgtgttggtacgagggtcttaaattaaggtggtgggcggagaattcgttgcagagatctgaatattatagctccacgagagataaatcccagatcggaaagcggagttgggttcaattctcgtgcaaatttaaaagctttaagtttgctcgagttttgaggtcttgcggtttattggtcctcagcttcatctgcatttgcgtggaaaagtgctaattgctggaagctggtcagataaagatggttaaggtgacaatgattgcgcgtgttactgatggtcttcccctagcagagggactggatgatggccgtgatgtgcctaatgctgaatattacaagcagcaaatcaaatctttgtttaagaatctttcccaaggccatcacgaggcctcaaggatgtcaattgagagtggtccttttgtctttcactatatcattgaaggacgggtttgctatttgacaatgtgtgatcgtgcttacccaaagaaactcgcatttcaatacctagaagacctgaaaaatgaatttgagcatgtcaatgggtctcagatagagactgctgcaaggccatatgcctttattaagtttgatgcattcatacaaaaacaaagagattataccaagatacacaaacccagaggaacatctccaaactgaatgatgagctctacgaggtccaccagattatgacacgtaatgttcaggaggttcttggtgttggtgaaaagctggaccaggtcagtcaaatgtctagccgattgacatcagaatctcgtgtttatgctgacaaggcacgagaccttaaccgacaggccttaatcaagaagtgggcaccggtggctattgtcatcggtgtggtgatcctgctcttctgggtcaggaagaagatctggtgattgaccctctgaggctttaaggacatcatcactgcaaggcgcaagcggcccgaattcgtgttttcatttttgaacctctgtgatgattaccagtatgtagtattcaagccaagtttatct

SEQ ID NO: 8895 - DNA, 1299 bp, Gnetum gnemon
ggaggagggccgaagcaggtcggacggacgaagggtaggagaattggaatgcaggatttgggtaaacttgtatgcgcatttagcattcgctgtgatcgatcagcaacagcaggcgaggattcgaagaaaggaagggaaacataatcaaatcaaatcaaatcaaacagagatattgatcgaaaatggtgaagctgacgatgatagcgcgggtcactgatgggttgccgctggccgagggcctggatgatgggcgagaacagagagatctggacttctacaagcagcaggccaaggctttgttcaagaaactctcccacggccagatcgagtcctccagaatgtccatcgagtctggcccctacgtttttcactacattattgaatctcgagtttgttatttaactatgtgtgatcggtcgtatccaaagaagctggctttccagtacctagaagatcttaagaatgaatttgagagggtgaaccattctcaaattgaaacagttgcaaggccgtatgctttcataaaatttgatacgtttattcagaagacgaagaagctgtatgttgacacacacacccagcggaacattgcaaagcttaatgatgagctttatgaggtgcagcagataatgacacggaatgtccaagaagttttgggcgttggtgaaaagttggaccaggtcactgagatgtcgaatcggttgtcatctgagtctcggatatatgctgagaaggctaaggaattaagcagacaggctctaattaaaaatgggcacctgtagcaattgtcctgggaattgtctttatgctattgtggttgcggggctacatctggccctgacatggtttttaaagtcgtcgatttttttcatctgaatgatgcatgtaccaagtatttacgttggagcttggccaattatcagatttctactctgcttcgtctccatttctttcaatggagagagacttccgtgggacatgagagcattaaaagaatactaccagttgccaacaaggcaatgttatttgatgtacatgacctacattgcagttgacatgttcttttttcctttaagattttagctagcaattatctatagccagtgttagtcatttgattacggagtgaccttttgcaagttttggaattatttttctgtgattttgatcaaattattaatcaccaccaaccgatgttctcggtaacaatgatcgtgaaagtagatcaacacccactggatgtgcttcaggagttataatgacatgtatgcaaatacgtaagaaagtttgttatgttta

SEQ ID NO: 8896 - DNA, 1322 bp, Conyza canadensis
atccacacatctacttactttgtctcccccaaattttatcgatcaccttctcctttacaaaaccctaattttctcaatttccgatccatcgcatgattttatcttcttgtaatttcagcttcttgaactaagtaagtaaacaaacatcatggtgaagctgacaatgattgcccgtgtaaccgacggccttccgctcgctgaaggacttgacgatgggcgcgatatgccagatgcagagttttataaacaacaagttaaggcattgtttaagaatctttctaggggacataatgaggcttctaggatgtctgttgaaactggcccttatgtttttcactatgtaattgaagggcgggtatgctatctaacaatgtgtgatcgtgcttatccaaagaaacttgcattccaatatcttgaagatctagtgaacgaatttgagcgtggttatgggaatcaaattgaaactgctgcaagaccgtatgctttcattaaatttgatacatttatacagaggactaagaagttgtaccaggacacaagaactcagaggaacattactaagttgaatgatgaactatatgaagttcaccaaataatgactcgtaatgtacaggaagttcttggtgttggtgaaaaattggaccaggtcagtcaaatgtcaagccgcttaacctcagaatctcgcgtatatgctgataaagcaaaagatctaaaccgacaggctttgattaagaaatgggctcctgttgctatagttcttggagttgtgattctactgttctgggccagaaagaagatatattgatcatggcttcatttagctctatggaaagtaccgttccaattctatgagttcctgttatccttgcatcttagttgccttattatccatttgccctttgaagagaagttttgtttatgtgctttaacacctagacaagtttaatttacggagaagcattcacaatcctgatagatctcacatttgtatcggattcaaaacggttttttcttatatctgtattagttgccttatcatccatttgctcctaaagagatgttttgtttatgtgctttaacacctagacaagtttaatttacagaaaaacattcacaatcctgatggacctcacatttttatctattttcaatgggtcactatgacatacatgagtatatttctatttggcattttaccttataaccaacataatcaagtatagaacaaaaaatttgtcaaaactcgctttatatcacctcatgtttaggacaatcaattgtatgattacaagaagagaacagaatgaagaaatgttacattg

SEQ ID NO: 8897 - DNA, 1394 bp, Cycas rumphii
gtgagtcaaacctgtacgctcattctagctttttggtctacaaacgcctgctgaaaagcttcaaagggccgagaaagcacaattatgctttttcatccaccgtttctcaaggcagaaggcacacaggaggattttattttgtatttattcagagcctgaatcaggtagattcgaatacataagcgtgatttattcttcttcttctatatagcgccggaacccaacaaatcatcagtgcacattttcggcggtcaggggttcgaatcgtttggagaacctattcggtccagccaattggaaccccgaagtggtgaattgcgggtccatctgtagggagaaatggtgaaactgacgatgattgctcgtgttattgacgggcttcctttagccgaaggattggatgatggtcgtgaacagagagatctcgagttttacaagcagcaggccaaatccttgttcaagaagctagcgcaagggcagcaccagccttcaagaatgtcaattgaatctggcccatatgtattccactatataattgaagctggcgtttgttacttaaccatgtgtgatcgatcttatccaaagaagcttgcatttcaatatcttgaggatcttaaaaatgagtttgagaaggtgaatcggtctcaaattgaaaccgtggcaaggccctatgctttcattaaatttgatacattcattcaaaagacaaggaagctgtacttggacacccagacacaacgaaacctggccaagctgaacgatgacctatatgaagtacagcagattatgacacgaaatgttcaagaagttcttggagttggtgaaaaactggaccaggtcagtcagatgtctagccggttatcatctgaatctcgaatttatgctgataaagctaaggacctaaacagacaggctttaatcaagaaatgggcacctgtggctattgttctgggagtagtcttggtgctactgtggatgcgaaggtatatttggtaatgattgcatctgtggaatgcaaatttattctgtggactatcagggaggatctgcttgcgaataaaaccagatgaaggttgacaaaaatattttatgaagggcagatgtcaactgaacattttgctatggctgagttgctgttcacctgtaagcagggaatgtgtttgggtagatttgagctggaaggaccaaaatattctttaaaaattcttgtccaggaaaagagagtaaatcacagatggggctagctgtgagagctcattttgatgcattgtattgtagttggtacaagcacagttgtatgaacagagcaatatcgtttctatttggagaaatggtgtatcaccaagaacaaatttgatttgattagccttggcatggattcctattgattgcga

SEQ ID NO: 8898 - DNA, 1277 bp, Medicago truncatula
caattcgcaaatcgcaaacggcaagcaggaacaaatcgcaaatctgaacaaagagaagaaacggcaacaccagagtcgcaaatcgcaagcaggaacagaattgcaaaattcaagattctgaaagggagattgtgttccgagaaagatggttaagttgactatgattgcccgtgttactgatggtcttccattggctgaaggaatggatgatgctcgcgatcttaaagatggtgaactttacaaacagcaagtcaagtctttgtttaagaatctatcaagagggcataatgaggcatcaaggatgtcagttgaaagtggtccttatgtttttcattatattatagaaggacgggtctgttacttgacaatgtgtgatcgggcataccccaagaaactagcatttcagtatcttgaagagctcaggaatgaatttgagcgtgttaatgggtctcaaattgaaactgctgccagaccttatgccttcattaagtttgacgcatttatacagaagacaaagaaactttaccaggatacccagacacagcgtaatattgcaaagttgaatgatgaactttatgaagtccaccagattatgactcgtaatgtgcaggaagttcttggtgttggtgaacagttggatcaggtcagtcaattgtccagtcgcttatcatctgaatcccgcatatatgctgacaaggctagagatttaaatagacaggctctgattcggaaatgggcccctgttgctattgtttttggagttgtctttgtacttttctggctcaagaacaaaatttggtgatcaagcttagcatttgacttcctgaacctagactgtgtggccatggcttcttgtcttcctcatatacgactatcaagatttatctgctcagttttgtgggaaccaaaccctacataaactaggtgatgtctactttttgtggacaaattatgaagaaatatcctgtgttacttctgagaaaggctggatccgactttctggaatagaaacattttacctctatatttaggtgacaagacatgaaaaaactggattcccttggggatgcatatagacatttcttcttgctacccaattattttcaggattactgtgttaatgagttatatattggctcctcgatattttgtttttcggccttaattttgaacacctgaaatagaactgcattttgtatggttagtataacgagttagtgtgatatgtttgttcttagactggtaaacccttttcactttcgtttatacaagtttac

SEQ ID NO: 8899 - DNA, 1098 bp, Ambrosia trifida
atctcatctcatctgttttatttgtatttgtatcgtatttgtttattattataccgtatccccaatttttcgatcaccaaaaccctattattattcattgtcgcttctttgtagatcgtccgtagatccctaccatacgcatgtttactagatgtaattctcagtgacagcttcttcagaaaagtaattaagtaaagatggtgaagctgacaatgatcgcacgtgtcatagatgggcttccattagcagagggacttgatgatggccgtgacatgcaggatgcagagttctacaaacagcaagttaaagccttgttcaagaatctttctaggggacataatgacgcctcacgaatgtctcttgaatccggcccttacgttttccactatattattgaagggcgagtttgttatttaacaatgtgtgatcgtgcttatccgaagaaacttgcgttccaatatcttgaagatcttaagaatgaatttgagcgtggttacggaaatcaaattgaaactgctgcaagaccgtatgctttcataaagtttgatacatttatacagaagactaagaaattgtaccaggacacaagaactcagaggaacatttctaagttgaatgatgaactttatgaagttcaccaaataatgactcgcaatgtacaagaagttcttggtgttggtgaaaaattggatcaggtcagtcaaatgtcaagccgcttaacatcagaatctcgcatatacgctgataaagcaagagatctaaaccgccaggctttgatcaaaaaaagggctcctgttgcaattgttcttggagttgttattctactgttttgggccagaaagaagatatattgatcatggtttcatttgtagcatggaaatatggttatggttcaccgagtttcagttacagagttttaggttaattttccttgcgctcttaagttacattatccatttgcaccttcaacttgaaagttttgtctatgtgctatttacatttaaacaagtttaatctattcacaatcttgacaaacccttacttctatgttggtatacacatattatttctgcaatgttaatgaatccctttcagaat

SEQ ID NO: 8900 - DNA, 780 bp, Catharanthus roseus
ggcacgagggaaccaccacggcaacgttagtgtgttccttcagttcgctgcccagcgccacagctccgcctacgggttaagaacacgagagcagttgagttgaagttttcaaaatccatctcagatttttctgtttgaactccgtcatcgacaacctcttgtggaagaaagatggtgaaattgacaatgattgctcgtgttactgacggccttccattagtggaggggttagatgatggccgagatatgccagatgcagatttctataagaagcaggccaaggccttgttcacaaacctctcaaggggtcagaatgacgcctctagaatgtctattgagactggcccttacatattccattacataattgaaggacgtgtttgttatttgacaatgtgtgaccgtgcctatcctaagaagcttgcttttcaatatctggaagaccttaagaatgaatttgaacgcttaaacggaagtcaaattgaaactgcagctagaccatatgctttcataaagttcgatacattcatacagaaaacaaaaaaattgtaccaagacacgcgaactcaacggaatatagcgaagctgaatgatgaactttatgaagtacaccagataatgactcgcaacgttcaagaagttcttggtgttggtgaaaagttggaccaggtcagtcagatgtcaagccgcttgacttcagaatctcgcatatatgctggcaaggcaaaagatttgaatcgccaggctttgattcgtaaatgggcacctgttgcaattgtc

SEQ ID NO: 8901 - DNA, 1463 bp, Cicer arietinum
gtcttttttacgtacattttataacaatacaatcaccattcttgcatttcttttaaagaaatatttttaccatttaacactactctttaaaacaacgtggcggtcataattcacattttcatttcatttcaacaaacataattacaacttcctatagtttcatcgatcggcttcagctcggctggaccatccacaccgccgatttttgcggcagctccgactaccttctcatcaccattcattcattcttctttagtgtgttttggtttagttgcaaagttcaagactttgagagggagattgtaaactgtgaaatatggtgaagttgactttaattgctcgtgttactgatggtcttccattggctgaaggactggatgatggtcgtgatcttaaagatgctgaattttacaaacagcaagttaaggctttgtttaagaatctctcaagaggacataatgatgcatcaaggatgtcagttgaaactggtccttatgttttccattatattatagaaggacgggtctgttacttgacaatgtgtgatcgtgcataccccaagaaactagcatttcaatatctcgaagagctcaggaatgaatttgagcgtgctaatgggtctcaaattgaaactgctgcaagaccttatgccttcgttaaatttgacacatttatacagaagacaaagaaactttaccaagatacgcatacacagcgtaatattgcaaagttgaatgatgaactttatgaagtccaccagattatgactcgaaatgtgcaggaagttcttggtgttggtgaacagttggatcaggtcagccaaatgtccagtcacctatcattagaatctcacaaatatgctaacaaggctagagatttaaacagacaggctctgattcggaaatgggcccctgttgctatcgtttttggagttgtctttgtacttttctggctcaagaacaaaatttggtgatcaagattagcatttgacttcataatggcttcttgtcttcctcatgtatgactatcaagatttgcacagttgtgagaactctatataaactaggtgatgtctacaaaagactatcatctgttacttctgagaaaaactgggtccgattttctgaaataggaacattttacctttatattaaggagccaagacatgagaaaagtagataccctccggtttggatatagacatttcttcttagtacttcccaattattttcaggattcttgcgttaatgggttattactgccacctccctattttgtttttccccattcaattgagcacttgatatagaactgcattttgtatggttaatgtatcgtgttagtgtggagtgtttgttcttagatattaaaccttttgttatttcgtttatacattttacttgcaaataatgcaatgaccaagatctgttggatccaatagctagtatttttcttttcttaaa

SEQ ID NO: 8902 - DNA, 894 bp, Raphanus sativus
gtgaagatgacatgatagctcgtgtactgacggttgctctagcagagggactcgacgatggtcgtgacttgccagattccgacatgtataagcaacaggttaagtctctgttcaagaatctctcccgaggtcataacgaagcttcacgaatgtctgttgaaactggcccttatgttttccattacatcatagaaggacgtgtttgctacttgacgatgtgtgaccgctcttacccgaagaaactcgcgttccagtacctggaagatctcaagaatgagttcgaacgtgtcaatgggcctaacattgaaacagctgctagaccttatgcttttattaaatttgatactttcatacagaaaaccaagaaactgtaccaagacactcgtacgcaacgaaatatcgccaagttgaatgatgaactctatgaggtccatcagataatgacgcggaatgtgcaggaagtcttaggtgttggtgaaaagctggaccaggtgagcgagatgtcgagtaggctaacttctgaatctcgtatatatgctgataaagctaaagatttgaatcgccaggctttgatcaggaaatgggcaccagtagcgatcgtgttgggtgtagttttccttcttttctgggtcaagaacaagctatggtaaagagacaggaggaacctaaggctattttcgtaatttagcagacttttccggacatatatcagcctgattccggcgccaccaaaatatcttctttctttcaaaacagaaacttcgacacattttgtacttctgtagtatgcaaactgttatgagactgctcatattatcatcatccgtttatacactttaaacttgattctcaaatttctcaaatgtccttttatcgatgacaataaccttatca

SEQ ID NO: 8903 - DNA, 973 bp, Helianthus annuus
agagtgacagcttcataaagtaaagatggtgaagctgacgatgattgcacgtgtcactgatggtcttccgttagctgagggacttgatgatggccgtgatgtgcaggatgcagagttctacaaacagcaagttaaagctttgtttaagaatctttcaagggggcacaatgatgcctcaaggatgtccgttgaaaccggaccttatgtttttcactatatcattgaagggcgagtttgttatttaacaatgtgtgatcgtgcttatccaaagaaacttgcgttccaatatcttgaagatcttaagaacgaatttgagcgtggttatggaaatcaaattgaaactgcagcaagaccgtatgctttcataaaattcgatacatttatacagaggactaagaaactgtaccaggacacaagaactcagaggaacattactaagttgaatgatgaactttatgaagttcaccaaataatgactcgtaatgtacaagaagttcttggtgttggtgaaaaattggaccaggtcagtcaaatgtcaagccgcttaacatcagaatctcgcgtatatgctgataaagcaagagatctaaaccgccaggcttttatcaagaaatgggctcctgttgcaattgttcttggggttgttattctactgttttgggccagaaagaagatatactgattatggtttggtctgtttcataggaatatgattctatttgtcccggttccgggtacagagttttaagttaattttccttgcaccccctgcactttagttatgctatccatctgcaccttcaacttgaaatttttgtttatgtgccttttctacatttaaacaagtttaatccgccaaatagcaattaaaatcttgacaaactcttacttctgtgttggtgtttacatcttatctatgtattataaagtaaattacacgaatcgtcctatagtatgttgaaatttcagcttt

SEQ ID NO: 8904 - DNA, 1311 bp, Fagopyrum esculentum
tgaagcccgaagaaacatcaccattagagttgaatcgacaaatctccccttcctcgttctttccggttctccttctctttcccccaaagcaattttcttcccgatttccaattgaaatttccgaccattacgtttcggtactagggtcttataattaggtggtgggcggagaattcggtacagagatctgaagataatagctccgagatagataaatcccagatcggaaagcggagttgggttcaattctcgtgcaaaatttaaaagtttcaagtttgctcgagtttgaggtcttgcggtttattgatcgtgagcttcatctgcatttgcttgtaaaagtgttaattgctgaaggctgatcagataaagatggttaaggtgacaatgattgcacgtgttactgatggtcttcctctagcagagggactggatgatggccgtgatgtgcctaatgctgaatattacaagcagcaaatcaaatctttgttcaagaatctttcccaaggtcatcacgaggcttcaaggatgtcaattgagagcggtccttttgtctttcactatatcattgaaggacgggtttgttatttgacaatgtgtgatcgtgcttacccaaagaaactagcatttcaatacctagaagacctgaaaaatgaatttgagcatgtcaatgggtctcagatagagactgctgcaaggccatatgcctttattaagtttgatgcattcatacaaaaacaaagagactataccaagatacccaaacccagaggaacatctccaaactgaatgacgagctctatgaggtccaccagattatgacacgtaatgttcaagaggttcttggtgttggtgaaaagctggaccaggtcagtcaaatgtctagccgattgacatcagaatctcgtgtttatgctgataaggcacgagaccttaaccgacaggccataatcaagaagtgggcaccagtggctatcgtcatcggtgtggtgatcttgctcttctgggtcaggaagaagatctggtgattgaccctctgaggctttaaggacatcatcactttaaggcgcaaacaacccgaattcgtgttttcatttttgaaccgctgtgatgataccgatatgtagtattcaatccaagtttatcttctcttttccagactaaacagataacagtaagtgaggatttttgttgttggaacaactatggcattgttgcctaggggttcttgttacggttctatacagctgaaactctcatgttttaaatattgcaatagaccaaacattctcattagtactatcttatcatcca

SEQ ID NO: 8905 - DNA, 1577 bp, Pinus pinaster
tactattggggccgcccacaatcaagcgaattttttgtttattttaagtgaagtcagacagtggtttgagcttgggtgcgcgatacacagatccacgtctgcattgaatgcaagcaaaaatcaagggtggtaacctcgtgtgatccgcggggagaaccgccagaccaccctcccaaattttggtcccagttgtcgctttgatttgattcgatccagcagttttcgctcttcaattcaaccttcttcgctgtcggaaaggttcaatttggaccaacatcggaccaaactgagaagcgcaaggggacagccaactgaattcaagctcacgagaccgtgtagatttgccctgttgaagtcttgggttcttttacaagcttcttcagcaacaataataattgactgcagagatggtcaaactgacgatgattgctcgtgttactgatggtcttcctttagcggaaggcttggatgatgggcgggaacaaagagacctggaattttataaacagcaggccaagtcattgttcaaaaaattgtcacacggtcaacatgaaccttcaaggatgtccattgaaactggcccatatatatttcactatataattgaagctcgtgtttgttacttaactatgtgtgatcgctcttatccaaagaagcttgcatttcagtaccttgaggagctcaaaaatgagtttgaaaagttgtatcagtctcaagtagaaactgttgcaagaccatatgcttttattaaatttgatacatttattcagaagacaaggaaactgtacttggacacacgaacacagcggaaccttgctaaactaaatgatgatctatatgaagttcagcagataatgacacgaaatgttcaagaagtgttgggagttggggagaagcttgatcaagtcagtcagatgtctagtcgtctgtcatcagaatctcggaaatatgctgataaagcaaaagatttaagcagacaggcatttatcaagaagtgggcacctgtggccattgttctgggagttgttattgtgctcctgtggatgcggagttatatttggcagtgattttctttcagtcattattacattacctgggtaagagtggagtttagctgctcagaggcagatagtaacaagcaggtaatatttttgagggagggaattcggggtagcattttgttttggcttggttgcttttattgaatgcaaattcgaaatgaggaaagagagatcttactgagggcaatgaccagttgtatgccgagcttgattggtacaggtgaacgtgaaacaagtttcactatttgatggatgagatgagtaagattttatttcagttgttagaattacaatcttagaggaagataataatattgttctggtcagatagcttattcatcagggagatgaaattttaaatatttaccttagggtttctctgtgatcagttgtcattggggccattatttctttttacagttattgtaattatttgttggtacttgtctagttataaaacagtatttgaatatttcaatgaaatgcacaaataactcaatgaggcttttcataatt

SEQ ID NO: 8906 - DNA, 1287 bp, Pinus taeda
gaggatgtcttctttgacctttccagctgaccactgtccatattttgaagcattaatggcgaagaaccggtgaatcttgtcgttcaaggtgccaatctggaggaacctaaaacgcgtgaggcttttctactcaaatatattgaaatctggagtggtctcagattcgaatcaccgaacgaagccggagctttattcaggatttcgtagggaataatggtgaagctgacaatgatagcccgggtcactgacgggcttcctctggcagaaggattggacgacgggcgcgagcagagagatgtggagttttataagcagcaggcgaaatcgttgttcaagaaattatcgcagggccagagcgagccttctagaatgtcaattgaatctggcccctacgtatttcactacatcattgaatctcgtgtctgttatttaactatgtgtgatcgatcttatcccaaaaagctcgcatttcagtaccttgaagatctcaaaaatgagtttgagaaggtgaaccactctcaaattgaaactgtggcgaggccgtatgctttcatcaaatttgatacatttatccaaaagacaaggaagttgtacttagacacccatacacaacggaaccttgcaaagttgaatgatgatctgtatgaagtgcaacagataatgacacggaatgttaaagaagttctgggagttggtgaaaaattggaccaggtcagtgagatgtctagtcggttgtcatctgagtctcgtatatatgccgataaagcaaaggatctaagcagacaggctttaattaagaagtgggcacctgtggcaattgttctaggagttgtctcggtgttgctgtttatgcgaggctacatttggcaatgaatgtaccaaaagtttgtgaattttttctttggggcgagaaagaaagtctcaaagccatttttggttgacaaaattgaagggcagttatcgattgaatttattttttcgctgggttgctactaacttaaacgtgaaatgtattaccttgtgtttgcaagaacctgtcattcaaggaaagagagcatcttagccagtgagccgaagttcacagctttgtatagtatttggaatgattatagtcttagaatcgaatttcatttccaattggagattggatttttatgtcgagtcaagttagcattgaatgcctattgattgtgattttccccatagtattttgtaaacagttaataatgcgcgacactaatttattttctgttatctacaaatgcgaaaaatgatttaggaagtgta

SEQ ID NO: 8907 - DNA, 1723 bp, Pinus taeda
ttcgagcggccgcccgggccaggtacgcggggaccgcccacaatcaagcgaattttttgtttattttaagtgaagtcagacagtggtttgagcttcggtgcgggatacacagatccacgtctgcattgaatgcaaacaaaaatcaagggtggtaacctcgtgtgatccgcggggagaaccgtcaaactaccctcccaaattttggtcccagttgtcgctttgatttgattcgatccagccgttttcgctcctcaattcaaccttcttcgcggtcggaaaggttcaatttggagcatcatcggaccaaattgagaagcattccaagttccagtataaatgcgcaaggggacagccaactgaattcaagctcacgagaccgtatttgccctgttgaagtcttgggttcttttacaagcttcttcagcaacaataataattgactgcagagatggtcaaactgacgatgattgctcgtgttactgatggtcttcctttagcggaaggcttggatgatgggcgggaacaaagagacctggaattttataaacagcaggccaaggcattgttcaaaaaattgtcacacggtcaacatgaaccttcaaggatgtccattgaaactggcccatatatatttcactatatcattgaagctcgtgtttgttacttaactatgtgtgatcgctcttatccaaagaagcttgcatttcagtaccttgaggagctaaaaaatgagtttgaaaagttgtatcagtctcaagtagaaactgttgcaagaccatatgcttttattaaatttgatacatttattcagaagacaaggaaactgtacttggacacacgaacacagcggaaccttgctaaactaaatgatgatctatatgaagttcagcagataatgacacgcaatgttcaagaagtgttgggagttggggagaagcttgatcaagtcagtcagatgtctagtcgtctgtcatcagaatctcggaaatatgctgataaagcaaaagatttaagcagacaggcatttatcaagaagtgggcacctgtggccattgttctgggagttgtttttgtgctcctgtggatgcgatggtatatttggcagtgattttctttcagtcattattacattacctgggtaagagtggagtttagctgctcagaggcagatagtaacaagcaggtaatatttttgagggagggcatttggggtagcattttgttttggcttggttgcttttttttgaatgcaaattcgaaatgaggaaagagagatcttactgagggcaatgaccagttgtatgccgagcttgattggtacaggtgaatgtgaaacaagtttcactatttgatggatgcgatgagtaagattttattttagttgttagaattacaatcttagaggaagataataatattgttctggtcagatagcttagtcatcagggagatgaaattttaaatatttaccttagggtttctccgtgatcagttgtcattggggccattatttctttttacagttattgtaattatttgttggtacttgtctagttataaaacagtatttgaatatttcatttaaatgcacaaataactcattgaggcttttcataattattacttgtgttaccgtgttagtgttttaggtcagggattaagcattttgccttcatgtttcacagtcaagtcctgctattgggattcaaaatattgatgtaat

SEQ ID NO: 8908 - DNA, 1419 bp, Pteridium aquilinum
tatcctctacgtgtaacatctccgtttccgccatagccgcattcttccctctgcggctttccagcttcacagaaatcaacacaggtacggagcgtcttccttctccttgctgagggagattttcttctcagggcatcattttttcgagtttgattccatctcaaagacaagaagagcgtatatagagggagattttcttctctgcgcatcaattctcaaacttgattccatctcaaagacaagaagaacgtaaatagatcatcctctttgtcgcagatcagtgagaaaggttaagcaatcacaggagttaatagggtttttgagcagttttctgcaatcagcttgatctgcaattgttgagatcacggattcagggtggttcttcttgtcagcagtgcttctgttgagatcaacaaattcagggttataacaggaaaatacaggttactgttaaagctttgtccacagagcagagatcaaggggcttcaaagcttgatctggtgatttctacaacctgaagaggccaaatggtgaagcttaccatgattgcacgtgttaccgatggattgccgcttgcagaggggcttgacgatggccgtggagagaaggatctggaatattacaagcagcaggcaaagactcttttcaagaagctctctcagagtcagcatgaaccatctcgcatgtctattgaaactggtccaaatacattccactacatcattgagggtggcgtgtgctacctcacaatgtgcgatcgatcctatcctaaaaagctagcattccaatatcttgaggacctacaaagagaatttgagaaagtcaatcgatctcagatcgagacagttgccagaccttatgctttcattaagtttgatacatttatacaaaagacccggaagctgtacttggatactcgtacacaaaggaatttggcaaagttgaatgacgatttgtatgaagtccagcagataatgacgcggaatattcaagaagttttgggagttggcgagaaactagatcaggtcagtcaaatgtctaatcgcttgacatcggaatctcggatctatgcagagaaggcaaaagatcttagtcgacaggcattgatccgaaagtgggcacctgttgcaattgtcattggagttgtgttgctgctgctgtgggctcgaagatccttttatcaatgagtttatcctgatagttgtcgagatgacagccattccaggccttgaagaattcaagccagaaagataccatttttggggtgtaaaattcagtttgatagctcaagatatatttatcagggaaagttcaaaacagtttgctgaagtcatagcatgtttgtatcatcttccagatctttggcatggggctgtgacatgctcaaacggcagccaccttgtagggggcaaaatttt

SEQ ID NO: 8909 - DNA, 921 bp, Ambrosia trifida
ccccaatttttcgtattctacctaaaacccttatttatttattattatttctaattcttttccttgtcgcttgtagatccatacgcatgtttattagctgacattcaaagtgacagcttgagaaaagtaaagtaaagtaaagatggtgaagctgacaatgatcgcacgtgtgatagatgggcttccgttagcagagggacttgatgatgggcgtgacatgcaggatgcagagttctacaaacaccaagttaaagccttgttcaagaatctttctaggggccataatgatgcctcccgaatgtctcttgaatccggcccttatgttttccactatattattgaagggcgagtttgttatttaacaatgtgtgatcgtgcttatccgaagaaacttgcattccaatatcttgaagatcttaagaatgaatttgagcgtggttatggaaaccaaattgaaactgctgcaagaccgtatgctttcataaagtttgatacatttatacagaagactaagaaattgtaccaggacacaagaactcaaaggaacattactaagttgaatgatgaactttatgaagttcaccaaataatgactcgtaacgtacaagaagttcttggtgttggtgaaaaattggaccaggtcagtcaaatgtcaagccgcttaacatcagaatctcgcatatacgctgataaagcaagagatctaaaccgccaggctctgatcaagaaatgggctcctgttgcaattgttcttggagttgttattctactgttttgggccagaaagaagatatattgagcattggtttcatttgtagcatggaaatacggttatggttcgccgaggttcagttacagagttttaagttaattttccttgcactcttaagttacattatccattttcaccttcaacttgaa

SEQ ID NO: 8910 - DNA, 1650 bp, Pseudotsuga menziesii
cacggttaaggaaaaatctcaacacttgcttaacaatcccgcaaagaataattttttttggtttataaaagcatagccggatcgcggtttgagcctcggtgctcgatacagagatccacgtccacattgaatgcaaagcaaaattaacggtggtagcctcgtgttatccgcggagaaccatcgaactacccttccatattttcgtcacagttgtcgctttgatttgattcgatctagtagtcttcgctcttcaatttaaccctattctcggtccggaagattcaatttcgaggaacatcgaaccaaattgagaagcgttccaagtttcagtataaatacgcaagggaacagcccactgaattcaagctcaagagaccgattttccctgctgcaagacttggttcttttacatgcttctttagacacgggaagttggtaacacttgactgcagagatggttaaactgacaatgattgcccgtgttactgatggtcttcctttagcggaaggcttggatgatgggcgggaacaaggagacctggatttttataaacagcaggccaagtcgttgttcaagaaattatcacagggtcaacatgaaccttcgaggatgtcaattgaaactgatccatatgtattccactatatcattgaagctcgtgtttgttacttaactatgtgtgaccgctcttatccaaagaagcttgcatttcagtaccttgaggagcttaagaatgagtttgaaaagttgtatcagtctcaagttgaaactgttgcaagaccatatgcttttattaaatttgatacatttattcagaagacaaggaaactgtacttggacacacgaacacagcgaaaccttgccaagctaaatgatgatctgtatgaggttcagcagataatgacacgcaatgttcaagaagtattgggagttggggagaagcttgatcaagtcagtcagatgtctagtcgtctgtcatcagaatctcggaaatatgctgataaagcaaaagatttaagcagacaggcctttattaagaaatgggcacctgtggccattgttctgggagttgtgtttgtgttcctgtggatgcgcatgtatatttggtagtgattttctttcaggcaggcattattacaataactgggtaagagtggagtttagctgctcatagaggcagatagcaacaagaaggtaatctttttgagggaggctattcagggttgcattttgtttttgctcggttgccttttgattgaatgcaaatggaaagagagttcttagccagggcaatgaccagtagtacgctgagctgtgattggtacaggtggacatgaaatcagtttcactttcagatagatgagatgagtaagattttattttaattgttagaattacagtgatagagtaagataataatattgttttggtcgggtagctgactcatcagggagatgctgttttaagtttttacctcgagagtttctctgtgatcgtttgtcattggggcattatttccttttaaaattattgtaattatttgttggtcttgtctagttataaattcgtatttgaattttcaatcaaatgcacaaacaactctgaggactttcataattactatctgtgttaccatgtcagtattttat

SEQ ID NO: 8911 - DNA, 1561 bp, Picea glauca
atagcggtttgagcctcggtgctcgatacacagatccacgttctcattgaatgcaagcaaaaatcaagggtggtaacctcgtgtgatcgggggataaccatcaaaccaccctcccaaattttggtcccatttgtcgctttgatttgattcgatccagcagttttcgctcgtcaattcaaccttactgtcggtcggaaaggctcaatttggagcaaaatcggaccaaattgagaagcgttccaagtttcagtattaatacgccagggaacatcccactgtattcaagctcaagagaccgaatttgccctgttgaagacttggttcttctacaagcttcttcagccacagcaatagttggctgcagagatggtcaaactgacaatgattgcccgtgtaactgatggtcttcctttagcggaaggcttggatgacgggcgggagcaaaaagacctggaattttataaacagcaggccaagtcgttgttcaagaaactgtcacagggtcaacatgaaccttcaaggatgtcatatgaaaccggtccatttgtattccactatatcattgaagctcgtgtttgttacttaactatgtgtgaccgctcttatccaaagaagcttgcatttcagtaccttgaggagcttaagaatgagtttgaaaagctgtatcagtctcaagtagaaactgttgcaagaccatatgcttttattaaatttgatacatttattcaaaagacaaggaaactgtacttggacacacgaacacagcggaaccttgccaaactaaatgatgatctgtatgaggttcagcagataatgacacgcaatgttcaagaagtgttgggagttggggagaagcttgatcaagtcagtcagatgtctagtcgattgtcatctgaatctcggaaatatgctgataaagcgaaagatttaagcagacaggcctttatcaagaagtgggcacctgtggccattgttctgggagttgtttttgtgctcctgtggatgcgaaggtatatttggtagtgattttctttcaggcattattacattaactgggtaagagtggagtttagctgctcataaaggcagatagtaacaagaaggtaatatttttgagggaggccattcagggtagcttttgttttggcttggttgcctttttattgaatgcgaatgcgaatttgaggaaagagagatttgactgagggcaatgaccagttgtatgctgagctgggattggtacaggtggatgtgaaacaagtttcactattagatgggagatgagttagattttattttagttgttgtaattacaatcttagagtaaataatattgccctggtcaagtagccgattcatcagggagatgaagttttaaatttttaccttagagtttctctgtgatcagttgtcattggggccattatgtctttttataattattgtaattatttgttggtcttgtctagttataaattagtatttgaatatttcaatcaaatgcacaaataactcaatgaggcttttcataattaatacttgtattaccatgtcagtattt

SEQ ID NO: 8912 - DNA, 1023 bp, Ambrosia trifida
gtctcatctcatctgttttatttgtatttgtttattataccgtatccccaattttccgatcaccaaaaccctattattattattattttattcattgtcgcttgtagatcgtccttagatccatacgcatgtttactggttttaattctcagtgacagcttcttcagaaaagtaattaagtaaagatggtgaagctgacaatgatcgcacgtgtcatagatgggcttccgttagcagagggacttgatgatgggcgtgacatgcaggatgcagagttttacaaacagcaagttaaagccttgttcaagaatctttctaggggacataatgatgcctccaggatgtctcttgaatccggcccttacgttttccactatattattgaagggcgagtttgttatttaacaatgtgtgatcgtgcttatccgaagaaacttgcgttccaatatcttgaagatcttaagaatgaatttgagcgtggttacggaaatcaaattgaaactgctgcaagaccgtatgctttcataaagtttgatacatttatacagaagactaagaaattgtaccaggacactagaactcaaaggaacatttctaagttgaatgatgaactttatgaggttcaccaaataatgacgcgaaacgtacaagaagttctcggtgttggtgaaaattggaccaggtcagtcaaatgtcaagccgcttaacatcagaatctcgcatatacgctgataaagcaagagatctaaaccgccaggctttgataaaaaaatgggctcctgttgcaattgttcttggagttgttattctactgttttgggccagaaagaagatatattgatcatggtttcatttgtagcatggaaatatggttatggttcaccgagtttcggtttacagagttttaagttaattttccttgcactctcaagttacattatccatttgcaccttcaacttgaaagttttgtctatgtgctatttacatttaagcaagtttaatctattcacaatcttgacaaa

SEQ ID NO: 8913 - DNA, 1271 bp, Pinus pinaster
cgaattctggcttgaggttgcctactttgacctttccagcctgaccaatgtacatactttgaagcattaatggctaagaaccggtgaatcttgtcgttcaaggtgccaatctggaggaacctaaaacgcgtgaggcttttccactcaaatatattgaaatctggagtggtctcagattcgaatcaccggacgaagccggagctttattcaggatttcgtaggggataatggtgaagctgacaatgatagcccgggtcactgacgggcttcctctggcagaaggattggacgacgggcgcgagcagagagatttggagttttataagcagcaggcgaaatcgttgttcaagaaattatcgcagggccagagcgagccttctagaatgtcaattgaatctggcccctacgtatttcactacatcattgaatctcgtgtctgttatttaactatgtgtgatcgatcttatcccaaaaagctcgcatttcagtaccttgaagatctcaaaaatgagtttgagaaggtgaaccactctcaaattgaaactgtggcgaggccgtatgctttcatcaaatttgatacatttattcaaaagacaaggaagttgtacttagacacccatacacaacggaaccttgcaaagttgaatgatgatctgtatgaggtgcaacagataatgacacggaatgttaaagaagttctgggagttggtgaaaaattggaccaggtcagtgagatgtctagtcggttgtcatctgagtctcgtatatatgcccataaagcaaaggatctaagcagacaggctttgattaagaagtgggcacctgtggcaattgttctaggagttgtctcggtgttgctgtttatgcgaggctacatttggcaatgaatgtaccaaaagtatgtgaatttttttctttggggcgagaaagaaagtctcaaagccatttttggttgacaaaattgaagggcagttattgattgaatttattttttcgctgggttgctactaacttaaatgtgaaatgtattgtcttgcgtttgcaagaacctgtcattcaaggaaagagagcatcttagccagtgagccaaagttcacagctttgtatagtatttggaatgattatagtcttagaatcgaattttattccaattggagattggatttttatgtcgaatcaagttagcattgaatgcctattgattgtgattttccccatagtattttgtaaaaagttaatgatgtgcgacactaatttatttctgttatcta

SEQ ID NO: 8914 - DNA, 1076 bp, Ambrosia trifida
atttggggaaatttagtattattcttcttctgcgtttcttggtgtagtctcatccccaattttcgatcaccaaaaccctattattattattattcaattcttttccttgtcgcttgtagatccatacgcatgtttattagctgacattcaaagtgacagcttgagaaagtaaagtaaagtaaagatggtgaagctgacaatgatcgcacgtgtgatagatgggcttccgttagcagagggacttgatgatgggcgtgacatgcaggatgcagagttttataaacaccaagttaaagccttgttcaagaatctttctaggggccataatgatgcctcccgaatgtctcttgaatccggcccttatgttttccactatattattgaagggcgagtttgttatctaacaatgtgtgatcgtgcttatccgaagaaacttgcattccaatatcttgaagatcttaagaatgaatttgagcgtggttatggaaaccaaattgaaactgctgcaagaccgtatgctttcataaagtttgatacatttatacagaagactaagaaattgtaccaggacacaagaactcagaggaacatttctaagttgaatgatgaactttatgaagttcaccaaataatgactcgcaatgtacaagaagttcttggtgttggtgaaaattggatcaggtcagtcaaatgtcaagccgcttaacatcagaatctcgcatatacgctgataaagcaagagatctaaaccgccaggctttgatcaaaaatgggctcctgttgcaattgttcttggagttgttattctactgttttgggccagaaagaagatatattgatcatggtttcatttgtagcatggaaatatggttatggttcaccgagcttcagttacagagttttaagttaattttccttgcgctcttaagttacattatccatttgcaccttcaacttgaaagttttgtctatgtgctatttacatttaaacaagtttaatctattcacaatcttgacaaacccttacttctatgttggtatacacatattatttctgcaatgttaatgaatccctt

SEQ ID NO: 8915 - DNA, 1353 bp, Abies balsamea
tggtttgagcctcggtgctcgatatacagatccacgtccgcattgattgcaagcaaaatcaacggtgttaaccatcaaactaccttcccaaattttagtcccagttgtcgcttggatgtgatccgatccagaagtcttcggtcgtcaattcaaccttatttttggttcggaaaggttcaatctggagcaacattgaaccaaattgagaagcgttccaagtttcagtataaatacgcaaggggacagctccctacattccagcccaagagaccggattttccctattgcaagatttggttcttctacaagcttcttcacccacaataacagttgactgcagagatggtcaaactgacaatgattgcccgtgttactgatggtcttcctttagcggaaggcttggatgatgggcgggaacaaagagacctggaatattataaacagcaggccaagttgttgttcaagaaattgtcacaggctcaacatgaaccttcaaggatgtcaattgaaaccggtccatatgtattccactatatcattgaagctcgtgtttgttacttaactatgtgtgaacgctcttatccaaagaagcttgcatttcagtaccttgaggagcttaagaatgagttcgaaaagatgtatcagtctcaagtagaaactgtcgcaagaccatatgcttttattaaatttgatacatttattcagaagacaaggaagctgtacttggacacacgaacacagcggaaccttgccaagctaaatgacgatctgtatgaagttcagcagataatgacacgcaatgttcaagaagttttgggagttggggagaagcttgatcaagtcagtcagatgtctagtcgactgtcatcggaatctcgaaaatatgctgataaagcaaaagatttaagcagacaggcctttatcaaaaagtgggcacctgtggccattgttctgggagttgtttttgtgctcctgtggatgcggaggtatatttggtagtgaatttctttatggcattattatattaactgggtaagagtggattttagctgctcataaaggcaaatggtaacaagaaggtaatctttttgagggaggccattcaaggtagctttttgttttggcccagttgccttttaattgaatgcaaatgtgaattgagtaaagagagatcctactaagggcaatagccagctgtatgctgagctgtgattgtgagatgagtaaggttttattctagttagaattacaatcttagagtgagataataatattgtcctgttcaggtagttgattcatcggggagatgaagtttaaattttaacttgtttatatgtgatcggttgtcattga

SEQ ID NO: 8916 - DNA, 937 bp, Ambrosia trifida
cgtacgggggcggtttctttggttgttagttcttctaatcccttaatatttcgtaattctactaaaacccttatttatttatttatttctaattcttttccttgttgcttgtagatccatacgcatgtttactggtttaaatcctcagtgacagcttgagaaaagtaaagtaaagataagatggtgaagctgacaatgatcgcacgtgtgatagatgggcttccgttagcagagggacttgatgatgggcgtgacatgcaggatgcagagttctacaaacaccaagttaaagccttgttcaagaatctttctaggggccataatgatgcctcccgaatgtctcttgaatccggcccttatgttttccactatattattgaagggcgagtttgttatttaacaatgtgtgatcgtgcttatccgaagaaacttgcgttccaatatcttgaagatcttaagaatgaatttgagcgtggttatggaaaccaaattgaaactgctgcaagaccgtatgctttcataaagtttgatacatttatacagaagacaaagaaattgtaccaggacacaagaactcaaaggaacattactaagttgaatgatgaactttatgaagttcaccaaataatgactcgtaacgtacaagaagttcttggtgttggtgaaaaattggaccaggtcagtcaaatgtcaagccgcttaacatcagaatctcgcatatacgctgataaagcaagagatctaaaccgccaggctttgatcaagaaatgggctcctgttgtaattgttcttggagttgttattctactgttttgggccagaaagaagatatattgagcattggttcatttgtagcatggaaatacggttatggttcgccgaggttcagttacagagttttaagtaattttcctgcactcttaagttacattatcct

SEQ ID NO: 8917 - DNA, 1357 bp, Pseudotsuga menziesii
cgggctgatgtcatttgatcggagattcggaacatgaagtcggagttccattctatgcccgggattttaaggtggtctactttgacctttgcaacttgactactgtacgccttttgaagcattaatggcgaagagtccgtaaatcttattgttcaacgatcacacaaattgccaaaaactggaggaacctgaaacgcgaggggcttttcttttctaacagattgaaatctgtagcggtcgcaggttcgaatcacggaacaaagcctgggatcgattcacgattttgtagggaataatggtgaagctgacaatgatagcccgggttacagatgggcttcctctagcagaaggattggacgacgggcgcgagcagagagatttggagttctacaagcagcaggcgaaatccttgttcaagaaattatcgcagggccagaacgaaccttccaggatgtcaattgaatctggcccctttgtgtttcactatatcattgaatctcgtgtttgttatttaactatgtgtgaccggtcttatccaaaaaagcttgcatttcagtacctggaggatctcaagaatgaatttgagaaggcgaaccactctcaaatagaaactgtggcaaggccctatgctttcattaaatttgatacatttattcaaaagacaaggaagctgtacttagacacccatacacaacggaacctggcaaagttgaatgatgacctgtatgaagtccaacaaataatgacacggaatgttaaagaagtattgggagttggtgaaaaattggaccaggtcagtcagatgtctagtcggttgtcatctgagtctcggatatatgctcataaagcaaaggatctaagcagacaggccttaattaaaaagtgggcacctgtggcaattgttcttggagttgtcttggtgatgctgctaatgcgaagctacatttggcaatgattgtaccaaaaagatgcgattttttctttggggtaggaaagaaggcctcaaagcaattttggttgacaaaattgaagggcagatatcaatcgaattttatttttttcgctgcgttgctgctaacataatgtcaaatgtattatcttgcgcttgcatgaacttgtcataaagaaaaagagcgtctagccaatgagccgaagttcactgatttgtattgtatttgggatgagtacggtcttcgaatcgagatttcatttccacttggaggatggatttttatggtcaaatcaatttagcattggactcctattgattgtgtatttttatccccataatattttgtaaacagtgaatgatacgtgacactaatttcttttccgttacctataaatagcaaaacgt

SEQ ID NO: 8918 - DNA, 1004 bp, Chrysanthemum coronarium
gcaagatgtagacttctataaaaagcaggaacagtcgtacgttattttttatcatcgataagcaggtgtatggagtccatattgcttcaccttatctgcgcaaaatagccaatttttagtaagtagctcatagcttctcaaagtaaagatggtgaatctgacgatgattgctcgtgtcactgatggccttccattagccgaaggattgactgatgggcgtgatatgcaagatgtagacttctataaaaagcaggttaaggccttgttcaagaacctttcgagaggacacaatggagcttctcgaatgtctgttgaaaccggcccttacttgttccactatattattgaagggcgagtatgttatttgacaatgtgtgatcgggcttatcctaaaaagcttgcttttcaataccttgaagatcttacgaatgaatttgagagagggtatgcggatcaaattgaaaccgtagcaagaccttatgcttttattaaatttgatacatttatacagaggactaagaaattgtatcaggacacgagaactcaaaggaatatttccaagttgaatgatgagctttatgaagtacaccagattatgacccgtaatgtgcaggaagttcttggtgttggtgaacagttggaccaggtcagtcgaatgtcaagccgattaacttcagaatctcgtatctatgctgacaaagcaaaagatctaaatcgacaggccttgatccggaaatacgctccagttggaattgtccttacagtagtcattctactcttctgggtcagaaacaagatatggtgattctgagaaaccatcttcctaaattccaatgtttttaggcgcttaagttaattgttcttgcactagttatcaatacaagaaattatgtgagccacgaaacggaaattgtagtttatgagcagcatagttgctagatatatttagtaacttaaaggaaaatgttttcactttatcttgtgatataatggatttatgcaat

SEQ ID NO: 8919 - DNA, 1550 bp, Picea glauca
cgctgatgtcatttgatcggaacctaaggtctaaggttcgatttctaggcttaaggtggtctactttgacctttccagcttgaccactgtatatctgttgaagcattaatggcggagaatcagtaaatcttgtcgttcaacaaccgcagaaagtgccaaatctgggggaacctaaaacgcgagaggcttttttattcaaacagactgaaatctggggtggtctcacgttcgaatcactgaacaaagccggagcgcaattcaggatttcgtagggaacaatggtgaagctgacaatgatagcccgggtcaccgacgggcttcctctggcagaaggattggacgacgggcgtgagcagagagatgtggagttttataagcagcaggcgaaatcgttgttcaagaaattatcgcagggccagaacgaaccttctagaatgtcaattgaatctggcccctatgtatttcactacatcattgaatcacgtgtttgttatttaactatgtgtgaccgatcttatccaaaaaagctcgcatttcagtacctggaggatctcaagaatgagtttgagaaggggaaccactctcaaattgaaactgtggcaaggccctatgctttcattaaatttgatacatttattcaaaagacaaggaagctgtacttagacacccatacacaacggaaccttgcaaagttgaatgatgacctgtatgaagtgcaacagataatgacacggaatattaaagaagttctgggagttggtgaaaaattggaccaggtcagtgagatgtctagtcggttgtcatccgagtctcggatatatgctcataaagcaaaggatctaagcagacaggctttaattaagaagtgggcacctgtggcaattgttctaggagttgtcttggtgatgctgttaatgcgaagctacatttggcaatgaatgtaccaaaaagatgtgaattttttctttggggcaagaaagaaagcttcaaagccatttttggttgacaaaattgaagggcagatatcaattgaatttttattttttcgctgggttgctactaacttaaatgtgaaatgtattatcttgcgcttgcaagaacttgtcatccaaggaaagagagcatctagcaaatgagccgaagttcacagctttgtatttgtatttgggatgagtttggtcttagaatcgagatttcatttccaattggagattggatttttatgtcaaatcaatttagcattggattcctatttattgtgattttttccccatagtattttgtaaacagttaatggtgcaagacactaatttcttttctgttatctacaaatacgaaaaagactttaggcagtgtacatcacacacacaatatattcttattgctttctatcactggcatcactgtttgcttcctgcagttgtcaatttctctggctcaagtgcacaagagttcataaaattatttaaacatttgatgagttccttttggagttcttccagcctcctcagtggctacaactgaaaacataattctgaaaggagaatttc

SEQ ID NO: 8920 - DNA, 4796 bp, Secale cereale
gacctctacctcctgcaggatagcgggcaccgaggtccccatcacgggctcggacaagctgcggtggatcgacctcaccgtcccctcacccccctcccagcgccggcgagccccgccgacccattcgtctccgtgcccccgggcgccgcctcggggtgccacgtcgtgtcctccggccgcgactcccaacgctacctcgcctggaggattcacgaagaacaccaaaatgtgctagaggtcattgaactctgtgctttgaaggagttcccaagctctggactgcgtttggtattccaggaggcgctatgtccattcgcttttatgtgtgaaagtgagggtgccaggcgaggcgagtctgtatatctgctatatgtgctcactatttctggagttgctattctgtgcaacttgcgcagcccattttcctatgtatctggttcaatactgtctcaaaatgacataattggatttaatcttcaaaccacacacagagtcctaaggttacggctgttaaagcgaagccaggatgtctagtaattgggcggcaagatgggtcaatctgctgttacagtcttggcaaattagctcctagttcaccaggtttctctaatgagctccgtgatgatgctggaatcgggcgtttgtggactctcatgtcgagaacaaaggctctggggcctgtacaagatattgacacagctactgtaaatgaaagggagctgttatttgttcttcatctggatggaagtttgcgtgtctgggatatttctagtcagacgaaacttgttaattataatgttcacttggatgattttgaagggcaaccctctaggctatgggttagtgacgctgatgatgatcaagagctgatatccttggctgttctgcaccaagggactgtggttccagcttgtgatcatattggtgtatatgccttcagttttggtgctggcgaaagattcttgttgtctcctgaaccttcggtttctgctgtacctttgctagagggaaaaattgttgatttgaaaataagcatggaaaagctttggatacttaaagaagttggaccaatgctctatgaaatagtgcagtataactctgatagtgaggaaatatgttcatatgtgctacaagaagacgctatcagtgagcaaatgttccaaagttctgagagtgcattggacgatttggtttggactgctgattcagtattctcatctatgaaggagcatagtttcagttttatctcatccatgtttctgcggaggctgctgcaaccaggagtgaaccactgttctgctctccgcaaaaccttattggagtacaaaaggtttctatccgattctgagtatcagtcgcttacaactagtgggctacggaaagaaatattatccattatagaacaagagggaaattcacaggtcgcaagttctactgtttatcactggaaaaagttttctgcacggtatctccacaactggtgctggaataatagaccatatgggttgcttcttgatacgaacaatgatgtgtttggtttaattagaaagggttcattttctctcttccgttgtttggagggcgtggagcaacttatttatggttcctctgatgacttgggaaatctcattggcctcgggatgaacttatcgaatgatactgacggtgaaacccttattgaagttctcaggtgcatgggccatataaaccatttgcttgggagatcttctgctgcaatatattacgagtccctcatcagttctgttatatcaccagatgaagttacttctcagatattaaagattctagagagtgggttcagtccccaatcttcgtcgcccctcattacattgtttggaacagatgcttatgtagaaagaaggcagacggctcacaaaagccaaaggaagttttctgttgagatgctactatctttccataagttgcaatcaagatccacatcctggtcggctgtatttgatgtgattgataagttcatgaagtgtttggatacaaaggtcactacacaagagtttgaattgagaagactttgcaatgtaaattctgccttagtggttcaggctacttcacaggttgcaagaaccatgtttgaggctgcttttgatctatttctgttcctcagttatttggttggtgtcggtgggcaggtctccttgctgcaaagcgatgttgctagaatcaaactgcagttgtttccaatgattcaagacatattgggacagtggatcgttctccattttgtgggaatttcaccaaccacaccaccaaccatcgaggatttcagctatcaactttcttccctccagctaggtatagccgatgagctgtctttgcacagaaagcttggatcctctgattttacattggcttgtttgcttgattttcctaaatcttcggaaggggatgatctgtcaccttgttttcctagtccaaccgaggtgatcaacttggtcaggaggtttagcagttcgattatgtgcagaaatagtgttgaccgtgtagacagcttcttgggttccacaataaatctggcagcagttttcatccgacatggtcaatatgaagctgctcagagtctgctgggcattcttgaaacatacttgggctatgcgagagcatcccaacctgatcaggatattgatattgcatgtttggctcgcctacatctcagtggattttgccttttgatgcttgcacatgatgaagcaaacattgttttgagagaatccaaggttcaggaagctatcagatgcttctttagagctgcatctgggcaagaagctccgaaggcgctgaagaagttctcttcagaaacagggtttcaaatttccggggtgtgtagatctatttctttatggaggcttcattactacgagtgggcaatgcaaatttttgagcaaaactcaatgagggagggagcatgccagtttgctctcgctgctcttgaacaagttgatagcattgatgatttggacaatggaagtgaagtcgaggatctcccagagactacagcgatgattaaaggacgactatgggccaatgtattcaagtacagcttggatttgaaaaactttcgagatgcgtattgtgctataatctcaaatccagatgatgatagcaagtatgtctgcttgaggcgtttcatcatagttctttgtgagcttggcgagactaaggtcatttgcaatggtgagataccgttcactggtttggtggaaaaggtggagcaagagctcttctggaaggctgagcgctcagatctatcttctaaaccaaatctatacaaagtcctttattcatttgaagcttataggaacaattggaggaaggcagctgcatacatgtacaggtattttgttagattgggtagagagggggatgcaggtggaggccgccaactcactcacgtattacaagagaagttgcatgctttgtctactgctatcaactcgttgcagcttgttgaaccctcatgtgcctggctcgattcggtttgtgaagctgatgatcaaatttcgccaagcaaaaagcctcgtaatcttttgatggagaactctgcttttggcacagattcagaactctctacattacagttttgtgttgacattgaaattcttgaaaaggaatacacactaacagaagcactttatatgcttagtgctgtaaattctaaatccaaattttctgaaagctattctatcgaagccttgacggacattcttgtaaatgagaatttgtatgacctggcattcaccatcgtgctgaaattttggaaggagtcaggaatgaaaagagaattggagcgtgtctttgcagctattgcacagcaatgctgcccaaacagagtaggcaactcagggagaaatttgactgacactcaacagctgctacttctgccttcttccgaggatgatggatgggatggcaataacaagactattgctgtggcccatcaagtgcagggaagttgccagtgggaaactcttgaactatatttggataaatataaagatttgcatccgaggctgcctgtcattgttgctgaaacacttctttacactgatcctgagattgagctacctctttggctggttcagatgttcaagaccaccaagggtggaaataggatgatttcatggggaatgtccggcaaagaggcagatccagctgcattatttcgactatatacaaattatggccggcacacagaagcagccaacttgttggtggagtacctggattcttttgcttcatcgagaccgatggacgtgctgcaccgcaaaagatgtcggccgcctggttcccgtacaccactgtcgagaggttttggtgtcagcttgaagagatgcaaagtgctggccacagtgctgatcagtgtgatcggctcaagaagttgctacatggagccctgatgaaccacctgcaacaagtggtcgtcgattcagaagacgtactgtcatcagttggagggcgtcaaggagtggagagccaaagcagctgagatcttgttggtcgtggattacacagtccaagcattgttgtatcttgtatgtaggttttgtatgttctcttttcagaaccgtaggctctgtatggctgatagtgtctatgtgggacgtttgacagaaaatggttaggacagctgcctgctaatgttcgtctccgtggaggacggactgatgttccgtatgtaatgtgaatatatgcatggcaggttaagttccatgtcgtttggttgatgatggatggatggtaagaccaaaaaaaaaaaacta

SEQ ID NO: 8921 - DNA, 5053 bp, Brachypodium distachyon
ctcaaaatttctccgagctttcccccacatcgccgcccaaaacccacactgcccgaccaaaaccctccccggccggcctccttcccgccgccgacggcgaggtctccatggcgacccccgcccccgcccccgcctcccgcaggatagcgggcaccgaggtccccatcacaggctcggacaagatacggtggatcgacctcaccgtcccttcctcctcctccgcgccggagagcgccacggacccattcgtctccgtgcccccacgcgctgcctcggggtgccacatcgtgtaccccggcagcgattcccagcgctacctcgcctggaggattcatgaggaacaccaaaatgtgctagaggttattgaactctgtgcttccaaggagtttcccagctctggactgcggttgatatttgaggaggagctatgcccattcgcttttatatgcgaaagtgagggtgccagaagggacaagtctgtatatttactatatgtggttactgtttctggagttgctttcttgtgcaacttgcacagcccattttcctatgtatctggctcgatactggctcaaaacgatatagtggaatttagtctccaaaccctcacacagagtgccaaggttacagctgtaaaagcaaagcctggatgtctggttattgggcgccaagatgggtcaatctgttgttacagtcttggcaaagtagctccttgttcaccaggtttctcaaatgagctccgtgatgatgctggaatcgggcgtttgtggactctcatgtcaagaacaaaggctgtgggacctgtgcaagatatagagacagctattgtaaatgaaagggaactgttgtttgttcttcatttggatggaagtttgcgtgtatgggatatttttagtcacacgaaagttcttaattataacgttcagtcgaatggttttgaagggcaaccctctaggctatgggttggtgaggccgatgatgatcaagagctgataactttggcagttctacatcaaggcactgtggttccagcttgtgatcgtgttgctgtatatggcttcagttttggtgccggagagaagttcttgttatcccctgagccttcagtgttcgatgtacctttgctggagggaaagcttgttgatttgaaaataagcacagaaaagctttggatacttaaagaagttggaccaatgctctatgaaatagtgcagtatgacactgatactggggaaatgtgttcatatgtgcttcaagaagatgctatcagtgagcaaatgttccaaagttctgagagtgcattggatgatttggtctggactgccgattcaatattctcttctacgaaggagcatagtttcagttttatctcatccatgtttctgcggaggctactgcaaccaggagtgaaccactggtgtgctcttcgcgaaaccttactggagtacaaaaggttcctatcagattccgagttccagtcactcacaactagtgggctagggaaagaaatattatccattatagaacaagaggaaagttcacagactgcaagttctactgcttatcactggaaaaagttctctgcccggtatctccacaactggtgccggaacaatcggccatatgggttgcttcttgacactaacggtgaagtgtttggtttaattagaaagggttcattttctctcttccgttgtttggagcgtgtggagcaacttatttatggtttctctgatgaattgggaaatctcaatggccttgaattgaccatattgagtgaaaaatctgaaaccgaaatcctcattgaagttctcacatgcatgggccatattcaccatttgctggggagatcttctgctgcaatatatcacgagtccctcatcagttctgtcatatcacttgatgaaattgcttctcagatactaaagattctagaaacgggtttcagtcctcaatcttcgtcagccctcattgcattacttggaacagatgcttatgtagaaagaaggcagatagctcacaaaagccaaaggaaattttctgttgagatgttactatcgttccagaagttgcaatcaagatccatatcctggccagcagtgttcgatgtgattgagaggttcatgaagtatttgaacacagagttaaccagacaagagtgtgaatcaaagagagtttgtaatataaattctatgttattagttcaggctacttcacaggttgcaagaacaatgtttgagtctgcttttgacctatttctgttcctcagatatctggttggtgtcggtgggcaggtctccttgttgcaaagcgatgctgctagaataaaattgaaattgttgccaatgattcaagacatattgggacagtggattgttctccattttataggaatttcaccaaccatgccaccaacaatcgaggatttcagctatcaactctcttctctccagctaggtatagctgatgagctgtctttgcacagaaagcttggctcctctgattttacattggcttgtttgctcgattttcctaaatctgctgaaggggatgctctgtcaccatgttttcctactccagccgaggtgatcaacttggtcaggaggtttagcagttcaattatgtgcagaagtaatgttgaacatgtagacggtttcttggatacctcatgggtacacagtttcttgggttccacaatcaatctggcagcactttttgtccgtcatggtcaatatggagctgctgagaatcttctgggcattctcgaaacatactggaacaatggaagagcatcccaaactgacaaggatactgatattgcaagtttggcacggttacatctcaacggattttgccttttgatgcttgcacatgacgaagcaaatatcgttttgaaagaatcgaaggtccatgaagctatcagatgcttcttcagagctgcatctggacaggaagctccaaaggctttgaagaagttttcttcagaaacagggtttcaattttccggggaatgtagatccatttctttatggaggcttcattactacgaatgggcaatgcaaatttttgagcagcactccatgagtgagggagcatgccagtttgctcttgctgctcttgaacaagttgatagcattttttatttgaacaatggaagtgatgccgaggatcttccagagactgcagcgatgattaaaggacgattatgggcgaacgtattcaaatacagcttagatttgaaaaagttccatgatgcatattgtgctataatttcaaatacagatgaagatagcaagtatgtctgtttgaggcgtttcatcatagttctttgtgagcttggcgaaacaaaggttatttgcagtggtgagataccattcactggtttggtggaaaaagtggagcaagagctcttctggaaggctgagcgctcggatctatcttccaaaccaaatctgtacaaggtcctttattcatttgaagcctataggaacaattggaggaaggcagctgcatacatgtacaggtattttgttagattgagtcgggaggggaatgcaggtggaaccctccaactttctcatgtattgcaagagagattgcatgctttggctgctgctatcaactcgttgcagcttgttgatccctcatctgcctggcttgattcggtttgtgaagctgatgatcaaatttcacccagcaagaagcctcgtaatcttttgatggagaactctgcttttggcacagattcggagcgctctcgattgcaattttgtgttgacattgaaattcttgagaaggaatatacactaacagaagcactttatatgcttagtactgtaaattctagatccaatttttctgaaagctattctattgaaaccttgacggatattcttataaatgaaaacctgtatgacctggcattcaccattgtactcaaattttggaaggattcaggaatgaaaagagaattggagcgtgtctttgcagccattgcacagcagtgctgcccaaataaagtaggcaattctgggagagatttgaccggcagtcaacagctgctgctgctgccttcttcccaggatgacgcatgggatgacaataataagagtattgctgtggcccatcaagttcggggaagttgccagtgggaaacccttgaaatatatttggataaatataccgatctgcatccgaggctgcctgtcattgttgccgaaacacttctttacactgatcctgagattgagctacctctttggctggttcagatgttcaagacttccaagggcggaaacaggatgatttcgtggggcatgtctggcaaagaggcagatccagctgcattatttcgactatatataaattatgggcggcacacagaagcaaccaacttgttagtgcagtacttggattcgtttgcatcatcgagaccggtggatgtgctccaccgcaaaaaaatgtctgctgcctggttcccgtacaccacaatcgagagattttggtcccagcttgaagagatgcaaagtgctggccatagtgttgatcagtgcgacaagctcaagaagttgctacatggagctctgatgaaccacctgcaacaagttgtcgttgactctgaagatgtgctgtcatctgttgggggaggtcaaggaacggagagccaaagcagctgagatcatgttcgttgtggattagtcgggttacacactgttgtatcttgtatttagttggtgtattattgtctctaggagacccctctgccagaaaatgcttattgttcgtctctgtaggcgatgctctgttttgtaatgtgaatatgggtagtatgttcaagttcaatgttggttggttgatggccaatgatgtcccagtaagagttttgatcacaggaactagtccagagatgaaaaggacgcggtgtcgcctaaactgactgattttttaaccatttgaatttgtgaaacttccaatttagaagtccatattctgattgaagatacactctgattgtaggccacattcaaatatgcttatgataattaaagggacg

SEQ ID NO: 8922 - DNA, 4870 bp, Setaria italica
gctcccaactcatcacgctccacctcgccgcccaaaaaacccactctctccaaaaccctctttcccgcggccgccgccggcgacgacggcgacggcgaggcagctatggccgcccccgccacccgaaggatcgttggtgctgaggtccccatccccggttctgacaaactgcggtggatcgacctcaccgtcccctcctcctcacccgcgccggcgggctccgccgatcccttcgtctgcgtgcctccgcgcgccgcctcgggatgccatatcatccctttgggagattctcagtgttacctctcgtggaggattcacgaggaacacctaaatgtgctagaggtcattgaacttggcgcttccaaggagttccctagctctggactgcggttggtcttccaggaggcgctatgtccatttgcctttttatgtgaacgagagggtcacaggcgaggggagcttgtatatatgttatatgcgcttactgtttctggggttgctatcttgtgccacttacgcagcccattttcttacgtatctggttcagtactgcatcaggatgatatagttgagtttagtctccaaactcatgctcagagtgcaaaggttacagcagtaacagcaaagccaggatgtatagtgattggtcggcaagatgggtccatctgttcttacagtcttggcaagttagctccaaactcaccaggcttcttgaatgagctgcgagatgatgctgggattgggcgtttatggactctcatgtcgagaaccaggactgtgggtcctgtgcaggatatagtggtaactgtcgtaaatgaaagggacctgttatttgttcttcatttagatggacatttgcgcatatgggataatcacacgaaacttctcaactataatgtttgctcaaatgatattgaaggccatccgtccagactatgggttggtgaggctgatgatgatcaagaaatgatatctttggcagttctgcatcagaacactgtggttcaagattgtgatcatgttgcattgtatggcttcagtttttctactggggaaaagttcccattctctcctgaaccttcaatttctactgtacctttgctggaggggaagcttgtcgacttgaaaataggcaaggacaagctttggatacttaaagaatttggatcaatgctgtatgaaatattgcagtatgacaccaaagctgagaaaatttgctcttatgtgctacaagaagacgctatcagtgagcaattgtttcaaagttcagacaatgcattggatgatttggtctggacagctgattcagtgttctcctccttgaaggaacaggctttcacttttatttcatctatgtttctgcggaggctacttcaaccaggagtaaaccactgttctgctcttcgtgaaaccttattagagcacaaaaggtttctgtcagattctgagttccagtcacttacagctaatggactacgaaaagagatattatccattatagaacaagaggtaagttcacagacagcgagtgctacagcctatcactggaaaaaattctgtgcacgatatctccacaattggtgctggaataataggccatatgggttgcttcttgatactaacaaagaagtgtttggtttgataagaaagggttcattttccctgttccgttgtttggagggtgtggagatgcttatttatggttcatccgatgaactgcgcaatattgatgacctagggatgaacttaatggatgctgacattgaacttctcaatgaagtccttaggtgcatgggccatatacaccatctgctggggagatcttccactgcaatatattacgagtccctaatcagttctgttatatcatctgatgaaattgcttcgcaaatagtaaagattctagagactggttttagtcctcaatcatcctcatccctcgttacattacttggaacggatgcttatgtagaaagaaggcaggcggctcacaaaagtcaaaggaagttttctgttgatatgttactatcttttcataagttgcgatcaagatccgcatcctggtccgtggtattcgatgtgatcgagaagtttatgaagtgtttgaacacaaacatcaacgtacaagactatgaatcaaagagagtttgtaatgtaaattctgtgttattagttcaagctacttcacaggttgcaaggacgatgtttgagtctgcttttgatctatttctgttcctcagttatctggttggtgttggtgggcaggtctccttgttgcaaagtgatgttgccagaataaaactgaagttgttcccaatgattcaagacatattgggacaatggattgttctccactttgtaggaatctcaccaacatcaccaccaaccattgaagattttagctatcaactttcttctcttcagcttggtaaagtagatgagctgtctttgcacagaaagcttggctgctctgattttacattggcttgtttacttgattttccaatatctcctcgagtcggtgttatgtcacattgttttcctagtccagtggaagtaatcaatctcgtaaggagttttagtagtttgattatgggtggaggaaattttgattgtgtacagactttcttgggttccacaattaatctatcagcagttctcatccgccatggtcaatatgaagctgctcagaatctgctgggaattctggaaacatacttgaacaatgagaaagtatcccgtactggtcaggacgcagatactgcatgttcagcatatcttcatcttaatggattttgccttctgatgcttgcacatgatgaagcaaatacagttttgagagaatccaaggttcatgatgctatccgatgctttttcagagctgcatccggccatgaagcttcaaaggctctgcagaagttttctttggaaacagggtttcaagtttcaggggaatgcagatctatttctttgtggagacttcattactatgagtgggcaatgcaaatttttgagcagcactccatgagcgagggggcgtgccagtttgctcttgctgctcttgaacaagttgacaacattgttgatttagataatggaactgaagccgagagccttccggagactgcagcaatgattaaaggacgactatgggctaatgtattcaagtacagcttggatttgaaaaactttcaagatgcatactgcgcaataatctcaaacccagatgatgatagcaaatatatctgtttgaggcgtttcatcatagttctttgtgagcttggggagacaaaggttctttgcaacggagagattccattcactggtttggtagagaaagtggagcaagagctcttctggaaggctgagcgctcagatctatcttctaggccgaatctctacaaggttctttattcatttgaagcatacaggaacaattggaggaaggcagctggatacatgtacaggtacttcgttagattgaatagagagggtaatgcaggtggcagctgccaacttcctcacgtgttgcaagagaggttgcatgctttatctgctgctatcaacgcattgcagcttgttgatccctcgtttgcatggcttgattctgtttgtgaagctgatgatcaaatttctccaagtaaaaggcctcggaatcttttgatggagaatttggcttttggcacagattctgagctttctcgattgcaattttgtgttgacattgaaatccttgaaaaggaatacacattaacgaaagcacagtttatgctcagcactgtgaaatcaacattcaatttttcagaaagccaatctattgagtccctgatggatattcttataaacgagaaattgtatgacctggccttcacaatcgtgctcaaattttggaaggactctggaatgaaaagggaattggagcgtgtcttttcagctattgcgcaacagtgctgcccaaacagatcagataaatcagggagaaatttgactgacagtaaacaactgctagtgctgccttcttctgaggatgatgcatgggatggcaacattaagagtattgctgtgacccaacagctgcagggaaactgccactgggacacccttgaactatttatgaagaaatacaatgatctgcatcctaggttgcctgtcgttgttgctgagacgcttctttatactgatcccgagattgagctacctctttggttggttcagatgttcaagactaacaaggcagggaacaggatatggggcatgtctgggaaagaggcagatcctgctgccttattcagactctacataaactatggccggcatgcagaagcaaccaacttgctggtggagtacctggagttgttcgcgtcatcgaggccagcggacgtcctccaccgcaaaaagatgtcagcagcttggtttccgtacaccgccgtcgagaggctgtggtgccatcttggggagatgcagcgcgccggccacagcgtggatcagtgcgaccggctcaagaagctgctgcacggagccctgatgagccatctgcagcaggtcgtggttgactcggaggacgtgctgtcgtcagttggaggtggtcagggaatggagggccagagcaactgagatcgtgttggtgttggtccgtgatgtagagaatagagaacgttatgtcacggctgaatcttgtacgtaattgtttgtatggttctgttgtctacgagtgatccatgtgtcttgggaagacaaatgcttgtgctgagacttcaacatggaagttcccataacgtgttcgagttccacatgtatgtagatggagtgacaccattgtagtacgtcggatatggctgtctaatattcattccgttttaaaatattcgac

SEQ ID NO: 8923 - DNA, 4835 bp, Oryza sativa
acctcaccgcccaaaacccgcgcccattccaaaaccctccgccgccgccgccgccgccgcggccgccggcgaggcctccatggccaccaccacccccgccgcccgcaaaatagccggcaccgaggtccccatcccgggctcggacagggtgcggtggatcgagctcaccgtcccctccaccccgtccccctcaccggagggcgattccgatcccttcgtcctagtgcccccgcgcgccgcctcggggttccacgtcgtctcctccggcgactcgcagtgctatctcgcctggaggttccatgaggaacaacaaaatgttctagaggttattgatctctgtgctttcaaggagtttccaagctctggactgcggttggtattccaggaggagctatgcccgttttccttcttatgtgcacgtgagggcggcagacgtggcacacctgtatatctgctatatgtgcttactgtttctggagttgctctcttatgccacttgcgaagcccattttcctatatctctggttcaatatttcctcaagacgatatagttgaatttaatctccaaacccaagtacagagtgctaaggttacagctgtaacagcgatgtcaggatgcctagtgattgggcgacaagatgggtcaatctgctgttacagtctgggcaagttagctctgaattcaccaggtttcttgaatgagctccgagatgatgctgggatcggacgtttatggtctcttgtgtcaagaacaaaggctgtgggccctgtacaagatatagtaacagctactgtaaatgaaagggaactgctgtttgttctccatctggatggaagtttgcgcatatgggatatttttaatcacactaaacttctcagttacaatgttcgctcgaatgatatcgaaggtcaaccatctaggatatgggttggtgatgctgatgatgatcaagagttgatttttttggctgttctgcgtcaaggcactgtgactggagcttgtgattgcgtttctgtatatggttttagttttggtgctggtgaaaggttcttgttttctcctgaaccttcatttttttctatacctttggtggagggaaagcttatcgacttgaaaataagcatggacaagctttggatacttaaggaagttggatcaatgctatatgaaatagtgcagtatgattgtgatactgagataatgcattcatatgtgctacaagaagtttctgtcagtgaccagttgtttcaaagctctgagaatacattggatgatttggtctggacagctgattcaatattctcatccaagaaggagcagacattcggttttatttcatctatgtttttgcggaggctacttcaaccaggagtgaatcacagttctgctctacgtgaaaccttgttggagcacaagagatttctatccgattcttatttccaatcacttacaactagtggactacggaaagaaatattatccaccatagaacaagagggaagttcacagactgcaagttcgactgcttatcattggaaaaagttttctgcacggtatctccacaattggtgctggaacaataggccatatgggttacttcttgatactaacagagaagtttttggtttaataagaaagggttcattttctctcttccgttgtttggagggcatggagcagtttatttatggttcctctgatgacctgcgcaatcttgatatccttggggtgaacccatcggataatatatctcagtctgaaatcctcattgaagttctaaggtgcatggatcatataagccatctgctggggagatctgctgctgcaatatatcatgaatccctcatcagttctgttatatcacctgatgaaattgtttctcagatcttaaagattctgggcactggtttcagtcctcagtctccctcagccctcattacattatttggaacagatgcttatgcagaaagaaggcagaccgctcacaagagtcagaggaagttttctgttgaaatgttactatcttttcgtaaattgcaatcaaagtcgacatcctggtcagcagtatttgatgtgattgagaacttcatgaagtatttgaacacaaacgtgaccatccaagagtatgagctgaagagagtttgcaatgtgaatactgcgttattggttcaagctacttcacaggtagcaagaacaatgttcgagtccacttttgatctatatctgttcctcaattatctggtctccattggtgggcaggtctccttgtcacaaaatgatattgccagaataaaactgaagttgttcccagtgattcaagatatactgggacagtggattgtcctccactttgtaggaatttcacctactacaccaccaactattgaggatttcagctatcagctttcttctctccagctaggaaaagctgatgacctgtctttgcacagaaagtttggctgctcttattttacattggcttgtttacttgattttccaaaatctgctgacggggatgttctctcaccctggtttcctaatccaactgagttggtcaacttggtaaggaggtttagtggctcaattatgagtgaaaatattgctggaaatgctgactgtttcttgagttccacaattaatctggcagcagttcttgttcgccatggtcaatatgaagctgctcagagtcttctgggcattctcgacacacacatgaactatgtgaaagcatctcaagctgaccaggatacagatcttgcacgctcatcatgccttcatctcaatggattttgccttctggtgcttgcacgtgatgaagcaaacattgtcctgaaagaatccaaggttcatgaagctatccgatgcttcttcagagctgcatctgggcaagaagctccaaaggctcttcagaagttctctgtggaaacagggtttcaaatctccggggaatgcagatcttttacagcatggaggcttcgttactatgagtgggcaatgcaaatttttgagcagcactccatgagtgaaggggcatgcgagtttgctcttggtgctcttgaacaaatagatagcatcgtcgatttagataatggaagtgaagctgaggatatccctgaaactacaactatgattaaagggcgactatgggctaatgtattcaagtacaaattggatttgaaaaattttcaagaggcgtattgcgcaataatctcaaatccagataatgatagcaagtatgtctgtttaagacgtttcatcatagttctttgtgagcttggcgagacaaaggtaatttgcaatggcgagataccattcactggcttggtggaaaaagtggagcaagagctcttctggaaggctgagcgctcggatcttttgtctagaccaaatctttacaaggtcctttattcatttgaggcttataggaacaattggaggaaggctgctgcacatatgtataggtatttcgttagattgagtagagagggtaatgctggtggaacccggcaactttctcatacattgcaagagaggctgcatgctttgtctgctgctatcaatgcattgcagcttgttgatccctcattcgcttggcttgattctgtttgtgaagcggatgatcaaatctcaccaagtaaaaagccctgtaatcttttgatgaagaactctgcttttggcacagattcagagctgtctaggttgaagttttgtgttgacattgaaattctcgaaaaggaatatacactaacagaagcactctatatgctcagcactgtaaattctagattcaacttttcagataaccaatctattgaagcactgacggatattcttataaatgagaatatgtacgacatggtgttcaccattgtgctgaaatttcggaaggagtcaggaatgaaaagggagttggaacgtgtatttgcagcaattgcgcagcaatgctgccctaatagagtgggcaactcagggaagaatttactgctgccatcttccgatgatgatgcctgtgatggcaatggtaacagtattgccatggctcatcaatcccaggggagttgccattgggagactcttgaaatatatttggagaaatacaaagatttgcatcctaggttgcctgtcattgttgcggaaacacttctttacacagaccctgagattgagctaccactttggctagtccagatgtttaagaccaccaaggctggtaacaggatgatttcatggggtatgtctggcacagaggcagaccctgctacattatttagattgtacataaattatggacggcacacagaagcggccaatttgctggtcgagtacttggaatcattcacatcatcgagacctgtggacgttctccaccgcaaaaagatgtcagcggcctggttcccatacactgccatcgagaggttgtggtgtcagctagaagagatgcaaaatgctggccacagcgtggatcagtgcgacaggctcaagaagttgctacatggatctctgattagtcacctgcagcaagttgtggttgattcagatgatgtgctttcatcgcttggaggagggaaaggaatggggagccaaagcaattgagttttttttttcttttgttccttagtgagcgagcaactgagatcttgtgagccgtggattagtgtcagcttactgttgtactgtcatgtgtatgtaatagttgtatggctaatgcctgtgagccatgttcatcacctgtttctgtagacaagggcaattttccatttgtaagtccttttaacacttatgtgaaaaatgcctcgctcctttgaagagtaccaggctaccagcagacacataa

SEQ ID NO: 8924 - DNA, 4893 bp, Oryza sativa
aagtcccaaatttctccgaacattccccacctcaccgcccaaaacccgcgcccattccaaaaccctccgccgccgccgccgccgccgcggccgccggcgaggcctccatggccaccaccacccccgccgcccgcaaaatagccggcaccgaggtccccatcccgggctcggacagggtgcggtggatcgagctcaccgtcccctccaccccgtccccctcaccggagggcgattccgatcccttcgtcctagtgcccccgcgcgccgcctcggggttccacgtcgtctcctccggcgactcgcagtgctatctcgcctggaggttccatgaggaacaacaaaatgttctagaggttattgatctctgtgctttcaaggagtttccaagctctggactgcggttggtattccaggaggagctatgcccgttttccttcttatgtgcacgtgagggcggcagacgtggcacacctgtatatctgctatatgtgcttactgtttctggagttgctctcttatgccacttgcgaagcccattttcctatatctctggttcaatatttcctcaagacgatatagttgaatttaatctccaaacccaagtacagagtgctaaggttacagctgtaacagcgatgtcaggatgcctagtgattgggcgacaagatgggtcaatctgctgttacagtctgggcaagttagctctgaattcaccaggtttcttgaatgagctccgagatgatgctgggatcggacgtttatggtctcttgtgtcaagaacaaaggctgtgggccctgtacaagatatagtaacagctactgtaaatgaaagggaactgctgtttgttctccatctggatggaagtttgcgcatatgggatatttttaatcacactaaacttctcagttacaatgttcgctcgaatgatatcgaaggtcaaccatctaggatatgggttggtgatgctgatgatgatcaagagttgatttttttggctgttctgcgtcaaggcactgtgactggagcttgtgattgcgtttctgtatatggttttagttttggtgctggtgaaaggttcttgttttctcctgaaccttcatttttttctatacctttggtggagggaaagcttatcgacttgaaaataagcatggacaagctttggatacttaaggaagttggatcaatgctatatgaaatagtgcagtatgattgtgatactgagataatgcattcatatgtgctacaagaagtttctgtcagtgaccagttgtttcaaagctctgagaatacattggatgatttggtctggacagctgattcaatattctcatccaagaaggagcagacattcggttttatttcatctatgtttttgcggaggctacttcaaccaggagtgaatcacagttctgctctacgtgaaaccttgttggagcacaagagatttctatccgattcttatttccaatcacttacaactagtggactacggaaagaaatattatccaccatagaacaagagggaagttcacagactgcaagttcgactgcttatcattggaaaaagttttctgcacggtatctccacaattggtgctggaacaataggccatatgggttacttcttgatactaacagagaagtttttggtttaataagaaagggttcattttctctcttccgttgtttggagggcatggagcagtttatttatggttcctctgatgacctgcgcaatcttgatatccttggggtgaacccatcggataatatatctcagtctgaaatcctcattgaagttctaaggtgcatggatcatataagccatctgctggggagatctgctgctgcaatatatcatgaatccctcatcagttctgttatatcacctgatgaaattgtttctcagatcttaaagattctgggcactggtttcagtcctcagtctccctcagccctcattacattatttggaacagatgcttatgcagaaagaaggcagaccgctcacaagagtcagaggaagttttctgttgaaatgttactatcttttcgtaaattgcaatcaaagtcgacatcctggtcagcagtatttgatgtgattgagaacttcatgaagtatttgaacacaaacgtgaccatccaagagtatgagctgaagagagtttgcaatgtgaatactgcgttattggttcaagctacttcacaggtagcaagaacaatgttcgagtccacttttgatctatatctgttcctcaattatctggtctccattggtgggcaggtctccttgtcacaaaatgatattgccagaataaaactgaagttgttcccagtgattcaagatatactgggacagtggattgtcctccactttgtaggaatttcacctactacaccaccaactattgaggatttcagctatcagctttcttctctccagctaggaaaagctgatgacctgtctttgcacagaaagtttggctgctcttattttacattggcttgtttacttgattttccaaaatctgctgacggggatgttctctcaccctggtttcctaatccaactgagttggtcaacttggtaaggaggtttagtggctcaattatgagtgaaaatattgctggaaatgctgactgtttcttgagttccacaattaatctggcagcagttcttgttcgccatggtcaatatgaagctgctcagagtcttctgggcattctcgacacacacatgaactatgtgaaagcatctcaagctgaccaggatacagatcttgcacgctcatcatgccttcatctcaatggattttgccttctggtgcttgcacgtgatgaagcaaacattgtcctgaaagaatccaaggttcatgaagctatccgatgcttcttcagagctgcatctgggcaagaagctccaaaggctcttcagaagttctctgtggaaacagggtttcaaatctccggggaatgcagatcttttacagcatggaggcttcgttactatgagtgggcaatgcaaatttttgagcagcactccatgagtgaaggggcatgcgagtttgctcttggtgctcttgaacaaatagatagcatcgtcgatttagataatggaagtgaagctgaggatatccctgaaactacaactatgattaaagggcgactatgggctaatgtattcaagtacaaattggatttgaaaaattttcaagaggcgtattgcgcaataatctcaaatccagataatgatagcaagtatgtctgtttaagacgtttcatcatagttctttgtgagcttggcgagacaaaggtaatttgcaatggcgagataccattcactggcttggtggaaaaagtggagcaagagctcttctggaaggctgagcgctcggatcttttgtctagaccaaatctttacaaggtcctttattcatttgaggcttataggaacaattggaggaaggctgctgcacatatgtataggtatttcgttagattgagtagagagggtaatgctggtggaacccggcaactttctcatacattgcaagagaggctgcatgctttgtctgctgctatcaatgcattgcagcttgttgatccctcattcgcttggcttgattctgtttgtgaagcggatgatcaaatctcaccaagtaaaaagccctgtaatcttttgatgaagaactctgcttttggcacagattcagagctgtctaggttgaagttttgtgttgacattgaaattctcgaaaaggaatatacactaacagaagcactctatatgctcagcactgtaaattctagattcaacttttcagataaccaatctattgaagcactgacggatattcttataaatgagaatatgtacgacatggtgttcaccattgtgctgaaatttcggaaggagtcaggaatgaaaagggagttggaacgtgtatttgcagcaattgcgcagcaatgctgccctaatagagtgggcaactcagggaagaatttactgctgccatcttccgatgatgatgcctgtgatggcaatggtaacagtattgccatggctcatcaatcccaggggagttgccattgggagactcttgaaatatatttggagaaatacaaagatttgcatcctaggttgcctgtcattgttgcggaaacacttctttacacagaccctgagattgagctaccactttggctagtccagatgtttaagaccaccaaggctggtaacaggatgatttcatggggtatgtctggcacagaggcagaccctgctacattatttagattgtacataaattatggacggcacacagaagcggccaatttgctggtcgagtacttggaatcattcacatcatcgagacctgtggacgttctccaccgcaaaaagatgtcagcggcctggttcccatacactgccatcgagaggttgtggtgtcagctagaagagatgcaaaatgctggccacagcgtggatcagtgcgacaggctcaagaagttgctacatggatctctgattagtcacctgcagcaagttgtggttgattcagatgatgtgctttcatcgcttggaggagggaaaggaatggggagccaaagcaattgagttttttttttcttttgttccttagtgagcgagcaactgagatcttgtgagccgtggattagtgtcagcttactgttgtactgtcatgtgtatgtaatagttgtatggctaatgcctgtgagccatgttcatcacctgtttctgtagacaagggcaattttccatttgtaagtccttttaacacttatgtgaaaaatgcctcgctcctttgaagagtaccaggctaccagcagacacataaagtttcctcgtgcccttttgggtttgtttg

SEQ ID NO: 8925 - DNA, 1083 bp, Echinochloa colona
acacgacgactattcactgcctggaagttcaaatgctgctgcggagacgcctgatcatgggtctcttgatcaaagatctcaggaaaatactccaaagaaaactcataaagctgaacgagagaagctcaagcgtgatcagctgaatgaactttttcttgagctcggcagtatgctagatcttgatcgacaaaatacaggaaaagcttcaatattaggtgatgctgctcgagtactgcgagatctggttactcaagtagaatctcttaggaaggaacaatccgctcttcaatcggaacgccaatatgtcaattcagagaagaacgagctgcaagaggagaacgctacactcaaatcccaaatatcagaactagcaaacgagctctgtgcaaggatgggaaatagcagcctcaatttaagcagctttgggatgtcaaatccgatggtgaacactataagtcctgatttggcgactcacccccctgccacctcagatgtggaacaatgttactaatttaagctccgtggccatggcgcaccaatcgaatacagtattaccggtgcagagtcagcatcactctgccaatgatgttgaggattatgcaccgcggcctcaggagctgcagctctttccaggtgcgtcgtcgtcaccagagcgcgaatgttcccgcctgggaagcacccataccacctcttcaagccttgcagattcgttgccagggcagcttcgcttaagccttacacaatcatcacaagaagaaagcagcagtggtgtattgggcaacagaaaagagaggcgaaacagctagcagattgctgatatgctggaatcagtaaataggtggtagtgtttgtcctgtaaataccgagaatcccctcccttcgctgattcagaactaatgggcataggtggttctgtactgaactatgactctgtagcacttgttctacaaacttcccagtcatgtctggctatagttctgatgctatgctgatcaaactgattcagatatataatattatagttactctgtactgaactgtgactagcgcttgaccgcttgttgtgcaaattagtcgtcgtgt

SEQ ID NO: 8926 - DNA, 1482 bp, Panicum virgatum
gggaccaatttcccatccccatcccaatccactgggagcttattcatcgttcagagtcccgatccaatccaaccagagctttttcctcatccatatctgcgtcgacccagggaattcccgtggccggtggggccggcggcgacgccatgtgccaccgcgctgccgcctgggtcacccaagtgtgcgggtgggtggccgccacacgctcgctgcgcccgcgtgcgtgtgctcgcctccctccctcaccccacgcaccagctccccactcccccaggcagccgtcccctgcacctgcccgcgcccatccatccggccaccctccatcgccggctgccgcggaccatccggctggggatcaagatccgtcgaggccgatctaggaacattaatctgggtatggtggctgacacagaaagctcagattcactgcctggaagttcaaatgctgctgtcgagatgcctattcatgggtctcttgatcaaagatctcaggaaaagactccaaagaaaactcataaggctgaacgagagaagctcaagcgtgatcagttgaatgaactttttcttgagctcggcagtatgctagatcttgatcgacaaaatacaggaaaagctacagtagtaggtgatgctgcgcgagtactgcgagatctggtcactcaagtagaatccctcagaaaggaacaatctgctctcctattggaacgtcaatatgtcagtttagagaagtccgagctgcaagaggagaacgctacactcaaatcccaaatatcagaactagcaaacaagctctgcgcaaggatggggaatagcagccttgggatgttacatcgagtggcgaacacaagaagccctgatttggcgacacaccccttgccacatcagatgtggagcaacattcctaatataagctctgtggccatggcacaccaaatgaatacagcatcaccgctgcacagtcaacatcactctgccaataatgctgaagtttatgcactgcggcctcaggagctgcagctctttccaggggcgtcgtcgtcaccagagcgtgaatgttcccatcccagaagtgcaggagccacctcttcgagcctcaccgattctttgccaagtcagctttgcttgagccttacacaatcatctcaagaagaacgcaccagtgatgtgctggttgacactgagagaacgacaaaacagttagcagattgctgatactggaatgaatcagtatttggtggtagtgagattgtcctgtaaataccaagaatgccctccctttactggttcagaactcatgttatagatgccctgtactagcgcttgttctacagactccctaatcatgtctgccttagttctgaacttctgatgctgatcaaagattcagacttgatgtaaatagttactatgtactgaactgattcagactggtgcttggtggagacgtgaagcagagaggccctcccacccaacctttctgca

SEQ ID NO: 8927 - DNA, 1438 bp, Sorghum bicolor
cacacacacaggcccctttcaccatctctagctttttcatcgatctgtttttttcgaccttggctttccttccccttttaaagctttgatgcacacaccacaccggccactcgaaatggacacactccacctgttgatgtgaagatctgtttcatttccagtctagtcgatctcacatgtgagaggaaccgatccagcaactgaagaattgaagaagatgatgatgaagaagcagtagcagtggcagtagcgctagaactagctagatctcctcccttgctagctagaagcttgtacaaacagtgcaccacacagatgttgccttaccctaaccctcaccatttcggcgtctcccaagaacccccacacccaaaccctaccagcttccccatgcttccgccgggcgcgcatctggatcagcagcactacgtggaccatcacttcttccccggccacggccacttcaactccgagacactggaggcggtgctgaggccgacgcgcgctgctccagagtgcgaggccgcagtggcggcggcggcgcagcagggtggaagacgaaacggtgtgcccgccggcggcggccagggccagggccacgcccgggcgcggaagcggccgttccggacggacaggcacagcaagatccggacggcgcagggcgtgcgcgaccgccggatgcggttgtccctcgacgtcgcgcgcgacttcttcgcgctgcaggaccggctcggcttcgataaggccagcaagacggtggactggctgctcacccagtccaagccggccatcgaacgcctcgccgccaccgatctctcccagcgaagcgtcggcggcggcagcgacgacgcagctttgtcacccccgacgtcaggggcggcggctgatggaccaggtaagaggggaggagttgccgagaagttgagctctagaagtggtggatcggcgtccatggagatggagcacacctgcgacctggaccgcctcgtgtccgcggcaccggtgcttcgggagtactactacggcctcagcgagatgatgagcaacgacaatggaggggacggcgacgacgatggtgagtacgaggaagacggtgatttcctggacggtatgcaatattagtatgtagaagcagcttgcatggtttctctacgtagtagagtacactagtagctagctctttctttatctggcaagcacttcttcactatcgttagttcctagtacttcctagtattcatgtgaactcctttaagttaatgctactggcaaatgctgtgacagatgttactcttgtgctccgcttttgattttcaatttgagcattcttttggggttttatgcactagctaggaaagaatgttgcttgtttgactggatgacttcatgagtagtgtctatatgtagacactctaccttgtttagttcgcaaaatttt

SEQ ID NO: 8928 - DNA, 1492 bp, Zea mays
aacaaaacccacacacacgataggggtcctagcaacaaaacaccaaaaattaagcttcactctcacaactttctgcttcctgtgtccacgcaccacaccggccgctttcaccatctctagctttttcatcgatctgtttttgcgaccttaattggttttctcttcccctttttaagctttgatacacacaccgcgccatacccagtcgaaatggacacactccacctcttgctgtgaagatctgttccatttccagtgtagtccctgtcccacatgtgagaggaaccgatctagcaagcgaatgaggaagatgatgaagaaacagtagcagtggcagtaccgctagaactagaactagctagatctcctctcttactagctagaagcttgtacaaacaatgcaccacagatgctaccttaccctaaccctcaccatcatttcggcgtctcccaagagcccccgcacccaaaccctactaccggcttccccatgcttccgcggggcgcgcatctggatcagcgctacgtggaccatcacttcttccccggccacggccacaccaactccgaaaccctggaggcggtgctgaggccgacgcgcgccgctccagagtgcgaggccgccgtagtgacggcgccaccgcagggtggaagtggaagacgaaacggcgccgtgcctgccgccggcggccagggccagggccacgcccacgcccacgcccgggcgccgcggaagcggccgtttcggacggacaggcacagcaagatccggacggcgcagggcgtgcgcgaccgccggatgcgcctgtccctcgacgtcgcgcgcgacttcttcgcgctgcaggaccggctcggctttgataaggccagcaagacggtggactggctgctcacccagtccaagccggccatcgagcggctcgccgccaccaccgagccctcacagagaagcgtcggcggcagcgacgacgctgctttgtcacccccgacgtcaggggtggctgatggatcaggtatgaggggaggtgttgcggagaagttgggttccagaagtggggggtcagcggcgtccatggagatggagatggagcacgcctccgagctggaccgcctcgtgtcggccgcaccagtgcttcgtcagtactactacggcctcagcgagatgatgagcaacgacaacggaggagatggcgatgacgacggtgagtacgaggaggaagacggtgatttcctcgacggtatgaaatattagtatgtagttatgtgtactagctagcagcttgcatggtttctacgtagtactagtagccgctggcagcttacctagagttaatcctttatttgtcaagcacttcttcactatcgtttttttcctactatatgcatttgtactcctttaagttaatgctatgtgtcacatgttactcttgttctttgttgttactagtagcagtatatgtaatagaaatgtgctccgcttgctttcgatttt

SEQ ID NO: 8929 - DNA, 1690 bp, Glycine max
cattcgcttgaatcctgaaaatctgaggaacctttgtctctcatcaatggctgccacgagaccggtgcagtgtttgttacgaagggtttgcaggggaagtaggagttttggggttgccacagaagttaatgcttcttcttcatcttcttctcagaaaatcatcgacaaggaatatgaacacagtgcccacaattaccatccccttccgattgtattttctcaggcaaagggaacctctgtttgggatccagagggaaacaaatatcttgattttctatctggttactctgctgttaatcagggacactgccatcctaaaattctcaaagcattacaagaacaagcacaaaggctgactgtgagctctcgagccttctacaatgatcgctttccagtctttgctgagtatgtgacaaacatgtttggttatgatatggtacttcctatgaatactggtgctgaaggtgtggaaacagcactgaaattagcacgaaagtggggttatgaaaagaaaagaattcccaaagacgaggctattattgtctcatgttgtggctgcttccatggtcgtacactaggtgtcatatctttgagctgtgacaatgaagctacccgtggttttggtcctttattgcctggcaatcttaaagttgattttggtgatgcagaagcccttgaaagaatttttaaagaaaaaggagaacacatagctgcgtttattttagaacctatccaaggtgaagctggggtgatatttcctccagatggttatttaaaagctgttagagatatttgctccaaatataatgtcttgatgattgctgatgaaattcaaactgggttagcaagaacagggaagatgctggcttgtgagtgggaagaagttcgcccagatattgtgatactagggaaagcattgggtggaggagttataccagttagtgcagttcttgcagacaaagatgtgatgctttgtatacaacctggacagcatggaagtaccttcggtggaaatccactggccagtgcagttgcaattgcctcactagaagtgataaaaaatgagagactcgttgagagatctgcccaaatgggagaggagcttgctggtcagctgcttaagattcagcagcaatatccagactacgtgaaggaggtacggggaagaggattgttcattggagtggagtttaacagcaaaaatttgttccctgtatctggctatgagctatgcaaaaaattgaagtatagaggagtccttgccaagccaacacatgatacaattatccgctttactcccccactttgcataagtctggatgagatccaacaaggttccaaggtcctggctgatgttctggaaattgatctaccaaagttgcagaagacaaagccaaaagatgctgctccggttgcctctagtgcatgtgatcgttgtggtagagtcttgtattaaccatataaagacgtatagattgcatgtacctttaattttccttggaaaaaaatatcacatgaagaatgttattccttatacatgaacccctggaaactatgctccaatattccatatatcatcataatttaaggccatgatatatgtgataggtagctgtataaataaatatgtaggagttaagggctcatttgtataacttcagtgattgataagatatatgatttattaggg

SEQ ID NO: 8930 - DNA, 1784 bp, Glycine max
agagggtgacaattattaaaacatactactttcatttcatcttacattcgcttgaatcctgaaaatctgaggaacctttgtctctcatcaatggctgccacgagaccggtgcagtgtttgttacgaagggtttgcaggggaagtaggagttttggggttgccacagaagttaatgcttcttcttcatcttcttctcagaaaatcatcgacaaggaatatgaacacagtgcccacaattaccatccccttccgattgtattttctcaggcaaagggaacctctgtttgggatccagagggaaacaaatatcttgattttctatctggttactctgctgttaatcagggacactgccatcctaaaattctcaaagcattacaagaacaagcacaaaggctgactgtgagctctcgagccttctacaatgatcgctttccagtctttgctgagtatgtgacaaacatgtttggttatgatatggtacttcctatgaatactggtgctgaaggtgtggaaacagcactgaaattagcacgaaagtggggttatgaaaagaaaagaattcccaaagacgaggctattattgtctcatgttgtggctgcttccatggtcgtacactaggtgtcatatctttgagctgtgacaatgaagctacccgtggttttggtcctttattgcctggcaatcttaaagttgattttggtgatgcagaagcccttgaaagaatttttaaagaaaaaggagaacacatagctgcgtttattttagaacctatccaaggtgaagctggggtgatatttcctccagatggttatttaaaagctgttagagatatttgctccaaatataatgtcttgatgattgctgatgaaattcaaactgggttagcaagaacagggaagatgctggcttgtgagtgggaagaagttcgcccagatattgtgatactagggaaagcattgggtggaggagttataccagttagtgcagttcttgcagacaaagatgtgatgctttgtatacaacctggacagcatggaagtaccttcggtggaaatccactggccagtgcagttgcaattgcctcactagaagtgataaaaaatgagagactcgttgagagatctgcccaaatgggagaggagcttgctggtcagctgcttaagattcagcagcaatatccagactacgtgaaggaggtacggggaagaggattgttcattggagtggagtttaacagcaaaaatttgttccctgtatctggctatgagctatgcaaaaaattgaagtatagaggagtccttgccaagccaacacatgatacaattatccgctttactcccccactttgcataagtctggatgagatccaacaaggttccaaggtcctggctgatgttctggaaattgatctaccaaagttgcagaagacaaagccaaaagatgctgctccggttgcctctagtgcatgtgatcgttgtggtagagtcttgtattaaccatataaagacgtatagattgcatgtacctttaattttccttggaaaaaaatatcacatgaagaatgttattccttatacatgaacccctggaaactatgctccaatattccatatatcatcataatttaaggccatgatatatgtgataggtagctgtataaataaatatgtaggagttaagggctcatttgtataacttcagtgattgataagatatatgatttattagggctagaacaaagttctctagatttgccatgccatctattttattcgcatca

SEQ ID NO: 8931 - DNA, 1710 bp, Cajanus cajan
aaagttaaaaagcatgttgggtgatactcattagaacatactttcatctctttcatcttacattttcgaacgaaaatcctgagaaatttgaggaacctttgtgtctcatcaatggctaccacgagaccggttcaatgtttgttacgaagggttttcaggggaagtaggagttttggtgttgccacagaagttaatgcttcttcttcttcttcttcttcctcccagagaatcatcgacaaggaacacgagcacagtgcccacaattaccatccgcttccaattgtattttctcaagcaaagggaacctctgtttgggatcctgagggaaacaaataccttgattttctatctggttactctgctgttaatcagggacactgccatcctaaaattctgaaagcattacaagaacaggtagaaaggctgactgtgagctctcgagccttctacaatgatcagtttccactctttgctgagtatgtgacaaccatgtttggttacgatatggtacttcctatgaatactggtgctgaaggtgtggaaacagctatgaaattagcgcgaaagtggggttatgaaaagaaaagaattcccaaagatgaggctattattgtctcatgctgtggctgcttccatggtcgtacactaggtgtcatatctatgagctgtgacaatgaagctacccgtggttttggtcctttatttcctggccatcttaaagttgattttggtgatgcagaagcccttgaaagaatttttaaagaaaaaggagaacacatagctggatttattttagaacctatgcaaggcgaagctgggattataattcctccagatggctatctaaaagctgttagagatctttgctccaaatataacatcttgatgattgctgatgaaatacaaactgggttagcaagaacagggaagatgctggcttgtgagtgggaagacgttcgcccagatgttgtgatacttgggaaagcactaggtggaggagttataccggttagtgcagttcttgcagacaaagatgtgatgctttgcataaaacctggacagcatggaagtacctttggtggaaatccgttggccagtgcagttgcaattgcctcactagaggtgatcaaggatgagagactcgttgagagatcagcacaaatgggaggggagcttattggtcagatgcttaagattcagcagcaatacccgaactacgtgaaggaggtacgtggaagaggattattcgttggagtggagtttaacagcaaaagtttgttcccagtatccggctatgagctaactaaaaaattgaagaataggggagtgcttaccaagccaacacatgatacaactatccgctttactcccccactctgcataagtggggatgagattcaacaaggttccaaggctctggctgaagttttggaaattgatctaccaaagttgcagaaggagaagccaaaagatgctgctccagttgcctctagtgcatgtgatcgttgtggtagagtcttgtatggttaaccaaataaagacatggattgcatgcacctttgattttccatcgaaaaaaatatgacctccagaatgttatttcttatacatgaaccgctggagaccgtgttccccttccataccatattatgaaataaaagatcagggccgtggctaaggcaaggccttgccttaggcccccagtcggtt

SEQ ID NO: 8932 - DNA, 1728 bp, Phaseolus vulgaris
gacgcaatataaaagggacaaagacataaaaacatattgggtgaacatagttagaacagaattgtactttcatattagatttgctagaatccgaggaatttgaggaacctttgcatctcaccaatggctgcaaagacacaggtgcagtgtttgctacgaagggttttcaggggaagcaggagttttggggtttccgcagaagttaatgcttcttcctcttcttctcagagaatcatggacaaggaatatgaacacagtgctcacaattaccatccacttccgattgtattttctaaagcaaagggaacctctgtttgggatccagagggaaacaaatatctagattttctagctggttattctgctgttaatcagggacactgccatcctaaaatcctgaaagcattacaagaacaggcagaaaggctgaccgtgagctctcgagccttctataatgatcgttttccactctttgcagagtatgtgacaaccttgtttggttatgatatggtacttcctatgaatactggcgctgaaggtgtggaaacagctatgaaattagcacgaaagtggggttatgaaaagaaaagaattcccaaagatgaggctattattgtctcatgttgtggctgcttcaatggtcgtacacttggggtcatatctatgagctgtgataatgaagctatccgtggttttggtcctttattgcctggccatcttaaagttgattttggtgatgctgatgcccttgaaagaatttttaaagaaaaaggagaacgcatagctgcatttattttagaacctatccaaggtgaagctggggtaataattcctccagatggttatttaaaagctgttagagatctttgctccaaatataacatcttgatgattgctgatgaaatacaaactgggttaggaagaacagggaagatgctggcttgtgaatgggaagaagttcgcccagatgttgtggtactcggtaaagcactgggtggaggtgttataccagttagtgcagttcttgcagacaaagatgtgatgctttgtatacaacctggacagcatggaagcacctttggcggaaatccattggccagtgcagttgcaattgcttcacttgaagtgataaaaaatgaaaaactagtcgagagatctgtccaaatgggagaaaagctcattggtcagcttcttgagattcaagagcaatacccagattacgtgaaggaggtacggggaagaggattattcattggagtggagctcaacagaaaaaaattgttccctgtatcggtgtatgagctaagtacaaaattgaaggaaagagcagtgcttgcgaagccaacacatgatacaataatccgctttactcccccactttgcataagtgaggatgagatcaaacaaggttccaaggcctgggctgatgttctgggaattgatcttccaaagttgcagaaggctaagccaatagagactgctccagtttctgatagtgcttgtgatcgttgtggtagagtcatgtatgattaatcagataaaggaatatggttttgcaggtacctttagttctccttggataagaaattatatcacaaatgctatgccttaagcatgaacctctagaaactactttcaaatattccatatatgcttatatcatgaaataaagatgtcatagtgttgaatggacctcacctcctacaagtttcaagttaaataaggaca

SEQ ID NO: 8933 - DNA, 1625 bp, Trifolium pratense
catccatccatccatcaatggcttccactagacaagtacactgtttgatgcgaagattttacagaggtagtagaaccttcgctgttgccacacaaccaaccgcttcttcctcttcccaaacaatcatcgacaaagaattccagcacagtgcccacaattaccatccacttcccattgtatttgctcatgcaaagggatcagctgtgtgggatccagagggaaacaaatatattgattttctatctggatattctgcagttaatcagggacattgtcatcctaaaattctgaaagctttaaaagatcaggcagaaaggctgactgtgagctctcgagccttctacaatgatcgttttccggtctttgctgagtatttgacagccttgtttggttatgatatggtacttcctatgaatactggtgctgaaggtgtggaaacagctttgaaattagcaagaaagtggggttatgaaaagaaaaaaattcccaacgatgaggctcttattgtctcatgctgtggctgcttcaatggccgtacattgggtgtcatatctatgagttgtgacaatgaagctactcgtggttttggtcctttaatgccaggacatcttaaagttgattttggtgatgcagaagccctcgagaaaattttcaaagaaaaaggagaccacatagctgcatttattttagaaccaatccaaggggaagccggggtgaaaattcccccagatggctatttgaaagctgttagagatctttgctccaaatataatgtgttgatgattgctgatgaaatacaaactggattagcaagaactgggaaaatgctggcttgtgagtgggaagatgttcgtccagatgtagtgatattagggaaagcattgggtggaggaatcataccagttagtgcagttcttgcagataaagatgtgatgctttgtataaaacctggacaacatggaagtacttttggaggaaatccattggccagtgcggttgccattgcctcacttgaagtgatcaaagaagagagacttactgagagatctgtcaaaatgggaggtgagcttctcggtctgctgcataagattcagaagcaatatccggaccacgtcaaagaggtgcggggaagaggattgttcattggtgtggagcttaacagcgaaagtttgtcgcctgtatcaggctttgagttaagcgaaaaattgaaggaaagaggagttcttgccaagtcaacacatgacacaattattcgcttcactcccccactctgcataagcgcggatgagattcaacaaggttctaaggcccttgctgatgtgctggaaattgatctaccaatgttgaagaagatgaagccaaaagatgctgctcctctagctggccctagtgcatgtgatcgttgtggtcgagtcgtgtatggttaaccatataatgaatgaatggtctgtgaattttatattttatttttgtttggaaaaggatatctcatgcactcacaaatgttgttttataattatacatgaaccaaaagaaactactaatatttaccatattgtatttatttatgaaattaaaaaatgtcaccaggtcattgaaatcacttattcctagtatcagtgttg

SEQ ID NO: 8934 - DNA, 1695 bp, Trifolium pratense
catcagttccattacatcaaaatataaacacaacaaaattgtgggaacaagtttcacaaaattgatccttccgaatctctcatcatcaatggcttcttccactagacaagtccagtgtttgatgcgaagattttgcaggggcagtagaacctttgctgttgccacacaaccaacctcttcttcctcttcccaaacaatcatcgacaaagaattccagcacagtgcccacaattaccatccacttcccattgtatttgctcatgcaaagggatcagctgtgtgggatccagaaggaaacaaatatattgattttctatctggatattctgcagttaatcagggacattgtcatcctaaaattctgaaagctttaaaagatcaggcagaaaggctgactgtgagctctcgagccttctataatgatcgatttccggtctttgctgagtatttgacagccttgtttggttatgatatggtacttcctatgaatactggtgctgaaggtgtggaaacagctttgaaattagcaagaaagtggggttatgaaaagaaaaaaattcccaacgatgaggctcttattgtctcatgctgtggctgcttcaatggccgtacattgggtgtcatatctatgagttgtgataatgaagctacccgtggttttggtccattaatgccagggcatcttaaagttgattttggtgatgcagaagccgtcgagaaaattttcaaagaaaaaggagaccacatagctgcatttattttagaaccaatccaaggggaagccggggtgaaaattcccccagatggctatttgaaagctgttagagatctttgctccaaatataatgtgttgatgattgctgatgaaatacaaactggattagcaagaactgggaaaatgctagcttgtgagtgggaagatgttcgtccagatgtagtgatattagggaaagcattgggtggaggaatcataccagttagtgcagttcttgcagataaagatgtgatgctttgtataaaacctggacagcatggaagtacttttggaggaaatccattggccagtgcagttgccattgcctcacttgaagtgatcaaggaagagagacttactgagagatctgtcaaaaggggaggtgagcttctcgggctgctgcataagattcagaagcaataccctgaccacgtaaaggaggtgcggggaagaggattgttcattggtgtcgagcttaacagccaaaatttatcccctgtatccggctttgagttaagcgaaaaattgaaggaaagaggagttcttgccaagtcaacacatgacacaattattcgcttcacccccccactctgcataagcgcggatgagatccaacaaggttctaaggcccttgctgatgtgctggaaattgatctgccaatgttgaagaagatgaaaccaaaagatgctgctcctctagctggccctagtgcatgtgatcgttgcggtcgagtcgtgtatggctaaactatataatgaatggcctgtgaattttatatttatttttgtttggaaaaggatatctcatgcactcacaaatgttgttttataattatacatgaaccaaaagaaactactaatatttaccatattgtatttatttatgaaattaaaaaatgtcaccaggtcattgaaatcacttattcctagtatcagtgttg

SEQ ID NO: 8935 - DNA, 1744 bp, Trifolium pratense
acatcaaaatataaacacaacaaaattgtgggaacaagtttcacaaaattgatccttccgaatctctcatcatcaatggcttcttccactagacaagtccagtgtttgatgcgaagattttgcaggggcagtagaacctttgctgttgccacacaaccaacctcttcttcctcttcccaaacaatcatcgacaaagaatttcagcacagtgcccacaattaccatccacttcccattgtatttgctcatgcaaagggatcagctgtgtgggatccagaaggaaacaaatatattgattttctatctggctattctgcagttaatcagggacattgtcatcctaaaattctgaaagctttaaaagatcaggcagaaaggctgactgtgagctctcgagccttctacaatgatcgttttccggtctttgctgagtatttgacagccttgtttggttatgatatggtacttcctatgaatactggtgctgaaggtgtggaaacagctttgaaattagcaagaaagtggggttatgaaaagaaaaaaattcccaacgatgaggctcttattgtctcatgctgtggctgcttcaatgggcgtacattgggtgtcatatctatgagttgtgataatgaagctacccgtggttttggtccattaatgccaggacatcttaaagttgattttggcgatgcagaagccatcgagaaaattttcaaagaaaaaggcgaccgcatagctgcatttattttagaacctatccaaggggaagctggggtgaaaattcccccagatggctatttgaaagctgttagagatctttgctccaaatataatgtgttgatgattgctgatgaaatacaaactggattagcaagaacgggtaaaatgctggcttgtgagtgggaagatgttcgtccagatgtagtgatattagggaaagcattgggtggaggaatcataccagttagtgcagttcttgcagataaagatgtgatgctttgtataaaacctggacagcatggcagtacttttggaggaaatccattggccagcgcagttgccatcgcctcacttgaagtgatcaaagaagagagacttactgagagatctgttaaaatgggaggtgagcttctcggtctgctgcataagattcagaagcaatacccggaccatgtaaaggaggtgcgtggtagaggattgttcattggtgtggagcttaacagccaaaatttatcccctgtatctggctttgagttaagcgaaaaattgaaggaaagaggagttctcgccaagtcaacacatgacacaattattcgcttcacccccccactctgcataagcgcggatgagatccaacaaggttctaaggcccttgctgatgtgctggaaattgatctaccaatgttgaagaagatgaagccaaaagatgctgctcctctagctggccctagtgcatgtgatcgttgtggtcgagtcgtgtatggctaaactatataatgaatggtctgtgaattttatatttatttttgtttggaaaaggatatttcatggattcacaaatgttgttttactagttacaaaacccgtgcattgcacgggctccttaaaataattcctacaatattgtcaaaacttattgtcattgtttgtagttatttttgttggattattttgatataatgcagaaattataaagtatacaaatttatattccatacagtgaatatcatttgaaaattgtttt

SEQ ID NO: 8936 - DNA, 1878 bp, Trigonella foenum-graecum
ctgcaatttcctatgaccaatgttaaagaatactagaagtctttttttagaaaaaatattaatattaatattttcatatttatctgccaactttattttacatcatcaatcaagaacacaatactactaagaactaaattcacaaaattgagacattcatctgaatctctctcagtctcttctcatcaatggcttccacaagacaagtacaatgtttgatgcgaagagtttgcagaggaactagaacttttggtgttgccacacaacccaatacttcttcctcttcccaaacaatcatcgacaaagaatttcaacatagtgcccacaattaccatccacttcctattgtatttgctcatgcaaagggatcagctgtgtgggatcctgagggaaataaatatattgattttctgtctggatattctgcagttaatcagggacattgtcatcctaaaattctgaaagctttaaaagatcaggcagacagtctgactgtgagctctagagccttctacaataatcgatttccggtctttgctgagtatttgacagctttgttcggttatgatatggtacttcctatgaatactggtgctgaaggtgtggaaacagctttgaaattagcaagaaagtggggttatgaaaagaaaaaattcccaacgatgaggctcttattgtatcatgttgtggctgcttcaatggtcgtacattgggtgtcatatctatgagttgtgacaatgaagccacccgcggttttggtcctttaatgccaggccatcttaaagttgattttggtgatgcagaagccgtcgagaaaattttcaaagaaaaaggagaccgcatagctgcatttattttagaacctatccaaggggaagctggggtgataattcccccagatggctatttgaaagctgttagagatctttgctccaaatataatgtattgatggttgctgatgaaatacaaactggattagcaagaacagggaaaatgctagcttgtgagtgggaagatgttcgtccagatgtagtgatactagggaaagcattgggtggaggaattataccggttagcgcagttcttgcagacaaagaagtgatgctttgtataaaacctggacagcatggaagtacttttgggggaaatccattggccagtgcagttgccattgcctcacttgaagtgatcaaagaagagaaacttactgagagatctacccaaatgggaggtgagcttctcggtctactgcataagattcagaaacaatatccggaccacgtgaaggaggtgcggggaagaggattgttcattggtgtggagcttaacagcgaaaatttgaaccctgtatcaggctttgagttaagcgaaaaattgaaggacagaggagttcttgccaagtcaacacatgacacaattattcgcttcactcccccactctgcataagtgcggatgagatccaacaaggttctaaggcccttgctgatgtgctggaaactgatctaccaatgttgaagaagatgaagccaaaagatgctgctcctccagctggccctagtgcatgtgatcgttgtggtcgagtcgtgtatggttaaccagataataattgcctggtctatgaattttataagacttatattttattttttgtttggaaaaggatatctcatggattacaaatgttgttttatagaacagaaagaaactaataaaacttaccatatcatatttatgaaatttaaaaaagtcactaggtccttgagatcacttattcccagtgttgtctattcatgaccagatcactcaaaattcttcattttttttaattctatgagctgagcagtgcttaacaggggtgtgtaaatcaaaagtacaa

SEQ ID NO: 8937 - DNA, 1598 bp, Arachis hypogaea
atggctgcgaggagacccgtccagtgtttgctgcaaagggtttgcggcggaagcagacgattcggtgttgctcttcagggccatgcttcttcttcctcttctcagcaactcattgacaaggaatatcagtacagcgcccacaattaccatccaattcccattgtgttttctcaagcaaagggagctgctgtgtgggatccagagggaaacaaatatcttgatttcttatctgcttattctgctgttaatcagggacattgccatcctaaaattctgaaagccttaacagagcaggcagaaaagctgaccctgagctctcgagccttttacaatgatcggtttccaccatttgctgagcatttgacaagtatgcttggttatgatatggtgcttcccatgaacactggtgctgaaggagtggaaacagctctgaaattagcaagaaagtggggttatgaaaagaaaagaattcccaaagatgaggctattattgtgtcatgttgtggctgcttccatggccgtacactagctgttatatctatgagttgtgacaatgaagctacccggggttttggtcctttattgcctggccatcttaaagttgattttggtgatgtagaagcccttgaaagaatttttaaagaaaaaggagaacacatagctggctttcttttggaacccatccagggtgaagctggggtaatcattcctccggatggctatttgaaagctgttagagatctttgcagcagatataatgtgctgatgattgcagacgaaatacaaactgggttagcaagaacagggaagatgctggcttgtgactgggaagaagttcgcccagatgttgtgatactagggaaagcattgggtggaggagtttttcctgtgagtgcagttcttgcagacaaggatgtaatgctttgtataaaaccaggagagcatggaagtacctttggcgggaatccattggccagtgcagttgcaattgcggcactaaatgtgatcaaagaggagaggcttgtcgaaagatctgagcaactgggaaaggagctcggccgtgagctgcacaagattcagcaacaatacccgaagtatgtgaaggaggttcgcggacgaggattgttcggcgcggtggagcttaacagcaagagcttgtcccctgtatcagcctatgatttgtgcgaaaagctgaaggatagaggagttcttgcaaagccgacacacgatacaattatccgctttacgcctccactttgcatcagttgggatgagatacaacaaggttctaaggccctggctgatgtcttggaaattgatttacccaagcttcaaaagacgaagccaaaacatgatgcttctcaagttgcctcccattcccgtgcatgcgatcgttgcggtcgactcttgtacggttgaatcattagagcacccttttatatttgtaatatcctcacactattcaataatcgagattagtttcttgacaacaatgccataatttattagttttgtgatattgttgaaaaatcacaaatataaaacagtgtatcgccgtttcagttatactctaatatgttatgttgtctgtcctgtag

SEQ ID NO: 8938 - DNA, 1692 bp, Lotus japonicus
ggtgtgttcatctttcatcaatggctaccatgagacaagttcagtgtttgatgcgaagaatttccagaggaagtaggagttatggggtcgccacacaactcaacgcttcttcctcttctcagacagtgattgacaaggagtataagcacagtgcccacaattaccatccacttcccattgtattttctcaagcaaagggagcttgtgtatgggatccagaggggaacaagtatattgattttctatctggttactctgctgttaatcagggacattgccatcctaaaattctgaaagcattacaagagcaggcagaaagcctgactgtgagttcccgagccttctacaatgatcgctttccgctgtttgctgagtatgtgaccaacatgtttggttatgatatggtgcttcctatgaataccggtgctgaaggtgtggaaacagctatgaaattagcaaggaagtggggttatgaaaagaaaaggattcccaataatgaggctcttatcgtctcatgctgtggctgctttaatggtcgtacactaggtgtcatatctatgagctgtgacaatgaagctacccggggttttggtcctttaatgccaggcaatcttaaagttgattttggtgatgcagaggccctcgaaagaatttttaaagaacatggagacaaaatagctggatttattttagaacctattcaaggtgaagctgggatcaaaatccctccagttggctatttgaaagctgtaagagatctttgctccaaatataatgtgttgatgattgctgatgaaatccaatctggattaggaagagcagggaagatgctggcttgtgactgggaagatgtccgtcccgatgtagtgatactggcaaaagcattgggtggtggaattttaccagttagtgcagttcttgcagacaaagatgtcatgctttgtataaaacctggacagcatggaagtacctttgggggaaatccattggccagtgcagttgctattgcctcactagatgtgatcaaggaggagagacttgtagagagatctgcccaaatgggagaggagcttcttaatcagctgcgtaagattcagcagaaattcccggatcacgtgaaggaagtccggggcaaaggattattcattggactggagcttaacagcaaaaggttattccctgtatcaggctttgagttaagtgataaacttaaggatagaggagtccttgccaagccaacacatgatacaattattcgctttactccccctctctgtataagtcgggatgagattctggaagcttctaaggccctgtctgatgttctggaaactgatctgccaaagttgctgaagatgaagccaaaggatgctgctcctccagctgcccctgaagcatgtgatcgctgtggtcgagtcttgtatggttagaccacataaagataaatgaattgcatgaaccttcaattgttattatggttatttttctttggaaaaggagacattaaaagaacaatttttacttgtaatacatgaaccagaataaagatattggtaagttgttactggttacattggtaagttgttacttttcacattggtaagttgtttttgtagaaaactgcttttctcttattcagtatatttctgtcacatgtacaaggtttgttatatatagactttagacctaaat

SEQ ID NO: 8939 - DNA, 1590 bp, Pisum sativum
tcgggagaccaatcaacaagacaacgtaaacaatttcatacaattgaaacatctcaaactctcatccatggctgccacacgacaagttcaatgtttgatgcgaagagtttgtagaggtactagaactttcgctgtcgccacgcaatccaatgcttcttcctcttcacaaacaatcatcgacaaagaacaccagcacagtgcccacaattaccatccacttcccattgtttttgctcatgcaaaggggtcatctgtctgggatccagagggaaacaaatatattgattttctatctggatattctgcggttaatcagggacactgtcatcctaaaattctgaaagccttacacgatcaggcggataggcttacggtgagctctcgcgcgttctataatgatcggtttcccgtctttgctgagtatttgacagccttgtttggttatgatatggtacttcctatgaatactggtgctgaaggtgtggaaacagctttgaagttagcaagaaagtggggttatgaaaagaaaaagattcccaacgatgaggctcttattgtatcatgctgtggctgcttcaatggtcgaaccttgggtgtcatatctatgagttgtgacaacgaagctacccgcggttttggtcctttaatgccaggccatcttaaagttgattttggtgatgcagaagccattgaacgaattttcaaagaaaaaggagaccgcgtagcggcttttattttagaacctatccaaggggaagctggggtggtaattcccccagatggctatttgaaagccgttagagatctttgctccaaatacaacgtgttgatgatcgccgatgaaatacaaactggattggcaagaacagggaaaatgctggcttgtgactgggaagatgttcgtccagatgtagtgattctagggaaagcattaggtggaggaattctaccagttagtgcagttcttgccgacaaagatgttatgctttgtattaaacctggacagcatggaagtacttttggaggaaatccattggctagtgcagttgccattgccgcgcttgaagtgatcaaagaagagagacttaccgagagatctaccaaattgggaggcgagcttctcggtttgctgcataagattcagaagaaacacccggagcacgtaaaggaggtgcggggaaaaggtttgtttattggagtggagcttaacagcgaaagcttgtctcccgtgtcaggctttgagttaagcgaaaaattgaaagaaagaggagttctcgccaagtcaacacacgacacaattattcgcttcactcccccactctgcataagcgcggatgagattcaacaaggttctaaggccttggctgaggtgctggaaatagatctaccattgttgaagaagacgaagccaaaagatgctgttcctctagctgggcctagtccatgtgatcggtgtggtcgactcgtgtatggttaacaagataatgaatggtctacgaattttataaaacttttgcttgaaaaaggatgtttcatagatgatcataaatgttgttttatctataaaccaaaagaaattaataaaactta

SEQ ID NO: 8940 - DNA, 5187 bp, Cicer arietinum
tttttattttggaatactaatacagcatttgttatttatttagtattacatataatataagatttaactcatctgacatatagttttatcataagttatataaggaattactttcttttttttttactttttcaaaatgtgtaataatttaaaaaaaggttaaaattgagataaaatagattttgttggaaaaactatttgagatgattagttgcatgacacccatttgtatgcatcagcaaaagcaatatttaaaatatattatcattatatttatatatgccaacttttatttacatgagtttatttagttgaataaatcaagaagacaattgtgagaaagagtttcagaaaattgaggcatatctgaattctgaatctcttcatcaatggctgcaactaaacaagttcagtgtttgatgcgaagagtttgcaacggaagaagtagaacttttggggttgccgcacaacccaatgcttcttcctcttctcagacaattatcgataaggaatttcagcatagtgcccacaattaccatccacttccaattgtatttgctcatgcaaaaggatcggctgtgtgggatccagagggaaacaagtatattgattttctatctggttactctgcagttaatcaggggcattgccatcctaaaattttgaaagcattaaaagaccaggcagaaaagctgaccgtgagctctcgggccttctacaatgatcgttttccggtctttgctgagtatttgacagccttgtttggttatgatatggtgcttcctatgaatactggtgctgaaggtgtggaaacagctctgaaattagcaagaaagtggggttacgaaaagaaaaagattcccaacaacgaggctcttattgtctcatgctgtggctgtttcaatggtcgtacgttgggagtcatatcaatgagttgtgacaatgaagctacccgcggttttggtcctttaatgccaggccatcttaaagttgattttggtgatgcagaagctgtcgagaaaattttcaaagaaaacggaaaccgcattgctgcattcattttagaacctatccaaggagaagctggggtgaaaattcccccagaaggctatttgaaaactgttagagatctttgctccaaatacaatgtgttgatgattgctgatgaaatacaaactggattagcaagaacagggaaaatgctggcttgtgattgggaagatgtccgtccagacatagtggtattaggaaaagcattgggcggaggaattataccagttagtgcagttcttgcagacaaagaagtgatgctttgtataaaacctggacagcacggaagtacctttgggggaaatccattggccagtgcagttgccattgcctcacttgaagtgatcaaagaagagaaacttgctgagagatctgcaaaaatgggagatgaacttcttggtctgctgcataagattcataagcaatatccagaccacgtgaaggaggtgcgcggacgaggattgttcattggagtggagcttaacagagaaaaattgtcccctgtatcgggcttcgagttaagcgtaaaactgaaagatagaggagttcttgccaaggcaacacatgacacaattattcgtttcactccgccactttgcataagtgacgatgagatccggcaaggttctaaggcactggctgatgtgcttgaaattgatctaccattgttaaagaagatgaagccaaaagaggctgctcctctagctggtcctagtgcatgtgatcgttgtggtcgagtcgtgtatggttaaccggataatgattggtctatgaattttatgcaacttgtattttatttttgtatggaaaaaggatatctcatggattcacatatgttgttttatacatgaaccaaaagaaactaataaaacataccatattatattatgaaatgaaatgaaaaaatcattgtgacagcgagatcacttatctcctgtgttgtccatttctgacaagatcacacagaattttttttatattcaattcacactatgatcataacagtacttaagagggggtgataatcacattactaatgaataaggatggttttaaatttgtttagcatggattttgattgtctttcaagtattttcctttgttcatgttttcccttttctgcgtttattttgtctttcagttattttttttgttaattatatcaataaaaatctttttgttgcttaaaaaaggtggcgagtagtttggttttgaaggtcttgaattggaggttttagaaagtaaaagaatatcttcaaatgtcaaagtaccttttacatttctccaaaacacaatgaactttgcacgcatacataataaatagattaaaaatgaaaatgaaaatgcaaaaatactgaatgcaattgaatgactttgaaaatgatccaacaagaaaaatcaacacttgatgacaacagctagcatatcaactgtttttgtgaagccaggctttgccacacatcttgttctagctagtactccattttttcaaatcctaaaaacagaattcacatatattaataataactttagtattaatattaaaagtaaaaccattagccaaatccaagatgcttatgcttgccccttgcaagttgcaatgaattaaaaaaattataaaaaggagcacacaaaaagatgaaactagaaaatatacattagatatactttaacagttggaatgtaatgttagcacaataatgtttggtctaacaggctatagatgctgcatggaagtaattaaggtggagctagaaagcaggaattagtattgaaatcgaaaattaacttgagattcagcaagctcagtaactataacacgatcactaaaaatttaccgaccatttttcagcgacaaaccatatgtttagggttgtacaagattcggtccgtcccgcaaacacgtcttatacagtaaacaataggataggtttgattaagttttagaaaaaatgacaaaaataaggacaagacaaatacaaggtagaaaaataacttggttcggtttaactccgagttaccaatcccatcctaaattaatttaagtataaataaatagtttttgttattattttatgttattattgattcaccgtctgaaaaagttaatcaccaacttattaatttataatatataaaataatattatgggttattacactttaataagttgacaagtggttaccatatgttacttattattatgagtttctttaggtttaattgcttttattttaaaaaaagtttagaattactatttaacaatttcatatttttattttgtctcatctttaatgaactcgcaactcattagatttgatcggattaaggaacaagttcgaatttaaaatttaaatctatcaaatattaagagatactccaaactcatcctttatacactctaatatatgcaattaatacttttaaattataaaaccttgcatttacttatatgtatactatactatatcattaccaaatcatttaagcttttgggaaacctgaatataagatactgtaatatcttagaactaatttattaaccatatggtttgccacttagcattcggttccttgaaataaggaaactatgaattgatatgaactaagttgtgagtctccaaccctaataaaaataaaatattggctatgtactctttcaagtgtgacatattaaagtaataaaaatccacatcactcacttacttttttctctaccactaaatagtctatagttctttgacttacttcctttaagaaagatgattcatctagggatgaaaaactttaacttagtttaattatactagcagtcactctccatattttctgttccatagagccccaatattgaactaccaccatatttctctatttaaattttacatttcacaataaaatattccaccatgactagctttttctatatatatatatatatctatagattctgaataattcccggctgattttaccaatttttctcaaatgaggggaaacaatacaaaaatattggcaacgagtatatatacatacacacatctatatatatctgtatggaattgtattaatcagaagatatacacacaactgaaaaaaaataaaaataattatgaaaattagagatgaaaaaaataaatttgatatttaaatttgcatttttcacatttagcaacataattagtgacaaatttttcatttttccgcttctaaattttagtttggtcgttatttcaataatttctagtaatcatttatgcatatagaaattacttactattttaaagttggagcatgcaattgagcactcaataagggtataaagcacaaaaataaatattatttgtctagaactgaagaaatggaattctcttaaacctggttcatataaaaatacctttaagtgtcctatggaaaacacctataagggtaccctacaaatgtgtcctacataaggctgcatcactgcttaataaatggcagtgtgctcagcacacgttagtcaatgcttttagatggaggatacattttttttacatgagtggcgatactttgcacaattacaatatgtttcgtttaaaataaaatataaataaaaagattaatcaaagatgtatttgattatttaaattaagttaattaattttttaattaatatttttgtttatattttatttttaaaagagtagttttttgtatccctaaataaaaaatcttttttgaatatagtgtgtataaatacacgtaggcagagcttgtccaattattatgaagaggtcaatttttattttatttttataattttttggtgaagagggccaatttaattaagtggtatattaaagttaaaagtcacacataattgaattaattcatagtagttatatattatattatgttaaaagtaatatgcaacaaaaataaaagataaaaaggtacaccaattaaattaaattaaatgttttaaaaactgttgaagaaaaaaaaagagagagagagagagagcaaagaagaagcagattcacgatggggaagtgttggaaattagggtgggctaagcaataaatattttggtaagaaaataattacatgaaggaaaaacttagagatatatggtaaattattaatatacaataa

SEQ ID NO: 8941 - DNA, 1445 bp, Trifolium pratense
gggcagtagaacctttactgttgccacacaaccaaccacttcttcctcttcccaaacaatcatcgacaaagaatttcaacacagtgcccacaattaccatccacttcccattgtatttgctcatgcaaagggatcagctgtgtgggatccagaaggaaacaaatatattgattttctatctggctattctgcagttaatcagggacattgtcatcctaaaattctgaaagctttaaaagatcaggcagaaaggctgactgtgagctctcgagccttctacaatgatcgttttccggtctttgctgagtatttgacagccttgtttggttatgatatggtacttcctatgaatactggtgctgaaggtgtggaaacagctttgaaattagcaagaaagtggggttatgaaaagaaaaaaattcccaacgatgaggctcttattgtctcatgctgtggctgcttcaatgggcgtacattgggtgtcatatctatgagttgtgataatgaagctacccgtggttttggtccattaatgccagggcatcttaaagttgattttggtgatgcagaagccgtcgagaaaattttcaaagaaaaaggagaccgcatagctgcatttattttagaacctatccaaggggaagctggggtgaaaattcccccagatggctatttgaaagctgttagagatctttgctccaaatataatgtgttgatgattgctgatgaaatacaaactggattagcaagaactgggaaaatgctggcttgtgagtgggaagatgttcgtccagatatagtgatattagggaaagcgttgggtggaggaatcataccagttagtgcagttcttgcagataaagatgtgatgctttgtataaaacctggacagcatggcagtacttttggaggaaatccattggccagcgcagttgccatcgcctcacttgaagtgatcaaagaagagagacttactgagagatctgttaaaatgggaggtgagcttctcggtctgctgcataagattcagaagcaataccctgaccacgtaaaggaggtgcggggaagaggattgttcattggtgtggagcttaacagccaaaatttatcccctgtatctggctttgagttaagcgaaaaattgaaggaaagaggagttctcgccaagtcaacacatgacacaattattcgcttcacccccccactctgcataagcgcggatgagatccaacaaggttctaaggcccttgctgatgtgctggaaactgatctaccaatattgaagaagatgaagccaaaagacgctgctcctccagctggccctagtgcatgtgatcgttgtggtcgagtcgtgtatggctaaactatataattaatggtctgtgaattttatgtttatttttgtttggaaaaggatatttcatggattcacaaatgttgtttta

SEQ ID NO: 8942 - DNA, 1798 bp, Lupinus angustifolius
caaagattgaaagaagaataaataagcatgttgagttacgtgattgatctatgttacttttcagaacagacactacaatttcataagcacactttcgaaattccacagaaaattaaggtatcttaaatctcaatccctcaactcatcaatggcttcaaggaaacctgttcagtgtttgctgcaaggggtttgcagagaaggaagtaggagaagttttggggttaccccacaagccaatgcttcttcttctcagaaaatcatcgataaggaatatgaattcagtgctcacaattaccatccaattcccattgtattttctcgagcaagaagatcgactgtttgggatccagagggaaacaaatatcttgattttctatctgcttactctgcagttaatcagggacattgccatcctaaaattatgaaagcgttacaagagcaagctgaaaagttgaccctgagctctcgagccttctacaacgatcgattcccaccatttgcggagtatctgacaagcatgtttggttatgacatggtactccctatgaatactggtgctgaaggtgtggaaacagctctgaaattagcaagaaagtggggttatgaaaagaaaaaaattcccaaagatgaggctgttatagtctcatgctgtggctgcttccatggtcgtacaatagctgtcatatctatgagctgtgatactgaagctactcatggttttggtcctttattgcctggccaacttaaagttggttttggtgatgcagaagcccttgaaagaatttttaaagaaaatggacaacgcatagctggatttctttttgaacccatccaaggtgaagctggggtaataattcctccagatggctacttaaagactgttagagatctttgctccaagtataatgtattaatgattgctgatgaaatacaaactgggttagcaaggacagggaagatgctagcttgtgactgggaagatgttcgtccggatgtagtgatactagggaaagcattgggtggaggagttatacctgttagtgcagttcttgctgacaaagatgtaatgctttgcataaaacctggagagcacggaagtacctttgggggaaatccattggccagtgctgttgcaattgcctcactgaatgtgatcagagatgagaaacttgctgaaagatctttccaactcggagaggagcttactcgtctgctgcttaaggttcagcagcaatacccgaactacgtcaaggaggtacggggaagaggattgttcaatgcagtggagcttaacagcaaaaatttgtcccctgtatcagcctatgatttatgccaaaaactgaaggatagaggagtccttgccaagccaactcatgattcaattatccgctttactccaccactttgcatgagtttggatgagatccaagaaggttctaaggcactggttgatgttctggaaattgatctaccaaacttgctgaagatgaagccaaaagatgcttctccatctgctcctagtgcatgtgatagatgtggtcgtgtcttgtatggttaaccagataaaaatccatgagttgagtgtatgaagggaaaggaaataagtgcaattcatatgaactttggttaataaactttgttgaccatttaaaataattgaaatgactcaataggtttttgtgtttatatgtgtatgttatggttggcgcaacattgaagttattacttagtgatcatgaggttacaggtgtaaattctagaaacagtctttctgcttgcaaaataaggttgcatataa

SEQ ID NO: 8943 - DNA, 1428 bp, Vicia sativa
atggctgccacacgacaagttcactgtttgatgcgaacagtttctagaggtactaggttcttcgctgttgccacacaatccaacgcttcttcctcttcccaaaccatcatcgacaaagaataccaacacagtgcccacaactatcatccacttcccattgtttttgctcatgctaagggttcatctgtgtgggatccagagggaaacaaatatattgattttctgtctggatattctgcggttaatcagggacactgtcatcctaaaactctgaaagccttacatgatcaggcggataggttgacggtgagctctcgtgcgttctataatgatcggtttccggtttttgctgagtatttgacagccttgtttggttatgatatggtgcttcctatggatactggtgctgaaggtgtggaaactgctttgaaattggcaagaaagtggggttatgaaaagaaaaaaattcctaatgatgaagctcttattgtctcatgctgtggctgcttcaatggtcgtacatggggggtcataactatgagttgtgacaatgaagctacccgcggttttggacctttaaagccaggccaacttaaagttgatttgggggatcaaaaacccattgaacggattttcaaagaaaaaggaaaccgcataccggcttttattttaaaacctatccaaggggaagccagggtggtaattcccccagatggttatttgaaagctgttagagatctatgctccaaatacaacgtgttgatgattgctgatgaaatacaaactggattagcaagaacagggaaaatgctggcttgtgaatgggaagatgttcgtccagatgtagtgattctagggaaagcattaggtggaggaattataccagttagtgcagttcttgccgacaaagatgtgatgctttgtattaaacctggacagcatggaagtacttttggaggaaatccattggctagtgcagttgccattgcttcactcgaagtgatcaaagaagagagacttaccgagagatctaccaaaatgggaggcgagcttctcggtctgctacataagattcagaagaaacacccggaccacgtaaaggaggtacggggaagaggtttgtttattggagtggagcttaacagcgaaagcttgtctcccgtatcaggctttgagttaagcgaaaaattgaaagagagaggagttcttgccaagtcaacacacgacacaattattcgcttcacccccccactctgcataagcgcggatgagattcaacaaggttctaaggcattggctgatgtgctggaaattgatctaccattgctgaagaagatgaagccgaaagacgctgttcctccagctgggcctagtccatgtgatcgttgtggtcgactcgtgtatggttaacaatataatgaatggtct

SEQ ID NO: 8944 - DNA, 3320 bp, Glycine max
ctaaactaacgtcgcctttatccgcttccccaccgtgcttttcagattggtcaagctccttttactccccgcaacaaaacaccacctagttgcagattttttcttcttcaaaaatttgtttatctttatcctaatttgatttggctttaaggttttccattatagcggttttctttttattatttgttgttattattatgacgtaatttcaatccttttcataatgactccataatggcgattagtgaagtttctgagctgtgtgagcgatttagtataaagtatacgatgcatcgtttctggttctggatgttcatgttcgagcaaagatcttctgtgtgtgtacggttactgctttgacgttttggattttcagtaagtcaaatctcggaagtcctcagtgaagttcttcagcttagttagggtttggaagatacttatgaaaaagaaaaatcacttagtatagggattagtattttccctggatccagggttagttttcaataatttttaaggttggatttgaagtgaatggttttagaaagggatactctgctcaccagaaagggttttttgtttgagagtgctgtggatatatggtcagggcatttgttagtcttactttatagttgtattggtcttattattttcttttaactgcatatctagtgatttgcagttgaacttgggttggggttcctggtgattattgcatgtgctgtttttctttggatgagaacgggttataataatcactgtgaatttgggcattctggatgacaagggttgtccagatgagtgttgatggcgacggcaaagagctgagagaactgaatcagtgcttacgagatgggaagaaaattgctggtggggaacgtggtttatacgagggcgatgaagtgaaatgtaatggagttgctgaagaagttaagattggaaagggggggattgtggagtcctcctctgtccagcagcatataccacagcctcaaggggcaataatttgttgggagaggtttttgcatattagatcccttaaggtcttgcttgtggagtatgatgactctacccgtcatgttgtcactgcactgcttcgcaattgtagttatgaagttattgacgcagcaaatggattgcaagcttggaagatattggaggatttaaccaatcatattgatctcattttaactgaggtggcaatgcctggcttatcaggcattggtctactatacaagattatgggccacaaaacccggaaaaatattccagtagttatgatgtcatctcatgattctatgggtttagtctttaagtgtttgtcaaagggtgctgttgactttctagttaaacccatacggaagaatgagcttaaaaacctgtggcagcatgtttggagaagatgtcacagttctagtgggagtggcagtgaaagtggcacacaaacccagaagtctgtaaaatcaaagagtcttgagaagtttgataataattctggaagcaatggcgaagatgataatggaagtataggactgaataatggggatggaagtgacaatggtagtggcactcagagctcatggaccaaacatgctgtagaagttgatagtcctaaaccagtttcccactgggataaaatagctgagtgccctgacagtacctgtgctcaagttgttcactccaatgctgaaattggtgagaacaaggtggttcctctagctgcgaaggagtgtccagaacagaaggaacaacttgtcaaaactgcaggttctaaacatagcaatgcacctgatgtcggcccctctaaatttaatgatcaaattaatagaggacaactggatcttaattgtgaaaatcaatctagcaagctaaggtgcaaaggtttatcactgtctgatgccattactagcacttctgattctcagatgcatagtggaggatttgaagccctgtataaaaaacccaagtcctcagatattgaaaataaagacactaataatgatgaagaattgccatctcttgagctcagtttaaagaggcttagaggagttgaagatgctggtattgcaattcaggatgacaggaatgttttaagacgttctgatcagtctgctttctcaaggtacaatgcagccttaaaccctaagaaatctcccactggatgtgttggaagcaattctcctcataataatagcttagaagttacaaagaaagattcatctcacgatattcaatctcattctagcggcaatcctcctaaccaaaactcaaatggtgctagcaataacattgatatgggttccactactaataatgcttacgctaaatctgcagttataagtgagccagcagtagcatcgacaaccaaatgtttgtaccaaacatctgcttaccagcctgaaaaaaacaaccttgtttgtacctctcaacaagttgtcttacataatactgaagatacgacggcaacaatgctggcaccacctaaactagacagacataaagattctgcagctccagacttccatctccattgtgaaaaccataactgtattgctgacaacatgaagcaccagctgccacctgatcatgatgctgaatctataaagaaaatggccactgctgctccacattgtggatcatcaaatgcggttgaagtgctagttgaaggtaatgttggaaaccacagtatcaatagaagtgcctcaggcagcaacaatggaagcaatggacaaaatgggagcagcacggcggttaatgctggagggacaaacatgaaaagcaacaatggactcactgggaatagtggcagtggtgatgctagcggaagtgtaagtgccaacagagtagatcaaaacaagacttctcaaagggaagcggccttaactaaatttcgccaaaagagaaaagagagaagggagaggtgctttcataaaaaggttcgatatcagagcagaaagagattagctgaacaacgacctcgatttcgtggacaatttgttcgacagtcctctaacgaaaatgcaagtgaggcaacaacagatagctgattcagagcatttgccacaatggcataatgatggggatatgcgagaaaaggtcgaggagtctgcatgtagaatttgggaattgttctgtgtgtttgtgttaaaaaggtataatgactctggttattccaacttgttcatttgaaacctgaatcaatttatgtggtgagagattgttatatgctgattgatgctcggataacttatagcgactcaataatttcaattacttgtcgatcttgtgcttgaagaatcaaatgtgttagttcacattctgta

SEQ ID NO: 8945 - DNA, 3099 bp, Glycine max
caaccgcggtcatcgcggtcccaacccacccaatatcttttcttttctcctctcccctaaactaacgtcgcctttatccgcttccccaccgtgcttttcagattggtcaagctccttttactccccgcaacaaaacaccacctagttgcagattttttcttcttcaaaaatttgtttatctttatcctaatttgatttggctttaaggttttccattatagcggttttctttttattatttgttgttattattatgacgtaatttcaatccttttcataatgactccataatggcgattagtgaagtttctgagctgtgtgagcgatttagtataaagtatacgatgcatcgtttctggttctggatgttcatgttcgagcaaagatcttctgtgtgtgtacggttactgctttgacgttttggattttcaggttgtccagatgagtgttgatggcgacggcaaagagctgagagaactgaatcagtgcttacgagatgggaagaaaattgctggtggggaacgtggtttatacgagggcgatgaagtgaaatgtaatggagttgctgaagaagttaagattggaaagggggggattgtggagtcctcctctgtccagcagcatataccacagcctcaaggggcaataatttgttgggagaggtttttgcatattagatcccttaaggtcttgcttgtggagtatgatgactctacccgtcatgttgtcactgcactgcttcgcaattgtagttatgaagttattgacgcagcaaatggattgcaagcttggaagatattggaggatttaaccaatcatattgatctcattttaactgaggtggcaatgcctggcttatcaggcattggtctactatacaagattatgggccacaaaacccggaaaaatattccagtagttatgatgtcatctcatgattctatgggtttagtctttaagtgtttgtcaaagggtgctgttgactttctagttaaacccatacggaagaatgagcttaaaaacctgtggcagcatgtttggagaagatgtcacagttctagtgggagtggcagtgaaagtggcacacaaacccagaagtctgtaaaatcaaagagtcttgagaagtttgataataattctggaagcaatggcgaagatgataatggaagtataggactgaataatggggatggaagtgacaatggtagtggcactcagagctcatggaccaaacatgctgtagaagttgatagtcctaaaccagtttcccactgggataaaatagctgagtgccctgacagtacctgtgctcaagttgttcactccaatgctgaaattggtgagaacaaggtggttcctctagctgcgaaggagtgtccagaacagaaggaacaacttgtcaaaactgcaggttctaaacatagcaatgcacctgatgtcggcccctctaaatttaatgatcaaattaatagaggacaactggatcttaattgtgaaaatcaatctagcaagctaaggtgcaaaggtttatcactgtctgatgccattactagcacttctgattctcagatgcatagtggaggatttgaagccctgtataaaaaacccaagtcctcagatattgaaaataaagacactaataatgatgaagaattgccatctcttgagctcagtttaaagaggcttagaggagttgaagatgctggtattgcaattcaggatgacaggaatgttttaagacgttctgatcagtctgctttctcaaggtacaatgcagccttaaaccctaagaaatctcccactggatgtgttggaagcaattctcctcataataatagcttagaagttacaaagaaagattcatctcacgatattcaatctcattctagcggcaatcctcctaaccaaaactcaaatggtgctagcaataacattgatatgggttccactactaataatgcttacgctaaatctgcagttataagtgagccagcagtagcatcgacaaccaaatgtttgtaccaaacatctgcttaccagcctgaaaaaaacaaccttgtttgtacctctcaacaagttgtcttacataatactgaagatacgacggcaacaatgctggcaccacctaaactagacagacataaagattctgcagctccagacttccatctccattgtgaaaaccataactgtattgctgacaacatgaagcaccagctgccacctgatcatgatgctgaatctataaagaaaatggccactgctgctccacattgtggatcatcaaatgcggttgaagtgctagttgaaggtaatgttggaaaccacagtatcaatagaagtgcctcaggcagcaacaatggaagcaatggacaaaatgggagcagcacggcggttaatgctggagggacaaacatgaaaagcaacaatggactcactgggaatagtggcagtggtgatgctagcggaagtgtaagtgccaacagagtagatcaaaacaagacttctcaaagggaagcggccttaactaaatttcgccaaaagagaaaagagagaagggagaggtgctttcataaaaaggttcgatatcagagcagaaagagattagctgaacaacgacctcgatttcgtggacaatttgttcgacagtcctctaacgaaaatgcaagtgaggcaacaacagatagctgattcagagcatttgccacaatggcataatgatggggatatgcgagaaaaggtcgaggagtctgcatgtagaatttgggaattgttctgtgtgtttgtgttaaaaaggtataatgactctggttattccaacttgttcatttgaaacctgaatcaatttatgtggtgagagattgttatatgctgattgatgctcggataacttatagcgactcaataatttcaattacttgtcgatcttgtgcttgaagaatcaaatgtgttagttcacattctgtatgggcagaacagtatcaaaaaatcgcaccatcttcgaatcagtaaaatgagaactgaaatataaacatgttgaaacaaatttataaatacacagatgacagacatgtttattggaaaaaattttaaagtgaa

SEQ ID NO: 8946 - DNA, 3019 bp, Phaseolus vulgaris
tgtcagcgatttagcacgaagaatacgatgcgtcgtttctggttctggatgttcatatttgagcaaggatcttgtgtgtgtgtacggttactgctctgacgttttggattttcagtaagtcaaatctcggaaggcctcagtaggttcttcagcttagttagggtttggaagatacttgcgaagaaaaattgaattacttcatgcaggggttagtgtttgctgtagatccattgttagttttgaataagtttgtatgttggatttgaagtgaatggttttagagagtgtttgtaagctattacagggtgagaattactgtagaaagggttttgtttgagagcgctgtggatatctggtcaaggcatttgttagtcttgtattcgttgtatagattttttttttcttttttcttttcaactgcatttctagtgatttgcagttgcatttgggttggggttcctggagattgttgaatgtgtgctgtttttctttggatgaggacgagttataatcactgtgaatttgggcattctggatgagaagggttgtccagatgagtgtcgatggcgacagcaaagagctgaaagaactgagtcagcgcttacgagatgcgaagaagattgctggtggggaacatgagttatgcgagggtgatgaagtgaaatgtaatggagtaaatgaagaagttaaggttggacagggggggactgtggagtcctcctctactcagcagcatattccacagcctcaaggggcaatagtatgttgggagagatttttgcatattagatcccttaaagtcttgcttgtggagaatgatgactgtactcgtcatgttgtcactgcactgcttcgcaactgtagttatgaagttattgatgcagcaaacggattgcaagcttggaagatattggatgatttaaccaatcatattgatctcattttaactgaagtggcaatgcctggcttatcaggcattggtcttctatacaagattatgggccacaaaactcggaaaaatattccagtagttatgatgtcgtctcttgattctatgggtttagtctttaagtgtttgtcaaagggtgccgttgactttctagttaaacccatacggaagaatgagctcaaaaacctgtggcagcacgtttggagaagatgccacagttctagtgggagtggcagtgaaagtggaacgcaaacgcagaagtctgtgaaatcaaagagtcttgggaagtctgataattttgggagcaatgatgatgataatggaagtggaggcctgaacaatggggatggaagtgacaatggtagtggcactcagagctcatggaccaaacgtgctgtagaagttgatagtcctaaacctgtctctcagtgggatcaaatagctgagtgccccgacagtacctgtgctcaagttgttcactccaatgctgaaatcaatgggaaccgggtggttctcctaggtgcaaaggagtctccagaacagaaggaacaacctgtcaaaactgcaggttctaaacatagcaatgtacctgatgccggcccctctaaaccactggaccttaattgtgaaaatcaatctaccaagctaaggtgcaaaggcttatcgttgtctgatgccattactagcacttctgattctcagatgcatagtggagaatttgaagccttaaataaaaggccgaagtcctcagatattgaaaataaaggtaataataatgatgaagaattgccatcactaggccacctttgtttaaagaggcttagaggagttaaagatgccggtgttacaattcaggatgacaggagtgtcttaagacgttctgatcagtctgctttctcaaggtacaatgcagcctctaacactaagatatctcccactggatgtgttggaagcaattctccctataataatagcttagaagttacaaagaaagattcatctcgtgatattcaatctcattctagcggcaatcctcctaaccaaaattcgaatggtgctagcaataacattgatatgggttccactactaataatgcttatgctaaatctgcagttataagtgagtcagcagtggcttcaaccaaatgtttgtaccaaacatccactttccagcctataaaaaacaaccttgtctgtaactctcaacaagttatcttacataaccctgaagataaagcagcaacaaggctggcactacctaaagtagacagacatcaagattctgcagctccggacttccatctccatcatgaaaaccataactgtactgctgacatgcaccagctgccacctgatcatgatgctgaatctgcaaagaaaacggctattgctgctactccacattgtgtgtcatcaagtgtggttgaagtgctagttgaaggtaatgttggaaacctcagtatcaatagaagtgtttcaggaagcaataatggaagcaatggacaaaatgggagcagcacagcagttaatgctggaggaacaaacatggaaagtaacaatggacttcctgggaatagtggcagtggcgatgctagtggaagtggaagtgccaacaaagtagatcagaacaagacttctcaaagggaagcagccttaactaaatttcgccaaaagagaaaagaaagaaacgagcggtgctttcatgaaaaggttcgatatcagagcagaaagaaattagccgaacaacgacctcgatttcgtggacagtttgctagacagtcgtctaacgaaaagacaagtgaggcaacgacagagaggtgattctgattcagagcattcgccacaatggcataatgatggggatatgcgaggaaaagtcgatgagtcttcatgtagaatttggggattgttctgtgttgtgttcatgtataatgactatagttattccaactcatttgaaacctgaattaatttatgtggtgagagagattctcatgctgattgatgccaggataacttatagccagtatgtaatttccaattactttttcgttgatcttgtgcatgaag

SEQ ID NO: 8947 - DNA, 1215 bp, Phaseolus vulgaris
ttcaataccaaccaaattaaatagtttatagtttatagttgaaagagcgtggaagagtgaagaagataacaaaatttggaatggagaaggtaagtgtgaaccgcatgaacgctcgtttcgcgcttccaaatggctctttcgattttcttcaattcaagcactcaaatttcttcctcaagtaccctaatccgaacctgaatccgagcccaaatccaaacccgaacctccttcgacttcgcaggctcaattgctcagtatcggacggcaccgttccgtcttctgttggtgccacggactcggctcttgtggtgaagaagaaagctgcagaggtgtcttctgacctcaaagggacctccatatttctggttggaatgaaaagttctctcaaaaccagtttgggaaagctgctggctgatgcattacggtattattattttgacagtgatagtttggtggaagaagctttaggtggtgcactggctgaaaaatcctttacagaaagtgacacgaaaggcttctatgagtctgagactgaagtactgaagcaattatcttccatgggtcgactagtggtctgtgcaggcaatggagctgtgacaagtcctactaatctggcacttctgagacatggaattacgctgtggatagatgtgcctgtagatcttgtggctagggatgtaatagaagatgagagtcagtttactccatctgaaatacctatttcaggatcatacccagaggtaaaggatgaactaggtgctatatatgttaaatacagagctggatatgctacagctgatgctattatttcagttcaaaaagtagcatctcggttgggttgtgacaacttagatgaagttacacgagaagacttgactttggaggctctgaaggagattgagaagttgaccagagtaaagaagatgatcgaagaggctgcaagacctttttaaccaaccttgacattctaccttcctttacctgtaatcaaacgggacaatctaaaacatttttgaatctgcaacccctgggttagcatctcaaatttcagttttcattttagttttcttccttcaaatttctgtcttcctttgttgctgttttaagatgtagagtgtttttgaaaaggaaattttttatgcctgctgtttttttttttatatcagtttgatatctttaccacttttggatttccaattcactttaacttggaat

SEQ ID NO: 8948 - DNA, 1009 bp, Zea mays
atagctctagggctgaaaccagcaaagccaacagaactgcacagtgtagtagttgcacataggcgtccgcgcgtcgtcctagctatggatccatatcactaccaaaccatgtatgacccacgcggcttccccatcatccacccgcagccttacctccagcacccggtggccggcgccctcggtgacagcagggtgcgcggcggcggcagtggcgcgcggcggcgtcctggcgccaagctctccacggacccgcagagcgttgcggcgcgcgagcggcggcaccgcatcagcgaccgcttccgcgtgctccgcagcctcgtccccggcggcagcaagatggacactgtgtccatgctcgagcaggccatccactacgtcaagttcctcaagacgcagatcagcctgcatcaggccgcgctgatgcagcacgaggaaggatgccatgctgagctcgccgcctattccgcggtggcggtggttggtgacaacgaggtgacactcgcgtcccatggtcgtaccggcgcatgcgacgagatgatgcagctccaggtggcggcggaggaagctttgagttatggtgttgatgcccatcagccgtacgggctcgatcccaggcagctgagtggtgggcacgagctgccaccgctgcctgcttcttgcatcttcctcgaggagcctgcagacgcatgctactctgtgtgtgacctcgacgacggggacaccggtctgcccggctcttactagagtagtagtagaagtttcttaaggtagcatcccgtgtgtgttggtgtctgctagacgctagtacgtctaattagcaaagtttagctagtactcgatcaattgtctgtctagttcgctcagagttaaagtatatgatgatgcatctgcatatatgggctctgtaattctgttatccgctgatcgcagatgatacaccgtatgtaatcacatgtatgtatgttgcctagctacttcctctcgtgtcgatcaagaatctgatctagct

SEQ ID NO: 8949 - DNA, 1065 bp, Panicum virgatum
ccaattctgatacaggtaaatcgcaatctagttcgtactttgcatgtgcttaactgcttatacgcttccatgcaattccatgctgagtatatatacccaccatgggctgcttccaaacccatagctctagggctgaaaccagcaaaggcaacagcgaagtgtagtggctgctgctcacctaggcgtccaagcatcctagctatggaaccatatcactaccaagccgtgtatgacccacgcggtttccccatgatccacccgcagccctacctccaccacccggcggcggccggcgccctcagcgacagcagggtgcgcggcggcggtggaggcggaggcgtgcggcggcgccccggggcaaagctctcgacggacccgcagagcgtggcggcgcgcgagcggcggcaccggatcagcgaccgcttccgcgtgctccgcagcctcgtccccggcggcagcaagatggacacggtgtctatgctggagcaggccatccactacgtcaagttcctcaaggcgcaggtcagcctgcaccaggccgcgctcatgcagcacgaggaaggatgccctgcggagctcgccgccgcgtactccgccgtggctggagccggcgaggtgacgctcgcatcatcaagctgccgggccggcgcatgtgaggaggtggtgatgatgcagctccagcaggtcccgctgccggaagcgatgagctacgatgtcggtgctcctcggctgcacgggctcgacccagggctgcagatgagtggtgggcacgagctgcctccgctgccttcttgcgtcttcgtcgaggagtctgcggcctgcggctactctgtgtgtgacctcgacgagggggagactgatctgcacggatcctattagcataagtaattaagtagccagtagcggtgtagttagtagggatccctagttagtaaggtagtttccgtacgttcgtgtctgctagtagtatctccacggagagcaaagcctaatcaagcgcattccatgaattacctgtcagtcgaatagtattctcagagcatgcaacaagcatggcttctctgt

SEQ ID NO: 8950 - DNA, 1615 bp, Triticum aestivum
cgcgcgtataaatccatctatccatccggccaacaaggcgcacgcaggcagcgccgcgccgaatcccctccttccctgtctctctctctctctctgcttctctgtccccggcgcggcgcagggggaagaggcatggagatattctactacctggtgttcgggggcctggcggcggtggtggcggggctggagctgggcaagagcggcaaggaccgcgtcgcaacccccaccgcattcaacgcattcaagaacaactacgtcctagtctactccctaatgatgtccggcgactggctgcagggcccctacgtctactacctctacagccagtacgggttcgacaagggcgacatcggccgcctcttcatcgccggattcggctcatccatgctcttcggcaccatcgtaggctcactagcagacaggcagggccgcaagcgcgcgtgcatcacctactgcatcacctacatcctcagctgcatcaccaagcactccccgcactacagggtgctcctcctcggccgcatcctcggcggcgtcgcaacctccctcctcttctctgccttcgagtcatggctcgtcgccgagcacaacaagagaggctatgacccacaatggctgtccatcaccttctccaaggctatattcctcggaaatggtctcatcgccattatagctggcctctttgctaacctgctcgctgacaacttgggctttggccctgtggctcctttcgatgccgccgcgtgcttcctggcaataggcatggctatcataatgtcctcatggagtgaaaactatggagatcaatctgaaggcaaggatctcatgtctcagttcaaggttgccgccaaggcaatcgcttcagatgaaaaaatcgctttgctgggagccattcagtcactgttcgagggctcaatgtacacctttgtcttcctctggactccagccttgagcccaaatgacgaagacattcctcatggcttcatatttgccaccttcatgctgtcgtctatgctgggtagctccattgcatcacgcctattggcccggaaaatgaaggttgaaggctatatgcagatcgtgtttgcagtatcagccttcacccttttcctcccagttgccaccagccttctggtgccgacgtcttcagtgaaaggaagcggcatctcatttgggggctctctgcagctgcttggtttctgtacctttgagtcgtgcgtcggcattttctggccatccatcatgaagatgagatctcagtacattcctgaggaggcgaggagcaccatcatgaacttcttccgcataccgctcaacctgtttgtctgtgtggtgctctacaatgtgaatgctttccctatcaccgtcatgttcggcatgtgttcaatcttcctcttcatggcggcaatcttgcagagacggctgatggttgtcgctgacctacacaagctatccacaaaatcacaagagatgaccgcgcaagacgagcttctaaatccttgaaaggccaacacactccctccacctgacctgggtgctgaataagatgttttgattgtaatcttttttctgtagcatagatcagatcgatattattattggctaggcacga

SEQ ID NO: 8951 - DNA, 1644 bp, Triticum aestivum
atggagatattctactacgtggtgttcgggggcctggcggcggtggtggcggggctggagctgggcaagagcggcaaggaccgcgtcgcaacccccaccgcattcaacgcattcaagaacaactacgtcctagtctactccctaatgatgtccggcgactggctgcagggcccctacgtctactacctctacagccagtacgggttcgacaagggcgacatcggccgcctcttcatcgccggattcggctcatccatgctcttcggcaccatcgtaggctcactagcagacaggcagggccgcaagcgcgcgtgcatcacctactgcatcacctacatcctcagctgcatcaccaagcactccccgcactacagggtgctcctcctcggccgcatcctcggcggcgtcgcaacctccctcctcttctctgccttcgagtcatggctcgtcgccgagcacaacaagagaggctatgacccacaatggctgtccatcaccttctccaaggctatattcctcggaaatggtctcatcgccattatagctggcctctttgctaacctgctcgctgacaacttgggctttggccctgtggctcctttcgatgccgccgcgtgcttcctggcaataggcatggctatcataatgtcctcatggagtgaaaactatggagatcaatctgaaggcaaggatctcatgtctcagttcaaggttgccgccaaggcaatcgcttcagatgagaaaattgcattgctgggagccattcagtcgttgttcgagggctccatgtacacttttgtcttcctctggactccagcgttgagcccaaatgacgaagacattcctcatggcttcatatttgccaccttcatgctgtcgtctatgctgggtagctccattgcatcacgcctgttggcccggaagatgaaggtcgaaggttatatgcagatcgtgtttgcagtatcagccttcacccttttcctcccggttgccaccagccttctggtgccgacgtcttcagtgaaaggaagcggcatctcgtttgggggctctctacagctgcttggtttctgtacctttgagtcgtgcgtcggcattttctggccatccatcatgaagatgagatctcagtacattcctgaggaggcgaggagcaccatcatgaacttcttccgcataccgctcaacctgtttgtctgtgtggtgctctacaatgtgaatgctttccctatcaccgtcatgtttggcatgtgttccatcttcctcttcatggcggcaatcttgcagagacggctcatgcttgtcgctgacctacacaagctatccacaaaatcacaagatatgaccgcggaagacgagcctctaaatccttgaaaggccaacagaacacatgcacctgggtgctggctgaataagatggaattggggaaagcaaaatatgttttgattgtaatatttcttttttctgtagcgtagatcagatcgatattattattggctaggcacgatcgaggacatggatggatggatacaccaaagcaagaattcagaggctgctgagtgaattggtatagtctattaattttatgattcctggtcttgttgttcatcggggacggcattatttgtgttcaatacgctacg

SEQ ID NO: 8952 - DNA, 1741 bp, Triticum aestivum
atggagatattctactacgtggtgttcgggggcctgtcggcggtggtggccgggctggagctgggcaagagcggcaaggaccgcgtcgcaacccccaccgcattcaacgcattcaagaacaactacgtcctagtatactccctaatgatgtccggcgactggcttcagggtccctacgtgtactacctctacagccagtacgggttcgacaagggcgacatcggccgcctcttcatcgccggattcggctcatccatgctcttcggaaccatcgtaggatcactagcagacagacagggccgcaagcgcgcatgcatcacctactgcatcacctacatcctcagctgcatcaccaagcactccccacagtaccgggtcctcctcctcggccgcatcctcggcggcatcgcaacctccctcctcttctccgcattcgagtcatggctcgtcgccgagcacaacaagagaggctatgacccccagtggctctccatcaccttctccaaggctatattcctcggaaatggtctcatcgccattatagctggcctctttgctaacctgcttgctgacaacctgggctttggtcctgtggctcctttcgatgccgccgcgtgcttcctggcaattggcatggccatcatcatgtcctcgtggactgaaaactatggagatcaatctgaaggcaaggatctcatgtctcagttcaaggttgccgccaaggcaatcgcttcagatgaaaaaatcgctttgctgggagccattcagtcactgttcgagggctcaatgtacacctttgtcttcctctggactccagccttgagcccaaatgacgaagacattccccatggttttatatttgcaaccttcatgctgtcgtctatgttgggtagctccattgcatcacgcctattggcccgcaagatgaaggttgaaggctatatgcagatcgtgtttgcagtatcagccttcacacttttcctcccagttgccaccagccttctggtgccgacgtcttcagtgaaaggaagcggcatctcatttgggggctctctacagctgcttggtttctgtaccttcgagtcatgcgtcggcattttctggccatccatcatgaaaatgagatctcagtatattcctgaggaggcaagaagcaccatcatgaacttcttccgcattccactgaacctgtttgtctgtgtggtgctctacaatgtgaatgctttccctatcaccgtcatgtttggcatgtgttcaatcttcctcttcatggcggcaatcttgcagagacggctcatggttgtcgctgacctaaacaagctatccacaaaatcacaagagatgaccgcgcaagacgagcttctaaatccttgaaaggccaacacactccctccacctgacctaggtgctgaataagatggaattggggaaagcaagatgttttgattgtaatatttctttttctgtagcgtagatcagatggatattattattggctaggcacgaggagatggatggatggatacaccaaagcaagaattcagaggctgctgagtgaattagtatagtctattatttttatgattcctgctcttgttgttaatcgggacggcactatttgtcttcaatacgctacaagtatcttcgtccaagctatatatattatcagttttgtcaaggtcacatctagatgtgccataagtattgcgcatctaagtcctatgtcattgaccttatgttg

SEQ ID NO: 8953 - DNA, 1796 bp, Secale cereale
acgccggggccggggccgagcgagcgagcgagcgagctgcagaaacaaggaaattccccaacgcgcgcgtataaatccatccctaggccaaccaacaaggaatcccctcctctgcctctctctctctgtcccggcggacgggtggggtgggcgtgcagctgcagggagaagaggcatggagatattctactacctggtgttcgggggcctggcggtggtggtggcggggctagagctgggcaagagcggcaaggaccgcgtcgccacgcccaccgcgttcaacgcattcaagaacaactacgtcctagtctactccctaatgatgtccggcgactggctccagggcccctacgtctactacctctacagccagtacgggttcgacaagggcgacatcggccgcctcttcatcgccggattcggctcctccatgctcttcggcaccatcgtaggatcactagcagacaggcagggccgcaagcgcgcctgcatcacctactgcatcacctacatcctcagctgcatcaccaagcactcaccccactacagggtcctcctcctcggccgcatcctcggcggcgtcgccacctcactcctcttctccgcattcgagtcatggctcgtcgccgagcacaacaagagaggctatgacccgcagtggctgtccatcaccttctccaaggctattttcctcggaaatggcctcatcgccatcatagccggcctctttgctaacctgctcgctgacaacttgggctttggtcctgtggctcctttcgatgccgccgcgtgcttcctggcaattggcatggctatcatcatgtcctcctggaccgaaaactatggggatcaatctgaaggcaaggacttgatgtcccagttcaaggtggccgccaaggcaatcgcttcagatgagaaaatcgcattgctgggagccattcagtcgctgttcgagggctccatgtacacctttgtcttcctctggactccagccttgagcccaaatgatcaagacattcctcatggcttcatattcgccaccttcatgctctcgtctatgctgggtagctccattgcctcacgcctgttggcccggaagatgaaggttgaaggttacatgcagatggtgtttgcagtgtcggccttgacccttttcctcccggttgccaccagccttctggtgcccacgtctccggtgaagggaagcggcggcatctcctttggtggctctctgcagctgcttggtttctgtatctttgagtcgtgcgtcggcattttctggccatccatcatgaagatgagatctcagtatatccctgaggaggcaagaagcaccatcatgaacttcttccgcataccgctcaacctgtttgtctgtgtggtgctctacaatgtgaacgctttccccatcaccgtcatgtttggcatgtgttcaatcttcctcttcatggcggcaatcttgcagagacggctcatgctcgtcgctgacctgcacaagctatccacaaaatcacaagagatgaccgcgcaagacgagccgctaaatccttgaaaggccaacagcagaaccgaaaggtgcatgctgaataagatggaagtggggaaagcaacatgttttttctttcttgtagcgtggatcaatattattattattatttttaatttttttgcgagaagtggatcaatattattagctaggcacgattgaggacatggatggatacaccaatctcatatatatattggttgattgagcaagaattgagaggctgctgagtgaattattggtattatgg

SEQ ID NO: 8954 - DNA, 1681 bp, Festuca arundinacea
atggaggtgttctactacctcgtcttcggcgcgctctccgccgtcgtggcggggctggagctcggcaagagcggcaaggaccgcgtcgccacacccaccgccttcaacgccttcaagaacaactacgtcctcgtctactccctcatgatgtccggggactggctgcagggcccctacgtctactacctctacagccagtacggcttcgacaagggcgacatcggccgcctcttcatcgccggcttcggctcctccatgctcttcggcaccatcgtcggctccctcgccgacaagcagggccggaagcgggcctgcatcacctactgcatcacctacatcctcagctgcatcaccaagcactcgccccagtacagggtcctcatgatcggccgcatcctcggcggcgtcgccacctccctgctcttctccgccttcgagtcatggctcgtcgccgagcacaacaagagaggctacgatccgcaatggctgtccatcacgttttccaaggctatatttctcgggaacgggctgattgccatcatcgctgggctgtttgcgaacctgcttgctgacaacctgggctttggtcccgtggctcctttcgatgctgctgcttgcttcctggcaataggcatggctatcataatgtcctcgtggagtgaaaactatggagattcatctgaaggcaaggacttgatcgcgcagttcaagggtgcggctaaggcgattgcttcagatgaaaagattgcgttgctgggagccatacagtcactcttcgagggctcaatgtacacatttgtcttcctctggactccagcattgagcccaaatgatgaagacattcctcatggctttatatttgcgacgttcatgctctcatctatgttgggtagctccattgcctcacgcctgttggcccggaaaatgaaggtcgaaggttatatgcagatagtgttttcagtatcagcagtcacccttttcctccctgttgccaccagcctcctagtgccagcttcactgaaaggaaacggcatctcatttgcaggctcactacagctgcttggtttctgtacctttgagtcatgtgtcggcattttctggccatctatcatgaaaatgaggtctcaatatattcctgaggaggcaagaagcacgatcatgaatttcttccgcataccgctgaacctgtttgtctgcgtggtgctgtacaatgtgaacgcgttccctatcaccgtcatgtttggcatgtgctccatcttcctcttcatggcagcaatcttgcagagacggctaatggttgttgccgacctacacaaactatcaacaaaagcacaagagatgactggggaagacgaaccactaaatccttgaaaggccaagagaatcgagatgccatctgttcatactcctgtgtcttttccacctggcggctgaataagatggaagtgagaaaagcctggaggggaatgtttttttcttgtaacttcgtttatgtagtgcagatcgatgattgttaggcgcgagcacgatacatagctgagataagaaaagtttcggagtgaattggtggtataggctattcatgttgtcattcatcacatggcattatttgcgtttaaatcgctgtgactatgttcattgaagctatattacatcaacagataacaatatctgaatgatc

SEQ ID NO: 8955 - DNA, 1621 bp, Avena sativa
gaccccgacccgatccccccatcccctccatagccatggaggtgttctactacctggtgttcggcgcgctctccgccgtcgtggcggggctcgagctcggcaagagcggcaaggaccgcgtcgccaccaccaccgccttcaacgccttcaagaacaactacgtcatcgtctactccctcatgatgtccggggactggctgcagggcccctacgtctactacctctaccagcagtacggcttcgacaagggcgacatcggccgcctcttcatcgccggcttcggctcctccatgctcttcggcaccatcgtcggctccctcgccgacaagcagggccggaagagggcgtgcatcacctactgcatcacctacatcctcagctgcatcaccaagcactcgccgcagtacagggtactcatggtcggccgcgtgctcgggggaatcgccacctccctgctcttctccgccttcgagtcatggctcgtcgcagagcacaacaagagaggctatgacccgcagtggctgtcgatcacattctccaaggctatatttctcggaaatggtctaattgccattattgctgggctgtttgcaaacctgcttgccgacaacttgggctttggtcccgtggctccttttgatgctgctgcgtgcttcctggcaataggcatggctatcataatgtcctcatggagtgaaaactatggagattcatctgaagggaaggacttgatcgctcagttcaagggtgcagctaaggcgattgcttcagatgagaaaattgcgttgctgggagccatacagtcgttgtttgagggctcgatgtacacttttgtcttcctctggactccagcgttgagcccaaatgaggaggacattcctcatggattcatatttgccacgttcatgctgtcatctatgttgggtagctccattgcttcacgcctattggcccggaaaatgaaggtcgaaggttatatgcagatagtgttttcagtatcagcagttaccctgttcctccctgttgccaccagcttcctagtgccatcttcagtgaaaggaaacggcatctcatttgcgggctctctacagcttcttggtttctgtacctttgagtcatgtgttggcattttctggccatccatcatgaagatgagatctcaatatatccccgaggaggcaagaagcacgatcatgaatttcttccgcatacccctgaacctgtttgtctgcgtggtgctgtacaatgtgagcgcattccctatcaccgtcatgttcggcatgtgctccatattcctcttcatggcagcaatcttgcagagacggctaatggttgtcgccgacctacacaaactatcgacaaaagcacaagagatgactggggaagacgagccactaaatccttgaaaggccaagagaatcgggagcaaatcggacgaacaatgatgccatcggttgatattcctgagccttttccacctggcggctgaataagatggaagtgagaaaagcctggagtgggatgattttttcttgtaacttggtttctgtagtgtagatcgattattgttaggtgcgaggacgatacatatagctgagcaagtattaagctacacgggctg

SEQ ID NO: 8956 - DNA, 1962 bp, Brachypodium distachyon
cccggcaacggcaagagggaagcgcccgaattccccccaacaagaagagcacgcgcgtataaatccacacgcctccgcccggcggcacaccaccccgcgccggccgaatcgcggactgctcttctcccccacctcaaggccacgatcccctctctctctgctgcctctgggtccgggcctctggagggtggccgccatggaggtgttctactacgtggtgttcggggcgctggcggccgtggtggcggggctggagctcggcaagagcggcaaggacagggtcgccaccaccaccgccttcaacgccttcaagaacaactacgtcctcgtctactccctcatgatgtccggggactggctgcaagggccctacgtctactacctctacagccagtacggcttcgacaagggcgacatcggccgcctcttcatcgccggcttcggatcctccatgctcttcggcaccatcgtcggctccctcgccgacaagcagggccgcaagagggcgtgcatcacctactgcatcacctacatcctcagctgcatcaccaagcactcccccgagtacagggtcctcatggtcggccgcgtgctcggcggcatcgccacctcgctgctcttctccgccttcgagtcatggctcgtcgctgagcacaacaagagaggctatgacccgcaatggttgtcgatcacattctccaaggctatatttctgggaaatggtctaattgctattatagctgggctgtttgcaaacctgcttgctgacaacttgggctttggtcctgtggctcctttcgatgctgctgcatgcttccttgcaattggcatggctatcataatgtcctcatggagtgaaaactatggagattcatctgaaagcaaggacttgatggctcagttcaaggttgcagctaaagcaattgcttcagatgaaaaaattgcgttgctaggagccatacagtcgttgtttgaaggctcgatgtacacttttgtcttcttatggactccagcattgagcccaaacgaggaagacatccctcatggctttatatttgctacgttcatgctgtcatctatgttgggtagctccattgcttcacgtctattagcccggaaaatgaaggttgaaggttatatgcagatagtgttctcagtatcagccgtcacccttttcctccccgttgccaccagcattctagtgtcaccttcttcagtaaaaggaggcggcatctcatttgggggttctctacagctgcttggtttctgtacctttgaatcatgtgttggcattttctggccatctatcatgaaaatgagatcacaatatattcctgaggaggcaagaagcacgatcatgaatttcttccgcataccactgaacttatttgtctgtgtggtactgtacaatgtgaacgcgttccctatcaccgtcatgtttggcatgtgctccatcttcctcttcatcgcagcaatcctgcagagacgtctaatggttgttgctgacctacacaaactatcaacaaaagcacaagagatgaccgtggaagatgagcccctaaatccttaaaaggccaacagaatcaagagcaagtcagagacgaacaaagacgccatccgtactcctgagtcttcttctccacccggctactgaataagatggaagtacgaaaagcctggaggagtagaaaccagttgtttttcattgtaactttgtttatctagtgtagattgattattggctaaggcacgaaaggcgatacaagcaaagcatctgagttatagggccaagataagagagattggtgaattagttgttataggctattcctgttgtccattcatcagcatggcattatctgtgtttcaaatgctatcgatatattcattgaaattgtattacatcagataacaaacatctgattggtctacaatgaatttctgccctgtctcattttttgc

SEQ ID NO: 8957 - DNA, 1343 bp, Triticum aestivum
ctccgcacctcggccccgccatggaggtgttctactacctcgtcttcggcggcctcgccgccgtcgtggcggcgctggagctcggcaagtccggcaaggaccgcgtcgccaccccgacggccttcaactccttcaagaacaactacgtcctcgtctactccctcatgatgtctggggactggctgcaggggccctacgtgtactacctctacagccagtacgggttcgacaagggcgacatcggccgcctcttcatcgccggattcggctcatccatgctcttcggcaccatcgtaggctcactagcagacaggcagggccgcaagcgcgcgtgcatcacctactgcatcacctacatcctcagctgcatcaccaagcactccccacagtaccgggtcctcctgctcggccgcatcctcggcggcgtcgcaacctccctcctcttctccgcattcgagtcatggctcgtcgccgagcacaacaagagaggctatgacccgcagtggctctccatcaccttctccaaggctatattcctcggaaatggtctcatcgccattatagctggcctctttgctaacctgctcgctgacaacttgggctttggccctgtggctcctttcgatgccgccgcgtgcttcctggcaataggcatggccatcatcatgtcctcatggagtgaaaactatggagatcaatctgaaggcaaggatctcatgtctcagttcaaggttgccgccaaggcaatcgcttcagatgaaaaaatcgctttgctgggagccattcagtcactgttcgagggctcaatgtacacctttgtcttcctctggactccagccttgagcccaaatgacgaagacattccccatggttttatatttgcaaccttcatgctgtcgtctatgttgggtagctccattgcatcacgcctattggcccgcaagatgaaggttgaaggctatatgcagatcgtgtttgcagtatcagccttcacccttttcctcccagttgccaccagccttctggtgccgacgtcttcagtgaaaggaagcggcatctcatttgggggctctctgcagctgcttggtttctgtacctttgagtcgtgcgtcggcattttctggccatccatcatgaaaatgagatctcagtatattcctgaggaggcaagaagcaccatcatgaacttcttccgcataccgctcaacctgtttgtctgtgtggtgctctacaatgtgaatgctttccctatcaccgtcatgtttggcatgtgttcaatcttcctcttgatggcggcaatcttgcagagacggctcatgcttgtcgctgacctacacaagcta

SEQ ID NO: 8958 - DNA, 1803 bp, Oryza sativa
ctctctcccacttcacctcgcgatctctctctctctcttccccacctctacgcgcctccgcctccgcctccgccatggaggtgttctactacctcgtcttcggcgggctcgccgccgtcgtggcggggctggagctcggcaagtccggcaaggaccgcgtcgccaccaccccggccttcaacgcgttcaagaacaactacatcctcgtctactcgctcatgatgtctggggattggctgcaggggccgtacgtgtactacctctacagccagtacggcttcgacaagggtgacattggccgcctcttcatcgccggcttcggctcctcgatgctcttcggcaccatcgtcggatccctcgccgataagcaggggaggaagagggcgtgcattacctactgcatcagctacatcctgagctgcatcacgaagcactcgcctgagtacaagatcctgatgattgggcgcgtgctcggaggcatcgccacatcgctgctcttctcggcgttcgagtcgtggctcgtcgcggagcacaacaagagaggatttgacccacagtggttgtcgataacattctccaaggctatatttcttggaaatggcctagttgcgatcatcgctgggctatttgcaaatctgcttgcagataacttgggttttgggcctgttgctccatttgatgctgctgcttgctttttagcaataggcatggcaatcatcttatcatcatggagtgagaactatggagatacatctgataacaaggatctgatagcccaattcaaggttgcagccaaagccattgcttcagatgaaaagattgcattgcttggagctatacagtcactgtttgagggttcaatgtacacttttgttttcctgtggactcctgctttgagcccaaatgatgaagaaattcctcatggcttcatatttgccacattcatgctctcctctatgttgggtagctcaattgcctctcgtttgttagctcggaagctgaaggttgaaggttatatgcagattgtgttttcgatatcagcttttactcttttcctccctgttgtcactaacttcctagtacctccctcctcggtcaaaggtggtggcatctcatttggaggctgtctacagctgctcggtttctgtatatttgaatcctgtgttggcattttctggccatcaatcatgaagatgaggtcccagtatattcctgaggaggcaagaagcacgatcatgaacttcttccgcataccactcaacctgtttgtttgtgtggttctttacaatgtgaatgcattccccatcactgtcatgtttggcatgtgtgctattttccttttcatggcagcaatcttgcagaggcggctgatggttgtctctgatctccacagatcaacaaaagctgtagagatgactggggaagatgagccgttaaacccatagaagacaagacaatagatgtgaattggacatgaaaattgccatccaacttgagccgctttccactggctgctgaataagctggaaaatagcaggctggaatgaaacgtactagtagtagtttagtttgcttgtaggtagtctcaattcatttttgtcaggagagagtacacggtccagaaaatattgagctacaggcggcatagtaacgccttgcataggtctccttcccattcttttccactttcttctcgagtgtgatgatcgatgcttaaccattttggatgcaaaacatattgagtagtgtaacaaatttggtgattgttcctaatgtttcgtatacgatgattgaatctgtttc

SEQ ID NO: 8959 - DNA, 2167 bp, Pennisetum glaucum
cccacactgccactctcctcccactgcagcaggcgggggaaggggaggaggtgcgggccggccgaagatttggcgcacgcacactcacccacactgccactctcctcccactgcaccccgacgaggaattttttcacgcgcaccgcacgcacgcccctcccccgggggccggtgaatccaccgtataaatcgacgccgagaccgagagggcggggagggagcgagcccatccgctgaccaggcaggccgcggcaccgcaccaccaccggatccacaccaccaccagtccccctccccctcccctctcccgggggcgcgcgcgcgcccgcccgccgctcctccggtgcgccgcgccgcgccgcgccggccatggaggccttctactacgtcgtgttcggcgcgctcgccgccgtcgtggcggggctcgagctcggcaagagcggcaaggaccgcgtcgccaccacctccgccttcgactcgttcaagaacaactacgtcctcgtctactccctcatgatgtccggggattggctgcagggcccctacgtctactacctctacagccagtacggcttcgacaagggcgacatcggccgcctcttcatcgccggcttcggatcctccatgctcttcggcaccatcgtcggctccctcgccgacaagcagggccgcaagagggcctgcatcacctactgcgtgagctacatcctcagctgcatcaccaagcactcccccgagtacaagatcctcatgatcggccgcattctcggcggcgtcgccacctccctcctcttctccgcgttcgagtcctggctcgtcgccgagcacaacaagagaggcttcgacccgcaatggctgtccattacattctccaaggccatctttcttgggaatggcttaattgccattgtatctggcctatttgcgaaccttcttgctgaaaacttgggtttcggtcctgtggctcctttcgatgcggctgcttgcttcctggcaattggcatggctatcataatgtcctcatggagtgaaaactatggagatccatccgaaagcaaggacctcatggcccagttcaaggttgcagctaaggcaattgcttcagatgaaaagattgcattgctgggagccatacagtcactgtttgagggctcaatgtacacttttgtcttcctatggactccagcgttgagcccaaacgaggaagacattcctcatggttttatctttgctacattcatgttgtcatcaatgttgggtagctcaattgcgtcacgcctgttggcccggaagctcaaggttgagggttatatgcagattgtgttcgcaatatcagccgtcacccttgtcctccctgttgtcaccaactttttagtgccgccatcttctgtgaaaggaggcagcatgtcatttggaggctctcttcagcttcttggtttctgcacctttgaggcttgtgttggcatattctggccatcaatcatgaagatgagatcacagtacattcctgaggaggcaagaagcacgatcatgaatttcttccgcattccactcaacctgtttgtttgtgtggtgctttacaatgtgaatgcgttccctatcaccatcatgtttggaatgtgttctattttcctcttcatggcggcaatcttgcagagacggctgatggttgtttctgacctacacaaatcatcaacaaaagcacaagaaatgatcggggaagatgagccactaaatccttaaatgattgactgtcaacagaagaatcatacacgacacaagtcagatatgaagacggcagccatactacaattcatttccacctgtggaataagatggacctgagaaccctgtagtagagtccagttgttttttgtttgtaatttcgcttctgtagtgtagatttgaccaggccgttagtttccaccaccttggatctgcttatatccagagggcaatatatagttcagcaagcattgagctattcctgcgttcgagatgagatgagttggtgaatcgagatgagctcttcgcattgtcttttgttgctattacttcaagcgtgacactgtccgctttaaagatatgatatatatatatatgtattctatagaaagctatattaactaaaaaagaaaaaaaaaaaaaaaaaagtaaaaaactacta

SEQ ID NO: 8960 - DNA, 1834 bp, Oryza sativa
actctttctctctcccacttcacctcgcgatctctctctctctcttccccacctcgacgcgcctccgcctccgcctccgccatggaggtgttctactacctcgtcttcggcgggctcgccgccgtcgtggcggggctggagctcggcaagtccggcaaggaccgcgtcgccaccaccccggccttcaacgcgttcaagaacaactacatcctcgtctactcgctcatgatgtctggggattggctgcaggggccgtacgtgtactacctctacagccagtacggcttcgacaagggtgacattggccgcctcttcatcgccggcttcggctcctcgatgctcttcggcaccatcgtcggatccctcgccgataagcaggggaggaagagggcgtgcattacctactgcatcagctacatcctgagctgcatcacgaagcactcgcctgagtacaagatcctgatgattgggcgcgtgctcggaggcatcgccacatcgctgctcttctcggcgttcgagtcgtggctcgtcgcggagcacaacaagagaggatttgacccacagtggttgtcgataacattctccaaggctatatttcttggaaatggcctagttgcgatcatcgctgggctatttgcaaatctgcttgcagataacttgggttttgggcctgttgctccatttgatgctgctgcttgctttttagcaataggcatggcaatcatcttatcatcatggagtgagaactatggagatacatctgataacaaggatctgatagcccaattcaaggttgcagccaaagccattgcttcagatgaaaagattgcattacttggagctatacagtcactgtttgagggttcaatgtacacttttgttttcctgtggactcctgctttgagcccaaatgatgaagaaattcctcatggcttcatatttgccacattcatgctctcctctatgttgggtagctcaattgcctctcgtttgttagctcggaagctgaaggttgaaggttatatgcagattgtgttttcgatatcagcttttactcttttcctccctgttgtcactaacttcctagtacctccctcctcggtcaaaggtggtggcatctcatttggaggctgtctacagctgctcggtttctgtatatttgaatcctgtgttggcattttctggccatcaatcatgaagatgaggtcccagtatattcctgaggaggcaagaagcacgatcatgaacttcttccgcataccactcaacctgtttgtttgtgtggttctttacaatgtgaatgcattccccatcactgtcatgtttggcatgtgtgctattttccttttcatggcagcaatcttgcagaggcggctgatggttgtctctgatctccacagatcaacaaaagctgtagagatgactggggaagatgagccgttaaacccatagaagacaagacaatagatgtgaattggacatgaaaattgccatccaacttgagccgctttccactggctgctgaataagctggaaaatagcaggctggaatgaaacgtactagtagtagtttagtttgcttgtaggtagtctcaattcatttttgtcaggagagagtacacggtccagaaaatattgagctacaggcggcatagtaacgccttgcataggtctccttcccattcttttccactttcttctcgagtgtgatgatcgatgcttaaccattttggatgcaaaacatattgagtagtgtaacaaatttggtgattgttcctaatgtttcgtatacgatgattgaatctgtttcgttgaaaatgaaattattggtgaa

SEQ ID NO: 8961 - DNA, 1815 bp, Sorghum bicolor
caccagggccaggcgcaccgctccgcgccaccgatccattcccccccggtctccctccctccggtgagcggcggcgcgggcgcggccatggaggtgttctactacgtcgtgttcggcgcgctagccgccgtcgtggcggggctagagctcggcaagagcggcaaggaccgcgtcgccaccacctccgccttcaactccttcaagaacaactacgtcctcgtctactccctcatgatgtccggggactggctgcagggcccctacgtgtactacctctacagccagtacggcttcgacaagggcgacatcggccgcctcttcatcgccggctttggatcctccatgctcttcggcaccatcgtcggctcgctcgccgacaaacagggccgcaagagggcctgcatcacctactgcatcagctacatcctcagctgcatcaccaagcactcccccgagtacagggtcctcatgatcggccgcattctcggcggcatcgccacctccctactcttctccgccttcgagtcctggctcgtcgccgagcacaacaagagaggctttgacccgcagtggctgtccataacattctccaaagccatcttccttgggaatggcttaattgccattgtatctgggctattcgcgaaccttcttgctgagaacttgggttttggtcctgtggctccatttgatgcggctgcatgctttctagcgattggcatggctatcataatgtcctcatggagtgaaaactatggagatccatctgaaagtaaggacctgatggcccagttcaaggttgcagctaaggcaattgcttcagatgagaagattgcattgctgggagcaatacagtcattgtttgagggctcgatgtacacatttgtcttcctatggactccagcattgagtcctaatgaagaagacattcctcatggttttatatttgctacattcatgttgtcatctatgttgggtagctccattgcgtcacgtctattagcccgaaagctcaaggttgaaggttatatgcagattgtgttctcaatatcggctgtcacccttgtcctccctgttgtcaccaacatcctagtgccgacatcttctgtgaaaggaggcagcatatcagttggaggttctcttcagcttcttggtttctgcacctttgaggcatgtgttggcatattctggccatcaatcatgaagatgagatctcagtacattcccgaggaagcaagaagcacaatcatgaatttcttccgcataccactcaacttatttgtttgtgtggtgctttacaatgtgaatgcattccctatcactgtcatgtttgggatgtgttctatcttcctcttcatggcagcgatcttgcagagacggctgatggttgtctctgatctacacaaatcatcaactaaagcacaagaaatgatcgaggaagatgagccactaaatccttaggtgtcgacagaatcatacgttcaaatcagatatgaagacggcatccatactgcaattcattaccacctgcgcaataagatggacgtcagaaccatgtagtagagtccagttgtttttgtttgtaatttcgtttctgtagtgtagatgtgaccaggctgttagtttgcacctcgggtctgcttatatccacagggcaatatatagttcagcaagtattgaactatacctatgtcccgagaagattagatgagttggcgctgttgtttcttgcaattattttgaaaaaatgttggctttaaagtttaaacaatacacggtatatatattcttgaaagtgttatattactgcatttg

SEQ ID NO: 8962 - DNA, 1966 bp, Saccharum officinarum
cgcaccacaccaccgatccatccccccggcctccctccctccggcgagcggcggcgcgggcggccatggaggtgttctactacgtcgtgttcggcgcgctggccgccgtcgtggcggggctcgagctcggcaagagcggcaaggaccgcgtcgccaccacctccgccttcaactccttcaagaacaactacgtcctcgtctactccctcatgatgtccggggactggctgcagggcccctacgtgtactacctctacagccagtacggcttcgacaagggcgacatcggccgcctcttcatcgccggcttcggatcctccatgctcttcggcaccatcgtcggctccctcgccgacaaacagggccgcaagagggcctgcatcacctactgcatcagctacatcctcagctgcatcaccaagcactcccccgagtacagggtcctcatgatcggccgcattctcgggggcatcgccacctccctactcttctccgccttcgagtcctggctcgtcgccgagcacaacaagagaggctttgacccgcagtggctgtccataacattctccaaagccatcttccttgggaatggcttaattgccattatatctgggctattcgcgaaccttcttgctgagaacttgggtttcggtcctgtggctccatttgatgcggctgcttgctttctggcgattggcatggctatcataatgtcctcatggagtgaaaactatggagacccatctgaaagtaaggacctgatggcccagttcaaggttgcagctaaggcaattgcttcagatgaaaagattgcattgctgggagccatacagtcattgtttgagggttcaatgtacacatttgtcttcctatggactccagcattgagtccaaatgaagaagacattcctcatggttttatttttgctacattcatgctgtcatccatgttgggtagctccattgcgtcacgtctattagcccgaaagctcaaggttgaaggttatatgcagattgtgttctcaatatcggctgtcacccttgtcctccctgttgtcaccaacatcctagtgccgacatcttctgtgaaaggaggcagcatatcagttggaggttctcttcagcttcttggtttctgcaccttcgaggcatgtgttggcatattctggccatcaatcatgaagatgagatctcagtacattcctgaggaagcaagaagcacaatcatgaatttcttccgcataccactcaacttatttgtttgtgtggtgctttacaatgtgaatgcattcccaatcactgtcatgttcgggatgtgttctatcttcctcttcatggcagcaatcttgcagagacggctgatggttatctctgatctacacaaatcatcaactaaagcacaagaaatgatcgatgaagatgagccactaaatccttaggtgtcgacagaatcatacgtccaaatcagatatgaagacggcatccatactgcaattcatttccacctgcgcaataagatggacgtcagaaccatgtagtagagtccagttgtttttgtttgtaatttcgtttctgtagtgtagatgtgaccaggctgttagtttgcacctcggatctgcttatatccacactccacagggcaatatatagttcagcaagaattgagctatacctatgtcccgagaagattagatgagttggcgaatccatatgggcttttcgcattgttgtttcttgcaattatttttaaaaattattcgctttacagtttaaacgatacggtatatatattcttgaaagtgagtatattactgcatctgatgacaattctggctgatgttcatgtagcatgagaaaagcgtgttgtgaaccagtgtggatatctttgaattgtgtactttatggccgctgctctgatgactgatgacaattttggtgatgttagggcacccgcaatgggtgactc

SEQ ID NO: 8963 - DNA, 2057 bp, Setaria italica
ccgacgagggaattttcacgcgcacgccccccaccgcactcccttccctcctgcgctgcactgcactgcacaagagacgcgcacgcaccgggcaccagcccccccccggggaatgacgcccgtataaatcgacgccgagagggagcgagctgcgagcccatccattaaccaggcgcatcgcaccaccgatccatccccccacctccctctcccgggcctccggtgcgcggcggcgaccggcgccggccatggaggtcttctactacgtcgtgttcggcgcgctcgccgccgtcgtggcggggctcgagctcggcaagagcggcaaggaccgcgtcgccaccacctccgccttcaactccttcaagaacaactacgtcctcgtctactccctcatgatgtccggggattggctgcagggcccctacgtctactacctctacagacagtacggcttcgacaagggcgacatcggccgcctcttcatcgccggcttcggatcctccatgctcttcggcaccatcgtcggctccctcgccgacaagcagggccgcaagagggcctgcatcacctactgcatcagctacatcctcagctgcatcaccaagcactcgcccgagtacaagatcctcatgatcggccgcattctcgggggcatcgccacctcgctcctcttctccgccttcgagtcatggctcgtcgccgagcacaacaagagaggctttgacccgcaatggttgtccattacattctccaaggctatctttcttgggaatggcttaattgccattgtatctgggctatttgcgaaccttcttgctgaaaacttgggtttcggtcctgtggctccttttgatgcggctgcatgcttcctggcaattggcatggctatcataatgtcatcatggagtgaaaactatggcgatccatccgaaagcaaggacctcatggcccagttcaaggttgcagctaaggcaattgcttcagatgaaaagattgcattgctgggagccatacagtcattgtttgagggctcaatgtacacttttgtcttcctatggactccagctttgagcccaaatgaggaggatattcctcatggttttatctttgctacattcatgctgtcatcaatgttgggtagctcaattgcgtcacgcctgctagcccggaagctcaaggttgagggttatatgcagattgtgttcgcaatatcagccgtcacccttgtcctccctgttgtcaccaattttttagtgccgccatcttctgtgaaaggaggtagcatttcatttggaggctcccttcagcttctcggtttctgcaccttcgaggcatgtgttggcatattctggccatcaatcatgaagatgagatcgcagtacattcctgaggaggcaagaagcacgatcatgaatttcttccgcattccactcaacctgtttgtttgcgtggtgctttacaatgtgaatgcgttccctatcactgtcatgtttggaatgtgttctatcttcctcttcatggcatcgatcttgcagagacggctgatggttgtttctgacctacacaaatcatcaacaaaagcacaagaaatgatcggggaagatgagccactaaatccttaaatgactgacaacaaaatcatacacgacacaagtcagatatgaagacggcatccataccgcaattcatttccacatgtggaataagatggacctgagaaccctgtagtagagtccagttgtttttgtttgtaatttcgcttctgtagtgtagatttgaccaggtcgttagtttccaccaccttggatctgcttatatccagagggcaatatatagttcagcaagcattgagctattcctgtgtccgagattagacgagttggtgaatcgatatgaactctttgcattgtcttttcttgctattatttcaagcgtgacactgtccgctttaaatgatatgatatatatgtattctagaaagctatattactgcatatgataacaatggtgattgatttattgtataaggaaaaaaaaatctgctgtcagtcgtgggg

SEQ ID NO: 8964 - DNA, 2104 bp, Zea mays
ccagccaacagtaaacaacttgattcccatccccaccagcaccagcacacggacccggcggcggtgggcggtggcgcacccacaccccagcaccagcaagcaggtgcagtcagtgtgaggtgcggcccggccgaagatttggcgcatgcacactcactcactccagtgcccactgcccactgcccactgcccgacgaggaagtttcacgatctcaacccgtataaatcgacgccgcgagggggagcgacgagcgatccccgtaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcattcaactccttcaagaacaactacgtcctcgtctactccctcatgatgtccggggactggctgcagggcccctacgtctactacctctacagccagtatggcttcgacaagggcgacatcggccgcctcttcatcgccggcttcggatcctccatgctcttcggcaccatcgtcggctccctcgccgacaaacagggccgcaagagggcctgcgtcacctattgcatcagctacatcctcagctgcatcaccaagcactcccccgagtacagggtcctcatgatcggccgcatcctcgggggcatcgccacctcgctgctcttctccgccttcgagtcctggctcgtcgccgagcacaacaagagaggctttgacccgcagtggctgtccataacattctctaaagccatcttccttgggaacggcttaattgccattgtatctgggctatttgcgaaccttcttgctgagaacttgggctttggtcctgtggctccattcgatgcggctgcgtgctttctggcgattggcatggctatcataatgtcctcatggagtgaaaactacggagatccatctgaaagcaaggacctgatggcccagttcaaggttgcggctaaggcaattgcgtcagatgaaaagattgcattactgggagccatacagtcattgtttgagggctccatgtacacatttgtcttcctatggactccagcattgagtccaaatgaagaagacattcctcatggttttatttttgctacattcatgctgtcatccatgctgggtagctccatcgcgtcacgtctattagcccgaaagctcaaggttgaaggctatatgcagatcgtgttctcgatatcggctgtcacccttgtcctccctgtcgccaccaacatcttagtgccaacgtcttctgtgaaaggaggcagcgtatcaattggaggttctcttcagcttcttggtttctgcacctttgaggcatgtgttggtatattctggccgtcaatcatgaagatgagatctcagtacattcctgaggaagcgagaagcacaatcatgaacttcttccgcataccactcaacttatttgtttgtgtggtgctttacaacgtgaatgcattccctatcactgtcatgtttgggatgtgttctatcttcctcttcatggcagcaatcttgcagagacggctgatggttgtctctgatcaagtacacaaatcatcaactaaagcacaagaaatgatcggggaagatgagccactaaatccttagatgtcgacagaaccatacatgcgaaatcagatattgacgacgacgtccatactccatactgcatttcgtttcgtcacctgtgcaataagatggacgtcaaaaccatgtagtctagtggttttcgtttctgtagtgtagatttgaccaggctgctaagtttgcacctgtcccgagaagattagatgagcaagtcaatcgatattggctattcgcattgttgtttcttttttttaaaaaaagatgttcgctttaaagtttaaacgatacggtatatatccttgtaagtgttgcattgctgcatctgatgacaattctagtggtgctgttactgactgttgagggctctctctacttggtcgttgtaagaactgttgcttcttaatgaaaaacgggctcaataaattca

SEQ ID NO: 8965 - DNA, 1985 bp, Hordeum vulgare
cgcagcctcagtgtcccctgccccgaaatctaacgccgacgcagatggcacgcccgccgctgcgcgtataaaatccattcccctataacaaaccgaccccaatcgcactcgccaccccccgaatcgcgatcccctccgctcctcggcaggccccgccatggaggtgttctactacctcgtcttcggcggcctcgccgccgtcgtggcggcgctggagctcggcaagtccggcaaggaccgcgtcgccaccccgacggccttcaactccttcaagaacaactacgtcctcgtctactccctcatgatgtccggggactggctgcaggggccctacgtgtactacctctacagccagtacgggttcgacaagggcgacatcggccgcctcttcatcgccggcttcggctcctccatgctcttcggcaccatcgtcgggtcgctcgccgacaagcagggaaggaagagggcgtgcatcacctactgcattacctacatcctcagctgcatcacgaagcactccccgcagtacaggattctgatgattggccgcgtgcttggaggcattgcaacatcgctgctcttctcggcattcgagtcgtggctcgtcgcagagcacaacaagagaggttttgatcctcagtggctgtcgataacattctccaaggctatatttcttgggaatggcctagttgccattgtcgcagggctatttgcaaatctactggctgataacttgggttttggccctgttgctccatttgatgctgctgcttgcttcctagcaataggcatggcaatcatcttatcgtcgtggggtgagaactatggagatgcatctgaaggaaaggacttgatggcccagttcaaggttgcagctaaagccattgcttctgatgaaaagattgcattgctcggagccatacagtcactgtttgagggttcaatgtacacttttgttttcttgtggactcctgctttgagcccaaatgatgaagacattcctcatggcttcatatttgccacattcatgctctcctcgatgttgggtagctcaattgcatctcgtctcttagctcggaagatgaaggtcgaaggttatatgcagattgtgttcttgatatcagctttcactcttttcctccctgttgttaccaatttcatagtacctcccgcggagaaaggtagctccatctcatttggaggctgtctacagcttcttggtttctgcatatttgagtcatgtgttggcatattctggccatcaatcatgaaaatgagatctcaatatatccccgaggaggcgagaagcactatcatgaatttcttccgcataccacttaacctgtttgtatgtgtggtgctttacaatgtgaatgccttcccaatcgctgtcatgttcggcatgtgttctattttcctcttcatcgcggcaattttgcagaggcggctgatgtttgtgtccgaccttcacagagcaactaaggccacagagatgacagcagaagatgagccactaaacccttaaaacacaccagcggccattgacgtgaaccgggcatggaacagtctccaacttcatctgcttgtctgcagggctgctgaataagacgtgaacccagtttagtttgctttgttaggtgcgctcacggtattcagttttgtcaggagagaggacacggctcggcatgtattgagatatatacactgcacagtagagctttggcatagtaccagatctgtattttccctcgtattcttgcatttgctaataggatgatcctacttgtatttaaatccaacctcttgatgaaacctacagcatgtgcccctgtatcccctattcctggtgccagtgaggattctcctaggcagaggaatttctgccgttttagtgattgcctccaaaaagtgtgttgattagcatatattttacaattactccctgtgttcactatgattagatgttttggatatttcaatatgga

SEQ ID NO: 8966 - DNA, 1781 bp, Oryza sativa
gatccatccacccgcgcttcgtccattccatctttctctctctctcgcggaggtcggaggagccatggaggtgttctactacctcgtgttcgggggcctcgccgccgtggtggccgggctggagctcggcaagagcgccaaggaccgggtcaccacctcccaggccttcaactccttcaagaacaactacgtcctcgtctactccctcatgatgtccggggactggctgcaagggccgtacgtgtactacctctacagccagtacggcttcgacaagggcgacatcggccgcctcttcatcgccggcttcggatcctccatgctcttcggcaccatcgtcggatcactcgccgacaagcaggggaggaagagggcgtgcatcacctactgcatcagctacatcctcagctgcatcaccaagcactcccccgagtacaagatcctcatgatcggccgcgtgctcggaggaatcgccacctcgctgctcttctcggcgttcgagtcatggctcgtcgcggagcacaacaagagaggttttgattcacaatggctgtcgatcacattctccaaggctatatttcttggcaatggcctggtcgcaattgtatccgggctatttgcaaacctgcttgccgacaacttgggctttggtcccgtggcaccatttgatgctgctgcatgcttcctggcaataggcatggctatcataatgtcttcatggagtgaaaactatggagacccatctgaaagcaaggatttgatgtcccagttcaaggttgcagccaaagcaattgcttcagatgaaaaaattgcattactgggagccatacagtcattgtttgagggctcaatgtatactttcgtcttcctctggactccggcgttgagcccaaatgaagaagatattcctcatggcttcatatttgccacattcatgctgtcatcaatgttgggtagctcaattgctgcacgcttgttagcccgaaagctgaaggtcgaaggttatatgcagatcgtgtttacaatatcagccttcacccttttccttcctgttgtcaccaacattctagtgccaacttcttcagtgaaaggaggtagcatctcatttggaggcactctgcagctgcttggtttctgtacctttgaggcatgcgttggcatattctggccatcaatcatgaagatgagatctcaatatattcctgaggaggcaagaagcacaatcatgaatttcttccgcataccactgaacttgtttgtttgtgtggtgctttacaatgtgaatgcattccctatcactgtcatgtttggcatgtgttctatcttcctcttcatggcggcaatcctgcagagacggctaatggttgtttctgacctacacaaatcatcgacaaaagcacaagagatggttgatgaagatgagccactgaatccttaaggattgataggatcatacaaacagatcgaatataagcatgtggcatactgcaattcatttctaccgagctgctgaataagattggacgttgcagaaaagagcagttgtttttgtttgtaactttatttctgcaatgtcgattgaccattggctggtagttcacatctgtggagcaaatgtagtaggcacgagaggcaatacatagttcagcaagcattgagctatagccgagatataggctattcatgttgtcatttgttatttgttattgttattcaccagcatgacattgtatgaaattaaatgctacggatatcctaatcgaagttatattttacacgag

SEQ ID NO: 8967 - DNA, 2024 bp, Hordeum vulgare
gcgacccaaccaaacgtcgggcacgcgcagcctcagtgtcccctgccccgaaatctaacgccgacgcagatggcacgcccgccgctgcgcgtataaaatccattcccctataacaaaccgaccccaatcgcactcgccaccccccgaatcgcgatcccctccgctcctcggcaggccccgccatggaggtgttctactacctcgtcttcggcggcctcgccgccgtcgtggcggcgctggagctcggcaagtccggcaaggaccgcgtcgccaccccgacggccttcaactccttcaagaacaactacgtcctcgtctactccctcatgatgtccggggactggctgcaggggccctacgtgtactacctctacagccagtacgggttcgacaagggcgacatcggccgcctcttcatcgccggcttcggctcctccatgctcttcggcaccatcgtcgggtcgctcgccgacaagcagggaaggaagagggcgtgcatcacctactgcattacctacatcctcagctgcatcacgaagcactccccgcagtacaggattctgatgattggccgcgtgcttggaggcattgcaacatcgctgctcttctcggcattcgagtcgtggctcgtcgcagagcacaacaagagaggttttgatcctcagtggctgtcgataacattctccaaggctatatttcttgggaatggcctagttgccattgtcgcagggctatttgcaaatctactggctgataacttgggttttggccctgttgctccatttgatgctgctgcttgcttcctagcaataggcatggcaatcatcttatcgtcgtggggtgagaactatggagatgcatctgaaggaaaggacttgatggcccagttcaaggttgcagctaaagccattgcttctgatgaaaagattgcattgctcggagccatacagtcactgtttgagggttcaatgtacacttttgttttcttgtggactcctgctttgagcccaaatgatgaagacattcctcatggcttcatatttgccacattcatgctctcctcgatgttgggtagctcaattgcatctcgtctcttagctcggaagatgaaggtcgaaggttatatgcagattgtgttcttgatatcagctttcactcttttcctccctgttgttaccaatttcatagtacctcccgcggagaaaggtagctccatctcatttggaggctgtctacagcttcttggtttctgcatatttgagtcatgtgttggcatattctggccatcaatcatgaaaatgagatctcaatatatccccgaggaggcgagaagcactatcatgaatttcttccgcataccacttaacctgtttgtatgtgtggtgctttacaatgtgaatgccttcccaatcgctgtcatgttcggcatgtgttctattttcctcttcatcgcggcaattttgcagaggcggctgatgtttgtgtccgaccttcacagagcaactaaggccacagagatgacagcagaagatgagccactaaacccttaaaacacaccagcggccattgacgtgaaccgggcatggaacagtctccaacttcatctgcttgtctgcagggctgctgaataagacgtgaacccagtttagtttgctttgttaggtgcgctcacggtattcagttttgtcaggagagaggacacggctcggcatgtattgagatatatacactgcacagtagagctttggcatagtaccagatctgtattttccctcgtattcttgcatttgctaataggatgatcctacttgtatttaaatccaacctcttgatgaaacctacagcatgtgcccctgtatcccctattcctggtgccagtgaggattctcctaggcagaggaatttctgccgttttagtgattgcctccaaaaagtgtgttgattagcatatattttacaattactccctgtgttcactatgattagatgttttggatatttcaatatggactactccctccgtc

SEQ ID NO: 8968 - DNA, 1827 bp, Brachypodium distachyon
ataacaacccacccaatcgcattcgccacctcccccgaatcgcgatcccccccaccccgcctaggccatggagttgttctactacctcgtcttcggcggcctctccgccgtcgtggcggcgctcgagctcggcaagtccggcaaggaccgcgtcgccacccccaccgccttcaactccttcaagaacaactacgtcctcgtctactccctcatgatgtctggggattggctgcaggggccgtacgtgtactacctctacagccagtacgggttcgataagggtgacatcggccgcctcttcatcgctggcttcggctcctccatgctcttcggcaccatcgtcggctccctcgcggacaagcaggggcggaagagggcgtgcgtcacctactgcattacctacatcctgagctgcatcacgaagcactcccctcagtacaggattctgatggttgggcgcgtgctcggaggcattgcaacgtcactgctcttctccgcgttcgagtcgtggctcgtcgcagagcacaacaagagaggttttgatccccaatggttgtcgataacattctccaaggctatatttcttgggaatggcctagttgccattgttgctgggctatttgcaaatctactggctgataacttgggtttggggcctgttgctccatttgatgccgctgcttgcttcctggcaataggcatggcaatcatcttatcatcatggggtgagaactatggagatgcatctgacggcaaggacttgatagcccaattcaaggttgcagctaaagccattgcttctgatgaaaagattgcgctgcttggagccatacagtcactgtttgagggttcaatgtacacttttgttttcttgtggactcctgctttgagcccaaatcatgaagacattcctcatggcttcatatttgctacattcatgctctcctcaatgttgggtagctcaatcgcgtctcgtctactagctcggaagttgaaggttgaaggatatatgcagatcgtgttctcgatatcagctttcactcttttccttcccgttgtcaccaatttcttagtaccttcctcggagaaaggtagcagcatctcatttggaggctctctacagctccttggtttctgcatattcgagtcatgtgttggtatattctggccatcaatcatgaagatgagatcccagtatattccagaggaggcgagaagcacaatcatgaatttcttccgcataccactcaacctgtttgtatgtgtggtgctttacaatgtgaatgcattcccaatcacagtcatgtttggcatgtgctctattttccttttcatcgcagcaattttgcagaggcggctgatggttgtgtctgatctccacagaacaacaaaagctgctgagatgacagcagaagatgtgccactaaacccttagaatacaccaaaagcatagacgagaacgggccatcaaacagcctccaacttcatctaccacccccctggctgctgaataagatgtaaaccagaaggctggagttcatagtattcaatttttgtcaggagagagaagaaatggttcagcaagttttgagctacacgcggcacgttagagcttggcatagcatcgtatctgtattcacccctccctatgtttgctgatcatatctgtattgaaatcccactatagcctgtagccctgtatccccgttttggatgccagtgcagtaaggatattcttctagcaagagtatggtgaatgtctgcattttcttgtctcggaaaacgaagtgatttcacaatgacataaccatctcactggagtgcctt

SEQ ID NO: 8969 - DNA, 1815 bp, Zea mays
accgcaccgcaccgcaacgcgccaccgatccaccccgcgtcctcggcctccctccctccggcgagcggcggcgcgggcggccatggaggtgttctactacgtcgtgttcggcgcgctggccgccatcgtggcggggctcgagctcggcaagagcggcaaggaccgcgtcgccactacctccgccttcaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagagggcctgcatcacctactgcatcagctacatcctcagctgcatcaccaagcactcccccgagtacagggtcctcatgatcggccgcatcctcggaggcatcgccacctcgctgctcttctccgccttcgagtcctggctcgtcgcagagcacaacaagagaggctttgacccgcagtggctgtccataacattctccaaagccatcttccttgggaatggcttaattgccattgtgtctgggctattcgcgaaccttcttgctgagaacttgggttttggtcccgtggctccatttgatgccgctgcatgctttctggcgattggcatggctgtcataatgtcctcatggagtgagaactatggagacccatctgatagtaaggacctgatggcccagttcaaggttgcagctaaggcaattgcttcagatgaaaagattgcattactgggagccatacaatcattgtttgagggctcgatgtacacatttgtcttcctatggactccagcgttgagcccaaatgaagaagacattcctcatggttttatttttgctacattcatgctgtcatccatgttgggtagctccgttgcgtcacgtctattagcccgaaagctcaaggttgaaggttacatgcagattgtgttctcgatatcggctgtcacccttgtcctccctgttgtcaccaacatcctagtgcccacatcttctgtgaaaggaggcagcatatcgattggaggttcccttcagcttcttggtttctgcaccttcgaggcctgtgttggcatattctggccatcaatcatgaagatgaggtctcagtacattcctgaggaagcaagaagcacaatcatgaatttcttccgcatcccgctcaacttatttgtttgtgtggtgctttacaatgtgaacgcattccctatcactgtcatgttcgggatgtgttctatcttcctcttcatggcagcaatcttgcagagacggctgatggttgtctcggatctacacaagtcatcaactaaagcacaagaaatgatcggggaagatgagccactaaatccttagacgtcgacagaaccatacgtgcaaatcagatacgaaggcggcatacacagagcaattcatttccacccgtgcaataagatggaagtcagaaccatgtagttgttttcgtttgtaattttctttctatagtgtaagatttgacaaggctgttagtttgcacctcggatctgcttatatccacagggcaatcgatagttcagcaagtattgagctatacctatgtcccgagaagattagatgagttggcgtcttggcgatcgatgtgggcttttcccgttgttgttccttgcaatttattttcgaaaaaaaaagaaacatgttcgctttaagctttacgatacggtatatattattcttgg

SEQ ID NO: 8970 - DNA, 1935 bp, Oryza sativa
acgcacactcaaaccccccactccactgcccccaaaacccaacccccaaccagccagaattaccacacacacgcaccgcacccgaaatcccaagaaacgcgcgtataaatcccaccggctgaggagtcgactcgccgatccatccacccgcgcttcgtccattccatctttctctctctctcgcggaggtcggaggagccatggaggtgttctactacctcgtgttcgggggcctcgccgccgtggtggccgggctggagctcggcaagagcgccaaggaccgggtcaccacctcccaggccttcaactccttcaagaacaactacgtcctcgtctactccctcatgatgtccggggactggctgcaagggccgtacgtgtactacctctacagccagtacggcttcgacaagggcgacatcggccgcctcttcatcgccggcttcggatcctccatgctcttcggcaccatcgtcggatcactcgccgacaagcaggggaggaagagggcgtgcatcacctactgcatcagctacatcctcagctgcatcaccaagcactcccccgagtacaagatcctcatgatcggccgcgtgctcggaggaatcgccacctcgctgctcttctcggcgttcgagtcatggctcgtcgcggagcacaacaagagaggttttgattcacaatggctgtcgatcacattctccaaggctatatttcttggcaatggcctggtcgcaattgtatccgggctatttgcaaacctgcttgccgacaacttgggctttggtcccgtggcaccatttgatgctgctgcatgcttcctggcaataggcatggctatcataatgtcttcatggagtgaaaactatggagacccatctgaaagcaaggatttgatgtcccagttcaaggttgcagccaaagcaattgcttcagatgaaaaaattgcattactgggagccatacagtcattgtttgagggctcaatgtatactttcgtcttcctctggactccggcgttgagcccaaatgaagaagatattcctcatggcttcatatttgccacattcatgctgtcatcaatgttgggtagctcaattgctgcacgcttgttagcccgaaagctgaaggtcgaaggttatatgcagatcgtgtttacaatatcagccttcacccttttccttcctgttgtcaccaacattctagtgccaacttcttcagtgaaaggaggtagcatctcatttggaggcactctgcagctgcttggtttctgtacctttgaggcatgcgttggcatattctggccatcaatcatgaagatgagatctcaatatattcctgaggaggcaagaagcacaatcatgaatttcttccgcataccactgaacttgtttgtttgtgtggtgctttacaatgtgaatgcattccctatcactgtcatgtttggcatgtgttctatcttcctcttcatggcggcaatcctgcagagacggctaatggttgtttctgacctacacaaatcatcgacaaaagcacaagagatggttgatgaagatgagccactgaatccttaaggattgataggatcatacaaacagatcgaatataagcatgtggcatactgcaattcatttctaccgagctgctgaataagattggacgttgcagaaaagagcagttgtttttgtttgtaactttatttctgcaatgtcgattgaccattggctggtagttcacatctgtggagcaaatgtagtaggcacgagaggcaatacatagttcagcaagcattgagctatagccgagatataggctattcatgttgtcatttgttatttgttattgttattcaccagcatgacattgtatgaaattaaatgctacggatatcctaatcgaagttatattttacacgagagaaggccttctcagata

SEQ ID NO: 8971 - DNA, 1891 bp, Secale cereale
cagtgtccactgccccgaaattcgacgcggatgagatgacacgcccgccgctgcgcgtataaaatccattctcctataacaaaccgacccaatcgcattcgccagcccccgaatcgcgatcccctccgcacctcggccccgccatggaggtgttctactacctcgtcttcggcggcctcgccgccgtcgtggcggcgctggagctcggcaagtccggcaaggaccgcgtcgccaccccgacggccttcaactccttcaagaacaactacgtcctcgtctactccctcatgatgtccggggactggctgcaggggccctacgtctactacctctacagccagtacgggttcgacaagggcgacatcggccgcctcttcatcgccggcttcggctcctccatgctcttcggcaccatcgtcgggtcgctcgccgacaagcagggaaggaagagggcgtgcatcacctactgcatcacctacatcctcagctgcatcaccaagcactccccgcagtacaggattctgatgattggccgcgtgcttggaggcattgcgacatcgctgctcttctcggcattcgagtcgtggctcgtcgcggagcacaacaagagaggttttgatccgcagtggctgtcaataacattctccaaggctatatttcttgggaatggcctagttgccattgtcgcagggctatttgcaaatctactggctgataacttgggttttggccctgtcgctccatttgatgctgctgcttgcttcctagcaataggcatggcaatcatcttatcgtcgtggggtgagaactatggagatgcatctgaaggaaaggacttgatggcccagttcaaggttgcagctagagccattgcttccgatgagaagattgcattgcttggagccatacagtcactgtttgagggttcaatgtacacttttgttttcttgtggactcctgctttgagcccaaatgatgaagacattcctcatggcttcatatttgccacattcatgctctcctcgatgttgggtagttcaattgcatctcgtctattagctcggaagatgaaggtcgaaggttatatgcagatcgtgttctcaatatcagctttcactcttttcctccctgttgttaccaatttcatagtacctccctcagagaaaggtggaagcatctcatttggtggctctctacagcttcttggtttctgcatatttgagtcatgtgttggcatattctggccgtcaatcatgaagatgagatctcaatatatccctgaggaggcgagaagcactatcatgaatttcttccgcataccacttaacatgtttgtatgtgtggtgctttacaatgtgaatgccttcccaatcgctgtcatgtttggcatgtgttccattttcctattcatcgcagcaattttgcagaggcggctgatgttcgtgtccgaccttcacagatcaactaaggccgcagagatgacaacagaagatgagccactaaacccttgaagcacaccagcagccattgacgtgaaccgggcaaggaacagtctccaacttcatctgcttctctgcagggctgctgaataatgcgtgaacccagtttagtttgctttgttaggtgctctcacggtattcagttttgtcaggagagaggacacggctcggcatgtattgagatatatacactgcatagtagagctttggcatagtaccatatctgtattttccctcctattattacgtttgctaataggattatcgtatttgtatttaaatccaaccagtctcttgatgaaaagctatagcctgtacccctgtataccctgttccgggtgccagtgaggattcttcttggcagaggagtttctgccgttttagtgattcgt

SEQ ID NO: 8972 - DNA, 2139 bp, Panicum virgatum
cgttggcgggggcaggcagtggcgcaccccaacaggctagcagggtgcgggtgcggcccggccgaagatttggcgcaaccacactgccactccactgccagacgaagaattttcacgcgcactctgctcgctctgcgcgcaccacaccacaccaggaatcatccaatccccggcccggcaccggccgtataaatcgacgccaaccattcgcaccgccaccgatccatctccccctccctccccgaccgccggcgccggcaatggaggtgttctactacgtcgtcttcggcgcgctcgccgccgtcgtggcggggctcgagctcggcaagagcggcaaggaccgcgtcgccaccacctccgccttcaactccttcaagaacaactacgtcctcgtctactccctcatgatgtccggggattggctgcaggggccctacgtctactacctctaccgccagtacggcttcgacaagggcgacatcggccgcctcttcatcgccggcttcggatcctccatgctcttcggcaccatcgtcggctccctcgccgacaagcagggccgcaagagggcctgcatcacctactgcatcagctacatcctcagctgcatcaccaagcactcgcccgagtacaggatcctcatgatcggccgcattctcggcggcatcgccacctccctgctcttctccgccttcgagtcctggctcgtcgccgagcacaacaagagaggttttgatccgcaatggctgtccatcacattctccaaggctatcttccttgggaatggcttagttgccattgtatctggcctatttgcaaaccttcttgctgaaaacttgggtttcggtcctgtggctcctttcgatgcggctgcatgcttcctggcgatcgggatggctatcataatgtcatcatggagtgaaaactatggagatacatctgaaagcaaggacctcatggcccagttcaaggttgcagcaaaggcaattgcttcagatgaaaagattgcattgctgggcgccatacagtcattgtttgagggctcaatgtacacttttgtcttcctatggactccagcgttgagcccaaatgaagaagacattcctcatggttttatcttcgctacattcatgctatcatccatgttgggtagctcaattgcgtcacgcctgttagcccggaagcttaaggttgagggttacatgcagattgtgttttcaatatcagctgttacccttgtgctccctgttgtcaccaactttttagtgccaccatcttctgtgaaaggaggtagcatatcatttggaggctgtcttcagcttctcggtttctgcaccttcgaggcatgtgttggcatattctggccatcaatcatgaagatgagatcacagtacattcctgaggaggcaaggagtacgatcatgaatttcttccgtattccactgaacctgtttgtttgcgtggtgctttacaatgtgaatgcattccctatcactgtcatgtttggaatgtgttctatcttcctcttcatggcagtgatcttgcagagacggctgatggttgtttctgacctacacaaatcatctacaaaagcacaagaaatgatcggggaagatgagccactaaatccttagatgatgtcaacagaatcatacatgacacaagtcagatatgaagacggcatccatactgcaattcatttccacctgtggaataagatgaaaaccctgtagtagagtccggttgttttcgtttgtagtttcatttctgtagtgtagatttgaccaggctgttagtctccaccaacttggatctacttgtatccatagggcaacatatagttcagcaagcattgagctattcctgtgtcccgagattagatgagttggtgaatcgatatgagctcttcgcattgtcgtttcttgctattatttcaagtgtgacgctgtccgatttagacgatatgatacgtactctagaaagctatattactgcatatgatagcaatggtgatcgatttattgtagaagaaaaatctgctgtatcttcaaattacctgtaatgtcagacgagatagttatacctagttgcgatggttttgtttgttaattcttctgcgtgtcacttttttgaagttcc

SEQ ID NO: 8973 - DNA, 1995 bp, Triticum aestivum
gcgacccaaccaaaacgtctggcacgcgcaccctcagtgcccactgccccgaaatccgacgcagatgagatgacacgcccaccgctgcgcgtataaaatccattcccctataacaaaccgacccaatcgcattcgccagcccccgaatcgcgatcccctccgcacctcggccccgccatggaggtgttctactacctcgtcttcggcggcctcgccgccgtcgtggcggcgctggagctcggcaagtctggcaaggaccgcgtcgccaccccgacggccttcaactccttcaagaacaactacgtcctcgtctactccctcatgatgtctggggactggctgcaggggccctacgtgtactacctctacagccagtacgggttcgacaagggcgacatcggccgcctcttcatcgccggcttcggctcctccatgctcttcggcaccatcgtcgggtcgctcgccgacaagcagggaaggaagagggcgtgcatcacctactgcatcacctacatcctcagctgcatcacgaagcactccccgcagtacaggattctgatgattggccgcgtgcttggaggcattgcaacatcgctgctcttctcggcgttcgagtcgtggctcgtcgcggagcacaacaagagaggttttgatccgcagtggctgtcaataacattctccaaggctatatttcttgggaatggcctagttgccattgtcgcagggctatttgcaaatctactggctgataacttgggttttggccctgtcgctccatttgatgctgctgcttgcttcctagcaataggcatggcaatcatcttatcgtcgtggggtgagaactatggagatgcatctgaaggaaaggacttgatggcccagttcaaggttgcagctaaagccattgcttccgatgaaaagattgcattgcttggagccatacagtcactgtttgagggttcaatgtacacttttgttttcttgtggactcctgctttgagcccaaatgaagaagacattcctcatggcttcatatttgccacattcatgctctcctcgatgttgggtagctcaattgcatctcgtctattagctcggaagatgaaggtcgaaggttatatgcagatcgtgttctcgatatcagctttcactcttttcctccctgttgttaccaatttcatagtacccccctcagagaaaggtggaagcatctcctttggaggctgtgtacagcttcttggtttctgcatattcgagtcatgtgttggcatattctggccatcaatcatgaagatgagatctcaatatatccctgaggaggcgagaagcactatcatgaacttcttccgcataccacttaacctgtttgtatgtgtggtgctttacaatgtgaatgccttcccaatcgctgtcatgtttggcatgtgctccattttcctattcatcgcagcaattttgcagaggcggctgatgttcgtgtccgaccttcacagatcaactaaagccgcagagatgacagcagaagatgagccactaaacccttgaaacacaccagcagccattgacgtgaaccgggcatggaacggtctccaacttcatctgcttctctgcagggctgctgaataagatgggaaaccagaaggctgcaacaaaacctcgtttagtttgctttgttaggtgctctcacggtattcagttttgtcgggagagaggacacggctcggcatgtattgagatatatacactgcacagtagagctttggcatagtaccggatctgtactttccctcctattcttacgtttgctaataggatgatcgtatttgtatttaaatccaaccagtctcttgatgaaagctatatagcctgtacccctgtataccctatttcgggtgccagtgaggattcttctaggcagaggagtttctgccgttttagtgatttgtctagttttcttgtctctacaaaaggtgtgctgattagcacagattttac

SEQ ID NO: 8974 - DNA, 2023 bp, Panicum virgatum
gtgcggcccggccgaagatttggcgcaagcacactcgtctccactggcactgcccgacgaggaattttcacgcgcactctgctcctcctctagtgctctgcacaagactacaagagagaggcgcgcaccacaccaggaatccaatccccactccccagccgtataaatcgagcgagcccaaccatctccctcttgattaatccagtcgcaccgcaccgcaccgccaccagccatggaggcgtactactacgtcgtcttcggcgcgctcgccgccgtcgtggcggggctcgagctcggcaagagcggcaaggaccgcgtcgccaccgcctccgtcttcaactccttcaagaacaactacgtcctcgtctactccctcatgatgtccggggattggctgcaggggccctacgtctactacctctacagccagtacggcttcgacaagggcgacatcggccgcctcttcatcgccggcttcggatcctccatgctcttcggcaccatcgtcggctccctcgccgacaagcagggccgcaagagggcctgcatcacctactgcatcagctacatcctcagctgcatcaccaagcactcgcccgagtacaagatcctcatgatcggccgcattctcggcggcatcgccacctccttgctcttctccgccttcgagtcctggctcgtcgccgagcacaacaagagaggctttgatccgcaatggttgtccattacattctccaaggctatcttccttgggaatggcttagttgccattgtatctggcctatttgcaaaccttcttgctgaaaacttgggtttcggtcctgtggctccttttgatgcggctgcatgcttcctggcgatcgggatggctatcataatgtcatcatggagcgaaaactatggagatccatctgaaagcaaggacctcatggcccaattcaaggttgcagcgaaggcaattgcttcagatgaaaagattgcattgctgggagccatacagtcattgtttgagggctcaatgtacacttttgtcttcctatggactccagcgttgagcccaaatgaagaagacattcctcatggttttatctttgctacattcatgctatcatccatgttgggtagctcaattgcgtcacgcctattagcccggaagcttaaggttgagggttacatgcagattgtgttttcaatatcagctgtcacccttgtgctccctgttgtcaccaactttttagtgccgccatcttctgtgaaaggaggtagcatctcatttggaggctgtcttcagcttctcggtttctgcaccttcgaggcatgtgttggcatattctggccatcaatcatgaagatgagatcacagtacattcctgaggaggcaaggagtacgatcatgaatttcttccgcattccactgaacctgtttgtttgtgtggtgctttacaatgtgaatgcattccctatcactgtcatgtttggaatgtgttctatcttcctcttcatggcagtgatcttgcagagacggctgatggttgtgtctgacctacacaaatcatcaacaaaagcacaagaaatgatcggggaagatgagccactaaatccttagatgatgtcaacagaatcatacatgacacaagtcagatatgaagacggcatccatactgcaattcatttccacctgtggaataagatgagaaccctgtggtcgagtctggttgttttcgtttgtaatttcatttctgtagtgtagatttgaccaggctgttagtctccaccaacttggatctacttgtgtcccgagggcaatatatagttcagcaagcattgagctattcctatgtccgagattagatgagttggttgatcgatatgagctcatcgcgttgtcgtttcttgctattatttcaagcgtgacactgtccgctttagacaatatggtatggactctagaaagctatattactgcatatgataacaacagtgattgatttattgtagaagaaaaatctgctgtatcttcaaa

SEQ ID NO: 8975 - DNA, 1875 bp, Setaria italica
tcccgtcgaaacgacgacggagaagcccagtcggtgcgccgtataaatcctaaccaatcgccacccccaaatcccaccaccctctcccccttccaccgctcgcgatctctcctcccagccccgccatggaggtgttctactatctcgtgttcggcgcgctcgccgccgtcgtggcggcgctggagctcggcaagtccggcaaggaccgcgtcgccacctccccagccttcaactccttcaagaacaactacatcctcgtctactccctcatgatgtctggggactggctgcaggggccctacgtgtactacctctacagccagtacggcttcgacaagggcgacatcggccgcctcttcatcgccggcttcggctcctccatgctcttcggcaccatcgtcggatccctcgcggataagcaggggcggaagagggcgtgcgtcacctactgcatcacctacatcctgagctgcttcaccaagcactcccccgagtacaagattctgatgattgggcgcgtgctcggaggcattgccacgtcgctgctcttctcggcgttcgagtcgtggcttgtcgctgagcataacaagaaaggatttgatccacaatggttgtccataacattctccaaggctatatttcttggcaatggtctagtcgccattgtcgccgggctatttgcaaattttcttgctgataacatgggttttggccctgtggctccatttgatgctgctgcttgcttcctagcaataggaatggcaattatcttatcatcatggggtgagaattatggagattcatctgacagcaaggacttgatgacccagttcaaggttgcagctaaagccattgcttcagatgaaaagattgcattgcttggagccatacagtcattgtttgagggttcaatgtatacttttgtcttcctatggactcctgctctgagcccaaatgatgaagaaattcctcatggcttcatatttgctacattcatgctctcctcgatgcttggtagctcaattgcttctcgtctattagctcggaagctgaaggttgaaggttatatgcaaattgtgtttgcagtatcagcctttactcttttcctccctgttgttaccaatttcctagtacctccctcctcagcgaaaggtggtagcatttcattaggaggctgtctgcaacttcttggtttctgtacatttgagtcatgcgttggcatattctggccatcaatcatgaagatgagatctcaatatattcctgaggaagcaagaagcacaatcatgaattttttccgcataccactcaacctgtttgtttgtgtggtgctatacaatgtaaatgcattcccgatcactgtcatgtttggcatgtgctccattttccttttcatggcagcaatcttgcagagacggctaatggttgtctctgatcttcacaagtcaacaaaagcggtagagatgactgcagaagatgagcctctgaacccttagaaaacaacaagaccatagaagcaaatcggagatcaaaatggcccaatccttcttcccactaggatgcataataagatcaacatcacaaggctgtaagggaactcggtttagtgtttctgttaggattggtgcttgcgcagtttccagttttgtcaggacagagaaacatgatgtagctgagtcttgaccactgagctacacacggcagagtagagcttggcaaagtcccccatatttttctccatttttttgcctctttatgtttgctggtaggattgatatttgtattcaaaatgccaaaagtatgatggaagcctgtttccctaatgcaaacgccgagtagtgtaagggcttgtttggatcaaaggtttttcatggg

SEQ ID NO: 8976 - DNA, 2101 bp, Panicum virgatum
ctactgttcagcctgcgcacactgcctccgtgtggctccgcacctaaatcccgtccccaagacgacgccggagaaaccagtcggtgcgccgaataaatcccaactaatcgccaacccccaaatcccaccactacccttcccccttcccaccgctggcgatctctccgccccgcaccgccacgccatggaggcgttctactacctcgtgttcggcgcgctcgccgccgtcgtggcggcgctggagctcggcaagtccggcaaggaccgcgtcgccacctccccggccttcaactccttcaagaacaactacatcctcgtctactccctcatgatgtctggggactggctgcaggggccctacgtgtactacctctacagccagtacggcttcgacaagggcgacatcggccgcctcttcatcgccggcttcggctcctccatgctcttcggcaccatcgtcggatccctcgcagataagcaggggcggaagagggcgtgcgtcacctactgcatcacctacatcctgagctgcttcaccaagcactcccccgagtacaagatcctgatggttgggcgcgtgctcggaggcattgccacgtcgctgctcttctcggcgtttgagtcgtggctcgtcgcggagcacaacaagaaaggatttgatccacaatggttgtccataacattctccaaggctatctttcttggcaatggtctagtcgccattgttgctgggctctttgcaaattttcttgctgataacatgggttttggccctgtggctccatttgatgctgctgcttgcttcctagcaataggaatggcaatcatcttatcatcatggggtgagaattatggagattcatctgacagcaaggacttgatgacccagttcaaggttgcagctaaagccattgcttcagatgaaaagattgcattgcttggagctatacagtcattgtttgagggttcaatgtatacttttgttttcctgtggactcctgctttgagcccgaatgatgaagaaattcctcatggcttcatatttgctacattcatgctctcctcgatgctgggtagctcaattgcttctcgtctattagctcggaagatgaaggttgaaggttatatgcaaatcgtgttttcagtatcagcctgtactcttttccttcctgttgtgacaaatttcctagtacctccctcctcggagaaaggtggtagcatttcattaggaggctgtctgcagcttcttggtttctgtacatttgagtcatgtgttggtatattctggccatcaatcatgaagatgagatctcaatatatccctgaggaggcaagaagcacaatcatgaactttttccgcataccactcaacctgtttgtttgtgtggtactatacaatgtaaatgcattcccaatcactgtcatgtttggcatgtgctccattttccttttcatggcagcaatcttgcagaggcggctaatggttgtctctgatcttcacaagtcgacaaaagcggtagagatgaatgcagaagacgagcctctgaacccttagaaaacagcatgaccacagaagcgaattggagatcaaaatggccccaatcctggacttcttcccacaaggatgctgaataagatcaacatcagaaggctgtaatggaactcggtttaatgtgtctgttaggattggtgctcgtgcagtttccagttttgtgaggacagggaacatgatgtagctgggtcttgactattgagctatacacggcagagtagagcttggcatagccaccccttttttcaccttttttttttgcttcatatgtttgctcatagggtcgctatttgtattcaaaagcccaaaattatgatggagcctgtatcctctatttaggatgcaaacgctgagtaatgtaagaaggctgtcataggcgtttgactccgtgtcatctcaaatactgtgtgggtctgtgggtctactgttatgctcacgtcctgttttctgtggtcatagtgacactttacaggaaatgtgccgattgcctgttgaatttgcactgtataacattttcattcaagctgttgtcattaagcgctgtaattg

SEQ ID NO: 8977 - DNA, 1868 bp, Saccharum officinarum
gcctccagtgcccactgctcctcgccaccaaaatcccgtcgggagtcgggacgacgaagaagccaagccggtgcgccgtataaatccaaaccaatcgccacccccaaatcccaccaccctttcccccttccacccctcgcgatctctccggcccgccatcgccatggagatgttctactacctcgtgttcggcgcgctcgccgccatcgtggcggcgctggagctcggcaagtccggcaaggaccgcgtcgccacctccccggccttcaactccttcaagaacaactacatcctcgtctactccctcatgatgtctggggactggctgcaggggccctacgtgtactacctctacagccagtacggcttcgacaagggcgacatcggccgcctcttcatcgccggcttcggttcctccatgctcttcggcaccatcgtcggatccctcgcggataagcaggggcggaagagggcgtgcgtcacctactgcatcacctacatcctcagctgcttcaccaagcactctccccagtacaaaatccttatgattggccgcgtccttggaggcattgccacttcgctgctcttctcagcctttgagtcgtggctcgtcgcagagcacaacaagaaaggatttgatccgcaatggttgtcgataacattctccaaggctatatttcttggcaatggtctagtggccattgttgctgggctatttgcaaattttcttgctgataacatgggttttggtcctgtggctccatttgatgccgctgcttgcttcctagcaataggaatggcaattatcttatcatcatggggtgagaactatggagattcatctgacagcaaggacttgataacccagttcaagggtgcagctaaagccattgcttcagacgagaagattgcattgcttggagccatacagtcattgtttgagggatcaatgtatactttcgttttcctgtggactcctgctctgagcccaaaggatgaggaaattcctcacggcttcatatttgctactttcatgctttcctcgatgctgggtagttcaattgcttctcgtttgttagctcggaagctgaaggttgaaggttatatgcaaatcgtgttttctgtatcggcctttactcttttcctccccgttgtcactaatttcctagtacctccctctggggagaaaggcggtagcatttcgttaggaggctgcttacagcttcttggtttctgtacctttgagtcatgtgttggtatattttggccatcaatcatgaagatgagatctcaatatattcctgaggaggcaagaagcacaatcatgaatttcttccgtataccactcaacctgtttgtttgcgtggtgctatacaatgtgaatgcattcccaataactgtcatgtttggcatgtgctccattttccttttcatggcagcaatcttgcagaggcgcttaatggttgtctctgatcttcacagatcgacaaaagcagcagagatgactgcggaagatgagcctctgaacccttagaaaacaccaagaacatagaagtgaatcagaagtcaaaatggccccaatctttggtttattcacatggggttgctgaataagatcgatatccgaaggctgtaacggctgtaacagaatgcagtttagtgtgttataggattggtgctagtgcagtttccagttttgtcatgatagagaacatgatgtcgcaagtcctgacaattgtgccacagggcagagtagagctcggcatagcctccccacgctttctccgtcttttcttctcgtgttttctgataggtttgatatttgtattcaaatgccaaaagtagcctgcatcgtccattttggatgc

SEQ ID NO: 8978 - DNA, 1996 bp, Sorghum bicolor
tgcctccagtgccccactgctgcctcgccaccaaaatcccgtcgggagtcgggacgacgaagaagccaagtcggtgcgccgtataaatcctactattcaacaatcgccaccccccaaatcccaccacccttttcccccacttccacccctcgcgatctctccccggcccgccatggagatgttctactacctcgtgttcggcgcgctcgccgccatcgtggcggcgctggagctcggcaagtccggcaaggaccgcgtcgccacctccccggccttcaactccttcaagaacaactacatcctcgtctactccctcatgatgtctggggactggctgcaggggccctacgtgtactacctctacagccagtacggcttcgacaagggcgacatcggccgcctcttcatcgccggcttcggttcctccatgctcttcggtaccatcgtcggatccctcgcggataagaagggtcggaagagggcgtgcgtcacctactgcatcacctacatcctcagctgcttcaccaagcactccccccagtacaaaattcttatggttggccgcgtccttggaggcattgccacttcgctgctcttctcagcgtttgagtcatggctcgtcgccgagcacaacaagaaaggatttgatccacaatggttgtcgataacattctccaaggctatatttcttggcaatggtctagtggccattgttgctgggctatttgcaaattttcttgctgataacatgggttttggtcctgtggctccatttgatgccgctgcttgcttcctagcaataggaatggcaattatcttatcatcatggggtgagaactacggagattcttctgacagcaaggacttgataacccagttcaagggtgcagctaaagccattgcttcagacgagaagattgcattgcttggagccatacagtcattgtttgagggatcaatgtatactttcgttttcctgtggactcctgctctgagcccaaaggatgaggaaattcctcacggcttcatatttgctactttcatgctttcctcaatgctgggtagttcaattgcttctcgtttgttagctcggaagctgaaggttgaaggttatatgcaaatcgtgttttctgtatcggcctttactcttttcctccctgttgtcactaatttcctagtacctccctctggggagaaaggtggtagcatttcgttaggaggctgcttacagcttcttggtttctgtacctttgagtcatgtgttggtatattttggccatcgatcatgaagatgagatctcaatatattcctgaggaggcaagaagcacaatcatgaatttcttccgtataccactcaacctgtttgtttgcgtggtgctatacaatgtgaatgcattcccaataactgtcatgttcggcatgtgctccattttcctatttatggcagcaatcttgcagaggcgcttaatggttgtctctgatcttcacagatcgacaaaagcagtggagatgactgcagaagatgagcctttgaacccttagaaaacaacaagaccatataagtgaatcagaagtcaaaatggccccaatctttgatttgttcccatggggttgctgaataatatcgatatccaaaggctgtaacgactgtaacagaatgcagtttagtgtgttggattggtgctagtgcagtttacagttttgtcatgatatagagaacatgatgtagcaagtcctgactattgtgccacacgcggcagtggagctcggtatagcctccccacgttttccccatattttcttcttgtgttttctgatagggttgacatttgtattcaaatgccagaagtatcatatggaagcctgtatcgctcattttggatgcaaacgctgagtaaagtgagaaaagacactcgttagcgaccaacaatctagaagtaaaacgtcttctgtcgttttgttcttgtgctctttgtgctgttttatacttctaat

SEQ ID NO: 8979 - DNA, 1880 bp, Zea mays
cgccacccaaatcccgtcgggacgacgaagaagccaagccggtgcgccgtataaatctaaccaatcgccatccgcccaccccccaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcaggggcggaagagggcgtgtgtcacgtactgcatcacctacatcctcagctgcatcaccaagcactctccccagtacaaagttcttatgattgggcgtgtccttggtggcattgccacttcgctgctcttctcagcgtttgagtcgtggctcgtggcagagcacaacaagaaaggatttgatccacaatggttgtcgataacattctccaaggctatatttcttggcaatggtctagtggccattgttgctggcctatttgcaaattttcttgctgataacatgggttttggtcctgtggctccatttgatgccgctgcttgcttcctagcaataggaatggcaattatcttatcatcatggggtgagaactacggagattcgtctgacagcaaggacttgataacccagttcaagggtgcagctaaagccattgcttcagacgagaagattgcattgcttggagccatacagtcattgtttgagggatcaatgtatactttcgttttcctgtggactcctgctctgagcccaaaggatgaggaaattcctcacggcttcatatttgctaccttcatgctttcctcgatgctgggtagctcaattgcttctcgtttgttagctaggaagctgaaggttgaaggttatatgcaaatcgtgttttcagtatcagcctttactcttttcctccccgttgtcaccaatttcctagtacctccctccggggagaaaggcggcagcatttcgttaggaggctgcttacagcttcttggtttctgtacctttgagtcatgtgttggtatattttggccatcaatcatgaagatgagatctcaatatattcccgaggaggcaagaagcacaatcatgaatttcttccgtataccgctcaacctgtttgtttgcgtggtactatacaatgtgaatgcattcccaataactgtcatgttcggcatgtgctccattttccttctcatggcagcagtcttgcagaggcgcttaatggctgtctctgatcttcacagatcgacaaaggctgtaatgatgactgcggaagatgagcctctaaacccttagagatcatcataaaaaggaatcggaagttaaaatggccccaatcctcgacttattcccatggggttgctgaataagattgatatctaaaagttgtaacgactgtaacagaacacggtttttactgtgttataggattggtgctagtgcagtttccggttgtcatggtagagaacatgatgtggctcctgactattgtgccacacacggcagagtatagctcggcatagcctccccacgttttccccatgtttttcttctcgtgttttctgataggattgatatttgtattcaagtgaagtatcatatggaaacccgcatcgtccattttggatgcaaacgctgagtaaagtgagaaagggctcattagagaccg

SEQ ID NO: 8980 - DNA, 1819 bp, Triticum aestivum
accgcgtcgccaccccgacggccttcaactccttcaagaacaactacgtcctcgtctactccctcatgatgtctggggactggctgcaggggccctacgtgtactacctctacagccagtacgggttcgacaagggcgacatcggccgcctcttcatcgccggattcggctcctccatgctcttcggcaccatcgtcgggtcgctcgccgacaagcagggaaggaagagggcgtgcatcacctactgcatcacctacatcctcagctgcatcacgaagcactccccgcagtacaggattctgatgattggccgcgtgcttggaggcattgcaacatcgctgctcttctcggcgttcgagtcgtggctcgtcgcggagcacaacaagagaggttttgatccgcagtggctgtcaataacattctccaaggctatatttcttgggaatggcctagttgccattgtcgcagggctatttgcaaatctactggctgataacttgggttttggccctgtcgctccatttgatgctgccgcttgcttcctagcaataggcatggcaatcatcttatcgtcgtggggtgagaactatggagatgcatctgaaggaaaggacttgatggcccagtttaaggttgcagctaaagccattgcttctgatgaaaagattgcattgcttggagccatacagtcactgtttgagggttcaatgtacacttttgttttcttgtggactcctgctttgagcccaaatgatgaagacattcctcatggcttcatatttgccacattcatgctctcctcgatgttgggtagctcaattgcatctcgtctattagctcggaagatgaaggtcgaaggttatatgcagatcgtgttctcgatatcagctttcactcttttcctccctgttgttaccaatttcatagtacctccctcagagaaaggtggaagcatctcatttggaggcagtgtacaacttcttggtttctgcatattcgagtcatgtgttggcatattctggccgtcaatcatgaagatgagatctcaatatatccctgaggaggcgagaagcactatcatgaacttcttccgcataccacttaacctgtttgtatgtgtggtgctttacaatgtgaatgccttcccaatcgctgtcatgtttggtatgtgctccattttcctattcatcgcagcaattttgcagaggcggctgatgttcgtgtccgaccttcacagatcaactaaagccgcagagatgacagcagaagatgagccactaaacccttgaaacacaccagcagccattgacgtgaaccgggcatggaacagtctccaacttcatctgcttctctgcagggctgctgaataagatgggaaaccagaaggctgcaacaaaacctcgtttagtttgctttgttaggtgctctcacggtattcagttttgtcgggagagaggacacggctcggcatgtattgagatatatacactgcacagtagagctttggcatagtaccggatctgtaatttccctcctattcttacgtttgctaataggatgatcgtatttgtatttaaatccaaccagtcccttgatgaaagctatagcttgtgcccctgtataccttattccgggtgccagtgaggattcttctagggagaggagattctgccgtgttatgttactcgctaagttacttccactatgattagccttagtgatttgtctacagatctcttgtctctacaaaatgtgtgctgattagcacagattttacaatcaaaagggccataccatgcgtcggccggccaatcttttt

SEQ ID NO: 8981 - DNA, 1662 bp, Pennisetum glaucum
ccgcgtcgccacctccccggccttcaactccttcaagaacaactacatcctcgtctactccctcatgatgtctggggactggctgcagggcccctacgtgtactacctctacagccagtacggcttcgacaagggcgacattggccgcctcttcatcgccggcttcggctcctccatgctcttcggcaccatcgtcggatccctcgcggataagcaggggcggaagagggcgtgcattacctactgcatcacctacatcctgagctgcttcaccaagcattctccccagtacaagattctgatgattgggcgtgtgctcggaggcatcgccacgtcgctgctcttctcagcattcgagtcgtggctcgtcgcggagcacaacaagaaaggattcgacccacaatggttatccataacattctccaaggctatatttcttggcaatggtctagtcgccattgtcgctgggctatttgcaaattttcttgctgataacatgggttttggccctgtggctccatttgatgctgctgcttgcttcctagcaataggaatggcaataatcttatcatcatggggtgagaattacggagattcatctgacagcaaggacttgatgacccagttcaaggttgcagctaaagccattgcttcagatgagaagattgcattgcttggagccatacagtcattgtttgagggttcaatgtatacttttgtcttcctgtggactcctgctctaagcccaaatgatgaagaaattcctcatggcttcatatttgctacattcatgctctcctcgatgcttggtagctcaattgcttctcgtctattagcacggaaactgaaggttgaaggttatatgcaaattgtgtttgcagtatcagcctttactcttgtcctccctgttgttaccaatttcctagtacctccctcctcagagaaaggtggtagcatttcgttaggaggctgtctgcaacttcttgggttctgtacattcgagtcatgtgttggcatattctggccatcaatcatgaagatgaggtctcaatatattcctgaggaagcaagaagcacaatcatgaattttttccgcataccactcaatctgtttgtttgtgtggtgctatacaatgtgaatgcattcccgatcactgtcatgtttggcatgtgctccattttcctttgcatggcagcaatcttgcagaggcggctaatggttgtctctgatcatcacaagtcaacaaaagcggtagagatgactgcagaagatgagcctttgaacccttagaaaacaacaagaccatagaagcaaatcagagaacaaaatggccccaatccttcttcccactaggatgcttaataagagcaacatcggaaggctgtaacggaactcagtttagtgtgtatgttaggattggtgcttgtgcagtttcaaatttgtcgggacagagaaatgatgtagctgcatcttgaccaatgagctacacgtggtagagtagagcttggcatagttccccattttttcctccatttttttgcctcttatgtttgctggtaggattgatatttgtactcaaaataccaaaagtatgatggaagactgtttcctccacagatgcaaacacacagtaatgcaagaagctgagtaggcgtttgatt

SEQ ID NO: 8982 - DNA, 2268 bp, Ananas comosus
aggaggtggaggaagagaggagaggggcgtggaaatggaggtgttctactacgtggtgttcggggggttggcgatggtggtggcgctgctggagctgagcaagacgagcaaggatcgcgtctccacctcctcagccttcaactccttcaagaacaactacctcgtcgtctactccctcatgatggctggtgattggttgcagggtccttatgtctactacctctatagccaatatggattcgataagggcgatatcgggcgcctcttcatcgctggattcggatcgtccatgctgtttgggacaattgttggatctcttgctgacaaacaaggtcggaagagagcctgcgttacgtattgcattagttacatccttagctgtatcacgaagcattcgccggagtacaaggttttgatggtggggagaatattgggaggaattgcaacttccttgctcttttcagcctttgagtcatggcttgttgccgaacataataagagaggttttgatccacagtggctgtctctgactttctcgaaggctatatttcttggcaacggtcttgtcgcgatcgtcgctggtttgtttgcaaatctattggctgataacctgggattcggcccagtggctccatttgatgccgcggcatgtttcctagccataggcatggccatcattttatcatcatggactgaaaattatggagatccttctgagaacaaggacttactggctcagttcaaggttgctgcctcagccattgcatcagatgagaaaattgctctgctcggtgcaatacagtcgcttttcgaaggctccatgtacacctttgttttcttgtggaccccagctctgagcccaaatgacgaagagattcctcatggctttatattcgctactttcatgttgtcttccatgctggggagctccattgcatctcggttattggcacgtcaaagccttaaagttgaaggctatatgcagattgtttttgcaatctctgctttcactctcctcctcccagttcttaccagtattctagttgcgccatctacggtgaaaggtggtgggatatcacttggtggctgcatccagcttattggtttctgtacatttgaggcatgtgtaggggtattctggccttcgattatgaagatgagatcccagtacattcctgaggaagctaggagcactatcatgaacttcttccgcatacccttgaacatatttgtctgtgtcgtgctttacaatgtggacgcatttcctataactatcatgttcggcatgtgttctattttccttttcatggcatcaatattgcagaggcggctgatggcggtcgctgacagccacaagtcaaagccgcaagattggagtgctttgaaggaaagggatggtgaggaggagccattgaatgcctaatcagttgccaaggcatctgcacttggcaatcaagggtaacacggtgatacagaactttctcctatcgtcgagccggtaaataagatggaagcgtcccaactaaaatagagcgggagaagttcaggagtgcatattcagtattgtaagaaatcaagtatgtcatccatttttgcatcctgttggttcatagtttacctatttttgagttctttttaagtagttttgcctggtatacaagtatttcttggttcccaagcttcactggccttcccaggatgatccattctatcagcttcttctattttccattttcactgtttgcgctaaccaggttgcgaaattgtgtgataactggtgattcaatctctaatgttaatgagatagctgattcaatatttcattttaaacccgaaacatggattgctgactattcttggacatgtagaatagcgggaagaagtttcaaatggttcagaaccttaacaacggataggaatacatgttctcgtttataaaaaggccaaaagtatgtcgtcactgtcattttgtatcccttgattttctcctcggttcagctgtctgtctcactagaccttccatgcttgataattcaaacctcggaatagcgattcttcatgttggaaaataaagtaacgccgttccctgatcacggcttttgaaagggtcgttgttcatcgccactgtaaatgagagaatggtttccttttcggacggaatttgcaaactgttcagtaacaaacaatttgaattctatttgacgtaatcgtctttctaacaattgtcttgttcagaagttgctgttgataccagagacacatttcccc

SEQ ID NO: 8983 - DNA, 1885 bp, Chelidonium majus
gatcgatctgcagggatggagatgttctattacctagtgtttggggctctgtcggccatcgttgccgtcttggagctcagcaaaaacaacaaagatcggattaatacttcatctgctttcaattccttcaagaacaattatctcgtcgtgtactctctcatgatggctggggattggttgcaaggtccttatgtttacttcctctacagccaatatggttttagcaagggagagattggacgactctttattgctggttttggatcctctatgttgttcgggaccattgttggatcactggccgataaacagggacggaagagggcgtgtgtcacgtactgcattacatacattctgagctgtatcacgaagcattcacctcaatacaaagtattgatgttgggtcgtatattgggaggagttgctacctctctcttgttttcagcttttgagtcatggttggttgcagagcacaacaagaggggttttgaacaacaatggctctcacttacattctccaaggcaatatttcttggcaatggtcttattgctattgttgctgggttgttcgccaacatgctagctgataatcttggatttggtccagttgctccctttgatgctgcggcttgttttcttgccattggtatggccattatcttgtcatcatggagtgaaaactatggagacccttccgagagcaaggacttgcttacccagttcaagggtgcagcagtagccattgcttcagatgagaagattgctttgttgggagcaattcaatccttgtttgaaggttcaatgtacacctttgtgtttctgtggacccctgctttgagccctaatgatgaggacattccacacggtttcatttttgcaacatttatgttggcttctatgttgggaagctccattgcttctcgattgatggcacgtacgtctcttaaagttgagagctacatgcagatcgtgtttgcagtttctgccaccactttcctgcttcccatcgtcactggtttcttcgtaccagcctcgaaggggaaaggtgggagcatctcatttgcagggtgcatccaactctttggcttctgtacttttgagtcttgtgttggcatattctggccatcaatcatgaagatgagatcacaatacatccctgaggaagctagaagcaccatcatgaatttcttccgtgttcctctcaacatcttcgtgtgcattgtgctatacaatgttaatgcattcccaatcactgtcatgtttggcatgtgctctattttcctcttcatggcatcgatcttgcagaggcggctcatggtggtagcagagagccacaaatcaaagcaacaagattgggcattgtcgaaggagagggactcagaggtggaaccattgaacatctaattgattcaagaccacaaaccaccggaatcgggaaggttaaaaaaaaggattacactttctatttatcaccataagataaagcattctgggtgcttgtgaccaatcttaaaataacagaagggaaatataggaccgttcttgatttgttagtggggttaccgattttgaaggataatcagctgaaaagaggttttgatgcaacaatagaaatagtgatgcaggaacaaatgcgtatttgcagtaatctgccatcacgttacgggttgtgtttcctaagctgttatttcttaggagccaaatgttctctgctgtaatttttgcaatttcttttttcttgccttgttcagtgtgagtgttaagaattaatactgttttagatggtttaggaattttttttctctttccaaatgatttgtgtttatggatcttcaacaagctttaatctgtaatgactttttatatatagatgggtatctctaat

SEQ ID NO: 8984 - DNA, 1480 bp, Ananas comosus
aatggaggtgttctactacctcgtcttcggggcgctcgcggtggtggtggcggtgttggagctgagcaagacgagcaaggaccgcgtcgccacctcctccgccttcaactccttcaagaacaactacctcgtcgtcttctccctcatgatggctggtgattggctacaaggcccttatgtctacttcctctacagccaatatggtttcgataagggagacattggtcgcctattcattgctggtttcggatcttccatgctgttcgggacaattgttggttctctggctgacaaacagggtaggaagagggcttgcgttacatattgcataacttacattcttagctgcatcactaagcattctcctgagtacaaggttttgatggtggggcgtatattgggaggaatagcaacatctctactgttctcggcctttgagtcatggcttgttgcagagcataataagaggggctttgatccacaatggctttctttaattttctccaaggctatattccttgggaatggtctcattgctattgtttctggcttgtttgcaaatatgttggctgataacctagggtttggccctgttgctcccttcgatgctgcagcatgcttcctagcaataggcatggcaatcatcttatcttcatggactgaaaattatggtgatccttctgacagcaaagacctaatgggtcagttcaaggttgctgcaacagccattgcttctgatgagaaaattgctttgctcggtgcgatacagtcattgtttgaaggctccatgtacacctttgtgttcttgtggactcctgcgttaagccccaatgatgaagaaattcctcatggttttatatttgctacatttatgatgtcttcaatgttggggagttctattgcatctcgtctattggcccgtgtaactctaaaagtcgaaagctatatgcagatagttttcgtagtctctgcattcactctcctcctccctgtcattatcaatttcttagtagcaccgtctacaggaaaagattctagccttccgtttggcggttgtatccttctctttggtttctgcatattcgagtcatgtgtggggattttctggccatcaatgatgaaaatgagatctcagtacataccagaggaggctaggagtacaatcatgaacttcttccgcatacccctcaacttatttgtctgcgtcgtgctctacaatgtgaatgcattccccatcaccgtcatgttcggcatgtgctccatattccttttcatggcctcaatcttgcagaggcgtctaatggtcatcgcagatcgccccaaatcaaagccgcaagattggactgctttaagggagatggatggtgaagaggagccgctgaacgtctaaactaaagtcggaactcatcggagctctcacgccacaacgatgcaatccaatgcaagaaaatgccttgctatttgcagttgcagctattat

SEQ ID NO: 8985 - DNA, 2004 bp, Papaver somniferum
ccgaaatccctattttatcagctttttcagttcttcttcttcttctactagtctcaatagaaatctctgtgtttctgtgagatcgattagcagagatggagatgttctattacttagtgtttggagctatgtctgtagtggtagcaatattggaattcagcaaaaacaacaaagatcggattaatacttctactgcttttaatgctttcaagaataactacttagttgtgtattctcttatgatggctggggattggttgcagggtccatacgtgtacttcttgtacagccaatatggtttctcaaagggagatattggacgtctctttattgctggttttgggtcgtctatgctctttgggactgttgttgggtctctagctgacaaaacagggcgtaagagggcctgcatcacatactgtataacatacatcctgagttgtatcaccaagcattcacctcagtacaaggttctgatggtgggtcgtatcttgggaggaattgctacttccctcttgttttcagcgttcgagtcatggctagttgcagaacacaacaagagaggttatgaacaacaatggctgtcattgacattctccaaggcaatatttcttggcaatggtctcattgctatttttgctgggttgtttggcaacatgctcgccgataatttgggatttggtcctgttgccccctttgatgccgctgcatgctttctcgccattggtatggctattatcttatcaacatggagcgaaaactttggtgacccctctgaaaacaaggacttgcttacccagttcaggggtgcagcagtagccattgcttctgacgagaagattgcactgttgggtgctattcagtccttgtttgaaggctcaatgtacacctttgtgttcctttggacacctgctttgagccctaacgatgaggacatcccacatggatttatttttgcaacattcatgttggcctctatgttgggaagctctattgcatctcgattgatggcacgccaaaatctcaaagttgaaggctacatgcagattgtgtttgcagtttctgcctgtactttccttcttcccttagtcactggtttcttggtacctccttcaggggagaaaggtggaagcatctcatttgcagggtgtattcaactttttggattctgtacatttgaatcttgtgttggcatattctggccatcaatcatgaagatgagatcgcaatacatccccgaggaggccagaagcaccatcatgaacttcttccgtattcctctcaacatcttcgtgtgcattgtgctatacaatgttaatgcgttcccgatcactgtcatgtttggaatgtgttctattttcctcttgatggcgtccatcttgcagaggcggctcatggtagtggcagagttgcacaacaagtcaaagcctgaagactggacatcattgaaggagagggacacagaggctgaacccctgaacatctaattgatgtgaaggtggcaaccatcaaagcttagaccggttcaggaaaaaataggcgatctttcttaacagtgaggcgtagtaattgcaacaatgcaatttgttagtttaccattcctataaataacaggggagatatagtaggatggttcacaattcattaaattgagaacaggttttgaagaaaaatcagtctggttaaagaagagttcagggctattggtaacaaaggacagttgcaggaataataggtattgaagtaaactaggggcatggtatggattatattacttcctactgttattttttgaaactaaaagtcctctgctgtaatttggtttttatttgttttgtctaagtgtgtttaagggttaatacaacaggatgtctagggttttctctctttttttcctttttttatgtggaattgaacacctgttacatgattatttttcttggagattccaagatgcggatctctgttctgtaagaactttttatatataaatagatattattt

SEQ ID NO: 8986 - DNA, 2157 bp, Papaver somniferum
aaaacacaacactaagattctgacacgtggaaatcgacaatcctcgaaacacaaaagatgatgctctatttgcccaggtttcactcactaacataaagagagagaatcagtctggggagtagaagaacgaaatcccattttatcagctttttcagttcttcttcgttcttcttcttttactagtctcaatagaaatctctgtggttgtgtgagatcgattagcagagatggagatgttctattacttagtgtttggagctatgtctgtagtggtagcagtattagaattcagcaaaaacacaaagatcggattaatacttctactgcttttaatgctttcaagaataactacttagttgtgtattctcttatgatggctggggattggttgcagggtccatatgtgtacttcttgtacagccaatatggtttctcaaagggagatattggacgtctctttattgctggttttgggtcgtctatgctctttgggactgttgttgggtctctagctgacaaaacaggacgtaagagggcctgcattacatactgtataacatacatcctgagttgtatcaccaagcattcacctcagtacaaggttctgatggtgggtcgtatcttgggagggattgctacttccctcctgttttcagcgttcgagtcatggctagttgcagaacacaacaagagaggttatgaacaacaatggctgtcattgacattctccaaggcaatatttcttggcaatggtctcattgctatttttgctgggttgtttggcaacatgctcgctgataatttgggatttggtcctgttgccccctttgatgccgctgcttgctttctcgccattggtatggctattatcttatcaacatggagcgaaaactttggtgacccctctgaaagcaaggacttgcttacccagttcaggggtgcagcagtagccattgcttctgacgagaagattgcactgttgggagctattcagtccttgtttgaaggctcaatgtacacctttgtgttcctttggacacctgctttgagccctaacgacgaggacatcccacacggatttatttttgcaacattcatgttggcctctatgttgggaagctccatcgcatctcgattgatggcacgccaaaatctcaaagttgaaggctacatgcagattgtgtttgcagtttctgcctgtactttccttcttcccttagtcactggtttcttggtacctccttcaggggagaaaggtggaagcatctcatttgcagggtgtattcaactttttggattctgtacatttgaatcttgtgttggcatattctggccatcaatcatgaagatgagatcgcaatacatccctgaggaggccagaagcaccatcatgaacttcttccgaattcctctcaacatcttcgtgtgcattgtgctatacaatgttaatgcgttcccgatcactgtcatgtttggaatgtgctctattttcctcttgatggcgtccatcttgcagaggcggctcatggtagtggcagagttgcacaacaagtcaaagcctgaagactggacatcattgaaggagagggacacagaggctgaacccctgaacatctaattgatgtgaaggtggcaaccatcaaagcttagaccggttcaggaaaaaataggcgatctttcttaacagtgaggcgtagtaattgcaacaatgcaatttgttagtttaccattcctataaataacaggggagatatagtaggatggttcacaattcattaaattgagaacaggttttgaagaaaaatcagtctggttaaagaagagttcagggctattggtaacaaaggacagttgcaggaataataggtattgaagtaaactaggggcatggtatggattatattacttcctactgttattttttgaaactaaaagtcctctgctgtaattttggttttatttgttttgtctaagtgtgtttaagggttaatacaacaggatgtctagggttttctctctttttttcctttttttatgtggaattgaacacctgttacatgattatttttcttggagattccaagatgcggatctctgttctgtaagaactttttatatataaatagatattatttctaatcaaaaaaaaaaaaaaaa

SEQ ID NO: 8987 - DNA, 1924 bp, Eschscholzia californica
cgtccgataaatcttcatttctattggcactcactttctctctctctctctctctctactttcttctttctgttcattcatttttctctcagatctatctgcagagatggagatgttttattatcttgtgtttggagctctatccatggtggttgctgtattagagtttagtaaaaacaacaaagatcggattaatacatcttctgctttcaattctttcaagaacaactaccttgttgtttactctctcatgatggctggggattggttgcaggggccttacgtttacttcctttacagccaatatggtttttccaagggagatatcggccggctatttattgcaggttttggatcctccatgttgtttgggactattgtgggatctttggctgacaaacagggacggaagagggcgtgtatcacgtactgtataacgtacatattgagttgtatcaccaagcattcacctcagtacaaaattctaatggtggggcgtatattgggaggaattgctacttctctcttgttttctgcctttgagtcatggctagttgcagaacacaacaagagaggtttcgagcaacagtggttgtctcttacattctcgaaggcaatttttcttggaaatggtctcgttgctattgttgctggattattcgcaaacatgttagctgataatttaggatttggtcctgttgctccctttgatgctgctgcttgctttcttgccattggtatggccattatcttatcatcatggggcgaaaactatggagacgcttctgataacaaggatttgcttacccagttcaagggtgcagcagtagccattgcgtctgatgagaagattgcgttgctcggtgcaattcaatccttgttcgaaggttcaatgtacacctttgtgttcttatggactcctgctttaagccctaacgatgaagacattccacacggtttcatttttgcaacatttatgttggcttctatgttgggaagctccatcgcttcacgattgatggcacgttcttctctcaaagttgaaagctacatgcaaatcattttcgcaatttctgccgcgaccttcttacttcccattgtcaccagtctcttggtaccaccatccaatgtgaaaggtgggagcatcacatttgcaggatgtattcagctctttgggttctgtacatttgagtcctgtgttggtattttctggccatcaatcatgaagatgagatctcagtatatccctgaggaggctcgaagcaccatcatgaattttttccgtgttcctctcaacatcttcgtgtgcatcgttctgtacaatgttaatgcattcccaatcactgtcatgttcggtatgtgctctattttcctattcatagcatcgatcttgcagaggcgtctcatggtggtagcagagctccacaaatcaaaatctcaagattggacatctgtgaaggatagggactcagaggtggaaccattgaacatctaatacctcgaacacaatcacggaattcggacaggttcaaaatgaacctaaaaagggcagagaagtatgatttctttttttttcaccataagatgtttagttgcagtttgggtagttatgatcaatcctataaataacagaagccgaaaattataggaaatttgtcgattcgttaatggatgaacagattctgaaccataatcagctgctggaggttttgatgcatgttttgtgcttcctaagctgttgttatttattagaagctaaatgttctttcaacctcagatgtaattttggtttcttgttcttgtttcattagggttttagaattatttttctttctccaatttgtttatctagagatatgaagacatgggtcttctcaaactttaatctgtaatgagtttctttgaatcttacttatataataga

SEQ ID NO: 8988 - DNA, 1554 bp, Triticum aestivum
caggggccctacgtgtactacctctacagccagtacgggttcgacaagggcgacatcggccgcctcttcatcgccggattcggctcatccatgctcttcggaaccatcgtaggatcactagcagacagacagggccgcaagcgcgcatgcatcacctactgcatcacctacatcctcagctgcatcaccaagcactccccacagtaccgggtcctcctcctcggccgcatcctcggcggcatcgcaacctccctcctcttctccgcattcgagtcatggctcgtcgccgagcacaacaagagaggctatgacccgcaatggttgtccatcacattctcaaaggctatattcctcggaaatggtctcatcgccattttagctggcctctttgctaacctcctcgctgacaacttgggctttggccctgtggctcctttcgatgccgccgcgtgcttcctggcaataggcatggctatcataatgtcctcatggagtgaaaactatggagatcaatctgaaggcaaggatctcatgtctcagttcaaggttgccgccaaggcaatcgcttcagatgagaaaattgcattgctgggagccattcagtcgttgttcgagggctccatgtacacttttgtcttcctctggactccagcgttgagcccaaatgacgaagacattcctcatggcttcatatttgccacattcatgctctcctcgatgttgggtagctcaattgcatctcgtctattagctcggaagatgaaggtcgaaggttatatgcagatcgtgttctcgatatcagctttcactcttttcctccctgttgttaccaatttcatagtacccccctcagagaaaggtggaagcatctcctttggaggctgtgtacagcttcttggtttctgcatattcgagtcatgtgttggcatattctggccgtcaatcatgaagatgagatctcaatatatccctgaggaggcgagaagcactatcatgaacttcttccgcataccacttaacctgtttgtatgtgtggtgctttacaatgtgaatgccttcccaatcgctgtcatgtttggcatgtgtaccattttcctattcatcgcagcaattttgcagaggcggctgatgttcgtgtccgaccttcacagatcaactaaagccgcagagatgacagcagaagatgagccactaaacccttgaaacacaccagcagccattgacgtgaaccgggcatggaacagtctccaacttcatctgcttctctgcagggctgctgaataagatgggaaaccagaaggctgcaacaaaacctcgtttagtttgctttgttaggtagactactacaacggtaattacaagttttagtacaaggaagaagaggaacaacgggactcggcatgtattgagatatatacactgcacagtagagctttggcatagtaccggatctctactttccctctattctacgtttgctaataggatgatcgtattgtaattttaaaccccaaactagtcttctagatagaactacatagctagtaccctgta

SEQ ID NO: 8989 - DNA, 2031 bp, Papaver somniferum
ctagtctcaatagaaatctctgtggttgtgtgagatcgatttgcagagatggagatgttctattacttagtgtttggagctatgtctgtagtggtagcagtattagaattcagcaaaaacacaaagatcggattaatacttctactgcttttaatgctttcaagaataactacttagttgtgtattctcttatgatggctggggattggttgcagggtccatatgtctacttcttgtacagccaatatggtttctcgaagggagatattggacgtctctttattgctggttttgggtcgtctatgctctttgggactgttgttgggtctctagctgacaaaacaggacgtaagagggcctgcatcacatactgtataacatacatcctgagttgtatcaccaagcattcacctcagtacaaggttctgatggtgggtcgtatcttgggaggaattgctacttccctcctgttttcagccttcgagtcatggctagttgcagaacacaacaagagaggttatgaacaacaatggctgtcattgacattctccaaggcaatatttcttggcaatggtctcattgctatttttgctgggttgtttggcaacatgctcgccgataatttgggatttggtcctgttgccccctttgatgccgctgcatgctttctcgccattggtatggctattatcttatcaacatggagcgaaaactttggtgacccctctgaaagcaaggacttgcttacccagttcaggggtgcagcagtagccattgcttctgacgagaagattgcactgttgggtgctattcagtccttgtttgaaggctcaatgtacacctttgtgttcctttggacacctgctttgagccctaatgacgaggacatcccacacggatttatttttgcaacattcatgttggcctctatgttgggaagctctattgcatctcgattgatggcacaccaaaatctcaaagttgaaggctacatgcagattgtgtttgcagtttctgcctgtactttccttcttcccttagtcactggtttcttggtacctccttcaggggagaaaggtggaagcatctcatttgcagggtgtattcaactttttggattctgtacatttgaatcgtgtgttggcatattctggccatcaatcatgaagatgagatcgcaatacatccctgaggaggccagaagcaccatcatgaacttcttccgtattcctctcaacatctttgtgtgcattgtgctatacaatgttaatgcgttcccgatcactgtcatgtttggaatgtgctctatattcctcttgatggcgtccatcttgcagaggcggctcatggtagtggcagagttgcacaacaagtcaaagcctgaagactggacatcattgaaggagagggacacagaggctgaacccctgaacatctaattgatgtgaaggtggcaaccatcaaagcttagaccggttcaggaaaaaataggcgatctttcttaacagtgagacgtagtagttgcaacaatgcaatttgttagtttaccattcctataaataataggggagatataggatggttcacgatccattaaattgagaacaggttttgaagaaaaatcagtctggtaaaagaagagttcagggctataggtaacaaaggacagttgcaggaataataggtatcgaagtaaactagtggcatggtatggattatattatttcctactgtaattttttgaaactaaaagttctctgctgtaattttggtttttatttgttctctctaagtgtgtttaaggggttaatacaacaggatgtctagggttttctctcttttttccttttttatgtggaattgaacacctgttacatgattatttttcttggagattgcaagatacggatctctgttctgtaagaactttctatatataaatagatatcgtttctaatcatacgacagtttaagcattgcacgcattatgtcgatttgatgacaagtcactttaaaaaggggaaaaaaaaa

SEQ ID NO: 8990 - DNA, 1963 bp, Allium cepa
accttagttacgggggatattgatttttgtttcttgtttttccttgtgggtagtcggcatatggctatttaaagaaattctctctatatatttagcacatgcatttagcactccgcaaaaaagtagtgcgggagctgaatttgttgacaaacagacggaccctggtcgtttcacttcggatctactctatccttcatctcttcagccaaaaacagaaaaagtaatggaggcgttctattacttagtttttggcgcgctttctatagttgttgcagtgctcgagctgagcaaatcgagcaatgatcgcatcaccacttcttccgccttcaattctttcaagaccaattacatagtcgtctattctctcatgatggctggagattggttacagggtccatatgtgtactacctgtatagtacatatggttttgataaaggggatattggtcgtcttttcattgctggatttggatcctcgatgcttttcggtaccattgtgggatctctagctgacaaacaaggccgaaagagagcgtgtgtaacctactgcctaacatacatattgagttgtattaccaaacattctccacaatataaggttttgatggtgggtcgtatattgggtgggattgctacctctctccttttctcgtcttttgaatcgtggctagttgctgagcacaataagaggggattcgaaccacaatggctctctttaacattctcaaaggcaatattttttggcaacggtcttattgccattatatctgggttgtttgccaacatgttagctgacaatttgggcttcggcccagttgctcctttcgatgctgccgcttgcttccttgcaattggcatggctgtaatactgtcaacttggtctgaaaattatggtgatccttctgacaacaaaaatttaataacccagttcaaaggtgctgctatagctatagcttcagatgagaaaattgccttattgggagcaatacagtcattattcgaaggctccatgtacacttttgtattcctctggactcctgctttgagcccaaatgatgaagacattccacatggttttatttttgcaacttttatgttatcttccatgctgggaagctctattgcatctaggctcttggcccgacctttacttaaagttgaaagttatatgcaagttgtttttgtagtatcttcatttactcttctcctcccgatccttaccactttcttggtgacacctccatctgttaaaggtgggagtatatcgtttgctggatgtatacagctttttggtttctgcacatttgaagcatgttgtggaatattttggccatctattatgaaaatgaggtcacaatacattcccgaggaggctaggagcacaatcatgaattttttccgtattccccttaacattttcgtttgtgttgtgctttataatgttaatgcattccctatcactatcatgtttggcatgtgttctattttccttttcatggcttccattttgcagaggcgtcttatggtggttgctgagaaccataagtcgaagtctcatatatcaatgaaggagagagacaccgaggctgaaccactgaacatatgaggagcaagaggaaaactatcaattgtttaaaggttcacaaaagatataccatggcacaatgcgattatttctgtgccaattccagttatatgttaaaaaatattaaatactgatgccgtcagtcagaaggcatgtaggaggcatattattaattaattcgaaatttacagtgtgaattagaaaattatattagcttttgaattcaataatataacgtaatttctgtttagattgactttgttattatggcatcgcctgataatgatagcaagtttgtcttgttctttagatgttagatgctttttgtaacttgcttgacagttttattatgattatttttatactaaaaacacacac

SEQ ID NO: 8991 - DNA, 1797 bp, Musa acuminata
ctctaatctctcccgttctcttccgagcctcggagggaagccgaagaaggaagaggaggaagggggcgatggacgcgttctactacttggtttttggcgggctcgcggcggtggtggcggcgatggagctgagcaagacgagcagagaccgcgttgccacctcctcccccttcaacgccttcaagaacaactacctcctcgtctactccctaatgatggctggtgattggttgcagggtccttatgtctactacctctacagtcagtatggctttgacaagggagacatcggccggctcttcattgcaggatttgggtcttccatgctgttcgggacgatagtgggatccttagctgacaaacggggtcgtaagagggcatgtgtcacctactgcatcacatatattcttagctgcattactaagcattctcctgagtacaaagttttgatggtgggtcgtatactgggaggaatttctacgtcgctgctcttctcggcatttgagtcatggcttgttgcagaacataataagagaggttttgatccacagtggttgtcagtaactttcgcgaaggctatatttcttggcaatggtcttatcgccattgtttctggactttttgccaatttattggctgataatttaggatttggtcctgtggctccatttgatgctgctgcatgctgccttgccataggcatggccattatcttgtcatcctggagtgagaattatggagatccttctgatagcaaagacttgattacacaattcaaaggtgctgctgcagccattgcttctgatgagaaaatcgctttgctgggtgcaatacaatcactttttgaaggttcaatgtacacctttgtattcctgtggactcctgctttgagcccaaatgatgaggatatacctcatggctttatttttgctacattcatggtttcttcaatgttgggaagctccatagcatctaggctgatggctcgtgggactcttaaagtcgaaagttatatgcagattgtgtttgcaatctctgccttcactctgctacttcccattatctctaatttcttagttgcaccttctaccgcgaagggtggtagcatatcttttggtagttgtatccaactccttggcttctgtgtctttgaggcctgcgttggcatattttggccatcaattatgaagatgagatcccagtacattcctgaggaagctaggagcacaattatgaacttctttcgcattcccctcaatatttttgtgtgtatcgtactctacaatgtaaatgctttcccaatcactatcatgtttggaatgtgctctatcttccttttcatggcctcggtcttgcaaaggcggcttatggtggttgccgagagccacaaatcaaagccacaagattggacaggtctgaaggagagggatgatgaagcagaatcattgaacatctgagtctagaaggcattagagcatccacagtgtgtgataaccagtgaaacatatggacgcttcattgaactgactgttctcatctggctaaatgaaggaaaggctattgatgtgtatagtacattggaaggcagttgatcctccaatttcattatgaagccacgacatgttcccaaatgaggaattgatcgtgttttgttctctatttaatttagtaacacagaatagatatatgtaggtactcatgcttggaaatctggcttaatcatcattcattttataattcatttgctgttgtatcggctattccaatctagttattcagtcttcagttctacgacgc

SEQ ID NO: 8992 - DNA, 1700 bp, Allium cepa
aactcctctccctccatctctgaaaagagcgaagcaaaagcaacagcaatggaggcattatactacatacttttcggcgcgctttcgttggtggttgctgtgcttgagcttagcaaaagcaacaaggatcgaatctcaacttcctctgcatttagttctttcaagaacaattacttggttgtctattctctcgccatggctggtgactggctacaaggtccttatgtctactacctatatagtcaatatggttttagtaagggtgatattggtcggttattcatcgctggttttggatcctctatgatttttggaacaattgtgggttctttagcagacaaacagggtcgaaagagagcatgtgttacctactgcataacctacatcctgagttgtatcacaaaacattttccacaatataaagttttaatgctgggtcgtatcctgggaggaatcgctacttctctcttgttttctgcttttgaatcgtggcttgttgctgaacacaacaagagaggctttgaatcacaatggctatctttgaccttttcaaaggctatatttcttggaaatggtctcattgccattatctcgggattatttgcaaatatgttagctgataatttagggtttggccctgtcgctccttttgatgcagctgcatgtttccttgcaattggcatggcaataatcttatcatcatggactgaaaattatggggatccttctgatagcaaggatttaatgactcagtttaaggctgcagctatagccattgcatctgatgagaaaattgctttgcttggagcaatacaatccttgtttgagggatcaatgtatacctttgtcttcttgtggactcctgccttgagcccaaatgacgaagatattcctcatggtttcattttcgcaaccttcatgttatcttcaatgttgggaagttcaattgcttctcggctgatggcacgctcgtctctcaaagttgaaagttacatgcaagccgtttttgcagtttcagcatttaccttactacttccaattcttaccacgttcatagcgtcacctccctcggtaaaaggtggtagcatatctttttcagggatgattcaactatttggattctgtattttcgagtcgtgtgtgggtatattctggccatctatcatgaaaatgagatctcagtacatccctgaggaggctaggagcactatcatgaatttcttccgcattcctctcaatatcttcgtctgtgttgtgctttacaatgtgaatgcattcccgattaccatcatgtttggcatgtgttcgattttccttttcatggcttcggttttgcaaaggcgactaatggtagtcgctgagatccataaatcaaagtctcaagactggacggcaatgaaagaaagggacactgaagcagaaccactgaacatgtaagtatcaaggagccgtgacagcaagaacataatccaacaaatgaagatcatatatgactttacggaggaagaaaaattgatttgttatagtcggtagttatgatttgttaagagagcttattctaaagcgatgaaagcatctctgttttgtgtaggaagtaggttgcatcaattgaattacagatggctttgatctttaataaaagttacacatatgcagtaattattggtacaagttacataagtttgtatcatctgggaata

SEQ ID NO: 8993 - DNA, 1873 bp, Allium cepa
catcgcccttccataaaaccgttcactccatgtcaagcaagcctctaaacacggaattgctattaagctcgggcatatactcacacgagtattgcgatatagtatgcttctcgcgttgctcaaaccaaatattttgtatattaattctcactactaatcccagatccaatctcctatctcacccctcaaagtgaagaagaaggagaatggaggccttctattatttggtttttggcgcactttccatagtggtcgcattgctcgagctcagcaaatccggcaatgatcgtaccgctacttctccttccttcaattctttcaagaacaattacttagtcgtctactctctcatgatggctggagattggttacagggcccttatgtatactacctatacagtacatacggttttgataaaggcgatattggtcgccttttcattgcagggtttggatcctccatgcttttcgggactattgtaggatctctagctgataagcaaggtcggaagagggcatgcgtgacatattgcataacatacatactgagttgtattaccaaacattctccacagtataagattttgatgttgggtcgtgtattgggaggaattgctacttctctcttgttttcgtcttttgaatcatggctagttgcggagcacaataagaggggttttgaaccgcaatggctatctttaactttctcgaaggctatatttcttggcaatggtcttgtagctatcatatctgggttgtttgcaaacatgttagcagacaatctgggatttggcccagttgctccttttgatgctgctgcatgtttcctagcgattggcatgtcaattatattgtcaacctggacagaaaattatggcgatgcttctgataacaaagatttactcactcaattcaaagttgctgcatcagctattgcttcagatgaaaaaattgctttactaggtgcaatacaatcattatttgaaggctctatgtacacttttgtgttcctgtggactcctgccttaagcccgaacgatgaagacattccacatggcttcatttttgcgacttttatgttgtcgtcaatgttgggaagttctattgcatcaaggctcatggcccgccctgtacttagagttgaaagttacatgcaagttgtttttcttgtatcatcattcactcttctccttcctattcttaccacgtttttgactacacctccatctgttaaaggtggaagtatatctttcgctggatgtatgcagctctttggtttttgcacatttgaagcatgttgtggaatattttggccatctattatgaaaatgaggtcacaatacattcccgaggaggctaggagcaccatcatgaatttcttccgcatccccttaaatatttttgtgtgtgttgttctttacaatgtgaatgcatttccaatcaccgttatgtttggcatgtgctctattttcctatttatggcttcagtcttgcaaaggcgccttatggtggttgctgaagtccacagagcaaagcatatatcaatgaaggagatagatccagaggcagaaccattgaatattagctagctagaggaacatgaattggatggaagctaaaataaagtaaatttgctttcttataccaaataatgcaaatgcatcatggtcaattcatggttttagtatcgtaacttgtatggaagagataaaatacagacacaaaggcatgaagacgactttgaaaattttgaaatatatagtatccgttttatagcctttggtattcctgtgattaatatgatgtaatttccatgtattttgttttggagattgtacaattactgttaatctttgttatattgacaaccttt

SEQ ID NO: 8994 - DNA, 2158 bp, Ananas comosus
gtggaaatggaggtgttctactacgtggtgttcggggggttggcgatggtggtggcgctgctggagctgagcaagacgagcaaggatcgcgtctccacctcctcagccttcaactccttcaagaacaactacctcgtcgtctactccctcatgatggctggtgattggctacaaggcccttatgtctacttcctctacagccaatatggtttcgataagggagacattggtcgcctattcattgctggtttcggatcttccatgctgttcgggacaattgttggttctctggctgacaaacagggtaggaagagggcttgcgttacgtattgcataacttacattctcagctgcatcactaagcattctcctgagtacaaggttttgatggtggggcgtatattgggaggaatagcaacatctctactgttctcggcctttgagtcatggcttgttgcagagcataataagaggggctttgatccacaatggctttctttaattttctccaaggctatattccttgggaatggtctcattgctattgtttctggcttgtttgcaaatatgttggctgataacctagggtttggccctgttgctcccttcgatgctgcagcatgcttcctagcaataggcatggcaatcatcttatcttcatggactgaaaattatggtgatccttctgacagcaaagacctaatgggtcagttcaaggttgctgcaacagccattgcttctgatgagaaaattgctttgctcggtgcgatacagtcattgtttgaaggctccatgtacacctttgtgttcttgtggactcctgcgttaagccccaatgatgaagaaattcctcatggttttatatttgctacatttatgatgtcttcaatgttggggagttctattgcatctcgtctattggcccgtgtaactctaaaagtcgaaagctatatgcagatagttttcgtagtctctgcattcactctcctcctccctgtcattatcaatttcttagtagcaccgtctacaggaaaagatgctagccttccgtttggcggttgtatccttctctttggtttctgcatattcgagtcatgtgtggggattttctggccatcaatgatgaaaatgagatctcagtacataccagaggaggctaggagtacaatcatgaacttcttccgcatacccctcaacttatttgtctgcgtcgtgctctacaatgtgaatgcattccccatcaccgtcatgttcggcatgtgctccatattccttttcatggcctcaatcttgcagaggcgtctaatggtcatcgcagatcgccccaaatcaagttaacattattaatttatcattcatgccatcaaccagacagctcatttcatcggggatacatggttcaacttaagggtctgatattttctccctcctgaatgttatgctccataattttcttacagagccacaagattggactgctttaagggagatggatggtgaagaggagccgctgaacgtctaaactaaagtcggaactcatcggagctctcacgccacaacgatgcaatccaatgcaagaaaatgccttgctatttgcagttgcagctattattgaggagacaataaaaggtggaacccttgctttcttttcccaccagagcgcgacaatatcttaaaaaagtgcatcccttctatgactcttataatccaaaaccaggtatctgtttcttaagcaggaaggctcttttattagtagtctttagatcttccatacaattttctttaggtgcccaggcttattagggtctattcattctattagtttagcattatcctaatctaattaagatataattgttttctcccttcatgaaatcatgtggtaatttccgtgacggctaaataataatattgatatgtagcttgttaagtgttggtaaagtcattccttatattaattctaagtgaatttatttttgttgtttaattttgttactcgcagagtttcagttacccatattttgtctttggtgtgtcaattttgctaaatggaatcgtatgtaattataacaacatttacaaacttcatgttgaaatgatccatggttttctctgcttacattttctttttaagagtttatttttattatcttgtggc

SEQ ID NO: 8995 - DNA, 2171 bp, Amborella trichopoda
gggaatgaggacgcggaaacgaaagatatactctctctctctctctctctctctctctttggtcgagcactaagacgtttaccttctctctctctctctctctaaatctcttctctctgtttctcactctaaaaatacgcttcttctactgcgtgtggaaccagggatcaacaatggaggttttctattacctggtttttggagtcctatctgtggtggttgcagtcctcgagctcagcaaaaccagcaaggatcgcattacaacatcctctgcattcaactccttcaagaacaattatctcgttgtttactccctcatgatggctggtgattggttgcaaggtccctatgtgtacttcctgtatagccagtatggttttagtaagggggagattggtcgactcttcattgcgggttttggatcttctatgttgtttggtacagttgttggatccctagcagacaaacagggaaggaagcgtgcttgcataacttactgtattacttacatcctgagctgtatcactaagcactctcctcagtacaaagttctgatgctgggccgtattttaggagggattgccacatcacttctgttctcagcatttgaatcatggcttgtagctgaacactttaagaggggttttgaagcacaatggttgtcctttacattctcaaaggccatattccttgggaatggacttgttgccatcgtgtccgggttgtttgcaaattttatcgccgacaatttaggctttggacctgttgctccctttgatgcagctgcttgctttctcgccattggcatggcaatcatcttatcatcatggacagaaaactatggagacccctctgagagcaaggacttgctgacccagtttaagggagcagcagtagccattgcttctgatgagaaaattgctttattgggagccatacagtctttgtttgagggttcaatgtacaccttcgtgttcctttggaccccagctttgagcccaaatgatgaggatattcctcatggattcattttcgctactttcatgttggcgtcgatgttgggaagttccattgcttctcgtctgatggcacgtgcatcacttaaggtggaatcctatatgcagatagtcttcatcatctctgctttcacccttctgcttcccattctcactacgttcttggttgtaccatcaaatattaaaggaggaagcatctcattcagtggatccatacagctttttgggttctgtatttttgagtcttgtgtgggtatcttttggccctctattatgaagatgcgatctcagtacatacctgaggaggccaggagcaccatcatgaacttctttcgtattcccctcaatatttttgtctgcatcgtgctttacaatgtgaatgctttccctatcactgtcatgtttggtatgtgctcaatttttctcttcatggcttcagttcttcagaggcgattgatgattgttgcagaaagccacaagtcgaagccacaagacacttgggccaaggagagagatgtagaggaagagccattgaatatttaagttcccaacggggttgtgaccacgaaggtctaagaaatgcagttggcacctttcagtttagctatttggaatcaagtacttcatgaaggataaacgtttcaactcagtggattcccttctttttaagttaaagcagctggtgaggatcttgagtggaagatcttgatctcttaatgagagatgattttattgtttctagctggccactctgttgaatcagtgggctaagtagcttgccaacattgagtgataccaaacaagggttcatgttagcattgatcagtgggctaagaattttcattatgtatttttggttttttttttgttaactaattgggttagggatggaagtaagcatgaaggttttagcgttggcagggatattcttctccatcaggtattcattttgtagtacccgaaagcttcattccatactcgacaatggattgttaagtgtctataataaaacttatacctcttcatttactaaatgtaagcataagttaattgtcttctaatggcaatgaaatattgaagaattaaagcttttgttcttctcttctcatggtaatgaattattgaagaactgatctcggggaacattcagggcaa

SEQ ID NO: 8996 - DNA, 1968 bp, Phalaenopsis aphrodite
aataacctgtcacaaactaaaccccacaatttcctttataaacggagaggaggagaggaattagcgttctacgcggaatccccatatcagatctcgccactctgcttcttggttcccaggaagaaaacttcgatctccctaatacattggatacagaaagaagaggggatggagctcttctattaccttctctttgccgtcctgtcggccgtggtggcgctgctggagctgagcaagaccagcaaagatcgcattgccacctccacagccttcaactccttcaagaacaactacctcgttgtctattctctcatgatggctggtgattggttgcagggtccctatgtttatttcctctacagtcagtatggatttgacaagggagacattggtcgtctgttcattgctggatttggctcttccatgttatttggaaccatagtcggatctctggccgacaaacaaggtcgtaggagggcatgcgtaacctattgcataacttatattcttagctgcatcacaaagcattctccacagtataaggtcctaatgcttggtcgtatattgggcggaattgctacatccttgttattttcggcctttgaatcatggcttgttgcagagcacaataagagaggctttgaacctcagtggctatccttaactttctcaaaggctatatttcttggtaatggtctagttgcgattgtctccggactgtttgctaatatattggcagataacttgggctttggccctgttgccccttttgatgctgctgcatgcttccttgctattgggatggcaatcatattatcctcctggagtgaaaacttcggagattcttctgataacaaaagtttactatctcaatttaaaggtgctgcagtagccatagcttctgatgaaaagattgctcttttgggtgcaatacagtcactgtttgaaggctctatgtatacatttgtttttttgtggactcctgcattaagcccaaatgaggaggatattcctcatgggtttatcttcgctacattcatgctttcttcaatgttgggaagctccactgcatctcgtttgttggctcgctccacaccaaaagtggaaagttatatgcagatcatttttggaatttctgcactaactcttcttcttcctataataactaattttctagtgtcatctactggagtaaaagggggcagcatttcagttgcaggctgcatccaactctttggcttctgtacctttgaggcatgtgttgggatattttggccatctatcatgaagatgaggtctcaatacattccggaggaagctagaagcacgatcatgaacttctttcgtattcctctcaacatatttgtctgtgttgttctttacaatgtgaatgcatttcccatcactgtcatgttcggcatgtgctctattttcctcttcatggctgcggttctacaaaggaggctaatggtggtttctgagagccacaaatcaaagccacaggactggatggcagtgaaggagagggacaatgagacagaaccgttgaatatctaatttgtctttgtagcatacctcaattggagttgacacatctttagttccttgatgtttccaacgatacatatacatatattccgattggcttataatctttatgaactgtgctttactgaagattgaatgagttgtattaccatcagcaacacctggagaattctctcgttattaccaagtactcagtagtcatagaatctcagtttgatatcttattccgagtgtcgaatgattggttgtggcaaagtatgccaacgcaaccatatctggtgagctatgttagtaaattttaagcatcatctgctctgtagtatatgtaataatattgctacattaagttattaaatttgtttcaagactccggcagcttgcttttctctgccccttcttctcttcttagtttaagaagtc

SEQ ID NO: 8997 - DNA, 2024 bp, Aquilegia formosa
gagaaagagaagagaaaaaacgaacgaagggtgaccatatctccatatttccatacaaaaacaacagtaacaataacaataagaagaataatatctctcttttctttgtgtgtgtgtttgttcgatcgatctatcgatctgtagaagaagaagaagatggagttgttctacttccttgtatttggtggtttgtcattgattgttgcagctttagagctaagcaagaacaacaaagatcgaatcaatacttcaacggtcttcaattcattcaaaaacaattatgttctcgtttactctctcatgatggctggggattggttacagggtccttatgtgtactacctctacagccaatatggctttggaaagggagacattggaaggctttttattgctggttttggatcttcaatgctttttgggaccattgttggatctctggctgacaaacagggtcgaaagagggcatgtgtgacttactgcattacctacatccttagttgcttcaccaagcattctcctgaatacaaagtcttgatggtaggccgtattctaggaggaatagctacttctctccttttttcatcctttgagtcgtggcttgttgcagaacacaacaagaggggttttgaacaacaatggctgtccctaacattttccaaggcgatattctttggcaatggtctagttgctattctcgctgggctatttggaaatgtgctagccgatactctgggatttggccctgtggccccatttgacgctgcagcagtttttcttgcaattggcatggcaatcatcttatcctcatggaatgaaaattatggtgatccttcggagagtaaggacttgcttacgcagttcaggggtgctgcagtggccattggttctgatgagaaaatcgcattgctgggtgcaatacagtccttgtttgaaggttcaatgtacacttttgtattcttatggacccctgctttgagtccaaatgatgaggagataccacatggatttatttttgcaacattcatgttgtcctcaatgttgggaagctcccttgcatcacgacttttggcccgtgcaacatttaaagtcgaaagctacatgcagattgtgtttgcagtctctgccggaacttttctccttcccatcattaccagttatattgtacctccatcaaaggtgaaaggtgggggcatctccttcgcagggtgtatccaggtcttaggcttctgtacttttgaggcttgtgtggggttgttttggccatcgataatgaaaatgagatcccaatacattccagaggaagcaagaagcacaataatgaatttcttccgcattcctcttaacatttttgtgtgcattgtgctatacaatgtgaatgcattccccatcacagttatgtttggcatgtgctccatattcctcttcatggcatcaatcttgcaaaggcgactcatggttgttgcagagagccacaggacaaagtcacaagagtggacatcaatgaaggagagggagacggaggaagaacccttgaacatttaattctattgaagattaaaacaccacaaaagttgaaaaggtcatcttgaagatgatttacaagttctgacctatcctataaataagggaacaagacaagacaggatgtttctttatttctcaaaaggaggaagataaggctgtctttctaatctgatagtgcatcctagtacaaaagaaatggtatttagccctactaaagaagaggaacaaggtgtctaattcagctttgggggtattcaagtttatatcttagttgcaattgtgttgaggagttatagatgttcttttttgtaattttgatgtattcattccagatcaggtttagtgttggtctgctgggaacatgttcaattttttatctggctacattttggatccaagtgcgcaatggcacagcaatgttagtagatattaatattctaactacttgatgtagtgacttctatagtatatgataaacaatatatcctcattttgtt

SEQ ID NO: 8998 - DNA, 1890 bp, Fagus grandifolia
gattccaccagaaaatgaaattccacccaaccacgaaagtgacattgacgacaactcctttttaacaacaccaccacccttttttctcatcttcttctgttactactctctctttctctctctcgatctgcgaaacccagaaatggagctcttctacttcattgtgtttggtggtctcgcggcaatagtggcagcattggagctaagtaaaagcagcaaagatcgtatcaacaccccttctgctttcaatgctttcaagaataactatctccttgtttactctctcatgatggccggggattggctgcagggtccatatgtttactacctctacagtcagtatgggtttggaaagggggacattggacagctctttattgctgggtttggatcctctatgttgtttgggacaattgttggatctttagctgataaacagggtcggaagagggcatctgttacttattgcattacttacattttaagctgcatcactaaacattcttcccagtacaaagttttaatgttgggacgcatattgggaggcattgccacttctctactcttctcagcttttgagtcatggcttgttgcagaacacaataagaggggtttcgagcaacaatggctttcgataacattctctaaggcaatatttcttggcaacggtttggttgccattatatctgggctgtttgggaatgtactagtagatacactaggatttggccctgttgctccgtttgatgctgctgcatgctttctggcaattggcatggcaattataatatcatcatggagtgaaaactatggagacccttcagaaaacaaggacttgcttacccagtttaagggtgctgctgtggccattgcttctgatgagaaaattgcattgctgggtgctatacagtccctatttgaaggctcaatgtacacctttgtattcctttggactcctgctctgagcccaaacgaggaggatattccacatggtttcatttttgcaacattcatgctggcttcaatgctgggaagctcctttgcatctcgattgatggctcgctcatctttcaaagttgagagctacatgcagattgtttttgtagtctcctcggcatcccttctgctccccattctaaccagttccttggtaaccacttccaaagtgaaaggtggaagtatctcgttttcggggtgtattcaacttgttggcttctgtacgtttgaggcttgtgtggggatattctggccatctatcatgaagatgagatcccaatacattcctgaggaggcaagaagcaccataatgaacttctttcgcattcctctcaacatctttgtgtgcattgtgctgtacaatgttaatgcatttcccatcaccatcatgtttggcatgtgctcgtatttttctcttcgtggctgctttactacagaggcggctcatggtaattgcagatagccaaaagtcaacaaaaccacaagactggacagcactggacagggacacggaagcggaaccattgaatgctgctgattgatgtgaagaataataacctctggaagttttgaaatttgaaacaagccaccttgtcttactgtgaattgttggaggtgcattctggttgctgtttgctgtctgattaataaggaaagggagaatgtgggttaatttccttcttgaaaagaaagcataaaatgattttcaggggagcaatcagctggtggctataacataaaagaaacgactaggtaaaagaatgatagtgttagtacttttagatcatgtcttctgcaattactctaaactggtgccacataagctcaggcaattcaaaatttacggtttgcgattatatataatgacggctttttaaatcattatcattccac

SEQ ID NO: 8999 - DNA, 1899 bp, Musa acuminata
cctatcttcggttcacttcactcgcaccctcctcgttctactccttcgccattccctcgctcctcctgcgacgctgtgaggtgaagcgtgccggagaatggaggccttctactggctgctcttcggcgggctcgcggcggtggtggcggccctggagatgagcaagaccaacagggaccgcgccgccacctcctccgccttcaactcgttcaagaacaactacctccttgtctattccctcatgatggccggagattggttgcagggtccgtacgtgtactacctctacagccagtatggatatgggaagggagacatcggtcggctcttcatcgccggcttcggatcttccatgctgttcgggaccatcgtcggatctctggcggacaaacagggtcggaagagagcttctgtgacgtattgtatcacttatatcctcagttgcatcaccaaacattctccacagtataaggtcttgatgttgggacgcatattaggagggattgcgacgtcactcttgttttcggcatttgagtcatggcttgttgcagaacacaataagaggggttttgaaccacagtggctatccataacattttccaaagctatatttcttggaaatggccttgttgccattatcgctgggttgtttgctaacctgctgacagataatttgggttttggacctgttgcaccctttgatgctgccgcatgttttcttgctattggcatggcggttatattatcaacatggactgagaactatggagatccttctgaaagcaagaatttagttacccagttcaaggttgccgcatcagctatttcttctgacacgaaaattgcgttacttggtgcaatacagtcgttgtttgaaggttccatgtatacatttgttttcctctggactcctgctttaagcccaaatgatgaagacattccacacggattcatttttgcgacatttatgctgtcctcaatgttgggtagctccattgcatctcgactattgtcccgcgcagcacccaaagttgaatcttacatgcagcttgtatttgctatcgctgcggtcactctccttctacctgttattaccagtttcttagtagcaccctcaacagtcaaaggtggaagcatttctttcgggggttgtattcagctctttggcttctgcacatttgaagcttgtgttggaatattttggccttccattatgaagatgaggtcccagtacattcctgaagaggctagaagcacgatcatgaactttttccgcattccccttaacatatttgtgtgtgttgttctatacaatgtgaatgcattccctatgactgtcatgtttgccatgtgctctgttttccttttcctcgcctcaattcttcaaaggaggttgatgatagttgctgagagccacagatcaaagtctgaagattggacttctctgaaggagagagatgctgaggcggagccactgaacatttgaagagcaataaaacctggagcgcacgataatgtggtctttcacggcaatgctactgcaatcttgtcttggttcttgtcattactaatctgatggaaaataagtttgttgctatgtttaggtggattcaattggatatgcagttatgaggcagaggacattggaaatgcaagaactccatattgaggtttccctattctagattttcttctaaaagattactgaaaaacagaagtatctctatgtagtggttaacagtcagttgcccaattggttttctgttttagaatccttttgttgcttctttatcttcactcacgacctacatgtccttagagattctatccatgaccgagtctttatcatgtattcagaaaataatcaataatttctgcatctagatttggttatttctg

SEQ ID NO: 9000 - DNA, 1754 bp, Papaver somniferum
ttagtgtttggagctatgtctgtagtggtagcagtattagaattcagcaaaaacaacaaagatcggattaatacttctactgcttttaatgctttcaagaataactacttagttgtgtattctcttatgatggctggggattggttgcagggtccatatgtctacttcttgtacagccaatatggtttctcgaagggagatattggacgtctctttattgctggttttgggtcgtctatgctctttgggactgttgttgggtctctagctgacaaaacaggacgtaagagggcctgcatcacatactgtataacatacatcctgagttgtatcaccaagcattcacctcagtacaaggttctgatggtgggtcgtatcttgggaggaattgctacttccctcctgttttcagccttcgagtcatggctagttgcagaacacaacaagagaggttatgaacaacaatggctgtcattgacattctccaaggcaatatttcttggcaatggtctcattgctatttttgctgggttgtttggcaacatgctcgccgataatttgggatttggtcctgttgccccctttgatgccgctgcatgctttctcgccattggtatggctattatcttatcaacatggagcgaaaactttggtgacccctctgaaagcaaggacttgcttacccagttcaggggtgcagcagtagccattgcttctgacgagaagattgcactgttgggtgctattcagtccttgtttgaaggctcaatgtacacctttgtgttcctttggacacctgctttgagccctaacgacgaggacatcccacacggatttatttttgcaacattcatgttggcctctatgttgggaagctctattgcatctcgattgatggcacgccaaaatctcaaagttgaaggctacatgcagattgtgtttgcagtttctgcctgtactttccttcttcccttagtcactggtttcttggtacctccttcaggggagaaaggtggaagcatctcatttgcagggtgtattcaactttttggattctgtacatttgaatcttgtgttggcatattctggccatcaatcatgaagatgagatcgcaatacatccccgaggaggccagaagcaccatcatgaacttcttccgtattcctctcaacatcttcgtgtgcattgtgctatacaatgttaatgcgttcccgatcactgtcatgtttggaatgtgttctattttcctcttgatggcgtccatcttgcagaggcggctcatggtagtggcagagttgcacaacaagtcaaagcctgaagactggacatcattgaaagagagggacacagaggctgaacccctgaacatctaattgatgtgaaggtggcaaccatcaaagcttagaccggttcaggaaaaaataggctttcttaacagtgagacgtagcagttgcaacaatgcaatttgttagtttaccattcctataaataataggggagatataggatggttccgcgattcattaaatgagaacaggttttgaagaaaaatcagtctggtaaaagaagagttttcagggctataggtaacaaaggacagttgcaggaataataggtattttagtaaactagtggcatggtatggaatttcctactgttattttttgaaactaaaagttctctgctgtaattttggtttttatttgttttctctaagtgtgtttaagggttaatacaacaggatgtctaggg

SEQ ID NO: 9001 - DNA, 1880 bp, Amorphophallus konjac
agagtacggaaggaggaagggaaggacgtctcctcctactcttcttcttcttcttcttcttcctctcgtgtcctcgtgtctctctagttgtctgagggcgggacgccgagggggggggagtggtggtgggtcggcaatggagatgttctactacctgctgttcggggcgctgtccctggtggtggctgggctggagtgcagcaagaccagcaaagaccgcatcaccacctcctccgtcttcaactccttcaagaacaactacctcgtcgtctactccctcatgatggctggggattggttgcagggtccctatgtctatttcctttacagtcagtatggttttgacaagggagatattgggcggctctttattgctggttttggatcgtccatgctgtttgggacaattgtgggatccctggcagataagcagggtcggaggagggcttgtgtgacatactgcatcacttacatcctgagctgtattacaaagcactcaccacagtacaaggtcttaatgttaggccgcattttgggaggaattgctacatctcttctcttttcagcctttgagtcatggcttgttgcggagcacaacaagaggggatttgatccacaatggttgtcattgacattctccaaggctatatttcttggcaatggtcttgttgctattgtctctgggctgtttgccaatttgctgacggataatctaggtcttggccctgtggccccctttgatgctgctgcatgctttctagcaattggcatggcaatcatcttgtcatcatggactgaaaattatggggatccttctgagagcaaggatttgcttacccagttcaggggtgctgcagttgccattgcatctgatgaaaagattgctttgcttggtgcaattcaatctctatttgaaggctccatgtatacatttgtgttcctgtggacccctgccttgagttcgaatgaggagaatattcctcacggttttatttttgccacgttcatgttatcttctatgttggggagttccattgcatcacggctgatgactcgtgcatcactcaaagttgaaagttatatgcagattgtctttgtgatatcagccttgactttgcttctccccattgtcactagtttccttgtggcaccttcttcagtaaaaggtggcagcatctcattctcgggttccatccaactcttcggattttgcatctttgaggcgtgcgtgggaatattttggccatcaattatgaaaatgaggtcccaatacattcctgaggaggccaggagcacgatcatgaacttcttccgtattcctcttaacatctttgtgtgcattgtcctttacaatgtgaatgcgttccctattacagtcatgtttggtatgtgctctattttcctccttatggcatcggtcctgcagaggcggttgatggtggtagcggagacccacaagtcaaagccacaagattggacagcactgaaggagagggattctgaggcagagccactaagcgtatgatcaacgagagaagaagatacctgcaaatttttgcacgttgaattttgctgctgcatcttgcccttctattgtgaggataataagatgaagttggaaatgttatagaagaaagtaggttttgtaggtgcagtttgcagtctattgccgagctccaagatttggaatcagtaatgtatcaggattttaggttttaaactgaattgttttaagggacgcttgtgccaaaatacaagtatccccatatagctgaagtgttatctacgtttctgtaattgagaattttacccctcttttcttacctatttaaattgcaacacaatctaaaatctaatgaattcttgttttaagaataaag

SEQ ID NO: 9002 - DNA, 2108 bp, Tabernaemontana elegans
cagatgaaactgagaaaacaaagataatgtgtcaaaaactagaagtaattctgaaatgtgtaactaaaaaaaatgataagaatgcaattactcttgaggttttgctgtgctccaataggactcgtgcaatgtatcaattacaatgttaaattactgattcactttacactttgtggatggcgggagcattttattctgtgtgcgcgtagtaccatttgctcttccggtacacttctccctctcccactcccagtgtgtgactgagtgtgagcgtgtataatagtatataatctggctagggcgagatttgctgtgcgagtttctgatagtgaggaaaatggagttgttctattatctggtatttggaggactagctgctgtggtggcagctttggagctgagtaagaacaacaaggatcgcatcgtcacttctcagcctttcaattccttcaagaacaattaccttcttgtttactcgctcatgatggccggtgactggttgcagggcccatatgtgtactacctttacagtgtgtatggctttgggaagggggacattggacagctctttattgctggatttggatcgtccatgttgtttggaacaattgttggatctctggctgacaaacagggacggaagagagcatgcgtgacgtactgtatcacttacatactcagctgcatcactaagcattcccctcagtacaaagttttgatgttggggcgtgttttaggtggtatcgccacttccctacttttctcagcatttgagtcttggcttgtggcagaacacttcaagaggggttttgatcagcaatggctctctttaactttctcaaaggcaatatttcttggcaatggccttgttgcaatccttgctggattgtttggaaatcttctagttgataccctaagtcttgggcctgtatcaccctttgatgctgctgcctgctttcttgcaattggaatggctgttataatgtcatcatggaccgagaactatggagacccttcagagagcaaggacttgcttactcagttcaagaatgctgctgtagcaattgcttcagatgagaagatagcattgctgggtgcaatacagtccctatttgaaggttcgatgtacacttttgtgtttctgtggactcctgctcttagtccaaacaatgaagaaattccccatggttttatttttgccacattcatgttggcttcgatgctagggagctcgattgcatctcgccttttggcacgcaactcactcaaagtcgagagctatatgcagattgtatttattatatcttctgcttctcttctgctacctattattactagtttcttggtagctccgtcaaaagtaaagggtggaggtatcacgtttgctggttgtctccaacttcttggtttctgtacctttgagtcttgtgtgggtatcttctggccatccatcatgaagatgagatctcagtacattcccgaggaggctaggagcaccattatgaatttcttccgcatccctctcaatatctttgtgtgcattgtgctctataatgttgatgcattccccatcactgttatgttcggtatgtgctcgattttcctctttatggcatccgtcctgcagagacggctagcagtaattgcagataagccaaagacagacgattggacagcaatgaaagaaaaagatacagaggcggagccattgaatgttccttgatgccaataatttagactattaagttttgtgaggttgcacacaaccacctaataccataatccaccccaggcctgatagctgggcattcctttgatccagtagtcattgttcagagaccataccaaaagtagagaactgcctggcaagagcggaagagggttgcagaaaagctggatgctgtctttgttagtctttgttcataattataatgcaaacacaaagcattaacatctacagatatctcagccattgctgttagtatatctattttaaattcgttatttggtcccaggttaagatcctgttcaggccttaattttgtatttggtacttatttcattatatttgaccatttatgtttcatcggaagtgaaatgccattatt

SEQ ID NO: 9003 - DNA, 2009 bp, Elaeis guineensis
ctctgcgtgaaagagaaagggaaggctccccaggcccccccaaacccattctcgccttctctctctctccatccttgtgagaggcaaagaaaggaaccggcaatggaggccttgtactacctggtcttcggggggctgtcggtggtggtggcgctgctggagttcagcaagaccagcaaagatcgcatctccacctccgtcgccttcaactccttcaagaacaactacatcgtcgtctactccctcatgatggctggagattggttgcagggtccttatgtttactacctttaccatacgtatggattcgggaagggagaaattggccggctcttcattgctggatttggatcctccatgctttttgggacgattgttggatctctggctgataaacagggtcggaagagggcttgtgtgacatactgcataagttatatcctgagctgtatcaccaaacattctccagagtttaaggtgttgatgttgggccgtatattgggaggaatcgctacctcgctcttgttttcggccttcgagtcatggcttgttgctgaacacaacaagaggggctttgaaccacagtggctctccctaactttttcaaaggctatattcattggcaatggtctcgtagccattgtctgtgggctgttcgctaatttactgactgatactttgggttttggccctgtgtccccctttgatgctgctgcatgtttcctagcaattggcatggcgattatcttatcaacatggggtgaaaattatggagatccttcagaaagcaaggacttacttagccaatttaaggttgctgcagtagctattgcttctgatgagaaaattgctttgctgggtgccattcaatcactgtttgaaggctcaatgtatacctttgtattcttgtggactcctgctttaagcccaaacgatgaggacattcctcatggttttatttttgctaccttcatgttgtcttcgatgctaggaagctccattgcatctcggctaatggcccgtgcgaaagttgaaggttacatgcaagttgtttttgcaatctcatcaatcactctcctccttcctgttatcaccagtttcttggtaacatcttcatctgtaaaaggtgggagcatctcaatagggggctgtattctgctagttggtttctgtaccttcgaagcatgcgtagggatattttggccatctattatgaagatgagatctcagtacattcctgaggaggcgaggagcacaatcatgaacttcttccgcattccccttaacatatttgtgtgcattgtgctttacaatgtggatgcattccctatgactgtcatgtttggcatgtgctccattttccttttcattgcctccatcttgcaaaggcggctgatggtggttgctgagagccaccgatcaaagacacaggattggacagcaatgaaggagagggatgatgaggcagagccactgaatatctaaatagcaggcaaacatttggttcttgcatagtcatagctactgcctttcatgataatatattgcaattgcattgtactcctgtcatcattgatctgattaataatttgaaaggtatgctgtcatcagagggcggtattattttaaagtgtgcaatcatacagaaaacatgtcgcatcaaaatgctccacatcaagcaagtttccttgagtcttagattagcagttaagggagttcttcaagtggtagcttgtgccagagtatgctagcatctctacgaagtcatgggagctagttggctgatggatcacctattttgtaactttttgtttttcctttgctttttcttgtttaagacttatatgtcttgttggaatttaattcttccaggccttagtttgagtatctgcaagcatggagtaacgtggatatctcacttgtattcttatatatttattttagttgacagtcatggtgggtgatgccatggtcatatcctttaataatataagttcattgttgttgca

SEQ ID NO: 9004 - DNA, 1998 bp, Chenopodium quinoa
ctgtttatataatctcactgctttaagttccatttttcccagaaattaattcgtttcttttttcttcaaattctctctcctaattttctttattcgtaaaaatggagtggtttttttacctggtttttggatctcttgctgctgttgtcgcagcaattgagctcagcaagaacaataaagatcgtatcaatacttctaccgctttcaatgccttcaaaaataattatgttctggtttattctcttatgatggctggcgactggttgcagggtccttatgtatactacctgtatagtacttatggttttgggaaaggggacattggacagctatttattgctggttttggatcctcaatgctatttgggactattgtcggatctttggctgacaaacagggccggaagagggcatgtgtgacttattgcataacctacatcttgagttgcataaccaaacattctcctcaatacaaagtgttgatgctgggccgaatattaggaggcattgccacatcactgttattctctgccttcgagtcatggcttgttgcagagcacaacaagaggggctttagaacaacaatggctctctgtaacgttctcaaaagcaatttttcttggaaacggtcttgtcgctattctttctggcttgtttggaaatttattggtggatacatttgggcttgggcctgtagcgccctttgatgctgcagcatgtcttcttgctataggcatggccatcattttatcatcatggactgagaactatggagacccttcagagaataaggacttgcttgcacaattcaagggtgctgcaatagctattgcttcggatgagaaaatagctttacttggagccattcagtcattgtttgagggttctatgtatacctttgtattcctctggacccctgcattgagcccaaatgacgaggaaattccacatgggtttatttttgcaactttcatgctggcttcaatgttgggaagctctattgcatctcggcttttggctcgttcatctcctagagttgagagctatatgtcaagtggttttctccatctctgctgtctctctcttgctaccaattgtgacaaatttccttgtagagccatcaaaggtgaagggtggtggcatcagtttttcaggttgtatccaggttctcggcttctgtgcttttgaagcatgtgtgggaatattttggccatctatcatgaagatgagatcccagtatattccagaggaagctaggagtactatcatgaacttcttccgcattccacttaatatctttgtctgcgttgttctatataacgtcaatgcatttcccatcactgtcatgtttggcatgtgctcaatcttcctcttcgtggcctctatattgcagaggcgactcatggtgatttctgaaaaacctaagacagaatatggactcaaggaaagagatactgaagctgagccattgagcatctaagcttgagaagtaataggcgcgaaagattgatataaaacccatgaaaagcgtcatgatagagtcaatacagctacatctcagaagcatattgatgtttaaatggtgatcattcttataagaattagttttgctgctccaaactcgagtaagaatacacggaaatacaaggtacttcagtactgcagaagtagtatgtagttttaagtctgcatagctgttcactaatgcattaggtggcgatttttttaccctataacctcccgtcctctcctatccaagagttcagaggatggtgagtatatgccaattttttgtttaggctccacattatttgttatgccattgaacagttgatcatatactgtatttttctcccttgattgttttggagattttttttcctcttaatattgaattgactttgtaagcaatttcttgcgcaaaacatttagagcaagtgattatgagattgttatcacaatttatttgagagcaatcgagaagtttcatatccaaaa

SEQ ID NO: 9005 - DNA, 1770 bp, Allium cepa
ctcaacagtcaattaaatatctcttaagaaactaatggagactttttattacttggtgtttggcgcgctttctgtagtggtggcagtgctcgagctaagcaagtcgagcaatgatcgagccaacacttcttccgccttcaattctttcaagaacaattacttggtcgtttactctctcatgatggctggagattggttacaaggtccttatgtatattacctatataccacatatggttttgataaaggagatattggtcgtcttttcattgctggctttggttcctccatgcttttcggaacgattgtgggatctctagctgacaaaacagggcgcaagagagcctgtgttacttactgcataacatacatattgagttgtattaccaaacactctccacaatacaaaattttgatggtcggtcgtatattgggagggattgctacttctcttttgttttcatcttttgaatcatggctagttgctgagcacaacaagaggggttttgaaccacaatggctgtccttgactttttcaaaggctatatttcttggcaatggtcttgttgccattatagctgggttatttgcaaatatgttagcagataatttgggatttggaccagttgctccttttgatgctgctgcctgcttccttgcaattggtatggcagtcatattatcaacgtggactgaaaattatggagatccttcagacagcaaagatttaatcactcaattcagaaatgctgcttcagccattgtttcagatgagaaaattgctttgttgggtgccatacaatcattatttgaaggctctatgtacacttttgttttcctgtggacccctgcattaagcccaaatgaagaagacataccacatggttttatctttgcaacttttatgttatcttctatgctgggaagttctattgcatctaggctcatggccaggcctgtagtcagagttgaaagttacatgcaaattgtttttcttatatcctctttcactcttctccttcctatcattactacgttcttggggacaaccccatctgttaaaggagggagtatatcgtttgctggatgtatacaactctttggtttctgcacatttgaagcatgctgtgggttattttggccatctattatgaaaatgaggtcacagtacatccctgaggaggcgaggagcaccatcatgaatttctttcgcattcccctaaacatttttgtttgtgtcgtgctttacaatgtgaatgcattcccaattaccatcatgtttggcatgtgctctattttccttttcatagcttctattttgcaaaggcgccttatggtggtttctgaagcccacagatcaaagtcacagagagatacagaggtagtaccactaaatctgtaagcagctacaggaaaatatgaattggtattattattattaaaggaaatgccttactccaaagcactgcagtcaactccaaagcactgcagtcaactcacaaccagttcatgattaagtatatttgtttgtaaactatggacacagtcaacctcaaagggatgaagagatcttactttttctgttaaaagattttgagatttattatattcagtttatatagcttttggtattcggcagtcacagaatattaacctatgaagtgatttatatgatgtaatatctgtattttagtttcatgaggatgaataggatttgatctgtattatttgatagtatcaggcattaattacaaaaagattttctttacg

SEQ ID NO: 9006 - DNA, 1853 bp, Musa acuminata
gtttccgctaccatagtaacgacatgagcaccttgtaagcccatcgcttggctcgcattccctctctccaaacttttgagcggaggaagccgaagaagaagaagaggaggaaggaacgatggaggtgttctactacgtggtgttcggcgggctcgccgcagtggcggcggtgatggagctgagcaagacgagcaaggaccggatcgccacctcctccgcattcaatgccttcaagaacaactactgcctcgtctattccctcatgatggccggtgattggatgcagggtccttacgtctactatctctacagtcagtatggcttcgacaagggagacatcgggcggctcttcattgcaggatttggatcttctatgctgttcgggacgatcgttggatctttggctgacaaacgcggtcggaagagggcctgcatcacctactgcataacctacattctaagctgcatcacgaagcattctccacaatacaaagttttgctgttgggtcgaatactgggagggattgctacgtcgctgctcttctcggctttcgagtcatggcttgttgcagagcataacaagagaggttttgatccacagtggttgtcagtgactttctcaaaggctatatttcttggcaatggtcttatcgccattgtttctggactttttgccaatttattggctgataacttaggatttggtcccgtggctccatttgatgctgctgcatgcttacttggcataggcatggccatcatcttgtcatcatggggtgaaaactatggagacccttctaatagcaaggacttgattacacagttcaagggtgctgctgtggccatcgctgctgatgagataattgctttgctgggtgcaatacaatcactttttgaaggttctatgtacacctttgtgttcttgtggactcctgctttgagcccaaatgatgaggatatacctcatggctttatttttgccacgctcatgttgtcttcaatgttgggaagctccatagcatctaggctaatggcccgttccactcttagagtcgaattttatatgcagattgtctttgcagtctctgccttcactctactgcttcccctcatctctaacttctttgtagctccttctaccgtgaaaggtggcagcatatcttttagtggttgtgtccaactccttggtttctgtgtctttgaggcctgtattggcatattttggccatcaatgatgaagatgagatcccaatacattcctgaggagtccaggagcacaattatgaacttctttcgcatccccctcaacatttttgtgtgtatcatactctataacgtaaatgctttcccaatcagtatcatgtttgggatgtgctctattttccttttcatggcctcggtcttgcaaaggcggctcatggtggttgctgagacccacaaatcaaagccacatgattggacaactctgaaggagaaggatagtgaatcagacatgctgagtatccagatctagatgagcattcaaccgaaggtaatacctttgaaagatacctgaaaccaactgaacttctctcatcaaaccaaagaaaaaaaaagaagcaaagaacttgatggcattggacagatacttgggaggtatccgcacaatagaggaaatgctgtctttggttctctacttgcagtaacatagcttagatgtatagggctattcacgctaagtaaagctgacctaatggggtcattcatttgtcactcattctatctcctaattgtaatgtggtggagacattttgggatgcttcagtctgtttctcgagtagtcattcagtactttgtgtctgttgccaatgttg

SEQ ID NO: 9007 - DNA, 1765 bp, Arabidopsis lyrata
cacacactctacaaatctgaaatcacaagtctctctctcatcatcttctgcgagatctgatcgtatcaatggagatcttctacttcgtggtgttcggtgggttggctgcgatcgtcgccggcttggagctgagcaaatcgaacaaagaccgcattaacacctcctccgccttcaactccttcaagaacaactatctcctcgtctactctctcatgatggctggggactggttgcagggtccctatgtgtactatctctatagcacttatggcttcggcaagggggagatcggtcagctctttattgctggtttcggatcttccatgttgtttggcaccattgttggatctcttgccgacaaacagggtcgcaagcgagcttctatcacctactgcattacctacattctcagctgtatcaccaaacattctccccagtacaaagttttgatggtcggtcgtgttcttggtggtatcgctacttctctccttttctctgccttcgaatcctggcttgtcgctgagcacaacaagagaggcttcgagcagcagtggctctctctcactttctccaaggctatcttcctcggtaatggattagtcgccatcattgctggcctctttggcaatttccttgtcgattctctcgcccttggtcctgttgctcctttcgatgctgctgcttgcttccttgctattggtatggccgttattatttcatcttggtccgaaaactatggtgatccctctgaaaacaaagaccttcttacccagttcaagaacgctgcatctgccattgcttctgatgagaagatcgcattgcttggtgccatacagtctctcttcgaaggctccatgtacacctttgtgtttctctggactcctgctttgagcccaaacgaagaggacattccacatggtttcatttttgcaacattcatgctggcttccatgcttggtagctccattgcctctcgtttgttggcacattcggctccaaaagtagagagctatatgcagatcgtatttgtgatttcttctacagctctaatgcttcctgttgtaacaagcttcttggtggcgccctcaggtgtaaaaggtggaagcatatcattctctggatgcattcagttaatgggtttctgcacttttgaagcgtgtgtaggaatcttctggccatctataatgaagatgagatcgcaatacattccagaggaagctagaagcaccatcatgaattttttccgcatcccactcaacatctttgtctgccttgtattgtacaatgttgacgcgtttccaatgaccgtgatgtttggaatgtgctctgtattcctttttgtggcctctatattgcagaggaggttgatgaatgtagccgagatccacaagtcaagatcacaagagtggtcagcagaaaaggagatgacctcagaagctgaccccctaaacccataataaccaaacctctcatgacataaaaaaaagaggaaacgccgttccgtcttctcttgatgatttttctacttgtcttaatacgttcgttggtcataaagtctttccacttgtttagttatatttggattttgtgccttcaccagatgtagcaaacaccctaatacctctgcacgtcagcttatttgggctctggccactattcttcttaaatctttcaactttcttttgtgcctcaaaaacaatctttataagtcacgatattggccctgaaccatagaaatgcagattcattagtgctgttttaaagg

SEQ ID NO: 9008 - DNA, 1757 bp, Arabidopsis thaliana
cacacacactctacaaatctgaaattacaaatctcatcatctccttcctcccttgcgagatctgatcgtatcaatggagatcttctacttcgtggttttcggtggcctggctgcgatcgtcgccggcttggagctgagcaaatcgaacaaagaccgcattaacacctcctccgccttcaactccttcaagaacaactatctcctcgtctactctctcatgatggctggggactggttgcagggtccgtatgtgtactatctctacagcacttatggctttggaaagggagagatcggtcagctctttattgctggttttggatcttccatgttgtttggcaccattgttggatctcttgccgacaaacagggtcgcaagagagcttctatcacctactgtatcacctacattctcagctgtatcaccaaacattctccccagtacaaagttttgatggtcggtcgtgttcttggtggtatcgctacttctctccttttctctgccttcgaatcctggctcgtcgctgagcacaacaagagaggcttcgagcagcagtggctttctgtcactttctccaaggctattttcctcggtaatggattagtcgccatcattgctggcctctttggcaattaccttgtcgattctctctccctcggtcctgttgctcctttcgatgctgctgcttgcttccttgctattggtatggccgttattatctcatcttggtccgaaaactatggagatccatctgaaaacaaagaccttcttacccagttcaagaacgctgcatctgccattgcttctgatgagaagatcgcattactcggtgctattcagtctctgtttgaagggtccatgtacacctttgtgtttctctggactcctgctttgagcccaaacgaagaggacattccacatggtttcatatttgcaacattcatgctggcttcgatgcttggtagctccattgcctctcgtctgttggcacattcgtctccaaaagtagagagctatatgcagatcgtatttgtgatatcttctgctgctctaatgcttcctgttgtaacaagcttcttggtggcgccctcaggtgtaaaaggtggaagcatatccttctctggatgcattcagttaatgggtttctgcacatttgaagcgtgtgtaggaatcttctggccatctataatgaagatgagatcgcaatacattccagaggaagctagaagcaccatcatgaattttttccgcatcccactcaacatctttgtctgccttgtattatacaatgttgacgcgtttccaatgaccgtgatgtttggaatgtgctctgtattcctttttgtggcctctatattgcagaggaggttgatgaatgtagccgagatccacaagtcaagatcacaagagtggtcagcagaaaaggagatgacctcagaagctgaccctctaaacccataataaccaaatcaaccatgacataagaaaaaagaagaaacgccgttccgtttctcttgatgatttttctacttgtcttaatatgttcgttggtcataaagtctttccacttgtttagttatatttggattttgtgccttcaccagatgtagcaaacacaccctaatacctctgcacgtcagcttatttgggctttagccactattcttcttgaatctttcaacttttttttttgtgcgtcaaaaacaatctttataagtcgattttggccctaaaccatagaaatgtagtgttattt

SEQ ID NO: 9009 - DNA, 1856 bp, Ricinus communis
atcaacctctttttaacacgccctcttctctctctctctgtgcggatcgaatcttgaaattaagtgatagagaggaagaagaagaaaaagaaagaatggagatgttctacttcatggttttcggaggcctagcggctgtagtggcagccatagaactcagcaaaacaagcagagatcgagtaaacacaacctctgctttcaatgctttcaagaacaactatcttctggtttattctctcatgatggctggggattggttgcagggtccatatgtatactatctatacagtacatatgggtttggaaagggagagattggccagctctttattgctggctttggatcttcaatgttatttgggacaattgttgggtctcttgctgacaagcagggtcggaggagagcttgtgttacttactgcataacttacatcttgagttgcatcaccaaacattctccagagtacaaagtcttaatgttgggacgtgttttgggaggcattgcaacttctctactcttttctgcttttgagtcttggcttgttgcagaacacttcaagaggggttttgatcaacaatggttgtcagtgacattctcaaaagcaatatttcttggcaatggtttggttgccattatggctgggttgtttgggaatttactagtggataacttgggtcttgggcctgttgctccatttgatgctgctgcatgtttccttgcaattggcatggcaattatattgtcatcttggactgaaaattatggagatacgtcagaaagcaaggacttactttcccaatttaagggtgctgccgttgccattgcttctgatgaaaaaattgcattgctgggtgccatacagtccctatttgaaggttcaatgtacacttttgtgttcctttggactcctgcactgagcccaaatggtgaggacattccacatggtttcatttttgcaacttttatgctggcttcgatgttgggaagctctattgcatctcgtttgatggctcgctcatccattaaagttgagagctacatgcagattgttttcataatctcagcagcttcacttctgcttcctgttataacaagtttcttgatagtaccttctggagtgagaggtggaggcatctcattttctgcgtgtgtccagcttcttggcttctgcacatttgaggcctgcgttggaatattctggccatctatcatgaagatgaggtcccaatatattcctgaagaggctagaagcaccatcatgaacttcttccgcattcctctcaacatatttgtgtgtgttgtgttgtataatgttgatgcgttccccataattgtaatgtttggcatgtgctctatttttctctttgtggcctctcttttgcagaggcggcttatgattattgcagaaagccaaaaatcaagatcgcaagattggacagcaatgagggagatggaagcagaaccattaaatgcctgactgactgcagaggccagaaacctcgtggaatttttttttaagagattgcaagcagccacctttgctccttatatatgctgttggagctgcaacttggattagctgtttgcatccaaacaataacagggagtgtgggtttagtcctactttataagagggaacaaaaggtatggtgcgggcaagaggcagttgacagtaagaaaccaatttttaggtgcttagaatgatggaagttattgcttttaaattttgtttacgggtgctcttgtaatctggtgttgcaatagtgctgagcatatctattccttagatattaatggtagaaacttttatggtgtcttcttaatgattaatatatatgtatgtaggttgttttac

SEQ ID NO: 9010 - DNA, 1769 bp, Vitis vinifera
atctttaactctccctgtctctctctcttctctgtaacagcaatggaggtcttctacttccttgtatttggtgcactctctgcagttgtagctgttattgagctcagcaagaacaacaaggaccgagtcaataccaccacggctttcaattctttcaagaacaattatcttcttgtctactctctcatgatggccggggattggttgcagggtccttatgtgtacttcctctacagtacgtatggcttcggaaaaggggagattggacagttgtttattgctggttttgggtcctccatgttgtttggcacgattgttggatctctagctgacaaacagggacggaagagagcttgtgtgacttattgcattacttatatactgagctgcattaccaagcattcacctcagtacagaattttaatggtggggcgtgtgttgggaggtatcgccacttctctcctgttttcagcatttgagtcatggcttgttgccgagcacaacaagaggggctttgagcaacagtggttgtctgtgacattttcaaaggcaatatttcttggcaatggccttgttgctattctctctgggttgtttggaaatctactagtagataacttgagccttggccctgtggccccttttgatgctgctgcatgctttctagctgttggtatggctgtcattttgtcatcatggtctgaaaactacggtgatccttcagagaacaaggacttgcttacacagttcaagggagctgctgttgccatagcttctgatgagaaaattgcgttgctgggtgcaattcagtcgttgtttgaaggctcaatgtatacttttgtgttcctctggactcctgctctaagcccaaatgaagaggagattccccatggtttcatctttgcaactttcatgttggcttcaatgttgggaagctctgttgcttctcgactgctggcccgcgcatcactcaaagttgaaagttacatgcagatcgtttttgtgatctcttctgcttctctcctgcttcccattgtgacaaatattttggttgaaccttccaaggtgaaaggcggaagcatctcatttgcaggttgtgtccagcttcttggcttctgcacattcgaggcttgtgtggggatcttctggccgtccatcatgaagatgaggtcccagtacattccagaggaggctagaagcactatcatgaacttcttccgcattcccctcaatatctttgtgtgcatcgtgctatataatgttaatgcattccccatcactgtcatgtttggcatgtgctcgattttcctctttgtggcatctatcttgcaaaggcggctcatggtgattgctgacaagtcaaagacagaagattgggcatcaatgaaggacaaaaatatggaggcagagccattgaacatctgagtgacatgcccagatgacagaccacagagattttttgaagggtgagaacaagcaccggattcattccataaacggattgaaaatcttatttaattgaagctgtaattcaattttattatgaggaccacagacagtgtataagaaaacagtggtctgcccagcaaacaaaatggaggtagggcagggaggaaagcaagagccacttaagctttttataatttcatttttactgtcagtagatcaacagagtagcgcataaaagcttgttaaatgctctcttttgtaattttgatgcttttgtaattcagatgctattcttttttatatatctggttttagaatca

SEQ ID NO: 9011 - DNA, 1803 bp, Allium cepa
gatctattctatctctttcttcacccctcctcaagagtcaattaaatatctctgaagaaagcaatggagacattttattacttggtgtttggcgcgctttctgtagtggtggcagcgctcgagctaagcaagtcgagcaatgatcgagctaacacttcttccgccttcaattccttcaagaacaattacttggtcgtttactctctcatgatggctggagattggttacaaggtccttatgtatattacctatataccacatatggttttgataaaggagatattggccgtcttttcattgctggctttggatcctccatgcttttcggaacaattgtgggatctctagctgacaaaacagggcgcaagagagcctgtgttacttactgcataacatacatattgagttgtattaccaaacactctccacaatacaaaattttgatggtcggtcgtatattgggagggattgctacttctcttttgttttcatcttttgaatcatggctagttgctgagcacaacaagaggggtttcgaaccacaatggctgtccttgactttttcaaaggctatatttcttggcaatggtcttgttgccattatagctgggttatttgcaaatatgttagcagataatttgggatttggaccagttgctccttttgatgctgcggcgtgcttccttgccattggtatgtcagttatattatcaacgtggactgaaaattatggagatccttcagacagcaaagatctaatcactcaattcagaagtgctgcttcagctattgtttcagatgagaaaatcgctttattgggtgccatacaatcattatttgaaggctccatgtacacttttgttttcctgtggactcctgcattaagtccaaatgaagaagacataccacatggttttatctttgcaacttttatgttatcttctatgctgggaagttctattgcatctaggctcatggccaggcctgtagtcagagttgaaagttacatgcaaattgtttttcttatatcctctttcactcttctccttcctatcattactacgttcttggggacaaccccatctgttaaaggagggagtatatcgtttgctggatgtatacaactctttggtttctgcacatttgaagcatgctgtgggttattttggccatctattatgaaaatgaggtcacagtacatccctgaggaggcgaggagcaccatcatgaatttctttcgcattcccctaaacatttttgtttgtgtcgtgctttacaatgtgaatgcattcccaattaccatcatgtttggcatgtgctctattttccttttcatagcttctattttgcaaaggcgccttatggtggtttctgaagcccacagatcaaagtcacagagagatacagaggtagtaccactaaatctgtaagcagctacaggaaaatatgaattggtattattattattaaaggaaatgccttactccaaagcactgcagtcaactccaaagcactgcagtcaactcacaaccagttcatgattaagtatatttgtttgtaaactatggacacagtcaacctcaaagggatgaagagatcttactttttctgttaaaagattttgagatttattatattcagtttatatagcttttggtattcggcagtcacagaatattaacctatgaagtgatttatatgatgtaatatctgtattttagtttcatgaggatgaataggatttgatctgtattatttgatagtatcaggcattaaataacaaaagtatttctttcaaggcc

SEQ ID NO: 9012 - DNA, 1702 bp, Eutrema halophilum
aatctcactccatactgtacaaatcaaatcacaatctcatcttcttcccctttgcttgcgagaattgagatctaacaatggagatcttctacatcgtggtgttcggtgggctcgctgcgatcgtcgccggcttggagctcagcaaatccaacaaagaccgcattaacacctcctccgccttcaactccttcaagaacaactatctcctcgtttactctctcatgatggctggggactggttgcagggtccgtatgtgtactatctctatagcacttatggcttcggaaagggagagatcggtcagctgtttattgctggtttcggatcttcaatgttgtttgggacgattgttggatctcttgccgacaaacagggtcgaaagagagcttctatcacctactgcatcacttatattctcagctgtatcaccaaacattctccccagtacaagattttgatggtgggtcgtgttctcggtggtatcgcaacttctctgctcttttctgccttcgagtcttggctagttgctgagcacaacaagagaggtttcgagcagcaatggctatcagtgacattctccaaggcaatattccttgggaatggattagtggccatcatagctgggctctttggcaatttccttgtggactctctgtccctgggtccggttgctccattcgatgctgctgcttgctttcttgctataggtatggccgtcattatatcatcatggtcagaaaactatggcgatccatcagaaaacaaagaccttcttacccagttcaagaacgcggcatctgccattgcttctgatgagaagatcgcattgcttggtgctatacagtctctgtttgaagggtccatgtacacctttgtgtttctctggactcctgctttgagcccaaatgatgaggacattccacatggtttcatatttgcaacattcatgctggcctcaatgcttggtagctccattgcatctcgtttgttggcacactcgtcaccaaaagtagagagctatatgcagatcgtatttgtgatatcttctgctgctctaatgctccctgttctaacaagcttcttggtggcgccctcaggtgtaaaaggtggtagcatatcattctctggatgcattcagctaatgggtttctgcacattcgaagcgtgtgtaggaatcttctggccatcgataatgaagatgagatcccaatacattccagaggaagccagaagcaccattatgaattttttccgcatcccactcaacatctttgtctgccttgtactgtacaatgttgatgcgtttccaatgaccgtgatgtttgggatgtgctctgtattcctttttgtggcctctatattgcagaggaggttgatgaatgtagccgagatccacaagtcaagatcacaagagtggtcagcagcaaaggagatgacctcagaagctgaccctctaaacccataataaccgatattccatcaccgatgacataaaaagagtaaacgccgttgctcagacggctttcttctcttgatgattttctacttgtcataatacgttttccactcaaacccatagtatcttgctagttatgtttggattttgtgcttccaccagatgtagcgaacactcagacatgtgcacatcaatcagcttatttgaggctttggccatttattcttcttcaatctttcagcatt

SEQ ID NO: 9013 - DNA, 1778 bp, Eutrema parvulum
aaatctcactcaacacacttcacaaaacaaatcacaatctcatctttctccttccttggcgagcgaaacaatggagatcttctacttcgtggtgttcggtggcctcgctgcgatcgtcgctggcttggagctcagcaaatcgaacaaagaccgcatcaacacctcctccgccttcaactccttcaagaacaactatctcctcgtttactctctcatgatggctggggactggttgcagggtccgtatgtgtactatctctatagtacttatggcttcggaaagggagagatcggtcagctctttatcgctggtttcggatcttcaatgttgtttgggacgattgttggatctcttgccgataaacagggtcggaagagagcttctatcacctactgcattacctatattctcagctgcatcaccaaacattctccccagtacaaagttttgatggttggtcgtgttctgggcggtatcgcaacttctctactcttttctgccttcgagtcttggctagttgctgagcacaacaagagaggtttcgagcagcaatggctctcagtgacattctccaaggcaatattccttggtaatggattggtggccatcatcgctggactctttggcaatttccttgttgattctctatccctgggtcctgttgctccattcgatgctgcagcttgctttcttgctattggtatggccgtcattatatcatcatggtcagaaaactatggagatccatcagaaaacaaagaccttcttacccagttcaagaacgcggcatctgctattgcttcagatgagaagatcgcattgcttggtgctatacaatctctgtttgaagggtccatgtacacctttgtgtttctctggactccagctttgagcccaaatgatgaggacattccacatggtttcatatttgcaacattcatgctggcttcaatgcttggtagctccattgcatctcgtttgctggcacactcgtctccaaaagtagagagctatatgcagatcgtgtttgtgatatcttctgcagctctaatgcttcctgttgtaacaagtttcttggtggcgccctcaggtgtaaaaggtggaagcatatcattttctggatgcattcagctaatgggtttctgcacatttgaagcgtgtgtaggaatcttctggccatctataatgaagatgagatcgcaatacattccagaggaagcaagaagcaccatcatgaattttttccgcatcccactcaacatctttgtctgccttgtgttgtacaatgttgatgcgtttccaatgactgtgatgtttgggatgtgctcggtattcctttttgtggcctctatattgcagaggaggttgatgaatgtagccgagatccacaggtcaagatcacaagagtggtcagcagcaaaggagatgacctcggaagctgaccctctaaacccataataaccgatattccatcaccgctcgatgacataaaaagagactaaaagccattgctcagacggcttcattctcttgatgaatttctacttctcttgatacgttggtccttaagtcataaaggctttccactcgaaccctaaacccataattcctttgttagttatatttggattttgtgctttcaccagatgtagccaacactcaaacctgtgcacatcaatcagcttatttgggctttttagccattattcttctttcaaccttttctgtgcctcgagaaacaatctttacaaagtcgatattggcttaaaaacacaga

SEQ ID NO: 9014 - DNA, 1943 bp, Spinacia oleracea
aaaaaatggagtggttcttctacctgttattcggatctctttctgcagtcgttgcggtaattgagctaagcaagaacaacaaagatcgtatcaatacttccactgctttcaattccttcaaaaacaattatgtcctcgtttattctctcatgatggctggcgactggttgcagggtccatatgtatactatctttatagtacttatggtttcgggaaaggggatattggacagctattcattgctggtttcggatcctctatgctatttgggacaatcgtcggatctctggctgacaaacagggccggaagagggcatgtgtgacttattgcattacctacattctgagttgcatcaccaaacattctcctcaatacaaagtccttatgctgggtcgaattctaggaggcatagccacatcacttcttttctctgcatttgagtcatggcttgttgcagagcacaacaagaggggctttgagcaacaatggctgtctgtaactttctcaaaagcaatttttcttgggaacggtctcgtcgctattctttctggattggtcggaaatttgctggtggatacattcgggtttgggcctgttgcacccttcgacgctgcagcatgtcttcttgctataggcatggccatcattttatcatcatggactgagaactatggagatccatcagagaataaggatttgcttgcacagttcaagggtgctgcaatagctattgcttcggatgaaaaaatagctttacttggagccatccagtcattgtttgagggttctatgtatacctttgtattcctctggacccctgcattgagcccaaacgatgaggaaattccacacgggtttatttttgcaacttttatgctggcttcaatgttgggaagctctattgcatctcggcttctagctcgttcatctcctagagttgagagctatatgcaaatagttttctccatatccgctgtctctctcttgctaccaattgtgacaaatttccttgtagagccctcaaaggtgaagggtggtggcatcagtttttcaggttgcatccaggttctcggcttctgtgcttttgaagcatgtgttggaattttctggccatctatcatgaagatgaggtcccagtatattccggaggaagctaggagtaccatcatgaacttcttccgcattcctcttaatatttttgtctgtgttgttctatacaatgtcaacgctttccccatcactgtcatgtttggcatgtgctcaatcttcctcttcgtagcctctatcttgcagagacgactcatggcgatttctgaaaaacctaaaacagaagcatatggactcaaggaaagagatactgaatccgagccaatgaacatctgagcacgagaaggaaaaagcgtgaaagatagatgaaaaacccatttaaaagcgtcatgaaaaagttgacacagctatatctcgctatcatattgattattaaaagggtgatcgttcttataagaattagttttgctgctccacgcgtgagtaagaatatatacagagatacaaggtacatcagcaactgtcagaagttcagaactcagaagcagtatgttagtatgtagtttaagttctggatagctgttcactaaatgcattaggaagcaattttttgaccatatgtacttaacctcccgttctcgcctactcaaactttaaagaaggagggggagtctgccgattttttccttctttttaggctccacattatatattatgcagttgtccaacagtttttcatacactatagttttctcctcccttaaaaattgcgttgattgtgtaagcaatttcttgcgcaaaacaatttgagcaagtgtttatgagattggtgtcacaaattatctgaaagcaattgagaagtttcatttctggtttatcttggagatttttctg

SEQ ID NO: 9015 - DNA, 1931 bp, Citrullus lanatus
accatttcaatctcactctgtaccagagggacgcccgttggagcttctctctctttctcgctttcttttcctatctctttctctcattgtgcttcaatggagattttctacttcttggtgtttggagcattgtctcttgttgttgcagctctcgagctcaccaaaaccaacaaggaccggatcaatacgccctccgctttcaatgccttcaagaacaattaccttctcgtttactctctcatgatggcgggggactggttgcagggcccatacgtatactacctttacagtcagtatggctttggtaaaggagagatcggtcagcttttcattgctggttttgggtcctccatgttgtttggtacaattgttggttctctagctgacaaacaaggtcgaaagagggcttgcattacttattgtattacatacattctgagttgcatcaccaagcattctcctgaatacaaggttctaatgttgggccgtgttttgggaggtattgccacttcgctcctcttttcagcatttgagtcatggcttgttgcagagcacaataagaggggctttgaacagcaatggttgtctatcacattctcaaaggctatatttcttggcaatggtcttgttgcaattcttgctgggttgtttggaaatgtattagttgatagtctgtctcttggaccagtggcaccttttgatgccgctgcatgctttcttgcaattggtatggccattattatgtcatcttggactgagaactatggggatccatcagagaataaggatctgcttacccaattcaggggggctgctgttgccattgcgtctgatgagaagattgcactgctgggtgctatccagtctctatttgaaggttcaatgtacacctttgtgttcctctggacaccagctcttagcccaaataatgaggatattccccatggctttatctttgcaacattcatgttggcttcaatgctcggaagttccctagcatctaggttgatggctcgaaattcaccaaaagttgagagctacatgcagattgttttcattgtctcttctgcctctcttgtacttccgattgtgaccagtttcttggtagctccatcagatgtgaaaggtggaagcatctccttcgcaggctgtattcagttgcttggcttctgtgtttttgaggcctgcgttggtatattttggccttccataatgaagatgagatcccagtacattcctgaggaggctagaagtaccatcatgaacttcttccgcattcctctcaacatcttcgtgtgtgtggtactttataatgtggacgctttccctatcactgtgatgtttggcatgtgcgccattttcctctttgtggcatcgattttacagaggcggcttcaggcaattgctgagaaaccaaagagtggagactggggattgagcgaaaagaactccgaggcagatccgttaaacatctaagcaatgtagaggacggacggaccacgggtacttattgggaggttagaacatgaacccttgattcatcttgtatacagcagcagcttcttgagtagctgatataatattttgaagaatgaaattgtacacgaatagtggtctgctcatccaaggaaagaagatgaaacaaaaaaaaaaaaagaaaaagaaaaaaagagtaaaggcttagtcgacaaattatgttttcatcaatttttgggcttcttcccaagtgtcattaaagtagagcttgtttagatatctcttcagcaattgttgtggggaattttctgagttcaaccctggattcatctgaacttgttaatcaaagattccatattttcgtgatgcattctttgtcaaattactattcccattctcattattatcattttgcctctaaaatctaactattgatagtgatttgtttgtggttg

SEQ ID NO: 9016 - DNA, 1891 bp, Citrullus lanatus
gctataaagacacaaccaatttcgagctctgaagcttttttctgatctctctccaacaatggaggtcttctactatttcgtttttgggggactgggtgccatagttgcagctatcgagctgactaaaaacaacagggacagaatcaacaccaccaccgctttcaattccttcaagaacaattaccttcttgtgtactctctcatgatggctggggattggttgcaggggccatatgtgtactatctttatagtcagtatggctatgggaaaggggagattggacagctttttattgctggttttggctcatctatgttgtttgggacaattgttggatcacttgctgacaaacagggtcgaaagagagcttgtgtgacgtattgtataacttatatactgagttgcatcacaaagcactcgccccaatataaagtcttaatgttgggccgtattttgggaggtattgccacttctctcctcttttcagcatttgagtcgtggcttgttgcagaacataataagaggggctttgagcaacaatggttgtcaataacattctccaaagcgatatttcttggcaatggtcttattgccattttatctgggctttttgggaacgtactagttgactccttggctcttgggccagtggcaccttttgatgctgctgcttgctttcttgcccttggtatggccataatcttatcatcatggacagagaattatggagatccatccgaaaacaaagacctcctcacgcaattcaggggggcagccgtggccattgcttctgatgaaaaaattgccctccttggtgctattcagtccctgtttgaaggttcaatgtatacctttgttttcctttggactcctgctcttagccccaataatgaggagattccccatggctttatctttgcgacgttcatgttagcttctatgttaggaagctccctagcttcaaggctactggcccgtgcatcgttaagggtggagaattatatgcagattgttttcattgtctcagctgcatctcttgttctcccaatagttacaagtttcttggtagcaccgtctcaagtaaaaggtggtagcatctctttttcaggctgcattcagttgattgggttctgtgtctttgaggcttgtgtgggtattttctggccatccattatgaaaatgagatcccagtacattcccgaagaggcgaggagcaccattatgaatttcttccgcattcctctcaatatctttgtgtgtgtcgtgctgtataacgttgatgcattcccaatcaccgttatgtttggtatgtgctcaattttcctatttgtggcatccatcctgcaaaggcgcctcatggtgatagcagacaagctaaagacagaaaccaggcctactttccgggaaaaggatgcagagatggagcctttgaatgcctagcttcacaagggcctgtctgtgccaaatgtggtgttcaggaattggaaattcactcattcttatacccaaaaagcggaaagtaattgtttgatttgatattttatatagtagtgaagattaaaaatgtataaagtggatggagatctcaaaattttcactcaattcatcagaaagaagaacagaggatggaggagaaaagctttgaatatatcatcacatggctgtttctattctttaagttatcagtagttgtattggatgatatcccccaaagaattatcttgagtggatatctgctttttgtagtgtaatttttattctttagcaatcaaggatcctatggctggtgatgctctcccggtgaaatctaggtgaaggtgctcaatttttttgccatggatattatgcattagtgcatcactttatatattatttaaattttgtaattta

SEQ ID NO: 9017 - DNA, 1895 bp, Daucus carota
gagagatggaggcattttactacctggtgttcgggttactgggagtgatagtagcagcaacggagctgagcaagagcaacaaagatcgaatcaccacttctcagccttttagcgctttcaaaaataattacctcgtggtgtactctcttatgatggcgggtgactggttgcagggaccatatgtgtactacctttacacaacctatggctatggtaagggagacattggacaactctttattgctggttttggatcttccatgttgttcggaacaattgttggatctctggcagataaaacgggtaggaaacgcgcatgcgtaacttactgcattacttacatactgagttgcttcactaaacactctcctcactataaagtcctcatgttgggtcgtattttgggtggtattgctacatcccttttgttttcgtcattcgagtcgtggcttgtggctgagcacaacaagagaaattttgatcagcaatggctctcactaacattttccaaggcagtatttcttggaaatggtcttgttgcaataatctctgggctattcggtaatatgcttgttgactccctaaatcttgggcctgtggcaccatttgatgctgctgcatgctttcttgccattggtatggccatcataatgtcatcctggtcggagaactatggagacccttcagaaagcaaggacttgcttactcagtttaaaggcgctgcagtggctatagcttcagatgagaagattgctttgttgggtgctatacagtcattgtttgaagggtctatgtatacctttgtgtttctctggactcctgctttgagtccaaatgacgaggatattccccatggtttcatttttgctactttcatgatggcgtcaatgctcggaagttcatttgcgtctcgcttgatggctcgctcatcaattaaagttgagggctatatgcagattgtatttgtggtttctgctgcctccctgttgcttcccatattgacatcgttgctggtatctccttctaatgtgaaaggtggaggtattaaatttgcaggttgtcttcagcttcttggcttctgtacctttgaggcttgtgtaggtatcttctggccgtctataatgaagatgaggtcccaatacatccctgaagaggctagaagcaccatcatgaatttcttccgcattcctctgaacatatttgtgtgcatcgttttgtataatgtcaatgcattccctatcactgttatgtttggcatgtgctccatctttcttttcgtggcagcactgttgcaaaggaggttgtcagttattgcagataagacgaagacagaagaatggtcacagttgagggagagggatgcagaggctgaacccctgaatgatgcttagtatcagaattttggtttaagcaatggaaaaattcaaaaagtggtgtagaactcaatctagttaactatatatcgagactagtggtgccaacaatttatagtagttttggcttctgggaagaagtggttatggagatgctattatccggctcttgggcataggttccagcagaaacatgtaacacgcacacttctactgctgggaagatttatcattcaactgtttgctactagtcttgttatcttcttttatatagttcaaagtttaagacaatagttctgtttgagattttgcaaattttctcatgttacacaagtgttaaatgacacaagcaattctttatacttttcaggtgtactacaaatatgaaagaaatgatatattatctcttttttcggttccttattttagttccacttaaaggaattcattagagatttgagtaatgcagattaatttgaatagtaccatcttcagctatcagccgattaaatttaaagaacc

SEQ ID NO: 9018 - DNA, 2598 bp, Glycine max
aagattgtccacaacatgtggatagcaggaaaaacgagtgtatagatcaacaactacccttcccttttcttctatcactcccatcactcttcttcttcttcttcacttgtacactcttcaaccactcaacaaagtggttggtttttggttcttaagccatggcatccacatcctctctgcatctatctcaggcccttctggcacgtgctgtgtaccttcatggctcttcttctgaccgtgtctcactctccttcccatcattctctggcctcaagtcacattctccatgcaaagcagcagccacgtcctcacgtagaaggggtgcttgcgcttccaccagcgttgttcgagccgctgcggttgagacactggaccagaccactgaggtttctctggtggagaaatccgtcaacaccattcggtttttggccattgatgctgttgagaaggccaactctggtcaccctggtctccccatggggtgtgctccaatgggtcacattctctacgatgaggtcatgaggtacaatcccaagaatcccacttggttcaaccgtgaccgtttcattctctctgctggacatggctgcatgctccaatatgctctccttcaccttgcaggctatgacagtgttctggaagaagacctgaaggaattccgacaatgggggagcaggactcctggacatcctgagaactttgagacagttggaattgaagtgactacaggtcctcttggtcagggcattgccaatgctgttgggttagcactagctgagaaacacttggctgcacgatttaacaagcctgacaatgagattgttgaccattacacatatgttatattgggtgatggttgtcaaatggagggaatttcaaatgaagcatgctcacttgccggtcactggggtctagggaagcttattgctttatatgatgacaaccacatttccattgatggggacactgagattgcattcactgagaatgttgatcaacgttttgaggcacttgggtggcatgtaatttgggtgaagaatggaaatactggatatgatgaaattcgtgcagccattaaggaagcaaaggctgtcaaagacaaacccactatgatcaaggtaaccactaccattggatttggttctccaaacaaggctaactcctacagtgttcatggaagtgcattaggtactaaagaagtggatgctacaaggaagaatcttggatggccatacgagcctttccatgtgccagaagatgttaaaaagcattggagtcgccatacccctgagggtgctaaacttgaagctgagtggaatgccaagtttgcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcagatcttgcctcttccaacatgaccttgttgaaatcatacggagatttccaaaagaatactcccgaagagcgcaatgttagatttggtgttagagaacatggaatgggagcaatctgtaatggtattgctcttcatagccccggattcattccatactgtgcaactttctttgtcttcactgactacatgagagctgccataaggatttctgcactgtgtgaagctggagttatttatgtgatgactcatgattcgattggacttggagaggatggaccaactcatcagccaatagagcacttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacattatttcagacaactcgtcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaagagagtgttctccctgcttcggtaacagttagagttagcattgaggcaggatcaacatttggttggcaaaagattgttggaagccaaggaaaggccataggcattgatcgatttggagcaagtgctccagcaggaaaaatatacaaggagtttggtatcaccaaggaagctgttattgctgctgccaaagaactttcgtagatctatttgttgactttcttttaagttttatctcatctagaacttgtggttttcactggtggctttgggttactattacattatttgttttttgagatatcacttttagccacaataaagaagatcagattgttcttgcatattatagtcagaggagccacttacattaaaggatgagttgaattaatgaagttgtatgaatttgtaacaactattt

SEQ ID NO: 9019 - DNA, 2772 bp, Glycine max
aggcagataagtaagaagaagatagccagaagcataggctaagattgtccacaacatgtggatagcaggaaaaacgagtgtatagatcaacaactacccttcccttttcttctatcactcccatcactcttcttcttcttcttcacttgtacactcttcaaccactcaacaaagtggttggtttttggttcttaagccatggcatccacatcctctctgcatctatctcaggcccttctggcacgtgctgtgtaccttcatggctcttcttctgaccgtgtctcactctccttcccatcattctctggcctcaagtcacattctccatgcaaagcagcagccacgtcctcacgtagaaggggtgcttgcgcttccaccagcgttgttcgagccgctgcggttgagacactggaccagaccactgaggtttctctggtggagaaatccgtcaacaccattcggtttttggccattgatgctgttgagaaggccaactctggtcaccctggtctccccatggggtgtgctccaatgggtcacattctctacgatgaggtcatgaggtacaatcccaagaatcccacttggttcaaccgtgaccgtttcattctctctgctggacatggctgcatgctccaatatgctctccttcaccttgcaggctatgacagtgttctggaagaagacctgaaggaattccgacaatgggggagcaggactcctggacatcctgagaactttgagacagttggaattgaagtgactacaggtcctcttggtcagggcattgccaatgctgttgggttagcactagctgagaaacacttggctgcacgatttaacaagcctgacaatgagattgttgaccattacacatatgttatattgggtgatggttgtcaaatggagggaatttcaaatgaagcatgctcacttgccggtcactggggtctagggaagcttattgctttatatgatgacaaccacatttccattgatggggacactgagattgcattcactgagaatgttgatcaacgttttgaggcacttgggtggcatgtaatttgggtgaagaatggaaatactggatatgatgaaattcgtgcagccattaaggaagcaaaggctgtcaaagacaaacccactatgatcaaggtaaccactaccattggatttggttctccaaacaaggctaactcctacagtgttcatggaagtgcattaggtactaaagaagtggatgctacaaggaagaatcttggatggccatacgagcctttccatgtgccagaagatgttaaaaagcattggagtcgccatacccctgagggtgctaaacttgaagctgagtggaatgccaagtttgcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcagatcttgcctcttccaacatgaccttgttgaaatcatacggagatttccaaaagaatactcccgaagagcgcaatgttagatttggtgttagagaacatggaatgggagcaatctgtaatggtattgctcttcatagccccggattcattccatactgtgcaactttctttgtcttcactgactacatgagagctgccataaggatttctgcactgtgtgaagctggagttatttatgtgatgactcatgattcgattggacttggagaggatggaccaactcatcagccaatagagcacttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacattatttcagacaactcgtcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaagagagtgttctccctgcttcggtaacagttagagttagcattgaggcaggatcaacatttggttggcaaaagattgttggaagccaaggaaaggccataggcattgatcgatttggagcaagtgctccagcaggaaaaatatacaaggagtttggtatcaccaaggaagctgttattgctgctgccaaagaactttcgtagatctatttgttgactttcttttaagttttatctcatctagaacttgtggttttcactggtggctttgggttactattacattatttgttttttgagatatcacttttagccacaataaagaagatcagattgttcttgcatattatagtcagaggagccacttacattaaaggatgagttgaattaatgaagttgtatgaatttgtaacaactatttggcttgtgagtttttctctgtgtagttgaattagtgatgctcactctagcactcaattttgggcagatatggcttctaggaagaattatatccttctcttttttttcttaaaaaaataaaaaaccattactaaa

SEQ ID NO: 9020 - DNA, 2552 bp, Glycine max
atcagtccaaacactcttcttcttcttcttcttcttcttcactctacaaccactaaactaagtggttggttttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagcagccacgtcctcgcgtagaaggggtgcttgtccatccaccaacgttgttcgagccgctgcggttgagacactcgaccaaaccaccgaggtttctctggtggagaaatccgtcaacaccattcggtttttggccattgatgcagttgagaaggccaactctggtcaccctggtctccccatggggtgtgctccaatgggtcacattctctacgatgagataatgaggtacaatcctaagaaccccgcttggttcaaccgtgaccgtttcgttctctctgctggacatggctgcatgctccaatatgctctccttcaccttgctggctatgacactgttcaggaacaagaccttaaggaattccgacaatggggaagcagaactcctggacatcctgagaactttgagacccttggagttgaagtgaccacaggtcctcttggtcagggcattgccaatgctgttggattagcactagctgagaagcacttggctgcacgatttaacaagcctgacaatgagattgttgaccattacacatatgttatattgggtgatggttgtcaaatggagggaatttcaaatgaagcatgctcacttgccggtcactggggtctaggaaagctcattgctttatatgatgacaatcacatttccattgatggtgacactgagattgcattcactgagaatgttgatcagcgttttgaagcacttggatggcatgtaatttgggtgaagaatggaaatactggatatgatgaaattcgtgcagccattaaagaagcaaaggctgtcaaagacaaacccactttgatcaaggtaaccactaccattggatttggttctccaaacaaggctaattcctacagtgttcatgggagtgcattaggtgctaaagaagtggatgctacaaggaagaatcttggatggccatacgagcctttccatgtgccagaagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaaagcacttccgacatacacaccagaaagccctgctgatgctacaagaaatctgtctcagcaaaatctaaatgcccttgttaaggttcttcctggtctacttggtggtagtgcagatcttgcctcttccaacatgaccttattgaaatcgtatggggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagctgccataaggatttctgcactgtgtgaagctggagttatttatgtgatgactcatgattcgattggacttggagaggatggaccaactcatcagccaatagagcatttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacaccatttcagacaactcatcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaggagagtgttctacctgcttcagtaacagctagagttagcattgaggcaggatcaacatttggttggcacaagattgttggaagcaaaggaaaggccataggcattgatcgatttggagcaagtgctccagctggaaaaatatacaaggagtttggtatcaccaaggaagctgttattgctgctgccaaagaactttcgtagatatatttgttgagtttcttttatctcatctagaacttgtggttttcacttgtggctttgggttactgttacatgacttgttttttgagatatcactttagccacaataaggaagattagattgttcttgcatatgattgtcagaggaaccacttacattgaaggatgagttgaattaatgaagttgtatgaatttgtaacaac

SEQ ID NO: 9021 - DNA, 2799 bp, Glycine max
aaaaaagatgaggcagagaagtaagaagaagatagccagaagtataggctaagattgtccacaacatgtggacagcaggaacaacgagtgtatagatcaacaactacctttcccttttcgtctatcagtccaaacactcttcttcttcttcttcttcttcactctacaaccactaaactaagtggttggttttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagcagccacgtcctcgcgtagaaggggtgcttgtccatccaccaacgttgttcgagccgctgcggttgagacactcgaccaaaccaccgaggtttctctggtggagaaatccgtcaacaccattcggtttttggccattgatgcagttgagaaggccaactctggtcaccctggtctccccatggggtgtgctccaatgggtcacattctctacgatgagataatgaggtacaatcctaagaaccccgcttggttcaaccgtgaccgtttcgttctctctgctggacatggctgcatgctccaatatgctctccttcaccttgctggctatgacactgttcaggaacaagaccttaaggaattccgacaatggggaagcagaactcctggacatcctgagaactttgagacccttggagttgaagtgaccacaggtcctcttggtcagggcattgccaatgctgttggattagcactagctgagaagcacttggctgcacgatttaacaagcctgacaatgagattgttgaccattacacatatgttatattgggtgatggttgtcaaatggagggaatttcaaatgaagcatgctcacttgccggtcactggggtctaggaaagctcattgctttatatgatgacaatcacatttccattgatggtgacactgagattgcattcactgagaatgttgatcagcgttttgaagcacttggatggcatgtaatttgggtgaagaatggaaatactggatatgatgaaattcgtgcagccattaaagaagcaaaggctgtcaaagacaaacccactttgatcaaggtaaccactaccattggatttggttctccaaacaaggctaattcctacagtgttcatgggagtgcattaggtgctaaagaagtggatgctacaaggaagaatcttggatggccatacgagcctttccatgtgccagaagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaaagcacttccgacatacacaccagaaagccctgctgatgctacaagaaatctgtctcagcaaaatctaaatgcccttgttaaggttcttcctggtctacttggtggtagtgcagatcttgcctcttccaacatgaccttattgaaatcgtatggggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagctgccataaggatttctgcactgtgtgaagctggagttatttatgtgatgactcatgattcgattggacttggagaggatggaccaactcatcagccaatagagcatttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacaccatttcagacaactcatcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaggagagtgttctacctgcttcagtaacagctagagttagcattgaggcaggatcaacatttggttggcacaagattgttggaagcaaaggaaaggccataggcattgatcgatttggagcaagtgctccagctggaaaaatatacaaggagtttggtatcaccaaggaagctgttattgctgctgccaaagaactttcgtagatatatttgttgagtttcttttatctcatctagaacttgtggttttcacttgtggctttgggttactgttacatgacttgttttttgagatatcactttagccacaataaggaagattagattgttcttgcatatgattgtcagaggaaccacttacattgaaggatgagttgaattaatgaagttgtatgaatttgtaacaactatttggcttgctctgtggtgtagttgaattagtgatgctcactctagcactcaattctggacagatatggcttctaggaagaattatatccttctctatttttttttcttaaaaataaaaaataaa

SEQ ID NO: 9022 - DNA, 2810 bp, Cajanus cajan
atcatatatactttttttttttatctttgaaaatatgaggaagagattgagaggcagagaagtgagaaggagatagccagaagcataggctaagattgattgtccacaacatgtggaccgcaagaacaacgaatgtttagatcatcaactaccctttttcctctctcactctcaccaacacaaccaacactcttcttcttcacttcaaccaccctcacaagtggttgctttggcttttgctttggtttcacttaacttgagtcatggcatcctcttcctctcttcatctttctcaggccctcttggcccgtgctgtgtaccttcatggcttcaactcttcatcttctgatcgtgtctcactcaccttcccatcattctctggcctcaagtcacattctccatgcaaagcagccacgtccacttcagcttcacgtagaaggggtggtgctatatccaccaccactgttcgtgccactgctgttgagacacttgaccagaccactgaggtttcactggtggagaaatccatcaacactattcggtttctggccattgatgctgttgagaaggccaactctggccaccctggcctccccatggggtgtgctccaatgggtcacattctctatgatgaggtcatgaggtacaatcctaagaaccccacttggtttaaccgtgaccgttttgttttgtctgctggacatggttgcatgctccaatatgctctccttcaccttgcaggatatgacagtgttcaggaagaagacctgaagaattttagacaatgggggagtaggactcctggacatcctgagaactttgagacggttggagttgaagtgaccacaggtcctctgggtcagggaattgccaatgctgttggattagcacttgctgagaaacacttggctgcacgatttaacaagccagacaatgagattgttgaccattacacatatgttatattgggcgatggttgtcaaatggagggaatttcaaatgaagcgtgctcacttgccggtcactggggtctagggaagcttattgctctatatgatgacaaccacatttccattgatggtgacactgagattgcattcactgagaatgttgatcaacgttttgaggcactaggatggcatgtaatttgggtgaagaatggaaatacggggtatgatgagattcgtgcagccattaaggaagcaaaggctgtcaaagacaaacccactttgatcaaggtaaccactaccattggatttggttctccaaacaaggctaactcctacagtgttcatggaagtgcattaggtgctaaagaagtggatgctacaaggaagaatcttggatggccatacgagcctttccatgtgccagaagatgttaaaaagcattggagtcgccatgctcctgatggtgctaaacttgaagctgaatggaatgccaagttttctgaatatgaaaagaaatacagtgaggaagctgcagagctgaaggctattatcactggtgaattaccagctggctgggaaaaagcactcccgacttacacaccagaaagccctgctgatgctacgagaaatctgtctcagcaaaatctaaatgcccttgttaaggttcttcctggtctgcttggtggtagtgcagatcttgcatcttccaacatgaccttgttgaaatcatacggagatttccaaaaggctactccagaagagcgcaatgttagattcggtgttagagaacacggaatgggagcaatctgtaatggtattgctcttcacagccccggattcattccatactgtgcaactttctttgtcttcaccgactacatgagagctgccataaggatttctgcactatgtgaagctggagttatttatgtgatgactcatgattcaattggacttggagaggatggaccaactcatcagccaatagagcacttggcaagcttcagggcaatgccaaatgttttgatgcttcgtccagctgatggtaatgaaactgctggatcgtacaaagttgctgtgcttaacaagaagagaccctcaattcttgcactttctaggcaaaagttgccccaacttccgggaacttctattgagggagttgaaaagggtggctacatcatttcagacaactcatcaggcaacaagcctgatattatcttgattggaactggttctgagttggaaattgctgctgctgctgctgaggatctaaggaaggaaggaaaagctgttagagttgtttcttttgttagctgggaactttttgaggagcagtcagatgaatacaaggagagtattctccctgcttctgtatcagctagagttagcattgaggcaggatcaacattcggttggcacaagattgttgggagcaaaggaaaagccataggcattgatcgatttggagcaagtgctccagcaggaaaaatatacaaggagtttggtatcaccaaggaagctgttatcgctgctgccaaagaagtttcgtagatctatttgttgagtttcttttatctcatctgaacttgtggttttcactggtggctttgggtaattacatgattttgttttttgagatatcactttagccacaataagaaagattagattgctattgcatatgattgtcagaggagccacttacattaaaggatgagttgaattaatgaagttgtatgaatttgtgacagctattttggcttgttagttttgctgtgatgtagttttaattagcaatcctcactttagcactcaagtctgatcagatacggcttctaggaagaattatatcgttctcta

SEQ ID NO: 9023 - DNA, 2746 bp, Lotus japonicus
cagatacagataatatcaatagctaccaactaactaccactataccactatcactgtggtgtgtcttcttcttcatcttcatcttctgaatccacttcttcactaacaaactatggcttcttcttcttcccttcacttatcacaagcacttgctgtgaatcttcacggtggcttcaactcttcttcttcttcctctgatcgtgttgcactctccaattctttccctgcattctctggtttgaaatcgcattcttcatgcaaacatgctgctaccccttcacgcagaagggttggtggaactaccacctccaccatggttcgtgccactgctgttgagacacttgacaagaccgctgaggtttctctggtggagaaatctgttaacaccattcggtttctctccattgatgctgttgagaaggccaattccggtcacccgggtttacctatgggttgtgctccgatgggtcatattctctatgatgagatcatgaggtacaatcctaagaacccttcttggttcaaccgtgacaggtttgttctctctgctggccatggatgcatgctccagtatgctctgcttcaccttgctggatatgacagtgtcaaggaagaggacttgaaggaattccgtcagtggggaagcaaaactcctgggcatcctgagaattttgagacatatggaattgaagtgaccacaggtcctctgggtcagggcattgccaacggcgttggattggcacttgctgagaagcacttggctgcacgatttaacaagcctgacagtgagattgttgaccattacacgtatgttatattgggtgatggttgtcaaatggagggaatatcgaatgaagcatgctcacttgctggccactggggtctagggaagcttattgctttatatgatgacaaccacatttccattgatggtgacactgaaattgcattcactgagaatgttgataaacgttttgaggcacttgggtggcatgtaatttgggtaaagaatggaaatactgggtacgatgagattcgtgcagccattaaggaagcaaaggctgtcaaagacaaacctaccctgatcaaggtaaccactaccattggatttggttctccaaacaaggctaattcatacagtgttcatggaagtgcattgggtgctaaagaagtggatgctactaggaagaatcttggatggccacatgaacctttccatgtgccagaagaagttaaaaagcattggagtcgccatgtccctgagggtgctgcacttgaagctgagtggaatgctaagtttgctgaatatgagaagaaatacaaggaggatgctgaagagctaaaatctattattactggtgtattacctgctggttgggagaaagcactcccgacatacactccagaaaaccctggtgatgctacaagaaatctgtctcagcaaaatctaaatgcccttgctaaggttctccctggtctgattggtggcagtgcagatcttgcttcttccaacatgacttgttgaaaagttatggagatttccaaaaggataccccagaagagcgcaatgttcgatttggtgttagagagcacggaatgggagcaatctgcaatggtattgctcttcacagccctggattcattccatattgtgcaactttctttgtcttcactgactacatgagagccgccataaggatttcggcgctgtccgaagctggagttatctatgttatgactcatgattcaattggacttggagaggatggaccaactcatcagccaatagagcacttggcaagcttccgggcaatgccgaatgttttgatgcttcgtccggctgatggtaatgaaactgccggatcatacaaagttgccgtgcttaacaagaagagaccctcaatccttgccctttctcggcaaaagttaccccagcttccgggaacttctattgaaggagttgaaaagggtggctacatcatttcagacaactcatcaggtaacaagcctgatgtgatcttgctgagcactggttctgagttggaaattgccgccgctgctggtgaggatctaaggaaggaaggaaaaactgttagagttgtttcttttgttagctgggaactttttgatgaccagtcagatgaatacaaggagagtgttctccctgctgctgtgacagctagagttagcattgaggcagcatcaacctttggttggcataagcttgttggaagcaaaggaaaagccataggcattgatcgattcggagcaagtgctccagcaggaaaaatatataaggagttcggtatcaccaaggaagctgttattgctgctgccaaagaagtttcttagatctattgaggttctattttttttttctttctttctttttcatgcaaaacttgtgggtttcaaaggtggctttgcgttactattacaagaatggtttcttgagatgccattgtagccacaataaggacggttagattgctcttgcatgtgattctcagagtagcaacatcgtgtaaaggatgagatgaactaatgaagttgaatgaatttgtaacaactactttggcatgtgagtttgcaccttgatgtagttgaattcaatgatcctcactccagcactgattttaagtccaatcaattatggcttctttgaagaattatatccttctccaattcttttttctttctttttctttccaaaggatctggtgtaattaaaatcattgctatattg

SEQ ID NO: 9024 - DNA, 2812 bp, Cicer arietinum
gcaagttagtactaaattttaggagaacagaaaagaagaagaagattcgaatatcctaatatatatattattatcgtaaaagaaaaaatgtatataaaatagtagtagatgatgaaatggattgagaggtagataagtaggaagcagatagcaatagcaagaagcataggctgagattttccacagcctctacaccgcacgactaacatcattctaatttctttctctatattctattctatcttttcatatatctcaacacacttcttattcttcactcttcactactatggcttcctctttgcatctttctcaagccttactggcacgtgccgtttacctcaactcagatcgtggatcactctcctcttcctcttcctcttccacttcaactctctctttcccttctcttaaatcttcttcatgcaaaccggctacctattcacccggttcccgtcgcagaacaactaccgtccgtgcaactgccgttgagacacttgataagacagcggaactttctctcgttgagaaatccgttaacacgattcgcttccttgctattgatgctgttgaaaaagctaattcgggtcacccgggtttacccatgggttgtgctccaatgggtcatattttatatgatgaaattatgagatataatcctaaaaatccttcttggtttaatcgtgaccgttttgttttgtctgctggacatggttgtatgcttcagtatgctcttcttcatcttgctggttatgacagtgtcaaggaagaagacttgaaggaatttcgacaatggggaagcaaaactcctggacatcctgagaattttgagacatatggaattgaagtcaccacaggtcctctgggtcagggtattgccaatggtgttggattggcacttgctgagaagcacttggctgcacgatttaacaagcctgacagtgagatcgttgaccattacacgtatgttatattgggtgatggttgtcaaatggaagggatttcaaatgaagcatgctcacttgctgggcattggggtctagggaagcttattgccttctatgacgacaaccacatttccattgacggtgacactgaaattgcattcaccgaggatgttgataaacgttttgaggcacttggatggcatgttatttgggtgaaaaatggaaatactgggtatgatgaaattcgcgcagccattaaggaagcaaagactgtcactgacaaacctactttgattaaggtaaccaccaccattggatttggttctccaaacaaggctaattcctacagtgttcatggagccgcattgggtgctaaagaagtggacgctacaaggcagaatcttggatggccatatgagcctttccatgtgccagaagatgttaaaaagcattggagtcggcatacccctgagggtgctgcacttgaagctgagtggaatgctaagtttgctgagtatgagaagaaatacgcagaggaagcagcagagctaaaggctattattactcgcgaattacccgctggttgggagaaagcacttccgacgtacactccagaaacccctgctgatgctacaagaaatctgtctcagcaaaatctaaatgcccttgctaaggttcttcctggtctccttggtggcagtgcagatcttgcctcttccaacatgaccttgttgaaaagttttggagatttccagaagggtactccagaagagcgcaatgttcggtttggtgttagggaacatgcgatgggagcgatctgtaatggtattgctcttcatagccctgggttcattccgtattgtgcaactttctttgtcttcactgactacatgagagctgccataaggatttctgccttgtgtgaagccggggttatttatgttatgactcatgattcaattggacttggagaggatgggccaactcatcagccaatagagcacctggcaagcttccgggcaatgccaaatgttttgatgcttcgtcctgctgatggtaatgaaactgctggagcatacagagttgctgtgcttaaccaaaagagaccctcaattcttgccctttctcggcaaaagttgcccaaccttccaggaacttctattgaaggagttgaaaagggtggctacatcatttcagacaactcatcaggtaacaagcctgatgttatcttgattggaactggttctgagttggaaattgctgccgctgctgctgatgatctaaggaaagaaggaaaagctgtaagagttgtttcttttgtgagctgggaactttttgatgaccagtcagatgaatacaaggaaagtgttctcccttcttctgtaacagctagagtcagcattgaggcaggatcaacatttggttggcataagattgttggaagcaagggaaaaaccataggcattgatcgatttggagcaagtgctccagcaggaaaaatatacaaggagtttggcataaccaaggaagctgttatttctgctgccaaagaagtttcatagatctgtcaaggtaaaagactggagtcttcattctctcaattactgactcaatggtcttcatcattggaggattttctgataagtcagactcatttttcattggttctgtctcattctcacactgaccaccagaaaaccactccccacccctgtagcagaaacaaggaggattgattatgtagagttcaaagtaattattaaacaaattaaatgctttttttacctgaaatgagaaggggaatagcccctgaagaaaactatagttttcttaggattaatattagtatccacccaatgtgacca

SEQ ID NO: 9025 - DNA, 2819 bp, Cicer arietinum
gggctacctccctgtgtcgtcctgagagacgaccgaccacacctacgtatgaaaatgggatttgagaggtagataagtaggaagcagatagcaatagcaagaagcataggctgagattttccacagcctctacaccgcacgactaacatcattctaatttctttctctatattctattctatcttttcatatatctcaacacacttcttattcttcactcttcactactatggcttcctctttgcatctttctcaagccttactggcacgtgccgtttacctcaactcagatcgtggatcactctcctcttcctcttcctcttccacttcaactctctctttcccttctcttaaatcttcttcatgcaaaccggctacctattcacccggttcccgtcgcagaacaactaccgtccgtgcaactgccgttgagacacttgataagacagcggaactttctctcgttgagaaatccgttaacacgattcgcttccttgctattgatgctgttgaaaaagctaattcgggtcacccgggtttacccatgggttgtgctccaatgggtcatattttatatgatgaaattatgagatataatcctaaaaatccttcttggtttaatcgtgaccgttttgttttgtctgctggacatggttgtatgcttcagtatgctcttcttcatcttgctggttatgacagtgtcaaggaagaagacttgaaggaatttcgacaatggggaagcaaaactcctggacatcctgagaattttgagacatatggaattgaagtcaccacaggtcctctgggtcagggtattgccaatggtgttggattggcacttgctgagaagcacttggctgcacgatttaacaagcctgacagtgagatcgttgaccattacacgtatgttatattgggtgatggttgtcaaatggaagggatttcaaatgaagcatgctcacttgctgggcattggggtctagggaagcttattgccttctatgacgacaaccacatttccattgacggtgacactgaaattgcattcaccgaggatgttgataaacgttttgaggcacttggatggcatgttatttgggtgaaaaatggaaatactgggtatgatgaaattcgcgcagccattaaggaagcaaagactgtcactgacaaacctactttgattaaggtaaccaccaccattggatttggttctccaaacaaggctaattcctacagtgttcatggagccgcattgggtgctaaagaagtggacgctacaaggcagaatcttggatggccatatgagcctttccatgtgccagaagatgttaaaaagcattggagtcggcatacccctgagggtgctgcacttgaagctgagtggaatgctaagtttgctgagtatgagaagaaatacgcagaggaagcagcagagctaaaggctattattactcgcgaattacccgctggttgggagaaagcacttccgacgtacactccagaaacccctgctgatgctacaagaaatctgtctcagcaaaatctaaatgcccttgctaaggttcttcctggtctccttggtggcagtgcagatcttgcctcttccaacatgaccttgttgaaaagttttggagatttccagaagggtactccagaagagcgcaatgttcggtttggtgttagggaacatgcgatgggagcgatctgtaatggtattgctcttcatagccctgggttcattccgtattgtgcaactttctttgtcttcactgactacatgagagctgccataaggatttctgccttgtgtgaagccggggttatttatgttatgactcatgattcaattggacttggagaggatgggccaactcatcagccaatagagcacctggcaagcttccgggcaatgccaaatgttttgatgcttcgtcctgctgatggtaatgaaactgctggagcatacagagttgctgtgcttaaccaaaagagaccctcaattcttgccctttctcggcaaaagttgcccaaccttccaggaacttctattgaaggagttgaaaagggtggctacatcatttcagacaactcatcaggtaacaagcctgatgttatcttgattggaactggttctgagttggaaattgctgccgctgctgctgatgatctaaggaaagaaggaaaagctgtaagagttgtttcttttgtgagctgggaactttttgatgaccagtcagatgaatacaaggaaagtgttctcccttcttctgtaacagctagagtcagcattgaggcaggatcaacatttggttggcataagattgttggaagcaagggaaaaaccataggcattgatcgatttggagcaagtgctccagcaggaaaaatatacaaggagtttggcataaccaaggaagctgttatttctgctgccaaagaagtttcatagatctgtcaaggttctgtttctttctttttttaatccagaacttgtgggtttcattggtgtctttgtattactattacgagagttgtttcttgagatatcattttagcagcgataaggacgaatagattgctctagcatatgattctcagaggagcaacatagattattaaatgatgagatgaattaatgcgaagttgtatgaatttatgacaattattttgccttgtgaattacacactgtgatgtagttgaattcagtgattctcactctaccacagttctaaaagtgctctgacttggctactgataggaaacattatatctttctctaattcccagtcgtgggaggcaaggcacacagggatagggg

SEQ ID NO: 9026 - DNA, 2881 bp, Lupinus angustifolius
gaggtagataagtcataaagctagccagaatcacaggctgagattttccacaagctatgatctcctcaatatcaatctatacatcactcatttcatttttctcttctctttctctcatataactcacacaacaacataaactgttgttgtttttattgttgtgagttgttctttcacttcaacaaaaactcatggcttcttcttcatctctctatctatctcaagcccttttagcacgtgctgtgcatggcttaaacccttcttcagaccgtgtttcactctccacttccactctataccttccatcattctctggtctaaggtcacattcttcttccacttcctcatcatgcaaggcacctacctctacttcctcaagtagaagggttagttctagttctagttctagtgttagagctactgctattgagacactagacaaaaccactgatgtaactcttgtagagaaatctatcaacaccattaggttcctttccattgatgcagttgagaaagctaactctggtcaccctggtcttcctatgggttgtgctcctatgggtcatatattatatgatgaggttatgaggtataatcctaagaatcatacatggtttaaccgtgaccgctttattttgtctgctggacatggctgcatgcttcaatatgctcttctgcatcttgctggatatgatagtgttctggaagaagacttgaagagtttcagacaatggggaagcagaactcctggacatcctgagaactttgagacacttggaattgaagttaccacaggccctcttggtcagggcattgccaatgctgttggattggcactcgctgagaagcacttggctgcgcgatttaacaagcctgatagcgagatcgttgaccattatacgtatgttatattgggtgatggttgtcaaatggagggaatttctaatgaagcggcctcgcttgctggccattggggtctagggaaacttattgctttctatgatgacaaccacatttccattgatggtgacactgaaatcgcattcactgaaagtgtcgataaacgttttgagggacttgggtggcatgtgatttgggtaaagaatggaaatactggctatgatgaaattcgtgcagccattaaggaagcaaagactgtcacagacaagcccactttgatcaaggtaaccactaccattggatatggttctccaaacaagtctaattcctacagtgttcatggaagtgcattaggtgctaaagaagtggatgctacaaggaagaatcttgcatggccatatgagcctttccatgtgcctgaagatgttaaaaagcattggagtcgccacacccccgagggtgctgcgcttgaagctgagtggaacgctaagtttgctgaatatgagaagaaatacaaggaggaagcttcggagctaaagtatattattagtggtgaattccctgctggttgggagaaagcgcttccgacatacactccagagaatcctgctgatgctacaagaaatctgtctcagcaaaatctgaattcccttgttaaggttcttcctggtctgattggtggcagtgcagatcttgcctcttccaacatgaccttgttgaaatcatttggtgatttccaaaaggatactccggaagagcgcaacatcaggtttggtgtacgagaacacggaatgggagcaatttgcaacggtatcgctcttcacagccctggattcattccatactgtgcaactttctttgttttcaccgactacatgagagctgccataaggatttctgccctgtctgaagctggagttatttacgtgatgactcatgattcaattggacttggcgaggacgggccgactcatcagcctatagagcacttggcaagcttccgagcaatgccaaatattcttatgcttcgtccggctgatggtaatgaaactgctggatcatacaaggttgctgtggttaacaggaagagaccctcaattatcgcactttcgaggcaaaagttgcctaacctctcaggaacttctattgagggagttgaaaagggtggctacaccatatctgacaactcatcaggtaacaagcctgatgttattttgatcggaactggttccgagttggaaattgctgccgccgctgctgaggatctaaggaaggaagggaaagctgttagagttgtatcttttgttagctgggaactttttgatgaccaatcagatgaatacaaggagagtgttctccctgctgctgtaacagctagagttagtatcgaggccgcaacaacatttggttgggaaaagattgtcggaagtaagggaaaagctatcggcattgatcgattcggagccagtgctccagcagggaaaatatacaaggagtttggtatcaccaaggaagctgttattgctgctgctaaagaactttcctagatctgttgcttcatgaatcaccttagtcacaataaggaagattagattggtcttgcatatgataatcagaggagaaacataaactaaaggatgagttgaattgaagaagttttatgaatttgtaacaactattttggctggtgaattttgcactgtgatgtagttgaattcagtgatcctcactctatcacttatttaaatatggcttctttggagaattatatccttctctaatgctttttttccttcaaggatctagtttaaaatcattagtacattgttttgagttaaagaataagaataatatgtaatagtattcgtaagagtcaagtattattctacaaattgtacagacaaatataaaatgaagcatatggtggtgaacatttcaatagttgataaaaagaataactatatccacacacatcactata

SEQ ID NO: 9027 - DNA, 2909 bp, Lupinus angustifolius
atagttggttggcagtgattgagagatagataagtaagaagcagctagccataaacacaggctgagattgagattttccacaacctgtggacctaaacattcatcaatctatacatcactcatcatctcttttttcctctcataactcacacaaactcttattcttcactacaccaagtgaagaattattcatggcttcttcttcctctcttcatctatctcaagctcttttagcacgtgctgtgcatggctgcttcaacccttcttcagaccgtctttcactctctacttccactctctcccttccaccattttctactctcaggtcacattcttcttccacttcttcaccatgcaagacatatagctccaactcctcacgtagaagggttggttctgttagagccagtgctgttgagacattggacaagaccactgaagtttctctagttgagaaatccatcaacactattaggttcctttctattgatgcagttgagaaggctaactcaggtcaccctggtcttccaatgggttgtgctccaatgggtcatatactctatgatgagatcatgaggtataatcctaaaaacccaacttggttcaaccgtgaccgattcgttttgtctgctggacatggctgcatgctccagtatgctcttcttcaccttgctggttatgacagtgttctggaggaggatttgaagagtttcagacaatggggtagcagaactcctggacatcctgagaactttgagacaattggaattgaagttaccacaggccctctgggtcaggggattgcaaatgctgttggattggcacttgctgagaagcacttggctgcgcgatttaacaagcctgatagcgagattgttgaccattacacgtatgttatattgggtgatggttgtcaaatggagggaatttctaatgaagcagcctcacttgctggccactggggtctaggaaagcttattgctttctatgatgacaaccacatttccattgatggtgacactgaaattgcattcactgagagtgttgataaacgtttcgagggacttggatggcatgtaatttgggtaaagaatggaaatacgggctacgatgaaattcgtgcagccattaaggaagcaaagactgtcaaagacaaaccaactttgatcaaggtaaccactaccatcggatacggttctccaaacaagtctaactcctacagtgttcacggaagtgcattgggtgctaaagaagtggatgctacaaggaaaaatcttggatggccatatgagccattccatgttcctgaagatgttaaaaagcattggagtcgccacacccctgagggcgctgcagttgaagctgaatggaatgctaagtttgctgaatatgaaaagaaatacaaggaggaagctacagagctaaagtatattatcagtggtgaattccctgctggttgggagaaagcacttccgacatacactccagagatccctgctgatgctacaagaaatctgtctcagcaaaatctgaatgcccttgttaaggttcttcctggtctgattggtggcagtgcagatcttgcctcttccaacatgaccctattgaaatcctttggtgatttccaaaaggatactcctgaagagcgcaatattagatttggtgttagagaacacggaatgggagcaatttgcaatggtattgctcttcacagccctggattcattccgtactgtgcaactttctttgtcttcactgactacatgagagctgccataaggatttctgccctgtccgaagctagagttatttatgttatgactcatgactcgattggacttggtgaggatggcccgactcatcagccgatagagcatttatcaagcttccgagcaatgccaaatattctgatgctacgtccagctgatggtaatgaaactgctggatcatacaaagttgccgtggttaacaggaagaggccctcgattattgcactctcaaggcaaaagttgcctaacctcgcaggaacttctattgagggagttgagaagggtggctacaccatatcagacaactcatcaggtaacaagcctgatgttattttgattggaactggttctgagttggaaattgctgccgctgctgccgaggatctaaggaaggaagggaaagctgttagagttgtttcttttgttagctgggaactttttgatgaccaatcagatgagtacaaggaaagtgttctccctgctgctgtaacagctagagttagcattgaggcagcaacaacattcggttggggaaagattgttggaagcaagggaaaagccatcggcattgatcgatttggagcaagtgctccagcaggaaaaatatacaaggagtttggtatcaccaaggaagctgttatcgctgctgccaaagaactttcctagatctattgttccccctcctttttttcctttctcgtttattacagatctgttgcttgataaatcaccttagccacaataaggaatattagattgctcttgcatatgataatcagaggagaaacataaattaaaggatgagttgaattgaagaagttgtatgaatttgtaacaactattttggctggtgaattttgcactgtgatgtagttgaattcagtgatcctcactctatcacttgtttaaatatcgtcagatatggcttcttggaagaattatatccttctctaatgcttttatttcaaggatctagtttaaatctttactatattcttttgtctgaaaaggcaggattagattaaaaaaattgctagaaattttacttaatcagtgtaggtaagtatttgaaatcagacaaatctaaatccttgttctttggataatgtatgttccagaactttgatcctgaaatgttgc

SEQ ID NO: 9028 - DNA, 3219 bp, Gossypium hirsutum
aaacacaaatgatttgcaactctgtcagatattggaaggagcaaacagctcttagtcatgaatttcttcttcagtacatattacaagaatcaactaagacatcattaatttcttcaactatataactacatacattaatttattctccttgctcttcatgcttttattcatggtgacatacagcaccacatttccattgcctacttgatcgtgtcgcagttaatggtaggatcaaaggaaatggcgacagtaacaccgcacaactgaggaagctgtttagctttgtcgggatcaacaccttcactacgactagctgcctcgagacaacgacacaagtccttgcgaattgcagtggtggtagcggcggcgttgatattagccaccgcggaacaacatgttgcaacgggtgtggattccccgccggtcaagaaagggcgacaaggcatcagtgacaataaagcttcttggcatgttattgcatccacagattttgatttcgctatcaaaatcatgataaacaaagaggggtcccttcactatcctcaccctctcaatcaacaatggcctctacttcatctgtcaccctatctcaagccctcctctctcgcgctatctcttcccatgcctccgcccaatcctccgaccaccgcccctccctctccactctctcttttcccggtttctctggcctcaaatcttctatccctcgcgcttcctcttcccgtcgacgccttccctcccgctccaaccacaagcgccaggtccgtgctgctgccgtcgaaacaattggcaccgccgccgagacttccttggtcgagaaatccgtcaacaccatcagattcttgtctattgatgcggtcgagaaggcgaattcagggcatcctgggttgcccatgggctgtgctcccatgggtcacattttgtacgatgaagtcatgaggtataaccccaagaacccttactggttcaaccgtgaccgtttcattctgtccgctggtcacggttgtatgttgcagtatgctctgcttcacctcgctggttacgacagtgtcctggaagaagatttgaagagtttccgtcagtggggaagcagaacccctggacatcccgagaactttgaaacaccaggagttgaagtcacaactgggcctcttggtcagggtattgcaaatgctgttggattggctcttgctgagaaacacttggctgctagattcaacaagccagacaatgagattgttgatcactacacatatgttatcttgggagatggttgtcaaatggagggtatttcaaatgaagcttgttcacttgctggacactggggacttggaaagcttatagctttctatgatgacaaccacatttcgattgatggtgacactgaaattgcgtttactgagaatgttgatacacgttttgaggggctagggtggcatgttatctgggtcaagaatggaaacactggctatgatgaaattcgcgctgcaatcaaggaagcaaaggctgtcaaagacaagcccactctgatcaaggtgacaaccaccattggttatgggtctcctaacaaggcaaactcatatagtgtacatgggagtgcactgggtgccaaggaagttgatgctactaggaaaaaccttggatggccatatgagcctttccatgtaccagaagatgttaaagctcactggagtcgccatacccctcagggtgctgctcttgaagctgaatggaatgccaagttcgctgaatatgagcagaagtacaaagaggaagctgctgagctcaaggcaatcatcactggtgaactaccagctggttgggagaaggcacttccaacatacactccagagagcccggctgatgctaccagaaatctctctcaacaaaatctcaatgcccttgtaaaagtactccctggccttcttggtggaagtgctgaccttgcttcttccaacatgaccttgctcaaaatgtacggtgatttccagaaggacacccctgaggagcgcaatgttaggtttggtgttagggaacatggaatgggagccatctgcaatggcattgcccttcacagcccgggcttcattccgtactgtgctacattctttgtcttcactgactacatgagagctgccattaggatttctgccttgtgtgaagcaggagttatctatgttatgacccatgattccattggtcttggggaagatggaccaacccaccagccaattgaacacttggcaagcttccgtgcaatgcctaatgttttgatgcttcgtccagctgatggaaatgaaacagctggtgcatataaggttgctgttctgaacaggaagagaccttctattcttgccctctctaggcaaaagctgccccaacttcctggaacttccattgagggagttgaaaaaggtggctacattatttcagacaattcttctggcaacaatcccaatgtaattctgattggaactggttctgagttggagattgccgctaaagctgccgatgaactaaggaaggaaggcaagaccgttagggttgtctcctttgtttcttgggagctctttgatgagcaatcagatgcctacaaggaaagcgttttaccatctgctgtatcagctagggtgagtattgaggctggatcaacatttgggtgggcgaagattgttggatccaaggggaaggctattggaattgaccggttcggggcaagtgcaccagcaggcaaaatatacaaggagtttggcttgactcctgaggctgttgttgcagcagcaaaagaactttgctaagcttgcttagaagtgtcgggagaaatttgtggttttgggttggaggttacactgaagagaggccattccatttgtgacagtctcttttgtttttaataagaatcagaatccacttatattttatgttgcctgtgattcatcaaaaagcaaaacatagagcgaaagggagggtagagtttgtgtatgatcatcaatttgtaatttcctctcggactttttcccagagttttgcagtacttgttgcttcaagttagcttgccctttttgttcttatgttttgaaacagagttgtctactattgtaatctagccatcattttgatcaaatatgcttggcctaagatgtaagaccagtttgtataatgttggttttccaaataaccagcttgattctacataaatgcattacttctatcctttag

SEQ ID NO: 9029 - DNA, 2927 bp, Gossypium raimondii
actttgcctcactctacatttatcaaacaaagaggggtcccttcaccatcctcaccctctcaatcaacaatggcctctacttcatctgtcaccctatctcaagccctcctttctcgcgctatctcttcccatgcctccgcccaatcctccgaccaccgcccctccctctccactatctcttttcccggtttctccggcctcaaatcttctatccctcgcgcttcctcatcccgtcgacgccttccctcccgctccaaccacaagcgccaggtccgtgctgctgccgtcgaaacaattggcaccgccgccgagacttccttggtcgagaaatccgtcaacaccatcagattcttgtctattgatgcggtcgagaaggcgaattcaggtcatcctgggttgcccatgggctgtgctcccatgggtcacattttgtacgatgaagtcatgaggtataaccccaagaacccttactggttcaaccgtgaccgtttcattctgtccgctggtcacggttgtatgttgcagtatgctctgcttcacctcgctggttacgacagtgtcctggaagaagatttgaagagtttccgtcagtggggaagcagaacccctggacatcccgagaactttgaaacacctggagttgaagtcacaactgggcctcttggtcagggtattgcaaatgctgttggattggctcttgctgagaaacacttggctgctagattcaacaagccagacaatgagattgttgatcactacacatatgttatcttgggagatggttgtcaaatggagggtatttcaaatgaagcttgttcacttgctggacactggggacttggaaagcttatagctttctatgatgacaaccacatttcgattgatggtgacactgaaattgcgtttactgagaatgttgatacacgttttgaggggctagggtggcatgttatctgggtcaagaatggaaacactggctatgatgaaattcgcgctgcaatcaaggaagcaaaggctgtcaaagacaagcccactctgatcaaggtgacaaccaccattggttatgggtctcctaacaaggcaaactcatatagtgtacatgggagtgcactgggtgccaaggaagttgatgctactaggaaaaaccttggatggccatatgagcctttccatgtaccggaagatgttaaagctcactggagtcgccatacccctcagggtgctgctcttgaagctgaatggaatgccaagttcgctgaatatgagcagaagtacaaagaggaagctgctgagctcaaggcaatcatcactggtgaactaccagctggttgggagaaggcacttccaacatacactccagagagcccagctgatgctaccagaaatctctctcaacaaaatctcaatgcccttgtaaaagtactccctggccttcttggtggaagtgctgaccttgcttcttccaacatgaccttgctcaaaatgtacggtgatttccagaaggacacccctgaggagcgcaatgttaggtttggtgttagggaacatggaatgggagccatctgcaatggcattgcccttcacagcccgggcttcattccgtactgtgctacattctttgtcttcactgactacatgagagctgccattaggatttctgccttgtgtgaagcaggagttatctatgttatgacccatgattccattggtcttggggaagatggaccaacccaccagccaattgaacacttggcaagcttccgtgcaatgcctaatgttttgatgcttcgtccagctgatggaaatgaaacagctggtgcatataaggttgctgttctgaacaggaagagaccttctattcttgccctctctaggcaaaagctgccccaacttcctggaacttccattgagggagttgaaaaaggtggctacattatttcagacaattcttctggcaacaatcccaatgtaattctgattggaactggttctgagttggagattgctgctaaagctgcagatgaactaaggaaggaaggcaagaccgttagggttgtctcctttgtttcttgggagctctttgatgagcaatcagatgcctacaaggaaagcgttttaccatctgctgtatcagctagggtgagtattgaggctggatcaacatttgggtgggcgaagattgttggatccaaggggaaggctattggaattgaccggttcggggcaagtgcaccagcaggcaaaatatacaaggagtttggcttgactcctgaggctgttgttgcagcagcaaaagaactttgctaagcttgcttagaagtgtcgggagaaatttgtggttctgggttggaggttacactgaagagagaccattccatttgtgacagtctcttttgtttttaataagaatcagaatccacttatattttatgttgcctgtgattcatcaaaaagcaaaacatagagagaaagggagggtagagtttgtgtatgatcatcaatttgtaatttcctctcggactttttcccagagttttgcagtacttgttgcttcaagttagcttgccctttttgttcttatgttttgaaacagagttgtctactattgtaatctagccatcattttgatcaaatatgcttggcctaagatgtaagaccagtttgtataatgttggttttccaaataaccagcttgattctacataaatgcattacttctatcctttgtttgaaattggtggttagaatccagccaggagaagatttcatttcattaaactggatgggattgagaaatggtttatagccattcgaaaaaggctatacatgaagccaagaattgttgatgggatccactagggaagaaggcaagtcttgagttgttgataagtttgtggttgttggagatcctgccttagagtgccacc

SEQ ID NO: 9030 - DNA, 2510 bp, Medicago truncatula
aaacactaccaccacctacatattctatctaatcccaacaacactcttactactattactttacttactacactctttcttcttcttcttcttcttcttcttgattgattattctctctaatcaatcacactatggcttcttcttctcttcatctttctcaagcattcctcgcacgtgccgtttacctcaaccctgaaattcgtgcagcttcactctcttccacttcttccctctccttccctgctctcaaatcctcctcttcatccaaaccacctacctcccgtcgcagaaccacaccagccatccgcgccaccgctgttgaaacactcgacaaaaccaccgaagcttctctcgttgagaaatcagtcaacactattcgattccttgctatcgatgccgttgagaaagctaattcgggtcacccgggtttacccatgggttgtgctccaatgggtcacattctatacgatgaagttatgagatataacccaaagaatccttcttggtttaaccgtgatcgctttgttttgtctgctggacatggttgtatgcttcagtatgctcttcttcatcttgctggttatgacagtgtccaggaagatgacttgaagcagtttcgacaatggggaagcaaaactcctggacatcccgagaacttcgagacatatggaattgaagtcaccacaggtcctctgggtcagggtattgccaatggtgttggattggcacttgccgagaagcacttggctgcacggtttaacaagcctgacagtgagattgttgaccattacacgtatgttatattgggagatggttgtcaaatggaaggaatttcaaatgaagcgtgttcacttgccggacattggggtcttggaaagctaattgcattttatgatgataaccacatttctattgatggtgacactgaaattgcattcactgagaatgttgatcaacgttttgaggcacttggatggcatgtgatttgggtaaagaacggaaatactgggtatgatgaaattcgtgcagccattaaggaagcaaaggctgtcacagacaaacctactttgattaaggtaaccactaccattggatttggttctccaaacaaagctaattcctacagtgttcacggagccgcattgggtgctaaagaagtagatgctacaaggcagaatcttggatggccatacgagcctttccatgtgccagaagatgttaaaaagcattggagtcgccatacccctgagggtgctgcactcgaagctgagtggaatgctaaatttgccgagtatgagaagaaatacaaagaggaggctgcagagctaaaggctattattaatcgtgaattacctgctgattgggagaaagcacttccgacttacactccggaaacccctgctgatgctacaagaaatctgtcacagcaaaatctaaatgccctggccaaggttcttcctggtcttattggtggcagtgcagatcttgcctcttccaacatgactttgttgaaatcgtttggagatttccaaaaggctactccagaagagcgcaatgttcgttttggtgttagggaacacgcaatgggagcaatctgcaatggtattgctcttcatagcccgggattcattccatactgtgcaactttctttgtcttcaccgactacatgagagctgccataaggatttcagctttgtgtgaagccggagttatttatgttatgacccatgattcaattggacttggagaggatggaccaactcatcagccaatagagcacctggcaagcttccgagcaatgccaaatgttttgatgcttcgtccagctgatggtaatgaaactgctggatcatacagagttgccgtgcttaaccagaagagaccctcaattctggccctttctcggcaaaagttgcctaaccttccgggaacttctattgaaggtgttgaaaagggtggctacaccatttcagacaactcatcaggtaacaagcctgatgttattttgattggaactggttctgagttggaaattgccgctgccgccgctgatgatctaaggaaagaaggaaaaactgtaagagttgtttcttttgttagctgggaactttttgatgatcagtcagatgaatacaaggagagtgttctccctgcttctgtgacagctagagtcagcattgaggcgggatcaacatttggttggcataagattgttggaagcaagggaaaaaccattggcattgatcgatttggagctagtgctccagcagggaaaatatacaaggagtatggcataaccaaggaagctgttatttctgctgccaaagaagtttcatagatctgttgaggttctgttttttcttttttaatccagaacttgtgggtttcattggtggctttgtattactattattacgagagttgtttcttgagatatcattttagccacaataaggatgaatagattgctctagcatatgattctcaaaggagcaacatagattaaat

SEQ ID NO: 9031 - DNA, 2763 bp, Medicago truncatula
gaggagatagatagcaagaaagcataggctgagattttccatagcttacacaccaaacaaacactaccaccacctacatattctatctaatcccaacaacactcttactactattactttacttactacactctttcttcttcttcttcttcttcttcttgattgattattctctctaatcaatcacactatggcttcttcttctcttcatctttctcaagcattcctcgcacgtgccgtttacctcaaccctgaaattcgtgcagcttcactctcttccacttcttccctctccttccctgctctcaaatcctcctcttcatccaaaccacctacctcccgtcgcagaaccacaccagccatccgcgccaccgctgttgaaacactcgacaaaaccaccgaagcttctctcgttgagaaatcagtcaacactattcgattccttgctatcgatgccgttgagaaagctaattcgggtcacccgggtttacccatgggttgtgctccaatgggtcacattctatacgatgaagttatgagatataacccaaagaatccttcttggtttaaccgtgatcgctttgttttgtctgctggacatggttgtatgcttcagtatgctcttcttcatcttgctggttatgacagtgtccaggaagatgacttgaagcagtttcgacaatggggaagcaaaactcctggacatcccgagaacttcgagacatatggaattgaagtcaccacaggtcctctgggtcagggtattgccaatggtgttggattggcacttgccgagaagcacttggctgcacggtttaacaagcctgacagtgagattgttgaccattacacgtatgttatattgggagatggttgtcaaatggaaggaatttcaaatgaagcgtgttcacttgccggacattggggtcttggaaagctaattgcattttatgatgataaccacatttctattgatggtgacactgaaattgcattcactgagaatgttgatcaacgttttgaggcacttggatggcatgtgatttgggtaaagaacggaaatactgggtatgatgaaattcgtgcagccattaaggaagcaaaggctgtcacagacaaacctactttgattaaggtaaccactaccattggatttggttctccaaacaaagctaattcctacagtgttcacggagccgcattgggtgctaaagaagtagatgctacaaggcagaatcttggatggccatacgagcctttccatgtgccagaagatgttaaaaagcattggagtcgccatacccctgagggtgctgcactcgaagctgagtggaatgctaaatttgccgagtatgagaagaaatacaaagaggaggctgcagagctaaaggctattattaatcgtgaattacctgctgattgggagaaagcacttccgacttacactccggaaacccctgctgatgctacaagaaatctgtcacagcaaaatctaaatgccctggccaaggttcttcctggtcttattggtggcagtgcagatcttgcctcttccaacatgactttgttgaaatcgtttggagatttccaaaaggctactccagaagagcgcaatgttcgttttggtgttagggaacacgcaatgggagcaatctgcaatggtattgctcttcatagcccgggattcattccatactgtgcaactttctttgtcttcaccgactacatgagagctgccataaggatttcagctttgtgtgaagccggagttatttatgttatgacccatgattcaattggacttggagaggatggaccaactcatcagccaatagagcacctggcaagcttccgagcaatgccaaatgttttgatgcttcgtccagctgatggtaatgaaactgctggatcatacagagttgccgtgcttaaccagaagagaccctcaattctggccctttctcggcaaaagttgcctaaccttccgggaacttctattgaaggtgttgaaaagggtggctacaccatttcagacaactcatcaggtaacaagcctgatgttattttgattggaactggttctgagttggaaattgccgctgccgccgctgatgatctaaggaaagaaggaaaaactgtaagagttgtttcttttgttagctgggaactttttgatgatcagtcagatgaatacaaggagagtgttctccctgcttctgtgacagctagagtcagcattgaggcgggatcaacatttggttggcataagattgttggaagcaagggaaaaaccattggcattgatcgatttggagctagtgctccagcagggaaaatatacaaggagtatggcataaccaaggaagctgttatttctgctgccaaagaagtttcatagatctgttgaggttcttttttttcttttttaatccagaacttgtgggtttcattggtggctttgtattactattattacgagagttgtttcttgagatatcattttagccacaataaggatgaatagattgctctagcatatgattctcaaaggagcaacatagattaaatgatgagatcaattaaggaagttgtatgaattgtaacaactattttggcttgtgaattacatattgtgatgtagttgaattcagtgattctcactctaccacttctctaaatgtgttctgatgtggcttctataaagaattatatctttctcaattttttcacaagaggatctagcataaaataattgctatattg

SEQ ID NO: 9032 - DNA, 2679 bp, Trigonella foenum-graecum
taggctgagattttccacagcctctccaccaaacactaccaatcatttattctatattctattctattctatccaacactacactactattactattacatacacacactcttctcattcttcttctttttcttgattgattcttcactaatcaatcaatcactatggctgcttcttctcttcatctttctcaagcattcctcgcacgtgccgtttatctcaactctgaaaaccgtgcggcatcactctcttccacttcttccctctccttccctgctctcaaatcctcttcatgcaaacctgctacctcctcaaccgcttcccgtcgcagagccacaccaaccgtacgcgccaccgcggttgaaacactcgacaaaaccactgaagcttctctcgttgagaaatccgtcaacactattcgtttccttgctatcgatgctgttgagaaagctaattcgggtcacccgggtttacccatgggttgtgctccaatgggtcatattctatacgatgaagttatgagatataacccgaagaatccttcttggtttaaccgtgaccgctttgttttgtctgctggacatggttgtatgcttcagtatgctcttcttcatcttgctggttatgacagtgtcaaggacgaagacttgaagcaatttagacaatggggaagcaaaactcctggacatcccgagaatttcgagacatacggaattgaagtcaccacaggtcctcttggtcagggcattgccaatggtgttggattggcacttgctgagaagcacttggctgcacgatttaacaagcctgacagtgagattgttgaccattacacgtatgttatattgggtgatggttgtcaaatggaaggaatttcaaacgaagcatgctcacttgccggacattggggtcttggaaagcttattgcgttttatgatgataaccacatttccattgatggtgacactgaaatcgcattcactgagaatgttgatcaacgttttgaggcacttggatggcatgtgatttgggtcaagaacggaaatactgggtatgatgaaatccgtgcagccattaaggaagcaaaggctgtcacagacaaacctactttgattaaggtaaccactaccatcggatttggttctccaaacaaggctaattcctacagtgttcatggagctgcattgggttctaaagaagtggacgctacaaggcagaatcttggatggccatatgagcctttccatgtgccagaagatgttaaaaagcattggagtcgccatacccctgagggtgctgcactagaagctgagtggaatgctaagtttgtcgagtatgagaagaaatacaaagaggaggctacagagctaaaggctattattaatcgcgaattacccgctgattgggagaaagcacttccgacttacactccggaaacccctgctgatgctacaagaaatctgtcacagcaaaatctaaatgccctggctaaggttcttcctggtcttattggtggcagcgcagatcttgcctcttccaacatgaccttgttgaaaagttttggagatttccaaaaggctactccagaagagcgtaatgttcgatttggtgttagggaacacgcaatgggagcaatctgcaatggtattgctcttcatagcccgggattcattccatactgtgcaactttctttgtcttcaccgactacatgagagctgccataaggatttctgccctgtgtgaagccggagttatttatgttatgacccatgattcaattggacttggagaggatggaccaactcatcagccaatagagcacctggcaagcttccgagcaatgccgaatgttttgatgcttcgtccagctgatggtaatgaaactgctggagcatacagagttgccgtgcttaaccagaagagaccctcaattcttgccctttctcggcaaaagttgcctaaccttctaggaacttctattgaaggagttgaaaagggtggctacaccatttcagacaactcatcaggtaacaagcctgatgttattttgattggaactggttctgagttggaaattgccgctgccgccgctgacgatctaaggaaagaaggaaaaactgtaagagttgtttcttttgttagctgggaactttttgatgatcagtcagatgaatacaaggagagtgttctccctgcttctgtgacagctagagtcagcattgaggcaggatcaacatttggttggcataagattgttggaagcaagggaaaaaccattggcattgatcgatttggagcaagtgctccagcaggaaaaatatacaaggagtttggcataaccaaggaagctgttatttctgctgccaaagaagtttcatagatctgtcgaggttctgttttttctttttaatccagaacttgtgggtttcattggtggctttgtattaatattattacgagagttgtttcttgagatatcattttagccacaataaagatgaatagattgctctaccatatgattctcaaaggagcaacatagattaaatgatgagatgaattaaggaagttgtatgaatttgtaacaactattttggcttgtgagttacatactgtgatgtagttgaattcagtgattctcactctaccacttctctaagtgtggtctgatttggctt

SEQ ID NO: 9033 - DNA, 2819 bp, Manihot esculenta
atgctacccgtagttaacggtcgagattgctttctctctcaatctaacgttcagctcagttcacctgtcacttagtgcaggcgaaaagatcaagaattcaagatcaggagttgttggaagcctttcgacaaaaaatagataaaagcccaaagcagctcattctctctttccaatctccataaacaaagctaagtgaagagcggagagggtcgccgaaggtgtcaaaaacaatggcttccacttcatctctgactctatctcaggccctcttggctccagccatctcccaccatggctcagcccagtcttctgaccaccaccgcctctctctttctacaccttccctcccctccttttctggtctcaagtccacctcatccatcccgttagccacttcctctgtccgccgccgcctggccgcgcgccaacaaatccagatccgcgcagctgcagttgagacccttgacgccaccgccgagacttcattggttgagaaatctgtcaatacaattagatttctcgctattgatgctgttgagaaggctaattcaggtcaccccggtctgccaatgggttgtgctccgatgggtcatattttatacgatgaaattatgagatataacccgaagaatccttattggttcaatcgtgatcgcttcgtcttgtctgctggccacggctgtatgctacagtatgctttgcttcatcttgctggatacgatagtgtcaaggaagacgacttaaagagtttccgtcaatggggaagcagaacccctggacacccagagaactttgagacacctggtgttgaagtcacgactggtcctctcggacagggtattgccaatgctgttggtttggctcttgcggagaagcacttggctgctcgctacaacaaaccggacaatgaaattgttgatcactacacatatgttatattgggagacgggtgtcaaatggagggaattgcaaatgaagtttgttcccttgctgggcactggggactaggaaagctgatagctttctatgatgataaccacatctccattgatggtgacacagcaattgcattcaccgaaagtgtagataaacgttttgagggtcttggatggcacgttatctgggtgaagaatggaaacactggatatgatgaaattcgtgctgccatcaaggaggccaaggctgtgaaagacaaacccactttgatcaaggtcactacaaccattggttatgggtctccaaacaaggcaaactcttacagtgtgcacggtagtgcactgggtgccaaggaagttgatgctactaggaagaaccttggttggccatatgagcctttccacgttccagaggatgttaagaagcattggagtcgccatgttccagagggtgctgcttttgaagctgaatggaatgcaaagtttgccgagtatgagaagaagtacaaggaggaagctgcagaattgaagtctatcatcactggtgaactgcctgctggttgggagaaggctcttccaacatacactccagacagcccagcagaggcaaccagaaatctctcccagacaaacctaaatgcgcttgcaaaagtactccctggacttcttggtggcagtgcagaccttgcctcttccaacatgaccttgttgaaaatgtttggggacttccaaaaggacacccctgaagaacgtaatgtccggtttggtgtcagggagcatggaatgggagccatctgcaatggtattgcactacacagccctggtctgatcccatattgtgcaactttctttgttttcactgattacatgagggctgctataaggatatctgctttgtgcgaggctggagtcatatatgttatgacccatgattcaattggtctgggagaagatgggccaactcatcagccaattgagcacttggcaagcttccgtgcaatgcctaatattttgatgctacgcccagctgatggaaatgaaactgctggtgcttacaaggttgctgtcctcaacaggaagagaccctctatccttgcactctctaggcaaaagctgccaaatcttgctggaacttctattgagggagttgaaaagggtggatatattatttcagataattcttccggaaacaagcctgacgtcattttgattggaactggttctgagttggaaatcgctgctaaggctgctgaggaacttagaaaggggggcaaggctgtaagagttgtctcctttgtttcatgggaactttttgatgaacaatcagatgcctacaaggaaagtgttctgccagaagctgtatcagctagggttagcattgaagctggatcaacatttggatggcagaagattgttggagccaaaggcaaggctattggaattgatcgatttggggccagtgcaccagctggtaagatatacaaggagtttggcattactgtagaggctgttattgctgcagccaaagaagctagttaggctggatgaaaactttttatttggaatttggggtttgggttgttgaatacaatgaagaggccatttctgggattgttattccatgacatggttatcttagtctcaataaaacagaaaaaaagggttagattttgttctgttgcttacaagtgacaaatgagcaacgtagtccggattaggagagttggattatgaacattgttgactttgtaacaactccttggatctattttgaattttgtgatgtgctgtgattttgaatttgtaacaactcttggatctattttcaattttgtgatgtgctgtgatttacttgtagtgaggttgacaattatttattactgc

SEQ ID NO: 9034 - DNA, 2702 bp, Gossypium hirsutum
acgactacttgcctccattgccttttgcatttgaatagatattatgagttaaaaaatctctctttctcttcacattaccaataaacaaagcggccgagggtcatttcctttccctttcaccaacctctctattcgatcgaaaaacaatggcctcttcttcctctctcaccctatctcaagccctccttgctcgagccatctcttcccatggctctgcccaaccctctgaccaccgcgtctctctctccgccctctctattcccactttctccggccttaaatctgcttccccacgcgcttccacttcctgtcgccggcttcccacgcgctctacccggaatcatcaagtccgttctgccgctgtcgagacgattggtaccgccgccgagacttcattggtcgagaaatcggtcaacacgatcagattcttggccattgatgctgtcgagaaggccaattcagggcatcctgggttgcccatgggctgtgctccaatgggtcacattttatacgatgaagttatgagatataacccgaagaacccttattggttcaaccgtgaccgtttcgtattgtccgctggtcacggttgcatgctacagtatgctctgcttcacctcgctggttacgacagtgtccgagaagatgatttgaagaatttcaggcagtgggaaagcagaactccaggacaccctgagaactttgaaacacctggagttgaagtcacaactggtcctcttggtcaaggcattgcaaatgctgttggattggctcttgctgagaaacacttggctgctagattcaataagccagacaatgagatcatcgaccactacacatatgttattttgggagatggttgccagatggagggtattgcaaatgaagcttgttcacttgctggacactggggacttggaaagcttatagctttctatgatgacaaccacatttccattgatggagacactgaaattgcctttacagagagtgttgataagcgttttgaggggcttgggtggcatgttatctgggtcaagaatggaaacactggctacgatgaaattcgtgctgctattaaggaagcaaaggctgtcaaagacaagcccactctgatcaaggtgacaaccaccattggttatggatctccaaacaaggcaaactcatacagtgtacatggtagtgcattgggtgccaaggaagtggatgctactaggaaaaaccttggatggccatatgagcctttccatgtacctgaagatgtgaaagggcactggagtcgccatgtccctcaaggggctgctctcgaagccgaatggaatgcaaagttctctgcatatgagaagaagtacaaagaggaagctgcagagctcaagtcaataatcactggtgaactacctgctggctgggagaaggcacttccaacatacactccagagagcccagctgatgctaccagaaatctctctcaacaaaatctcaatgcccttgtaaaagtactcccaggtcttcttggtggaagtgcagatcttgcttcttccaacatgaccttgctcaaaatgtttggggatttccagaaggacacccctgaggaacgcaatgttcggtttggtgttagggaacatggaatgggagctatctgcaatggcattgcccttcacagccctggcctgattccatactgtgctactttctttgtcttcactgactacatgagggccgccattaggatttctgccttgagtcaggctagagttatctacgttatgacccatgattccattggtcttggggaagatggaccaactcaccagccaattgagcacttggcaagcttccgtgcaatgcctaatgttttgatgctccgtccagctgatggaaatgaaacggctggagcatacaaggttgctgtcctcaagaggaagacaccctcaattcttgccctttccagacaaaagctaccccaattagctggaacttccattgagggggttgaaaaaggtggctacatcatttcagacaattcttcaggcaacaatcctgatgtaattctgattggaactggttctgagttagagatcgctgttaaagctgctgatgaactaaggaaggaagggaaggctgtaagggttgtctcccttgtttcatgggagctctttgatgagcaatcagatgcctacaaggaaagtgttttcccatctgctgtaacagctagagtgagtattgaggctggatcaacatttgggtgggggaagatagttggatccaaagggaaggcaatcggaattgatcggtttggggcaagtgcaccagcagggagaatatacaaggaatttggcttaactccagaggctgttattgctgcagccaaagaactttgctaagcttggttcaaagtctctgaggaaacttaaggttttcgattgaagatgtcgctgaagagctgttccaattgtgacagtctcttttgttttgttttctttaataagaaacagattcaaattttcttttgttgcttatgattcatcaatagcagcagtgagcaaaagggaggttagagtttctttatgtttatggatttgtaactcctcctgggacttctccggatttctgctttggcctaagatataaaatgagtttgtataattttgcttttcagaataaacagtttgattcccccacacttaaaaaaaaaaaaaaaa

SEQ ID NO: 9035 - DNA, 2753 bp, Gossypium raimondii
ctcattttgtccctttctgtagacgagaagatcaatgagagttggtggctactggttacgagttacgactacttgcccccattgccttttgcatttgaatatatattatgagttaaaaagtctctctttctcttcacattaccaataaacaaagcggccgagggtcatttcctttccctttcaccaacctctctattcgatcgaaaaacaatggcctcttcttcctctctcaccctatctcaagccctccttgctcgagccatctcttcccatggctctgcccaaccctctgaccaccgcgtctctctctccgccctctctattcccactttctccggccttaaatctgcttccccacgcgcttccacttcctgtcgccggcttcccacgcgctctacccggaatcaccaagtccgttctgccgctgtcgagacgattggtaccgccgccgagacttcattggtcgagaaatcggtcaacacgatcagattcttggccattgatgctgtcgagaaggccaattcagggcatcctgggttgcccatgggctgtgctccaatgggtcacattttatacgatgaagttatgagatataacccgaagaacccttattggttcaaccgtgaccgtttcgtattgtccgctggtcacggttgcatgctacagtatgctctgcttcacctcgctggttacgacagtgtccgagaagatgatttgaagaatttcaggcagtgggaaagcagaaccccaggacaccccgagaactttgaaacacctggagttgaagtcacaactggtcctcttggtcaaggcattgcaaatgctgttggattggctcttgctgagaaacacttggctgctagattcaataagccagacaatgagatcatcgaccactacacatatgttattttgggagatggttgccagatggagggtattgcaaatgaagcttgttcacttgctggacactggggacttggaaagcttatagctttctatgatgacaaccacatttccattgatggagacactgaaattgcctttacagagagtgttgataagcgttttgaggggcttgggtggcatgttatctgggtcaagaatggaaacactggctacgatgaaattcgtgctgctattaaggaagcaaaggctgtcaaagacaagcccactctgatcaaggtgacaaccaccattggttatggatctccaaacaaggcaaactcatacagtgtacatggtagtgcattgggtgccaaggaagtggatgctactaggaaaaaccttggatggccatatgagcctttccatgtacctgaagatgtgaaagggcactggagtcgccatgtccctcaaggtgctgctctcgaagccgaatggaatgcaaagttctctgcatatgagaagaattacaaagaggaagctgcagagctcaagtcaataatcactggtgaactacctgctggctgggagaaggcacttccaacatacactccagagagcccagctgatgctaccagaaatctctctcaacaaaatctcaatgcccttgtaaaagtactcccaggtcttcttggtggaagtgcagatcttgcttcttccaacatgaccttgctcaaaatgtttggggatttccagaaggacacccctgaggaacgcaatgttcggtttggtgttagggaacacggaatgggagctatctgcaatggcattgcccttcacagccctggcctgattccatactgtgctactttctttgtcttcactgactacatgagggccgccattaggatttctgccttgagtcaggctagagttatctacgttatgacccatgattccattggtcttggggaagatggaccaactcaccagccaattgagcacttggcaagcttccgtgcaatgcctaatgttttgatgctccgtccagctgatggaaatgaaacggctggagcatacaaggttgctgtcctcaagaggaagacaccctcaattcttgccctttccagacaaaagctaccccaattagctggaacttccattgagggggttgaaaaaggtggctacatcatttcagacaattcttcaggcaacaatcctgatgtaattctgattggaactggttctgagttagagatcgctgttaaagctgctgatgaactaaggaaggaagggaaggctgtaagggttgtctcccttgtttcatgggagctctttgatgagcaatcagatgcctacaaggaaagtgttttcccatctgctgtaacagctagagtgagtattgaggctggatcaacatttgggtgggggaagatagttggatccaaagggaaggcaatcggaattgatcggtttggggcaagtgcaccagcagggagaatatacaaggaatttggtttaactccagaggctgttattgctgcagccaaagaactttgctaagcttggttcaaagtctctgcggaaacttaaggttttcgattgaagatgtcgctgaagagctgttccaattgtgacagtctcttttgttttgttttctttaataagaaacagattcaaaatttcttttgttgcttatgattcatcaatagcagcagtgagcaaaagggaggttagagtttctttatgtttatggatttgtaacttctcctgggacttatccggatttctgctttggcctgagatataaaatgagtttgtataattttgcttttcagaataaacagtttgattcccccacactaaat

SEQ ID NO: 9036 - DNA, 2786 bp, Populus trichocarpa
tttcattctcaaataaatttaactctctctgtaatatcgacaatactcaacaaaaaccagagagagagactgagagagtttcagaattcaggaatggcttccacttcttctctaactctctctcaagcccttttggctagagccgtctctcacaatgccattgaccacctccgtgacagccgtctctctctcgtctcccttcctgctttctccggcctcaaatccaccacctgtacagccacacgcgccacaacaacaactagccgccgccgccgcgtgtcttcccgacaagtaagggcggcggcagtggagacactggatgcgacaacagagacttcattggtggagaagtcggttaatacgattagatttctcgctattgatgctgttgaaaaggctaattcaggtcaccctggtttgcctatggggtgtgctccgatgggtcatattttgtacgatgaggtcatgaggtacaatccgaagaacccatattggttcaatcgtgaccggtttgttttgtctgctggccatggctgtatgttgcaatatgctctgcttcaccttgctggatatgatagtgtcaaggaagaagacttgaagagtttccgtcagtggggaagcaggacaccgggacatcctgagaactttgagactcctggtgttgaagtcacaactggtcctcttggacagggtattgccaatgctgttggtttggcacttgcagagaagcacttggctgctcgcttcaacaaaccagacaatgagattgttgaccactacacatatgttatattgggagatggttgtcaaatggagggtatttcaaacgaggcttgttcgttggccgcacactggggacttggaaagctgattgctttctatgatgacaaccatatctctattgatggtgacactgagattgcattcactgaggatgttgacaaacgttttgagggtcttgggtggcatgttatctgggtgaagaatggaaacactggatatgatgagattcgtgctgccattaaggaggctaagtctgtgaaggacaaacccactatgataaaggtgactacaaccataggttatggatctccaaacaaagcaaactcttacagtgtacatgggagtgcattgggtgccaaggaagttgatgctaccaggcagaaccttggatggccatatgagcctttccatgttccagaggatgttaagcagcactggagccgccacaccccagctggtgcagcttttgaagccgaatggaatgccaagtttgtcgagtatgagaagaagtacagtgaagaagctgcagagttgaagtctattgccaatggtgaactgcctgctggttgggagaaagcacttcctacatatactccggagagcccagcagatgccacccgaaatctatctcagcaaaacctaaatgcacttgcaaaagtgctccctggtcttcttggtggcagcgcagatcttgcctcttccaacatgaccttgttaaaaatgtttggggacttccaaaaggacacccctgaggaacgcaatgtcaggtttggtgtcagagagcatggaatgggagccatctgcaatggcattgcacttcactgtcctggcttgatcccctactgtgctactttctttgttttcacagattacatgagagctgctatgaggatttctgctttgtgtgaggctggagtcatatatgtcatgacccacgattccattggtcttggagaggatggaccaacccatcaaccaattgagcacttggcaagcttccgtgcaatgcccaacattttgatgttacgcccagctgatggaaatgaaactgctggcgcatacaaggttgctgtcctcaacagaaagagacccgctatcctagccctctccaggcaaaagctaccccaacttcctggaacctccattgagggagttgaaaagggtggctacatcatttcagataactcctctagtaataagcctgatgttatcttgattggtactggttcagagctggaaattgctgctaaagctgccgaggaacttagaaaggaaggcaaggctgtaagagttgtttcctttgtttcatgggagctttttgatgagcaatcagatgcctacaaggaaagtgttttgccagcagctgtagaagctagggttagcatcgaagctggatcaacatttggatgggagaagattgttggagacaaaggaaaggctattggaattgaccggtttggagcaagtgcaccagcaggtaaaatatacaaggagtacggtattactacagaggctgttatcgcagctgccaaagaagtcagctaggtggatcaattcactcacaacatcttgttaaatgcgcatctgtggtttgggttagagaatagaatggagaggctattccgggggacctgtttcattacttggcctcttttgtttcaataaaagactgagatgaatccttcttcttttgcttataagtggtaagttgagcaaagctggatcaaagagagagttgggtttatgatatcttcgaatttgtaactgtgttgcatctcatctctcttgagttttgtagtgttctttggtaacttgtaatgagttgaagatgaattattattatttctccttcatgttattaagaagaagaaagatacattgctttaattctaagatctcttttgcttttctgttgtgagttcgaagaggatcgtattgctgactctcaggtaatttgtttctttaactgtttcccctaccaacccccaaataatatcatcacg

SEQ ID NO: 9037 - DNA, 2562 bp, Rosmarinus officinalis
catttttcttatccggcaactaaaatagaagactttgaaaactcccacacacctcatatttctccttttatctccaccaattctctcactcattgcgacaaacacaaagaaagcagctgagcagccatggcttcttcctcctctctcacgctctctcaagccatcctctcccgcacctccatcccccgccatggctccgcccagcagctccacccgtcctccgcctccatcccctccttctccggcctcaaatccgcctcctccggtgtcgccaccctctcccgccgccgcgcctccgctatggtacgccatccggtctccgcctctgccgccgtggagaccctcgagaagaccaccgaaaccgagctggtggagaagtccgtcaacaccatccggttcctggccatcgacgccgtggagaaggccaattccggccaccccggtttgccgatgggatgcgcgccgatgggccacatattgtacgatgaggtgatgaggtacaaccctaagaacccctactggttcaaccgcgaccgcttcgttctctccgccggccacggctgtatgctgcagtacgcgcttcttcaccttgccggttacgattccgtcaaggaagatgatttgaagaacttccgacaatgggaaagcaggacacccggtcatcccgagaattttgagacacctggtgttgaagtcaccactggcccacttggtcaaggtattgccaatgccgttggtctggcgcttgcagagaagcacttggccgcgcgatacaacaagccggatagcgagatagttgatcactacacatatgttatccttggtgatgggtgtcaaatggagggtatctcgaatgaagccgcctcccttgctggccactgggggctcggaaagttgattgctttctatgacgacaaccatatctctattgatggtgacacagagattgctttcactgagagcgttgatactcgctttgagggtcttggctggcatataatctgggtgaagaatggtaacactggatacgatgaaattcgtgctgccatcaaggaagccaaggctgtgacagacaagcccactctgattaaggttaccacaaccattggctttggttcccccaacaaagccaattcgtacagtgtccatggaagtgcattgggtgccaaggaagttgaggccaccagacagaatctcggatggccatttgagcctttccatgtgcccgaagatgtgaaaagtcattggagccgacacactcctgaaggggctgctttggaagctgaatggaacgccaagtttgctgaatacgagaagaagtacccagaggaatctgcagagctgaaatccatcatcactggtgccttcccagctggttgggaaaaggcccttcctacatatactcctgagagcccggctgatgccacaagaaatctatctcagcaaaatctcaatgctctagcaaaggttctccctggtctgattggtggcagtgctgatctcgcctcttccaacatgacacttctgaaaatgtttggggacttccaaaagaacacaccagaagagcgtaacgtgaggtttggtgtccgtgaacatggtatgggagccatctgtaacggaattgcccttcacagcccgggtttcatcccctactgtgcaactttcttcgtgttcacggattacatgagagcagccatgaggatctccgccttgtctgaagccggagtcatctacgtcatgacccacgactccatcggactgggagaagacggacccacccatcagccaatcgagcatttggcaagcttccgagccatgcccaacatactgatgctccgtccggctgacggcaacgagacagcaggatcgtacaaggtggctgttctcaacaggaagagaccctccgttcttgccctctctcgccagaagctccctcagcttccgggcacctccatcgaaggcgtggagaagggaggatacaccatctcagacaactcgtctggcaacaagcccgatgtaattctgattggaaccggttcggaactggaaattgcagccaaggctgctgatgagctgagaaaggaaggcaaggcagtgagagtcgtctccttcgtttcttgggaactctttgatgaccaatccgctgagtacaaggagagcgtgctgcccgcctccgtgactgctagggttagcattgaggccgggacaacgttcgggtgggagaagattgttggttcgaaaggaaaggccattggaattgaccgatttggggcaagtgcacctgctgggaagatatacaaggagcttgggatcacggcagaagccgttgtagctgctgccaaggagttgatctaagctttcttcttttctttcggatgtcgatttgtggttgattgaagcacataaaaaacaaggagtcaatttggagcagcagagctgagaattcctaataaagaatacacaaatctcttatttccttttttgtatgagtttttgtagtctaaatgtgatcgagagatattaggcacaagaatcctcttgaatatgtaaactcgaacatct

SEQ ID NO: 9038 - DNA, 2959 bp, Prunus mume
aataaacaaatatgttctcaattttggtttggatagtggaaaaaatggaaggcagagcatttcctaattcctaccctcagtccacggtcgagattggatctgtgctgaatctaacggtcagctcatctctctacctgtcctcttgtgcagacgagaagctcaaagcccggctctcctaccccgataaaaccaaagagccgcaaacggtatcacaggctctcaaaagtctctctttctctctctctctctctctctcagccatagccagaaccacagagcaaaagccatgacttcgtctacatctgtgactctgtctcaagcccttttggctcgcgccatttctcaccatggctcgagctcaacctcagaccgggtctctctctctgcagccctcactctaccaactttctccggtctcaaatccacttcatcgtcgccatcgtcgtcgtcttcgacgtcatccaagctctctcggttccagcgccgccgtgtaggcgcgaacaggccggtccgggccgccgccgtcgagactctggacaagaccacagagacctctttggtcgagaagtcggtcaacacgatccgatttttggccattgatgctgtagagaaggccaattcgggtcaccccggtttgcccatgggctgtgctccaatgggtcatattttgtacgatgagatcatgaggtacaaccccaagaacccgtactggttcaaccgtgaccggttcgtgttgtctgctggacacgggtgtatgttgcaatacgctttgcttcaccttgctggatatgacagtgtcaaggaagaagacttgaaaggcttccgtcaatggggaagcaagacccctggacatcctgagaactttgaaacacctggtgttgaagtcacaactggtcctttggggcaaggcattgcaaatgctgttggtttggcccttgctgagaagcacttggctgcacgtttcaacaagccagacagtgagatcgttgaccactacacatatgtgatattgggtgatggttgtcaaatggagggtatttcaaatgaagttgcttctcttgcggggcattggggacttgggaagctgatagccttctatgatgataaccacatttccattgatggagacactgagattgcattcactgagagtgttgatacccgttttgagggtcttgggtggcacgttatctgggtgaagaatggaaacaccgggtatgatgagattcgagctgccatcaaggaagcaaaggctgtcacagatagacccactttgataaaggtgacaacaaccattggttttggatctccaaacaaagcaaactcatacagtgttcatggtgctgcattgggtgctaaggaagtggatgctacccggaagaaccttggatggccatatgagcctttccatgtaccagaggatgttaaaagtcattggagtcgccataccgctgagggttctgctcttgaagctgaatggaatgccaagtttgctgaatatgagaagaagtacaaggaggaagctgcagagctgaagtccatcattacgggtgagctaccagctggttgggaaaaagcacttccgacttacactccagagagcccagctgatgctacccgaaatttatctcaagcaaacctaaatgcccttgtgaaggttctccctggtcttcttggtggaagtgcagaccttgcttcttcaaacatgactttactaaaaagttttggagacttccagaagaataccccggaagaacgcaatgttaggtttggtgttagggagcatgggatgggagccatctgcaatgggattgcccttcacagccctggcctcattccgtactgtgccactttctttgttttcacggactacatgagagctgccataaggatctctgccttgtcagaggctggagttatctatgttatgacccatgattcaattgggcttggagaagatggaccaacccatcaaccaatagagcacttggcaagtttccgggcaatgcccaacattttgatgctccgcccagctgatgggaatgagactgctgggtcatacagggttgcagtccttaacaggaagaggccatctatcctcgccctctctcgccaaaagctgcccaatcttcctgggacttccattgagggagtcgagaagggtggttacattatatcagacaactcttcaggtaacaagccagatgtcattttgcttgcaactggctccgagttggaaattgctttcaaagctggtgaggaactcagaaaggaagggaaggctgttagagttgtctcctttgtttcttgggaactctttgatgagcaatcagatgcctacaaggaaagtgttttgccggctgcagtaacagcaagagttagcattgaagctggatcaacatttgggtgggaaaagcttcttggaagcaaaggaaaggctattggaattgatcattttggggcaagtgcaccagctggaaaaatatacaaggagtttggccttaccgttgaggcagttattgcagcagcaaaagaagttagctaggcaacttgttatttagcaaatttggttttggttggagatcaaggtaagaggccatattcttgtgatttgtttcacagtatggtctcttttgttttaataaaatattattttccatttgttgcttataattcttcagtgaagcaacatggatcaaaagagagggtagggtatgagaatgctcttgtattttgtaacaactcttggacctgtcttgagttttgtaatgctaatgctctgtggttaatcaatgagtttcactttctccatcattttcttcactttgtaactcagaaactatttgggattgtctattttgtaataagaagggcagctttacacttggaataaatattgtaactgttatttttcaggtaaataaagtagggcaatccatttgtgtgttccctccataaa

SEQ ID NO: 9039 - DNA, 2511 bp, Tripterygium wilfordii
agagcattagcaatggcctcctcttcttctcttacactttctcaggcccttcttgctagagccatttctcaccaccaaagccccgaccactgtctctccccctccaacctctctttccctgctattttctggccttaagtcaaccacttctcagaatccacgcgccgccgcctccgcctcccgccgccgaattcccactcgccagctcactgtccgagcagctgcagtagagaccctcgatgctaccgccgagacttcattggtggagaaatcggttaatacaatcagattcttggccattgatgccgttgagaaggcgaattcgggtcacccgggattacccatgggatgtgctccgatgggtcatatattgtacgatgaaatcatgcggtacaaccccaagaacccctactggttcaaccgtgatcgcttcgttttatccgccggtcacgggtgtatgttgcagtatgctttgcttcacctcgctggctacgatagtgtcaaggaggaggacttgaagagcttccgtcaatggggaagcaaaacccctggacacccggagaactttgagactcccggtgttgaagttaccactggtccccttgggcagggtattgccaatgctgtcggtttggcccttgctgagaagcacctagctgctcgtttcaacaagccagacaatgagattattgatcactacacatattgtatattgggggatggttgtcaaatggaaggtatttcaaatgaagcttgttcccttgctgcgcactggggtcttgggaagctgatagctttctatgatgataaccacatttccatagatggtgacactgagattgcattcactgagaatgttgacactcgttttgagggtcttggatggcatgttatctgggtgaaaaatgggaacaatggctatgatgaaattcgtgctgccatcaaggaagcaaaggctgtcaaggacaagccaactttgatcaaggtgaccacaactataggttttggatctccaaacaaggcaaactcatacagtgttcatgggagtgcacttggtgctaaggaggtggatgcaacaaggaagaaccttggatggccttacgagcctttccacgtgcctgaggatgttaaaaagcattggagtcgtcatgttcctgagggtgctgctcttgaagctgactggagtgctaaatttgccaagtatgagaagaattacaaggaggatgctgcagagctgaagtctatcattacaggtgaactacctgctggttgggagaaggcccttccgacatacactactgagagcccagctgatgcaaccagaaatctatcccagcaatgtcttaatgctcttgcaaaagttcttcctggtttccttggtggcagtgcagaccttgcttcttccaacatgaccttgctgaaaagttttggggacttccaaaaggacacaccagaagaacgcaatgttagatttggtgttagagagcatagtatgggagctatctgcaatggcattgctcttcacagccctggcctgattccatactgtgctaccttcttcgtattcactgactacatgagagctgctatcagaatttctgccttatgtgaagctagggttatatatgttatgacccatgattcaattggcctgggagaagatggaccaactcatcaaccaattgaacacttggcaagcttccgggcaatgcccaacattttgatgctacgccctgctgatggaaatgagactgctggtgcttacaaggttgctgtcctcaacaggaagagaccctctatccttgccctgtctcgacaaaagctgccccaacttgccggaacttcagttgaaggagtcgaaaagggaggttacattatttcagacaattcttcgggtaacaagccagatgttattttgttgggaactggttctgaattggaaattgctgccaaagccgctgaggaactaagaaaggaagggaaggctgtaagagttgtgtcctttgtatcttgggagctttttgatgatcaatcagatgcatacaaggaaagtgttctaccggctgctgtaacagctagggtaagcattgaagccggaacaacatttggttgggagaaaatagttgggagcaaaggaaaggctatcggaattgacaggttcggggctagcgcacctgcaggtaaaatatacaaggagtttggcatcactcctgaggctgttatagcagctgctaaagaagtttcctagatgctatcatcttgtttttggatttgggttggagaatacacaaaccggctgttctcttaagtgaggtagcctcttttatttgaaataaggagttagattgaaatttctgttgcataaaaaattgcttagtgaagaagcatcatggatcaattaggagagggtttatgaatgtttggaatttgtctttaagttttgtaatgttctgtttgttagctaaatgaggttcgagattctgcctgtgttcatcctattttatgtgaata

SEQ ID NO: 9040 - DNA, 2647 bp, Platanus occidentalis
tcttcccgaatcctcaccaactgtttcagcgtagtttgaaactacactcctcacttctcttccccaacaactcaacaatggcggcctcttcttccctcacagtatctcaagcccttgtgggtcgcaccatagctcaccatggctctacctcacactctgaccgtctcgcccttcctgggttcagcctcagtaccctcgccggccgaggcatcaaatcgtctccttctcaatctccgcgtgcccccggtgcccagaagcgcgtgagctctcgatcgttagtccgtgcggctgcggtggagaccctcgacaagactgagacgagtttggtggagaagtcgattaatacgattcggtttctagcgattgatgctgtcgagaaggcgaattctgggcaccccggtttgccgatggggtgtgctccgatgggacatattttgtatgatgaggtgatgaggtacaaccccaagaatccttactggttcaatcgtgatcggttcgtgctctctgctggacatgggtgtatgctgcagtacgctttgcttcaccttgctggatacgacagtgttaaggaagaagacctgaagtctttccgtcaatggggaagtaagactcctggtcaccccgagaattttgaaacacccggttgtgaagtcaccacaggtcctcttggacagggtatcgccaacgctgtcgggttggctcttgcagagaagcacttggctgcccgttacaacaaacctgacaatgagattgtcgatcattacacatatgtaatacttggggatggttgtcaaatggaagggatttcaaacgaagcttgttcccttgctgggcattggggacttgggaagctgatcgctttctatgatgacaatcacatctccattgatggtgacaccgatattgcattcactgagagcgtcgacacccgttttgagggtcttggttggcacgtgatttgggtaaagaatggtaacactgggtacgatgacattcgtgctgccatcaaggaagcaaaggctgtaaaagacaaacccactttgatcaaggtgactaccaccattggttttgggtccccaaacaaggcgaactcgtacagtgtacacggaagtgcattgggtgccaaagaagtggatgccacaaggaagaatcttggttggccatatgagcctttccatgtgcccgaggatgtgaagaagcattggagccgccacgtccctgagggtgcttctcttgaagctgaatggaatgccaagttcacagagtacgagaagaagtataaggaggaagctgcagagttgaaatctattgttagcggtgaacttcctgccggttgggagaaggctcttccaacttacactccagagagccctgccgatgccaccagaaatttatctcaacagtgcctcaatgcacttgcaaaagttctcccaggacttcttggtggtagtgcagatcttgcttcctccaacatgaccttgctgaagatgtttggggatttccaaaaagacaccccagaggagaggaacgttcgttttggtgttagggagcatggcatgggtgccatctgcaatgggattgccctccacagccctggacttatcccctactgtgcaacattctttgtgttcactgactacatgagggctgcaataaggatctcagccttgtgtgaggctggagttatctatgtgatgacccacgattcaattggtcttggagaggatgggccaacccatcagccaatcgagcacttggctagcttcagggccatgcctaacatcctgatgctccgccccgccgatgggaatgagactgctggtgcatacagggttgcagttcttaacagtaagagaccctcaatccttgcgctctctcgtcagaagctaccccagcttccaggaacatccattgaaggagttgaaaagggagggtatgtcatatcagacaattcttcaggaaacaagccagacgtcatcttgattggtactggttccgaattggagattgctgccaaggccgccgatgaactccggaaggaagggaaggcggtccgggttgtctcctttgtttcatgggagctgttcgatgagcagtctgatgcatacaaggagagtgtcctcccagctgctgtctctgccagggttagtattgaggctggatcaacatttggatgggggaagattgtgggaagcaaggggaaagcaatcgggatcgaccgttttggagcgagtgcacctgctggaaaaatatacaaggaattcggcctaacagctgaggctatcattgcagcagccaaggcactttgctagggttatgttagtggttgttctgtcttcactttatttggcatttggattttggattttgggtccctgctttcctgagtttgcaaaatacagtgtagaatagaccagtcttgagagattgagtcagtaaatggcctcttggattataataaaaaaaaactttaatttttcccctgccctcttatgggcatcaatggagcagttgagtctccaaatggaattaagagcaagagagtcataagtttgatgaatgttcacaaaatgtataccaactcttcatgaatctattttgaatcttgtaaccttttcaaggttaattcctagtgaagttcaattat

SEQ ID NO: 9041 - DNA, 2766 bp, Theobroma cacao
gactctggcatcctctccctcgaatatatcaattaaagttaactctctcttttcaacattaccaaaggaagagcggtctgtctcttcaccaaactcgccgtctcactgactcgattagaaaacaatggcctcaacttcatctaccaccctatcccaagccctcttggctcgcgccatctcttaccatggctccacccagtcctccgaccaccgcgtctctctctccaccctctctctccccaccttctctggcctcaaatccactacctcacgtgcttcggcttttcgtagacgccctcccgtgcgctcctaccagaaccgccaagtccgtgccgccgccgtggagacaattggcactgccgcggagacttccttggtggagaaatcggtcaatacgatcagattcctggccattgatgctgtcgagaaggcgaattcgggtcatcctgggttgcctatgggctgtgctccgatgggccacattttgtacgatgaagtcatgaggtataacccgaagaacccttattggttcaaccgtgaccgtttcgtgttgtccgctggtcacggttgtatgttgcagtatgctctgcttcacctcgctggttacgacagtgtcctggaagaagatttgaagaatttccgtcagtggggtagcaaaaccccaggacatcctgagaactttgaaacacttggagttgaagtcacaactggtcctcttggtcaaggtgttgcgaatgctgtcggattggctcttgcggagaaacacttggctgctagattcaacaagccagacaatgagatcgttgaccactacacatatgttattttgggagatgggtgtcaaatggagggtattgcaaatgaagcatgttcacttgctggacactggggacttgggaagcttatagctttctatgatgacaaccacatttccattgatggtgacactgaaattgcctttactgagagtgttgataagcgttttgaggggcttgggtggcatgtcatctgggtcaagaatggaaacactggctatgatgatattcgtgctgctattaaggaagcaaaggctgttaaagacaaacccactttgatcaagctgacaaccaccattggttatggatccccgaacaaggcaaactcatacagtgtacatgggagtgcactgggtgccaaggaagtggatgctactaggaaaaatcttggatggccatatgagcctttccatgtacctgaagatgttaaaacgcactggagtcgccatgtccctcagggtgctgctcttgaagccgaatggaatgccaagtttgctgaatatgagaagaagtacaaagaggaagctgcagagctcaagacaatcatcactggtgaactacctgctggatgggagaaggcacttccgacatacactccagagagcccacctgatgctaccagaaatctctctcaacaaaatctcaatgcccttgtaaaagtactccctggtcttcttggtggaagtgcagaccttgcttcttccaacatgaccttgctcaaaatgtatggtgatttccagaaggacacccctgaggaacgcaatgttaggtttggtgttagggaacatggaatgggagccatctcaaatggcattgcccttcacagccctggtctgattccatactgtgctactttctttgtctttactgactacatgagagctgccatcaggatttctgccttgtgtgaagctggagttatctatgttatgacccatgattccattggtcttggggaagatggaccaacccaccagccaattgagcacttggcgagcttccgtgcaatgcctaacattttaatgctccgtccagctgatggaaatgaaactgctggtgcatacaaggttgctgtcctcaacaggaagagaccctcaattcttgctctctctcggcaaaagctgccccaacttgctggaacttccattgagggagttgaaaagggtggctacattgtttcagacaattcttcaggcaacaagcctgatgtaattctgattggaactggttctgagctagagattgctgctaaagctgctgaggaactaaggaatggaggaaaggctgttagggttgtctccctggtttcttgggagctctttgatgagcaatctgatgcctacaaggaaagtgttttgccatctgctgtatcagctagggtgagtattgaggctggatcaacatttggatgggagaagatagttggatccaaaggaaagtcaataggaattgaccggtttggcgcaagtgcaccagcaggcagaatatacaaggaatttggtttaaccccagaggctgttgttacagcagcgaaagaactctgctaggcttggttagaagcctccggcgaaacttgtggtttttgttttgggtgaaagattacacgaagaggccattccaatcgtaacagtctcttttgttttaataagaagcagaattaaatcttcttctgttgcttatgattcatcaatagcaacatagagcgaaagggtgggtagagtttctgtgtgcttatgaatttgtaactcctcttgggcttctcccagagttttgcaatacttcttgttgctttaaattagctgacccttgtcctcttacattttctttttttcacgttagaacggaagttatctactattgtaattttgattagtggtcgagaacctcaaaaattattattgttcgaacatgtttggccttaagatgtaggacccagtttgtataatttcgc

SEQ ID NO: 9042 - DNA, 2733 bp, Ricinus communis
caccaaacgaaagaaaaaaaaaaaaaaaaagcagaggaggagagaaatggcgtctacttcatctctaactctatcacaagctctcttggctcgagccatttctcaccatgtctcaacccaatcctctgaccgtctctctctctccacaccttccctccctgccttttccggactcaagtccacctcttcttccatcccacgcgccacctcctcccgccgcagtcgccgcaacagcagcatccccaccgctcgccgcctccagaccccaaccagagcagctgccgttgaaactctggatgtcactactgatacttcattggttgagaaatctgtcaatacaattagatttcttgctattgatgctgttgaaaaggccaattcaggtcatcccggtctacccatgggttgtgctcccatgggtcatattttgtacgatgaaataatgaaatataatccaaagaatccttattggttcaatcgtgatcgctttgtattgtctgctggtcatggatgtatgttgcagtacgctttgcttcaccttgctggttatgatagtgtcaaggaagaagacttaaagagtttccgtcaatggggaagtaaaacccctgggcatcctgagaactttgagacacctggtgttgaagttacaactggccctcttggacagggtattgccaatgctgttggtttggcacttgctgagaagcacttggctgctcgctttaacaaaccagacaatgaaattgttgaccactacacatatgctattctgggagatgggtgtcagatggagggtattgcaaatgaagcttgttcccttgctggacactggggactaggaaagcttatagctttctatgatgacaaccacatttccattgatggtgacacagaaattgcattcactgagagcgtggacaaacgtttcgaggctcttggatggcatgttatttgggtgaagaatggaaacactggctatgatgaaattcgtgctgccattaaggaggccaaggctgtgacagacaaacccactatgattaaggtcactacgaccataggttatggatctccaaacaaggcaaactcatacagtgtgcatggtagtgcattgggtgccaaggaagttgacgctactaggaagaaccttggttggccattcgagcctttccatgttccagaggatgttaagaatcactggagccgccatattccaggaggtgctgcttttgaagctgaatggaatgcaaagtttgcagagtatgagaagaagtacaaggaggaagctgcagagttgaagtctatcatcaagggtgaactacctgctggttgggaaaaggcacttccaacatatacaccagaaagcccagcagatgctacaagaaacctgtctcaggcaaacctaaatgcacttgcaaaggttctccctggtcttctcggtggcagtgcagatcttgcttcttcaaacatgaccttgttgaaaatgtttggggacttccaaaaagatacccctgaagaacgtaatgtcaggtttggtgtcagggagcatggaatgggagccatctgcaatggcattgcacttcatagccctggcttgatcccatattgtgcaacattctttgttttcactgactacatgagggctgctatgagaatttctgccttgtctgaggctggagtcatctatgttatgacgcacgactcgattggtcttggagaagatggaccaacccatcaaccaattgagcacctggcaagcttccgtgcaatgcctaacatcttgatgttccgcccagctgatggaaatgaaactgctggtgcatacagaattgctgtcctcaacaggaagagaccatctgtccttgcactctccagacaaaagctaccccaacttcctggaacctccattgagggagtagaaaagggtggctacacaatttctgataattcttcaggaaacaagcctgatgttattttgattggaactggctccgaattggaaattgctgccaaggctgcagaagaacttagaagggagggcaaggctgtaagagttgtctcctttgtgtcatgggagcttttcgatgagcaatcagatgcctacaaggaaagtgttctgccagcagctgtaacagcaagagttagcattgaagccggttcaacatttggttggcagaagattgttggaggaaaaggtaaggctattggaatagaccgatttggggctagcgcaccagctggtaagatatacaaggagtacggcattactgcagaggcagtaattgctgcagcaaaagaactttgctaggctagattaaatcttttcatctgggatttgggttgcggaatacagggaagaggccatcgcgaagagagctaagctattcgaagagtgggtctgtttgtttcaataaaggaaaaacaagattaaattttcgtctgttgctttcaagttgatcaattgagcaacataattcaaaagaggagagttggattataaatgtctcgagtttgtaacaactctttggacctatcttgagttttgtaatttctttgtgtttgtagtgaggttgccaattacttattattgcatcttttaccttcacgcagaatcagaatcttattttgatcgccatttttatttttggttgtgttgagaatgcttatgatagcattttgtaagtctctctgtaaccatgtggtccctgtcgaccacaaaaataataaccagcaaga

SEQ ID NO: 9043 - DNA, 2672 bp, Prunus persica
ccatgacctcgtctacatctgtgactctgtctcaagcccttttggctcgcgccatttctcaccatggctcgagctcaacctcagaccgggtctctctctctgcagccctcactctaccaactttctccggtctcaaatccacttcatcgtcgccatcatcgtcgtcttcgacgtcatccaagctctctcggttccagcgccgccgtctaggcgcgaacaggccggtccgggccgccgccgtcgagactctggacaagaccacagagacctctttggtcgagaagtcggtcaacacgatccgattcttggccattgatgctgtagagaaggccaattcgggtcaccccggtttgccaatgggctgtgctccaatgggtcatattttgtacgatgagatcatgaggtacaaccccaagaacccgtactggttcaaccgtgaccggttcgtgttgtctgctggacacgggtgtatgttgcaatacgctttgcttcaccttgctggatatgacagtgtcaaggaagaagacttgaaaggcttccgtcaatggggaagcaagacccctggacatcctgagaactttgagacacctggtgttgaagtcacaactggtcctttggggcaaggcattgcaaatgctgttggtttggcccttgctgagaagcacttggctgcacgttacaacaagccagacagtgagatcgttgaccactacacatatgttatattgggtgatggttgtcaaatggagggtatttcaaacgaagctgcttctcttgcggggcattggggacttgggaagctgatagccttctatgatgataaccacatttccattgatggagacactgagattgcattcactgagagtgttgatacccgttttgagggtcttgggtggcacgttatctgggtgaagaatggaaacaccgggtatgatgagattcgagctgccatcaaggaagcaaaggctgtcacagatagacccactttgataaaggtgacaacaaccattggttttggatctccaaacaaagcaaactcgtacagtgttcatggtgctgcattgggtgccaaggaagtggatgctacccggaagaaccttggatggccatatgagcctttccatgtaccagaggatgttaaaagtcattggagtcgccataccgctgagggttctgctcttgaagctgaatggaatgccaagtttgctgaatatgagaagaagtacaaggaggaagctgcagagctgaaatccatcatttcgggtgagctaccagctggttgggaaaaagcacttccgacttacactccagagaacccagctgatgctacccgaaatttatctcaagcaaacctaaatgcccttgcgaaggttctccctggtcttcttggtggaagtgcagaccttgcttcttccaacatgactttgctaaaaagttttggagacttccagaagaacaccccggaagaacgcaatgttaggtttggtgttagggagcatgggatgggagccatctgcaatgggattgcccttcacagcccaggcctcattccatactgtgccactttctttgttttcacggactacatgagagctgccataaggatctctgccttgtcagaggctggagttatctatgttatgacccatgattcaattgggcttggagaagatggaccaacccatcaaccaatagagcacttggcaagtttccgggcaatgcccaacattttgatgctccgcccagctgatgggaatgagactgctggggcatacagggttgcagtccttaacaggaagaggccatctatcctagccctctctcgccaaaagctgcccaatcttcctgggacttccattgagggagtcgagaagggtggttacattatatcagacaactcttcaggtaacaagccagatgtcattttgattgcaactggctccgagttggaaattgttttcaaagctggtgaggaactcagaaaagaagggaaggctgttagagttgtctcctttgtttcttgggaactctttgatggccaatcagatgcctacaaggaaagtgttttgccggctgcagtaacagcaagagttagcattgaagctggatcaacatttgggtggcaaaagcttgttggaagcaaaggaaaggctattggaattgatcattttggggcaagtgcaccagctggaaaaatatacaaggagtttggccttaccgtcgaggcagttattgcagcagcaaaagaagttagctaggcaacttgttatttagcaatttggttttggatggagatcaaggtaagaggccatattcttgtgatttgtttcacagtatggcctcttttgttttaataaaatattattttccgtttgttgcttataattcttcagtgaagcaacatggatcaaaagagagggtagggtatgagaatgctcttcttgtattttgtaacaactcttggacctgtcttgagttttgtaatgctaatgctcactggttaatcaatgagtgtcactttctccatcattttcttcactttgtaactcagaaactatttgggattgtctattttgtaataagaagggcagctttacacttggaataaatattataactgttattttcaggtaaataaagtagggcaatccatttgtgtgttccctcca

SEQ ID NO: 9044 - DNA, 2695 bp, Quercus alba
ctcggactctccatcattagctcctctctctctctctctctctctctgaaaatctctctcttcttcgaggttgagccatggcttcctctacatctctgaccctatcccaagctcttctagcccgcgccacctctcttcaccacggctccacccaatcctccaccgaccgcgtctccctctccactttcaccggtctcaaatcctcctcctccaccaccccgctcatctcctcctcccgccgcgccgccaaccgccgatgcgcttccctgcccggcccgacccgtgcccgaccgggcgtagtcaaggccgtttccgtcgagaccgcggtggaccaggcagccgacaccgcattagtggagaagtcgatcaacacgatccggttcctcgcgatcgacgccgtcgagaaggcgaattcgggtcacccgggcctgcccatgggctgcgccccgatggggcacgtgttgtacgacgaggtcatgaggtacaacccgaagaacccgtactggttcaaccgtgaccgcttcgtcctctccgcgggtcacggttgtatgctacagtacgctcttcttcacctcgctggttacgacagcgtccaggaagaagatttgaagggtttcagacagtggggaagcaagacccctggacaccctgagaattttgagacacctggtgttgaagtcacaactggtcctcttgggcagggtattgccaatgctgttggtttggctcttgctgagaaacacttggctgctcgtttcaacaagcccgacagtgagatcgttgatcattacacatatgctatattgggagatggttgtcaaatggaggggatttcgaatgaagcctgttcgcttgctggacactgggggcttgggaagttgattgctttctatgatgataaccacatttctattgatggtgacaccgagattgcattcaccgagagtgttgacaaacgttttgagggtcttgggtggcacgttatttgggtgaagaatggaaacactggctatgatgaaattcgtgctgctattaaggaagctaaggctgtgacagacaagcccactttgatcaaggtgactacaaccattggttttgggtctccaaacaaggcaaactcatacagtgtacatggaagtgctctgggtgccaaggaagtagatgccactaggaaaaaccttggatggccatttgagcctttccatgtgccagaggatgttaaaaagcattggagtcgccatgtccccaagggttctgctcttgaagctgaatggaatgccaagtttgctgaatatgagaagaagtacaaggaggaggctgcagagctcaagtctattgctaatggtgaactacctgttggctgggagaaagcccttcctacatacactccggagagcccagctgatgccaccagaaatctgtctcagcaatgccttaatgcactagcaaaggttctccctggtctcctaggtggtagtgcggatcttgcatcttccaacatgacattgctgaaaatgtttggggacttccaaaaggacaccccagaagagcgcaatgttaggtttggtgttagagagcatggcatgggagccatttgcaatggcattgcccttcacagccctggtctgattccatactgtgctactttttttgttttcaccgactacatgagagcagctatcaggatttctgccttatctgaagccggagttatctacgttatgacccatgattcaattgggcttggagaagatggcccaacccatcagccaatagagcacattgcaagtttccgggcaatgcccaacatattgatgctccgcccagctgatggaaatgagactgctggagcatacaaggttgcagttcttaacaggaagagaccctctatccttgccctttctcggcaaaagctgaaacaacttcctggaacttccatcgaaggagttgaaaagggaggctacattatttcagacaattcttctggtaacaagccagatgttattttgattggaactggttctgaattggaaattgctgctcaagctgcagaggaactaagaaaggaaggcaaggctgttagagttgtctcgttcatctcttgggaactctttgatgagcaatcagatgcctacaaggaaagtgttttgccagcagctgtgtcagctagggttagcatcgaggctggatcaacatttgggtgggagaaaattgttggaagcaaaggtaaggcgataggtattgaccggtttggcgcaagtgctccagcagggaaaatatacaaggagtacggtcttactgcagaggctgttattgcagcagctaaggaactttcttaggcttggtttgttcgtctgtcacgaaaacttgccattcggcaattgggtttgggttgggaatttcaatgaggaaaccattcctagagatctgttttgcaacacggtctcttctactacaataaaaggcaagattaaattttcttctgttgttatgattccccagtggagcatatagatcaaagagagagtagggtttaatgaattttcatgaatttgtaacaactcttggacatgtcttgagttttgtaattttatgtggttgattttaacgagcttcttcatacttcataaacctctgtcactgtcttcattattagttgttttagcttttggagcaatcggatcatctttatgaa

SEQ ID NO: 9045 - DNA, 2681 bp, Populus trichocarpa
aataaatttagctcttcctaaaaatatcaacagacccaacaaccgtaagagagatagaaatagagagtttcagtctttcagaattcaagaatggcttccacttcttctcttactctgtctcaagcccttttggctagagctatttctcatcacgccactgaccaacgccgtgacagccgcctctctcttgtctccctccctgctttctccggcctcaaatcgaccacctctacagcctcacgcgccaccacaaccactaaccgccggcgtcgtgtgtcttcccgtcatgtaagggcggcggcagtggagacattggatgcgacgacagagacttcactggtggagaagtcggttaatacaattagatttcttgctatcgatgctgttgaaaaggccaattcgggtcaccccggtttacctatggggtgtgctccgatgggtcatatcttgtacgatgaggttatgaggtataatccgaagaacccatactggttcaatcgtgatcggtttgttttgtctgctggtcatggctgtatgttacaatatgctctgcttcaccttgctggttatgatagtgtcaaggaagaagacttgaagagtttccgtcaatggggaagcaggacacctggacatcctgagaacttcgagactcctggcgttgaagtcacaactggtcctcttggacagggtgttgccaatgctgttggtttggcacttgctgagaagcacttggctgctcgcttcaacaaaccggacagtgaaattgttgaccactacacatatattatattgggggacggttgtcaaatggagggtatttcaaatgaggcttgctccttggctgcacattgggggcttggaaagctgattgctttctatgatgacaaccatatctccattgatggtgacactgagattgcattcaccgaggatgttgacaaacgttttgagggtcttgggtggcatgttatctgggtgaagaatggaaacaatggatatgatgagattcgggctgccatcaaggaggccaaggctgtaaaagacaaacccactttgatcaaggtcactacaaccattggttatggatctccaaacaaagcaaactcatacagtgtccatgggagtgcattgggtgccaaggaagttgatgctaccaggcagaaccttggatggccatttgagcctttccatgttccagaggatgttaagcagcactggagccgccacatcccagctggtgctgctttcgaagccgaatggaacaccaagtttgctgagtatgagaagaagtatagtgaagaagctgcagagttcaagtctatcatgactggtgaactacctactggttgggagaaagcacttcccacatacactcccgagagcccagcagatgccaccagaaatctatctcagcaaaacttaaatgcacttgcaaaagtgctccctggtcttcttggtggcagtgcagatctcgcctcttctaacatgaccttgttgaaaatgtttggggacttccaaaaggatacccctgaggaacgcaatgtcaggtttggtgttagagagcatggaatgggaggcatctgcaatggcattgcacttcacagtcctggcttgattccctactgtgctactttctttgttttcactgactacatgagaggtgccataaggatttctgctttgagtgaggctggagtcatctatgtcatgacccatgattccattggacttggagaagatggaccaacccatcaaccaattgagcacttggcaagcttccgtgcaatgcccaacattctgatgctccgcccagctgatggaaatgaaactgctggtgcatacaaagttgctgtcctcaacaggaagagaccttctatccttgccctctccaggcaaaagctaccccatcttcctggaacctccatcgagggagttgaaaagggtggctacatcctttcagataactcctctggtaacaagcctgatgtcatcctgatgggtactggttcagagttggaaattgcagctaaagctgccgaggaacttagaaaggagggcaaggctgtgagagttgtctcctttgtttcatgggagctttttgatgagcaatcagatgcgtacaaggaaagtgttctgccagcagctgtaacagctagggttagcattgaagctggatcaacatttgggtggcagaagcttgttggagccaaaggcaaggctattggaattgaccggtttggagcaagcgcaccagcaggtaaaatatacaaggagtttggtattaccgcggaggctgttatcgcagcagccaaagaatttagctaggcagatctatattcgttcacgatatcttgctaaatgcgcatttgaggtttgtattagaaaaatacagaggagaggctgttccggaagacctgtttcattacttggcctcgtttgtttcaataaaagactcagattaaatattcttctgctgcttgtaagtggtcagttgaggaacctggatcaaagatagagtttaggtttatgaataatcctgaatttgtaacagctcttggacctctcttgagttttgtagttttctttggttacttgaatgagttgaagacgaattattatttttccttcatgttattaagcagcgcaaaggtatttgctctgattctcagttttcatctctc

SEQ ID NO: 9046 - DNA, 2184 bp, Vicia sativa
cccctcctccacctcctccctctccttcccctctctcaaacccaaaccacccacctcctcaaccatttcacgtcgcagaacaccaacaccaacaaccaccgtccgtgcaaccgctgttgaaacactcgacaaaaccgctgaggtttctcttgttgagaaatcagttaacactattcggtttctcgctattgatgccgttgaaaaagccaattccggtcaccctggtttacccatgggttgtgctccaatgggccatatactatacgatgaaatcatgagatataaccccaagaatccttcttggtttaaccgtgatcgctttgttttgtctgctggacatggttgtatgcttcagtatgctcttcttcatcttgccggctatgacagtgtcaaggaagaagacttgaagcagtttcgacaatgggggagtaaaactcctggacatccagagaattttgagacttacggaattgaagtcaccacaggtcctctgggtcagggtattgccaatggtgttggattagcacttgctgagaaacatttggctgcgcggtttaacaagcccgacagtgagattgttgaccattacacgtatgttatattgggtgatggttgtcaaatggaaggaatttcaaatgaagcatgctcacttgctggacattggggtctcgggaaacttatcgcattttatgatgataaccacatttccattgacggtgacactgaaattgcattcactgaaaatgttgatcaacgtttcgaggcacttgggtggcatgtggtttgggtaaagaatggaaatactgggtatgatgaaatccgtgctgccattaaggaagcaaaggctgtcacagacaaacctactttgattaaggtaaccactaccatcggatttggttctccaaacaaggctaattcctacagtgttcacggagccgcattgggttctaaagaagtggacgctacaaggcagaaccttggatggccatatgagcctttccatgtcccagaagatgttaaaaagcattggagtcgacatacccctgagggtgctgcacttgaagctgagtggaatactaagtttgctgagtatgagaagaaatacaaagaggaagctgcagagctaaaggctattattaatcgtgaattacccgctgattgggagaaagcactcccgacatacactccagaaacccctgccgacgctacaagaaatttgtcacaagcaaatctaaatgccctggctaaggttcttcctggtcttattggtggtagtgcagatcttgcctcttccaacatgaccttgttgaaatcgtttggagatttccaaaaggctactccagaagagcgcaatgttcggtttggtgttagggaacacgcaatgggagcaatctgcaatggtattgctcttcatagccctggattcattccatactgtgcaactttctttgtcttcactgactacatgagagctgccataaggatttccgccttgagtgaagccggagttatttatgttatgacccatgattcaattggacttggagaggacgggccaactcatcagccaatagagcacctggctagcttccgggcgatgccaaatgttttgatgcttcgtccagctgatggtaatgaaactgctggatcatacagagttgccgtgcttaacccgaagagaccctcaattcttgccctttctcggcaaaagttgccaaaccttccgggaacttctattgaaggagtagaaaagggaggctacaccatttcagacaactcatcaggtaacaaacctgatgttatcttgattggaactggttctgagttggaaatagccgcggctgccgccgatgatctaaggaaagaaggaaaaactgtaagagttgtttcttttgttagctgggaactttttgatgatcagtcagatgaatacaaggagagtgttctccctgcttctgttactgcaagagtcagcattgaggcaggatcaactttcggttggcacaagatagtcggaagcaagggaaaaaccataggtattgatcggttcggagcaagtgctccagcaggaaaaatatacaaggagtacggtataaccaaggaagccgttatttctgccgctaaagaagtttcatagatctattgatgttctgtttcccgagatattaagatttgtattactac

SEQ ID NO: 9047 - DNA, 2595 bp, Citrullus lanatus
tcgaaacccatttctcttcaaaacggtaccaaaacccactctgcttctcacacagccttcgatcttcttcagctatggcttccacttcctctgcggctctttcacaagccgtattgccccgagccatctctcaccatgcttcaaatgcatccgctgatcgcgtttctctttcttctcgctctcttcccagtttttccggtctcaaatccaccaactccgccgccgtcgcagcatcatctcgccggactaggccgtctcggagacgatgtggagtggttcgagcttcggtcgccgagacgcttgataaaaccactgagacgtcgttgattgagaagtctgtcaatacgatccgtttcctctcgattgatgctgtggagaaggcgaattcgggccacccgggcttgccgatgggttgtgctccgatgggccatgttttgtacgatgaggttatgaggtataatcccaagaatccttactggtttaatcgggatcggttcgtcttgtcagctggccatggatgtatgttgcagtatgctttgcttcaccttgctggatatgatagtgttaaggaagaggacttaaagaattttcgtcaatgggaaagcagaactcctggacaccccgagaacttcgagacgcctggagttgaagtaacaactggtcctcttggacagggtgttgcaaatgctgttggcttggcacttgctgagaagcatttagctgctcgtttcaacaagccagatagtgaaattgttgaccattacacatatgttatattgggagatggttgccaaatggagggaattgccaatgaagcttgctcgcttgctgggcattggggtctaggcaagctgattgctttctatgatgacaaccacatctcaattgatggcgacacggagattgcattcactgagagtgttgacaaacgattcgagggtctagggtggcatgttatctgggtgaaaaatggaaataatggctacgatgagattcgtgctgccattagggaagcgaaagctgtaaaagataaacccactttgatcaaggtgaccacaaccattggttatggatctccaaacaaggcaaattcttacagtgtacatggtagtgcactgggtgcgaaggaagttgatgccacgagacagaaccttggatggccatacgagcctttccatgtgcccgaggatgttaagaagcactggagtcgtcacatcccccaaggagctgctctggaagctgaatggaacactaagtttgctgaatacgagaagaagtatgcagaggaagctgctgaactgaagtctattattaatggcgaactacctgctggttgggaaaaggcattgccaacatacaccccggagagcccagctgatgccactagaaatctttcccagcaaaaccttaatgcccttgcaaaagttctccctggtttccttggtggaagtgctgaccttgcttcatcaaacatgaccttacttaaatcgttcggaaacttccaaaaggatactcctgaagagcgtaatcttcgatttggtgttagagagcacggaatgggagccatctgcaatggaattgcccttcacagtcctggactcattccatattgtgctacgttctttgtttttacagattacatgagagctgccattaggatatctgccttgagtcaagcgggtgtaatctatgtcatgactcatgattcgatcggtcttggtgaagatgggccaacccatcagccaatcgaacatctggcaagcttcagggctatgccaaacatattgatgctccgaccagctgatggtaatgagactgctggggcgtacaaagttgcagtactaaatcgaaagagaccttccattcttgccctttctcgccaaaagttgcccaatcttcctggaacttccattgaaggagttgagaagggtggatacattctctcggacaattcgtccggtaacaagcccgatgttatcttgattggaaccggttctgaacttgaaattgccgccaaagctgcagaagaactgagaaaggaaggaaaggctgttcgcctcgtttcctttgtctcatgggagcttttcgacgagcaatcagatgcgtacaaggaaagcgttttgcctgctgctgtttctgccagagtgagcattgaggctggaacaacatttgggtgggagaagattgtcggaagcaaaggaaaagcaatcggcattgaccgctttggagcaagtgctccagcagggaaaatttacaaagagtttggcataactgttgaggctgttatcgccgctgctaaacaagttatctagaacaggttagttgtaattcgctgaaacgaatccaacatctaccatttgtttaaatttgggcgggaatttctgtagagaccatttccaagaggtctgttttaatgacatggcctcttatgttgcaataaaaaggtctgagttttctgtccattgtgtgtatgtgtcttttttgtgaagagttattgtttgacgacgatagaaactaggatttctctttttctcataaaacttttttgaacttttgttcttttcaagcaattaagtaatgaggtccaccaccctt

SEQ ID NO: 9048 - DNA, 2439 bp, Tripterygium wilfordii
ttctcttacaatttctcaggcccttctagctagagctatttctcaccaccaaacccccgaccaccgtctctctccctccaacctctcttttcctgcattttctggccttaagtcaaccaattctcaaaccccacgggccgccatctcccgccgacgaattgctagtcgccatagcactgtccgagcagctgcagtagagaccctcgatgctactgccgagacttctttggtggagaaatccattaacactatcagattcttggccattgatgccgtcgagaaggcgaattcgggtcatccgggattgcccatgggatgtgccccgatgggtcatatcttgtacgatgaaatcatgcggtacaaccccaagaacccctactggttcaaccgtgaccgcttcgttttgtccgccggtcacgggtgtatgttgcagtatgctctgcttcacctcgctggctacgatagcgtcaaggaagaggacttgaagagcttccgtcagtggggaagcaaaacccctggacacccagagaactttgagacacctggtgttgaagttaccaccggtccccttgggcagggtattgctaatgctgtcggtttggcgcttgctgagaagcaccttggtgctcggtttaacaaagcagacaatgagattattgatcactatacatattgtatattgggagatggttgtcaaatggaaggcatttcgaatgaagcttgttcccttgctgcacactggggtcttgggaagctgatagctttttatgatgacaaccacatctccatagatggtgacactgagattgcattcactgagagtgttgacacacgttttgagggtcttggttggcatgttatttgggtgaaaaatgggaacactggctatgatgaaattcgtgctgccatcaaggaagcaaaggctgtcaaggacaagccaactttgatcaaggtgacaacaactataggttttggatctccaaacaaggcaaattcatatagtgttcatgggagtgcactcggtgctaaggaggtggatgcaacaaggcagaatcttggatggccgtacgagcctttccacgtgcctgaggaagttaagacgcattggagtcgtcatgctcctgagggtgctgctcttgaagctgcctggaatgccaaattcgcggagtatgagaagaagtaccaggatgaagctgcagagttgaagtctatcattacgggtgaactacctgctggttgggagaaggcccttccgacatacactcctgagagcccagctgatgcaaccagaaacctatctcagcaaaatcttaatgctcttgcaaaagttcttcctggtttcctcggtggtagtgcagaccttgcttcttccaacatgaccttgctgaaaatgtttggggacttccaaaaggacacaccagaagaacgcaatgttagatttggtgttagggagcatgggatgggagctatctgcaatggcattgcccttcacagccctggcctgattccatactgtgctacattctttgtattcactgactatatgagagctgctatcagaatttctgctttatgtgaagctggggttatatatgttatgacccatgattcaattggtctgggagaagatggaccaactcatcaaccaattgaacacttggcaagcttccgggcaatgccaaacattttgatgctacgccctgctgatggaaatgagactgctggtgcatacaaggttgctatcctcaacaggaagagaccctctatccttgccctgtctcgacaaaagctgccccagcttcctggaacttcaattgagggagttgaaaaaggaggttacactatctctgacaattcttcaggtaacaagccagacgttattttgatgggaactggttctgaattggaaattgcagccaaagctgctgaggaactaagaaaggaagggaaggctgtaagagttgtgtcctttgtttcttgggagctttttgatgagcaatcagatgcatacaaggaaagtgttttaccgactgctgtaacagctagggttagcattgaagctgcatcaacatttgggtgggcgaaaattgttgggagcaaaggaaaggctatcggaatcgacacatttggggctagcgcacctgcaggtaaaatatacaaggagtttggtatcactgctgaggctgttatagcagctgctaaagaatttttctagatgatatcatctggttaacaggctgttgtcgtaagtgaggtggcctcttttatttgaaataagaagggagattgaaatttatgttgcataaaaaattgcttagtaaagaagcatcatggatcaattggaaggagaggagggtttatgaaaatgcttagaatttgtaactgaccatgtcttaagttttgtaatgttctgtttgttagttaatgagttcgagattc

SEQ ID NO: 9049 - DNA, 2649 bp, Euonymus alatus
ggggctcccgctctatatctctatctattgatttctctctctaaaagaattgtataaaaccccaaacgatcacatatctcctccctctctctctctctctttttctagctgagcattaagaatggcctccacttcttcccttacactttctcaggcccttctcgctagagccatttctcaccaccaaagccccgaccaccgtctctctcccttcaacctctctttccctgcattttctggccttaagtcaaccaattctctaaccccacgcgccgcctcctcccgccgcagaattcctagtcggcagcgcactgtccgagcagctgcagtggagaccctcgatgctactgccgagacttctttggttgagaaatcgattaacactatcagattcttggctattgatgccgtcgagaaggcgaattcgggtcatccgggattgcccatgggatgtgccccgatgggtcatatcttgtacgatgaaattatgcgatacaaccccaagaacccctactggttcaaccgtgatcgcttcgttttgtccgccggtcacgggtgtatgttgcagtatgctcttcttcacctcgctggctacgatagcgtcgaggaagaggacttgaagagcttccgtcagtggggaagcaaaacccctggacacccagagaactttgagacacctggtgttgaagttaccactggtccccttgggcagggtgttggcaatgctgtcggtttggcgcttgctgagaagcacctagctgctcggtttaacaaggcagataatgagattattgatcactacacatattgtatattgggagatggttgtcaaatggaaggtatttcaaatgaagcttgttcccttgctgcgcactggggacttgggaagctgatagctttttatgatgacaaccacatctccattgatggtgacactgagattgcattcactgagagtgttgacacacgttttgagggtcttggttggcatgttatctgggtgaaagatgggaacactggctatgatgaaattcgtgctgccatcaaggaagcaaaggctgtcaaggacaagccaactttgatcaaggtgaccacaactataggttttggatctccaaacaaggcaaactcatacagcgttcatgggagtgcactcggtgctaaggaggtggatgcaacaaggcagaaccttggatggccttacgagcctttccatgtgcctgaggaagttaaaaagcattggaatcgtcatgttcctgagggtgctgctcttgaagctgcctggaatgccaaatacgccgagtatgagaagaagtacaaggaggaagctgcagagctgaagtctatcattacgggtgaactacctgttggttgggagaaggcccttccgacatacactcctgagagcccagcagatgcaaccagaaacctatctcagcaatgtcttaatgctcttgcaaaagttattcctggtttccttggtggtagtgcagaccttgcttcttctaacatgaccttgctgaaaatgtttggggacttccaaaaggacacaccagaagaacgcaatgttagatttggcgttagggagcatgggatgggagctatctgcaatggcattgcccttcacagccctggcctgattccatactgtgctacattctttgtattcactgactacatgagagctgcgatcagaatttctgcattatgtgaagctggggttatatatgttatgacccatgattcaattggtctgggagaagatgggccaactcatcaaccaattgaacacctggcaagcttccgggcaatgccaaacattttgatgctacgccctgctgatggaaatgagactgctggtgcatacaaggttgctatcgtcaacaggaagagaccctctatccttgctctgtctcgacaaaagctgccccaacttcctggaacttcagttgagggggttgaaaagggaggttacatcatctcagacaattcttcaggtaacaagccagatgttattttgatgggaactggttccgagttggaaattgcagccaaagctgctgaggaactgagaaaggaagggaaggctgtaagagttgtgtccttcgtttcttgggagctttttgatgagcaatcagatgcatacaaggaaagtgttctaccggctgctgtaacagctagggttagcattgaagccgcgtcaacatttgggtggacaaaaattgttgggagcaaaggaaaggctatcggaatcgacaggttcggagctagcgcacctgcaggtaaaatctacaaggaatttggcatcactcctgaggctgttatagcagctgctaaggaatttttctagataatatcatctagtttttggatttgggttggataatactcgaacaggctgttctacttctcgtaagtgaggtggcctcttttatttgaaataataacgatgattgaaatttctgttgcaaaaaagattgcttgctgaagaagcatcatggatcaactagaagggagaggagggagtgtttatgaatgcttagaatttgtaactgaccctgtcttaagtttttgtaatgttctgtttgttagttaaatgaggctcaagattcttcttttcttcatcctatttcatgtcaataaaaggtg

SEQ ID NO: 9050 - DNA, 2360 bp, Cucumis sativus
ctatggcttctacttcatctgcggctctttcacaagccgtattgccacggaccatttcccaccatgcttcaaatccttctgctgatcgtgtttctctttccactcgctctcttcccactttctccggcctcaaatccaccaactccgccgccgtcgttgcatcatctagacggaacaggtcttctcggagtcgatgtggagtggttcgagcttcggtcgctgagactgtcgataaaaccactgacacttcgttgattgagaagtctgtcaatacgatccgtttcctctcgattgatgctgtggagaaggcgaattcgggtcacccgggattgccgatgggttgcgctccgatgggccatgttttgtacgacgaggttatgaggtataatcccaagaatccttactggtttaatcgggatcggttcgtcttgtcagctggccatggatgcatgttgcagtacgctttgcttcaccttgctggatatgatagtgttaaggaagaggacttaaagaatttccgtcaatgggaaagcagaactcctgggcatcccgagaacttcgagacacctggaattgaagtaacaactggtcctcttggacagggtgttgcaaacgctgttggtttggcacttgctgagaagcatttagccgctcgtttcaacaagccagataacgaaatcgtagaccattacacgtatgttatactgggagatgggtgccaaatggagggaattgccaatgaagcttgttcgcttgctgggcactggggactaggcaagctaattgctttctacgatgacaaccacatctcaattgatggtcacacagagattgcattcaccgagaatgttgacaaacgattcgaggctttagggtggcatgtcatctgggtgaaaaatggaaataatggttatgatgagattcgtgctgccattagggaagcgaaagctgtaaaagacaaacccactttgatcaaggtgacaacaactattggttacggatctccaaacaaggcaaattcctacagcgtacatggtagtgcactgggtgcgaaggaagttgatgccacaagacagaaccttggatggccatacgagcctttccatgtgcccgaagatgttaagaagcactggagtcgtcacacccctcaaggagctgctcttgaagccgaatggaacgctaagtttgccgaatacgagaagaaatatgcagaggaagctgctgaactgaagggtattattagtggcgaactacctgctggttgggaaaaagcattgccaacatacaccccggagagcccagcggatgccactagaaatctgtcccaacaaaaccttaatgcccttgcaaaggttcttcctggtttccttggtggcagtgctgaccttgcttcatcaaacatgaccctgcttaaatcattcggaaacttccaaaaggacactcctgaagagcgtaatcttcgatttggtgttagagagcacgggatgggagccatctgcaatggaattgcccttcacagtcctggactcattccttattgtgctacgttctttgtttttacagactacatgagagctgccattaggatatctgccttaagtcaagctggtgtaatctatgtcatgactcatgactcaatcggtcttggtgaagatgggccgacccatcagccaattgaacatctggcaagctttagggctatgccgaacatattgatgctccgaccagctgatggtaatgagactgcaggggcatataaagttgcagtacttaaccaaaagagaccttccattcttgccctttctcgccaaaagttgccaaatctccctggaacttctattgagggagtcgaaaagggtggatacattctctcagacaattcctcaggcaacaagcctgatgttatcttgattggaaccggttccgaacttgaaattgctgccaaagcagcagaagaactaagaaaggaaggaaaggctgttcgacttgtttccttcgtctcctgggagctcttcaacgagcaatcagatgcatataaggaaagtgttttgcctgctgctgtttctgccagagtgagtattgaggctggaacaacatttgggtgggagaagatcgtcggaagcaaaggcaaagcaatcggcattgaccgcttcggagcaagtgctccagcagggaaaatttacaaagagttcggtataaccgtggaagctgttattgccgctgctaaacaagttatttagaacaggttagtcaatttgtttgaatttgggcgggaatttctgtagagaccacttccaagagattttgttctaacgacacgatctcttatgttgcaataaaaaggtctgagtattctgtcc

SEQ ID NO: 9051 - DNA, 2637 bp, Platanus occidentalis
tgctcctcctccctcaccaacacaaccatggcggcctcctcatcccttaccgtctctcagtcccttgtgggtcgcaccatagcccaccatggctcctccacacagtctgaccgtctcgcccttcctgggtttagcctcagcacgctcgccggccggagcatcaaatcttcttcttctccgtctccgcgagtcttcggtgcacgcaagcgcgtgaactctcgaccgtcagtccgtgcagctgctgtggagaccctcgacaagactgacactactttggtagagaagtcgatcaatacgattcggtttctcgcgattgatgccgtcgagaaggcgaattctgggcacccgggtttgccgatggggtgtgctccgatgggtcatattttgtacgatgaggtgatgaggtacaaccccaagaatccttactggtttaaccgggaccgatttgtgctttctgctggacatgggtgtatgctacagtacgcattgcttcatcttgctggatatgacagtgttaaggaagaggacttgaagtctttccgccagtggggaagcaaaattcctggtcaccctgagaactttgagacaccaggtgttgaagtcactacaggtcctctcggtcagggtattgccaatgctgtaggattggcccttgcagagaagcacttggctgcccgtttcaacaaacctgacaatgagattgttgaccattacacatatgttatactgggggatggttgtcaaatggaggggatttcaaacgaagcttgctcccttgccgggcattggggacttgggaagttgatcgctttctatgatgacaaccacatctccattgatggtgacacagatattgcattcactgagagtgttgacacccgcttcgagggtcttggttggcatgtgatttgggtaaaaaatggtaacaccggctatgatgacattcgtgctgctatcaaggaagcgaaggctgtgaaagacaagcccactttgatcaaggtgacaactaccattggttatggatccccgaacaaggcaaactcatacagtgtacatggaagtgcattgggtggcaaagaagtggatgccacgaggaagaatcttgggtggccatacgagcctttccatgtgcctgaggatgtgaagaagcattggagccgccacatccctgaaggttctgctcttgaagctgaatggaatgccaagtttgcagagtatgagaagaagtataaagaggaagctgcagagttaaaatcacttatcactggtgaatttcctgctggctgggagaaggctcttccaacttacactccagagagccccgccgatgccaccagaaatctatcacaacagtgccttaatgcacttgcaaaagttctccccggacttcttggtggtagtgcagatcttgcttcctccaatatgaccttgctgaagatgtttggggacttccaaaagggcaccccagaggagagaaatgttcgttttggtgtaagggagcatggcatgggtgccatctgcaatgggattgcccttcacagcccgggctttgtcccatactgtgcaaccttctttgtgttcactgactacatgagggctgcaatgaggatctcagccttgagtgaggctggagttatctatgtgatgactcacgattcaattggtcttggagaggatggaccaacccatcagccgattgagcatttggctagcttcagggccatgcctaacatcctgatgctccgccctgccgatggtaatgagactgctggtgcatacaaggttgcagttgtcaacaggaagagaccctcaatccttgccctttctcgccaaaagcttccccagcttccaggaacatccattgaaggagttgagaagggagggtacattgtatcagacaattcttcaggtaataagccagatgtcatcttggttggtactggttctgaattggaaattgctgccaaggctgccgatgaactccggaaggaaggaaaggcagtccgggttgtctcttttgtttcttgggagctgtttgatgagcagtcagatgcatacaaggagagtgtcctcccagttgctgtctctgccagggttagcattgaggcaggatcaacatttgggtgggaaaagattgtggggagcaagggagtggcgattgggatcgatcggtttggagcgagtgcacctgcaggaaaaatatacaaggagttcggtttaacagctgaggctgtcattgcagcagccaaagcagtttgctaggcctgctcagtggtgatttattatcttcaccttatttggcatttggattttgtatccctgctttccctaagtttggaaaatacagtggaaggagaggccggtcttcagagattctggtctgtaaatgttctcttggatttaaaaaaaaaaaaaagagaactctaatttcttcccttttcctcatgttcatcaatgggggattgagtctccaaatggaatcaagagcaagagagtttaggactgataaatgttcattaaatgtgtaactcgtcatgaatctgtttgaattttgtattttttgttcttaaggttatttcctagtgaagtttatcatgaagtataatttcacagaacataagatagcgtcaagtataa

SEQ ID NO: 9052 - DNA, 2901 bp, Eucalyptus grandis
caaaaaggagaaaagactatcgtttcgtttccccaagtaaagctgtaagcttgtaactcgctcgctactacaacatcctaagacagacagacaacggtattcacccgttaactgaccaacggcgatcgccaacgctcgaaccggaccgcctttctctgtctccgcgagccgagccatggcttccacctcgtccccgacgctgtcccaggccatcttggcccgacccatctccggcagcgcctccaattcctcctcctccgaccgcgtctccctctccctctccgccctcaagttctctcccctctcctcctccaggcgcgcctccggctcctcctgccgccgccgccgcagcagcgtccagggtccctcctcggccgtccgacccatcagggccgccgccgtcgagaccctcgacaccgccaccgaggcctccctggtcgagaagtcggtcaacaccatccggttcctggccatcgacgccgtcgagaaggcgaactccggacacccgggactgcccatggggtgcgccccgatgggtcacatcctgtacgacgaggtcatgaggtacaaccccaagagcccctactggttcaaccgcgaccggttcgtgctgtcggccgggcacggttgcatgctgcagtacgcccttatgcatctcgctgggtatgacagcgtccaggaggaagacttgaaaggcttccggcagtggggaagcaagacccctggccatccggagaactttgagacaaccggtatcgaagttacaacaggtccactcgggcaaggaattgccaatgctgttggtttggcactcgtagagaagcatttggctgctcgcttcaataaaccagacagtgaaatagttgaccactacacatatgtcatccttggagatggttgccagatggagggtatttccaatgaagcttgttcacttgctggtcactggggacttggaaagttgattgctttctatgacgacaaccacatctctatcgatggcgatacggaaattgcattcaccgagagtgttgacacccgtttcgagggtcttggttggcatgtcatatgggtgaaaaacggaaacactggctatgatgagatacgtgctgctattaaggaagcgaaggctgtcaaggataagcctacattaattaaggtgactaccaccattggctacggttcacctaacaaggccaactcatatagtgtgcatgggagcgcactgggtgccaaggaagtcgatgcaacaaggaagaaccttggttggccatatgaacctttccatgtgcctgaggatgtcaaagcgcactggagtcgccatgtccctgctggcgctgctattgaagctgaatggaatgccaagtttgccgagtatgagaagaagtacaaggaagaagctgcagaactgaagtccattttcaagggtgaactgcctgctggttgggaaaaagcacttccgacgtatactcctgagagtcctgctgatgccaccaggaatctctctcagcaatgcctgaatgccctcgctaaagtgctgcctggtcttcttggtggcagtgctgatcttgcttcttccaacatgacactgcttaagatgttcggtgatttccaaaagggcaccccggaggaacgcaatgtcaggttcggtgttagagagcatggaatgggagctatttgcaacgggattgccctgcacagccctggtctcattccatactgcgccacgttctttgtcttcactgactacatgagggctgcgatgaggatctctgccctttgtgaagctggagttatctacgtgatgacccatgattcaattggtcttggagaggacgggccgacccatcaacctattgagcacttggccagcttccgtgctatgcccaatattttgatgcttcgaccagctgatgggaatgaaaccgcaggtgcgtacaaggttgctgtcctcaacaggaagagaccttctgtccttgctctctccaggcagaagctgccccagctttccggaacttccattgaaggagtcgaaaaaggtggttacatcatttcggacaactcttcaggcaataagcccgatgtcatcttgattggaactggttctgagttggaaattgctgtgaaagcagcagatgaactgagaaaggaagggaaggctgtgagagttgtatcatttgtttcatgggagctctttgacgatcaatctgctgagtataaagaaagcgttttgccagctgccgtatccgctagggtcagcattgaagctgggtcaacctttggatggtcgaaaatcgtcggaagcggagggaaggctattggaatcgaccgcttcggggccagtgctccggcaggtataatttacaaggagttcggcatcactgccgaggccgtcgttgcggcagctaaagagctttgctaggttctggtaagtacacaatgcggttacttgggtggcatttgggttccggcgcagagctcccctggaaagcctgctggagagatttatatttattcaatgtctcttgtgctataaacaaaaataatgacagaaaatttttccttctagtgcttgaagtttctcaatgaggcagaaatggatcacaagagagctgtagtgaatgatcttgcactagtaaaactctagcagctgttctcttgagatttgtaactgtgggtggatgaagtcaatgcggcaaaatttcctccatcctgtcgaaatgttacaaaccctatgttcatttaacagttgctattcagatctctgtattcacgatttgcctctttatgttctggtattctattcttgcttctgatgggtgtctactattctcattattcaataattctaggatagcaaagcaagtagaggagcaaatgacaaacttttttatttagaaa

SEQ ID NO: 9053 - DNA, 2546 bp, Panax ginseng
aaagggggagactttatcaagacctctctttctctactgtcagccatggcagcttcttcatctctaactctttctcaagccatcctttcccgctcaattcctcgccatggctccaattcctctagccaacaaacccccatcttctcttttcctcttttttctcacctacccactttctccacctccctcagatcctcctctcgccgctgcagctccgccgctggccgccaggtagtccgggccgccgttgtggagacgctcgacaagacggagacctcattggtggagaaatcggtgaacacaattcggttcttggctattgatgcagtggagaaggctaattcgggtcatccgggtttacccatggggtgtgccccgatgggtcatatattgtacgatgaggtgatgaggtacaaccccaagaacccgtattggtttaatcgggatcgctttgttttatccgctggacatgggtgcatgcttcagtatgctttgctacaccttgctggttatgacagtgtcctggaagaagatttgaagtccttccgtcaatgggggagcagaactccaggacaccctgaaaactttgagacccctggtgttgaagtcactacaggtcctcttggtcagggtattgccaatgctgttggtctggcccttgtggagaagcacttggctgctcgcttcaacaaacctgacagtgagattgttgaccattacacatatgtcatacttggggatggctgtcaaatggaggggattgcaaatgaagcttgttcccttgctggacattggggacttggaaaactgattgctttctacgatgacaaccatatctccattgatggtgacacggagattgcattcactgagagtgttgacacccgttttgagggtcttgggtggcacattatctgggtgaagaacggtaacacaggttatgatgacattcgtgctgccatcaaggaggcaaaggctgtaacagacaagcctactttaatcaaggtgaccacgacaattggttttggatcacctaacaaagcaaactcgtacagcgtccatggaagtgccctgggagctaaggaagtcgatgccacaaggaagaaccttgggtggccttatgagcctttccatgtacctgaggatgtgaaacagcattggagccgccatacctgtgaaggtgcttctcttgaagctgcatggaatgccaagtttgctgagtatgaaaagaagtatgcagaggaagctgtagaattaaagtctatcattactggtgtgctacctgctggttgggagacagctctgccaacatacactccagagatccctgctgatgccaccagaaatctctctcaaacatgtctgaatgcccttgcaaaggttcttcctggccttctgggtggcagtgctgatcttgcttcctccaacatgaccctgctgaaaatgtttggggacttccaaaagggtacaccagaagaacgtaatgtcaggtttggcgtccgtgagcatggtatgggagctatctgcaatggtattgctctccacagccctggcctcattccctactgcgcaactttctttgtgttcactgactacatgagaggggccatcaggatctccgccttgagtgaagctggagttatttatgtcatgacccatgattcaattgggctgggagaagatggaccaactcatcaacctatcgaacatctggccagcttcagggcaatgcccaacattttgatgctccgtccagctgacggaaacgagactgctggggcatacaaggttgcagtcctcaacaggaagagaccatcaatccttgccctatctaggcaaaagctgcccaaccttcctggaacttccattgaaggagttgaaaaaggtgggtacacgatatcagacaattcatctggtaacaagccagatgtcatcttgattggaaccggttctgaattggaaattgcagccaaagctgctgatgaactcagaaaggaagggaaggcagttagggtcgtctcttttgtgtcttgggagttatttgatgagcaatcagatgattataaggaaagtgtcctacctgcagctgtaactgcaagggttagcattgaagctgcatcaacatttggttgggggaaacttgttggaagcgaagggaaagctattgggatcgacaagtttggagcaagtgctccagctggaaaaacatacaaggagtatggcattacggtagaggcaattattgcagcagctaaagaacttatctagagcttcattacagaattccatttggaggctgtcagttcagcggaaacttagtatttttggagtttgggttggagaatttacacctaatcattgttaaaagactcatcttgattcagtacctcttaagatttcacaataacaaagatgaaattttcttttgttgcttttcattatcttcagcgctgcagctgaggctgcaaaatgaatcgagatcaaaagagagattagatttcattaacgttcatgaatttgtataccaatacttgaacatgtatcaa

SEQ ID NO: 9054 - DNA, 2863 bp, Citrullus lanatus
gaagctccatttccacacgaaatataactgataattctcacagtccatttcttcaatccttcatcaatcccaaagccatggcttccacttcctccctcaccctttctcaagccctcttgtcccgcgaaatctctcgccatggctccaattcctcctccgaccgagttcccctctctatccccacattctccggcctcaaatccaccaaaccaccgcgcctcgcgggctccgcccaccgccccagggccacccattaccgccgccagatcgttagagccgccgtcgccgagacactaggcaccaccgccgaaactgccctcgttgagaagtccatcaacacgatccgattcttggccattgatgcggttgagaaagctaattccgggcaccctggtttgcctatgggctgtgcgccaatgggtcatattctttacgatgaggtcatgaagtataaccccaaaaacccttactggttcaatcgggaccgtttcgttttgtccgctggacatggttgtatgttgcagtatgctctgcttcatcttgctggctatgacagtgtcaaggaggaagatttgaagagcttccgtcaatgggaaagccgaacccctggacatccagagaactttgagactcctggtgttgaggtcacaactggtcctcttggacagggaattgcaaatgctgttggtctggcccttgctgagaaacacttggctgctcgttttaacaaaccagacagtgagatcgttgaccactacacatatgttatactgggagatggctgtcaaatggagggaattgccaatgaggcttgttctttggctggtcactggggactgggaaagcttattgctctgtatgacgacaaccacatttcaattgatggagatacagagattgcattcactgagagtgttgacactcgtttcgaggcgcttggatggcacgttatctgggttaagaatggaaacactggctatgatgaaatccgtgccgcaattcaagaagctaaagctgttaaagacaagcctacattgatcaaggtgacaacaaccattggttttggatctccaaacaaagccaattcatatagtgtgcatggtagtgcccttggtgcaaaagaagttgaggctactaggagcaaccttggatggccatatgaacctttccatgtgccagaggacgttcagaagcactggagtcgtcacattcctcagggtgcagattttgaagcagaatggaatgctaagtttgctgaatatgagaagaagtatgcagaggaagcggctgagttaaggtctatcatcactggtgaactacccgcgggctgggaagatgcacttcctaaatatacacctgagagtccaggtgatgcaactagaaatctatctcagcaatgccttaatgccctcgcaaaagttcttcccggtttccttggtggcagtgctgacttggcatcgtccaacatgacccttctgaaaatgtatggtgacttccaaaagaacactccagaagaacgcaatgttaggtttggtgttagggaacatggaatgggtgccatatgcaatgggattgcccttcacagccctgggtttatcccatactgtgccacattctttgttttcactgactacatgagagctgctatgaggatttctgccttatctgaagctggtgtcatctatgtcatgactcacgattcgatcgggcttggagaagatggtccaacccatcagccaatagagcacctggctagctttagggcaatgcccaacatattgatgtttaggcctgctgatggtaatgagactgctggtgcttacaaagttgcagttgtaaataggaagaggccttctattatggccctttcacggcaaaagttgcctcaactccccggaacttcaattgaaggagtcgagaagggtggatacactatttccgacaactcttcaggcaacaagccagacgttatcttgataggaactggttctgaattggagattgctttccaagcaggagaggaactcagaaaggaaggaaaagctgttagggttgtttccttcgtctcttgggagctttttgatgaacagtcagatgcctacaaggaaagtgtcttgccagaagctgtatcagctagagttagcattgaggccggttcaacatttgggtggcagaagattgttggaagcaaaggaaaggcaattggtatcgatcgatttggcgcaagtgcaccagcaggaaaaatatacaaggagtttggcatcacagtagaagctgtcgtagcagctgctcgagaacttagctaggatcatttgtatcagtatcttccatatatggaaattggcagtccatgacacgaatttctttattgtaataaacgaagcaaaacgtgaatccttcttgttaaaacaaaaaaacattggcagtccatgacacgaatttctttattgtaataaacgaagcaaaacgtgaatccttcttgttaaaacaaaaaaacaaaaaaaaaaaaaagtgaagctgaatcacattctctgttacttatgattctgtttacggtaaatgaggtcacaaatgagaaacagagagaggcattagtatttttgagtaaaaatgaaagtctagaacagctcctgggcctctcttttctgtatcttctatgctcaatcttaagaggtgcttcatcctttatttattctccaatcttcaaacgaattattctcatatccctctctaagcactacagtacatcaaaatgtcccatggcgctccatcttgctcttatgttttttcagtaatggcatcatttgtactgatttttctttcaagaatatgaatatagaaactcatcagtgttgtctctgct

SEQ ID NO: 9055 - DNA, 2741 bp, Catharanthus roseus
ctcccttcatataatcatcaatctatccacccccacaaagactcctctcagcctcctctcaccaagaaatttttgtactagagtaggagccatggcctcatcttcttctctcactctttcccaagctatcctcgctcgttccgtccctcgccatggctcttcttcttcttcttcttcctcaaacatcccttccatttccttcccaacattttccggccttaaatccactaacccatcaacaaccaccgtctctcgccgccgttcttctacttcacgccgtcaaaatcaagtctttgcagcagcaactatagagacaattgagaaaactgacactgaattggttgataagtccgtcaatacgatccgattcttggctatcgatgctgttgaaaaggctaattctggacaccctggtttaccaatgggttgtgctccaatgggtcatattctttatgatgaggttatgaagtataatcctaagaacccttattggtttaaccgtgaccgctttgttctctccgccggtcatggttgtatgcttcagtatgctttgcttcatcttgctggatatgatgctgttcaggaggaagatttaaagaatttccgccaatggggaagcaaaactcctggtcatcctgagaactttgagacccctggtgtcgaagtcaccactggccctcttggtcaaggtattgccaatgctgttggtttggcccttgctgagaagcacttggctgcccgttataataaacctgatgcagagattgttgaccactacacgtatgttatacttggtgatggatgtcaaatggaggggatttcaaatgaagcatgttccctagctggccactggggactcgggaaactgattgctttttatgatgacaaccatatctcaattgatggtgacactgaaattgcattcactgagaatgttgacacccgttttgagggtctgggttggcatgttatctgggtgaagaatggtaacacaggctatgatgaaattcgtgctgccatcaaggaagcaaaggccgtgaaggacaaacccactttgatcaaggtgactactactattggttttggctcccccaacaaggcaaactcatacagtgtacacggaagtgcccttggtgccaaggaagtagaagctacaaggagtaatcttgggtggccttatgagcccttccatgtgcctgaggatgtgaagaagcattggagtcgccacattcctaatggtgctgcttatgaagctgaatggaatgccaaattttcggaatatgaaaagaaatatcctgaggaggcagcagaattcaagtccattattactggtgaactccctgctggctgggagaaggctcttcctacatatacccctgagagcccagctgatgctaccagaaacctctctcagcaaaaccttaacgctcttgcaaaggttcttcctggcctgcttggtggtagtgctgaccttgcctcttccaacatgacccttcttaagatgtatggtgacttccagaagaacacgccagaagagcgcaatgtgaggtttggtgtccgtgaacatggtatgggtgccatctgtaatggtattgctctccacagtcctggcctaattccgtactgtgcaactttctttgtgttcactgactacatgagagcagccatgaggatctctgccttgtgcgaagctggagttatctatgtgatgacacatgactcaatcgggcttggagaagatggacccacccatcagcctattgagcacttggcaagcttcagggcaatgcccaacattctgatgctacgaccagctgatggaaatgaaacagctggtgcttacaaggtggctgtcctcaacaggaagagaccatcagtccttgctctctcacgtcaaaagttgccccagctcgctggaacttctattgaaggagttgaaaagggtggatacattgtatcagacaattcttctggcaacaaacctgatgtcattttggttggaactggttctgagttggagattgcagtcaaggctgctgatgaactcagaaaggaagggaaggccgtcagagttgtctcctttgtttcatgggagctatttgatgagcaatcagcagaatacaaggaaagtgtcttgccagcttcagtaacagctagagtcagcattgaggctggatcaacatttggatgggagaggattgtgggcactaaaggaaaagcaattggaattgtcggatttggggctagtgctcctgcaggaaaaatatacaaggaattcggcattactgcagaagctgttatagcagcagctaaagaagttatgtaggctttgcaaatttaactttccaggtttgccagttgttttgtcaaaattatttaggttcggaatcaaagcttgcaaaaattacagccaaaacattggtaagggactcggcttatagttcactaccgcaacttgagacttcataataagagaagataagtttttctttgtccttctgtcttcataagttggggaggggttttgtgcctgcaaaattgaatagaggaggcagtttaggatatgctcttgaatttgtacactttggcatggcatttgtaatcttatgtggttctattgccttgagttctctctctttttcatcatcattatgtttaatggtttaaatgataccaagtttttgtttcttgccaaatatttcaagttcttttctttctgtttcaatgaaatatttcaacat

SEQ ID NO: 9056 - DNA, 2323 bp, Cucumis sativus
ccatggcttccacttcttctctcaccctttctcaagctctcttgtcccgcgaaatctctcgccatggctccaattcctcctccgaccgtgttcccctctctatccccacattctccggcctcaaatccaccaaaccacctcgtctcaccggctccgcccaccgtcccagagctacccactaccgccgtcagatcgttagagccgccatcgctgagacattgggcaccactgcagaaactgccctcgtcgagaagtccatcaatacgattcgattcttggccattgatgcggttgagaaagctaattccggtcaccctggtttgcccatggggtgtgcgccgatgggtcatattctttacgatgaggtcatgaagtataaccccaaaaacccttactggttcaatcgggaccggttcattttgtccgctggacatggttgtatgttgcagtatgctctgcttcatcttgctgggtacgacagtgtcagggaggaggacttgaagagcttccgtcagtgggaaagccgaacgcctggacatccggagaactttgagactcctggtgtcgaggttacaactggtcctcttggacagggaattgcaaatgctgttggtctagcccttgctgagaaacacttggctgctcggtttaacaaaccagacagtgagattgtcgaccactacacatacgttatactgggagatggctgtcaaatggagggaattgccaatgaggcttgttctttggctggtcactggggactaggaaagcttattgctctgtatgatgacaaccacatttcaattgatggagatacagagattgcattcaccgagagtgttgacactcgttttgagggtcttggatggcacgttatctgggtgaagaatggaaacactggctatgatgaaatccgtgcggcaattcaggaagctaaagctgttaaagacaagcctacaatgatcaaggtgacaacaaccattggttttggatctccaaacaaagccaattcatacagtgtgcatggaagtgcccttggtgcaaaagaagttgaggctactaggagcaaccttggatggccatatgaacctttccatgtgccagaggacgtccagaagcactggagtcgtcacactcctctgggtgcagattttgaagcagaatggaatgctaaatttgctgaatatgagaagaagtacccggaggaagcggctgagttgaagtctatcatcactggtgaactaccagcgggctgggaagatgcacttccgaaatatacacctgagagtccaggtgatgcaactagaaatctgtctcagcaatgccttaatgctctcgcaaaagttcttcctggtttccttggtggcagtgctgacttggcatcatccaacatgacccttctgaaaatgtatggggatttccaaaagaacactccagaagaacgcaatcttaggttcggtgtcagggaacatggaatgggtgccatatgcaatgggattgcccttcacagtcctgggtttatcccatactgtgccacattctttgttttcactgactacatgagagctgctatgaggatttctgccttatctgaagctggtgtcatctacgtcatgactcatgattcaatcgggcttggagaagatggtccaacccatcagccaatagagcacctggcaagctttagggcgatgcccaacatattgatgtttaggcctgctgatggtaacgagactgctggtgcttacaaagttgcagttgtaaacaggaagagaccttctattatggccctttcgcggcaaaagttgcctcatttacctggaacttcaattgaaggagtcgagaagggtggatacattgtttccgacaactcttcaggcaacaagccagatgttatcttgattggaactggttctgaattggagattgctttccaagcaggagaggaactcagaaaggaaggaaaagctgttagagttgtttcctttgtctcttgggagctttttgatgatcagtcagatgcctacaaggaaagtgttttgccagaagctgtaacagctagagtcagcattgaggccggttcaacatttgggtggggaaagattgttggaagcaaagggaaggcaattggtatcgatcgatttggcgcgagtgcaccagcaggaaaaatatacaaggagttcggtctcacagtagaggctgttgtagcagcagctcgagaacttagctaggatcattgtatcttccatatatggaaatcagcggcccatgacatgaatttctttattgtaataaacgaagcaaagcgtgaatccttcttgtt

SEQ ID NO: 9057 - DNA, 2664 bp, Panax ginseng
aagcagtggtatcaacgcagagtacatggggatttcgaaccaattctgttctgtcctctgatttctttatttctctctctaaaatttcagagagagacttcaccggtactactttttctctagactctgccatggcttcttcatctctaactatttctcaagctatcctttctcgctctattcctcggcatggcggctccaattcttctacccaacaacccgcttcttctctctcctctttctctcacctgcccactttctccacctccctcaaatcctcctctcgccgccgcaactccgccgccggacggcgtatagtcagggccaccgccgtggagacgctcgaaaagacggagacttcactggtggagaaatcggtgaacacgattcggttcctggccattgatgcagtggagaaggccaattcgggtcacccaggtttacccatgggttgtgcccccatgggtcacattttgtatgatgaggtgatgaggtacaatcccaagaacccgtattggttcaatcgggatcgctttgttctctctgctggacatgggtgtatgcttcagtatgctttgctccaccttgctggatatgacagtgtattggaagaagacttgaagcagttccgtcagtgggggagcaaaactccaggacaccctgagaactttgagacccctggtgttgaagtcactactggtcctcttggtcagggtgttgccaatgctgttggtctggcccttgtggagaagcacttggctgctcgtttcaacaaaccggacagtgagattgttgaccactacacatatgtgatacttggggatggctgtcagatggaggggatagcaaatgaagcttgttctcttgctggacattggggacttggaaaactaattgctttctacgatgacaaccatatttccattgatggtgacacagagattgcattcactgagagtgttgacactcgttttgagggtcttggttggcacattatctgggtgaagaatggtaacactggctatgatgacattcgtgctgccatcaaggaggcaaaggctgtaacagacaagcctactttaatcaaggtgaccacgactattggttttggatcacctaacaaagcaaactcgtacagcgttcatggaagtgccctgggagctaaggaagttgatgccactaggaagaaccttgggtggccttatgagcctttccatgtacctgaggatgtgaaacagcattggagccgccatgcctccgaaggtgcttctcttgaagctgaatggaatgccaagtttgccgagtatgagaagaagtatgcagaggaagctgcagaattgaagtctatcttcactggtgtgctaccttctggttgggagtcagctctgccaaaatacactccagagagccctgctgatgccaccagaaatctctctcaaacatgcctgaacgcccttgcgccagttcttcccggtcttctaggtggcagtgctgatctagcttcctccaacatgacccttctgaaaatgtttggtgacttccaaaaaggtacaccagaagaacgtaatgtcagatttggtgtccgtgaacatggtatgggggctatctgcaatggaattgctctccacagccctggcctcattccctactgtgcaactttctttgtgttcactgactacatgagaggggccataaggatctccgccttgagtgaagctggagttatctatgtcatgacccatgattcaataggactaggagaagatggaccaactcatcagcctattgagcacttggccagtttcagggcaatgcccaacattttgatgcttcgtccagctgatggaaatgagaccgctggggcatacaaggttgcagtcgtcaacaggaagagaccatcaatccttgccctctcgaggcaaaagctgcccaaccttcctggaacttccattgaaggggtagaaaagggtggctacacaatatccgacaattcatctggtaacaagccagatgtcatcttgattggaactggttctgaattggagattgcagccaaagccgctgatgaactcagaaaagaagggaaagctgttagagttgtctcctttgtgtcttgggagttatttgacgagcaatcagatgtttacaaagaaagcgttctgccagcagctgtaacagcaagagttagcattgaagctggatcaacatttggatgggtaaaaattgttgggagcggaggaaaggctattgggattgacggatttggagcaagtgctccagcgggaaaaatatacaaggagtatggcataacggcagaggcagttattgcagcagcgaaagaacttttctaggtattcactactgcatgcactccattgttgttagttctgcggaaacttcttaaagtttggattctgggttggagatttttcaccgaaatgttgttaatagactcagctcaattcatgatctcctaagttttcacaataaggaagataaaagtttttttcttcttgttttttatcttcttcagtgcaacagttgagactgcaaactgaatcaatctaaagagagattagatttcttgaatgttcatgaaattgtatcaatacacttgaacatatattgatttttgtaatcttatgtgttggattgcaagtgaaa

SEQ ID NO: 9058 - DNA, 2605 bp, Actinidia deliciosa
agaaaacacatcctctctctctttctcactctagagccatggcgtcctcttcctctctcaatctatcccaagccaccctctctcgctccgccgcgcaacaacaccaccgcggctccaaccgtccggcttctctcaccacctcctctctccccaccttccccggcctcaaatcctcctcacgcgccgcctccacgcgccgtcgctccgtgcgcgcgtccgcttccacgagccgtcgctccgtacgcgcgtccgccgccgtggagaccctcgagacgacggcgacggagctcatcgacaagtcggtcaacacgattcggttcctggcgatcgacgcggtcgagaaggccaattcgggtcacccggggctgcccatgggctgtgctccgatgggtcacgtactctacgatgagatcatgaggtacaatcccaagaacccgtattggttcaatcgcgaccggttcgttctctccgctggacatggttgtatgcttcagtatgccctgcttcatctcgctggatacgatagtgttcaggaagaagacttgaaacaattccgccagtggggaagcaagacaccaggtcacccagagaactttgagacccctggcgttgaagtcaccactggtcctcttggccaaggtcttgccaatgctgttggtctggccctcgcagagaagcatttggctgctcgtttcaacaaaccagacagtgagattgttgaccactacacatacgcgatattgggagatggttgtcaaatggagggaatttcaaatgaagcctgttccattgcaggtcattgggggctcggaaagctcattgctttctatgatgataaccatatctccattgatggtgacacagagattgcttttactgagagcgttgacactcgttttgagggtctcgggtggcatgttatctgggtgaagaatgggaatacgggttacgatgaaatccgtgctgccatcaaggaagcaaaggctgtcaaagacaaaccaactttgatcaaggtaactactactattggttatggctctcctaacaaggcaaattcatacagtgtacatgggagcgcactgggtgccaaggaagttgatgccacaaggcagaaccttggttggccatacgaacctttccatgtgccagaggatgtgaaaaagcattggagctgccatgtccctgctggtgctgctcttgaagctgagtggaatgccaaatttgctgaatacgaaaagaaatatacagaggaagctgtagagttgaagtccattatcactggtgaacttccagctggttgggagaaagctctcccgacatacactccagagagcccagctgatgccacaagaaatctctctcaacaatgccttaatgcccttgctaaggttattcccggatttcttggtggcagtgccgatcttgcttcctccaacatgaccctgctgaaaatgtttggcgacttccaaaagagcacaccagaagaccgtaacctcaggtttggtgtccgtgagcatggtatgggagccatctgcaacgggattgccctacacagtcccggcctcattccctactgtgccactttctttgttttcactgactacatgagagcagccatgaggatttctgccttatctgaagccggagttatttatgttatgacccacgattcaattgggctcggagaggatgggcccacccatcagccaattgagcacttggcaagcttccgggcaatgcctaacattttgatgttccgcccggccgacggcaacgagacagctggtgcatacaaggttgccgtcctcaaccccaaaagaccatcagtccttgccctctcgcggcaaaagctgccccaactgcccggaacttccattgaaggagtggagaagggaggttatatagtatcagacaattcttctggtaacaagccagatgttatcttgattggtactggttctgagcttgaaattgctgccaaggcagccgatgaactcagaaaggaagggaaagctgtgagacttgtctccttcgtttcctgggagctatttgacgatcaatcggatgcttataaggaaagtgtcctgccagaggctgtttcggctagggttagcattgaagcgggatcgacatttggctgggagaagatcgttggaagcaaagggaaggcaataggcattgaccggtttggggcaagtgctccagcagggaaaatatacaaggagtacggcataacggctgaggctgttgttgcagcagctaaagcactttgctagtgattcacaacatgaggttcttcgtttccggtagcccaatctaggtttcttccaccggattctggatttggccatttatattgaaggttttgtgcttaagagatctggggcatttcatggcctcttggcttttcaaaataaagaagagatattgaaagttctcttttgtaatatcttcttcagcagagcagccaagtctgcaaactgaatcaagatcaaaagagaaagaaccgtgatgtaatttgtagtttgtaccaactcttgcaccagcttcgagttttgtaactttaagcgattgatggtaatgagatttcatattcttcctttca

SEQ ID NO: 9059 - DNA, 2530 bp, Cleome spinosa
ctcatcgctcatttcttcaccactagctcctctttctctctctagaaccagagagcgcatccatggcttccacttcttcccttgcgctctctcaagccctcctcgcccgcgccctttctcaccatggctctgaccagcgcgtctccttacccgccttctccggcctcaaatccaccggcccacgcgccgcctcctcctcccgtagacgcgccggacccacgcgccaccgcgatacccgccccgtaatccgtgccgccgccgtggagacgattgacacaaccactgaggcgtcggttgtggagaagtcgatcaacacgatcaggttcctggcgatcgacgctgtgcagaaggcgaactcgggtcacccgggtttgcccatgggctgtgccccgatgggtcacattttgtacgatgaagtcatgaggtacaaccccaagaacccttactggttcaaccgtgaccgcttcgttctctccgctggacatggttgtatgttgcagtacgcattgcttcaccttgctggatacgacagcgttaaggaagaagatttgaagaatttccgtcagtggggaagcagaacaccgggacaccccgagaacttcgagactcctggaattgaagtgactaccggtcctctcggacaaggtattgcgaatggtgtcggtttagctcttgctgagaggcatttggcagctagattcaacaaacccgacagtgaaattgttgaccattacacatatgtgatcctgggagatggttgtcagatggagggaatttcaaatgaagcttgctctcttgctggccactggggacttggaaagctcattgctttttacgacgacaatcacatttccattgatggtgacacggaaattgccttcaccgagaatgttgaccaacggtttgaagcccttggatggcatgttatctgggtgaagaatggaaacactggctatgacgagatccgtgctgccatcaaggaagctaaggctgtgaaagacaagcccacattgatcaaggtcacaaccaccattggttttgggtctcccaacaaggcaaactcgtacagtgtacacggtagtgcacttggtgagaaggaggttgaggcaactagaaagaaccttggatggccctatgagccattgcatgtacctgacgatgttaaaagccactggagccggcatacccctgaaggggctgctcttgaagctgattggaatgccaagtttgcagagtatgagaagaaatacccagaggaagctgcagaactgaaagctatcatcactggtgaattgccttctggttgggagaaggcactgcctacatatacccctgagtccccgggtgatgctaccagaaacctgtctcagcaatgccttaatgcccttgcaaatgttgtgcccggtttccttggtgggagtgctgaccttgcatcttccaacatgacattgctcaaaatgtttggtgatttccaaaaggggacacccgaagagagaaacctaaggtttggtgttagggagcacggtatgggagccatctgcaacggcattacccttcacagcccgggccttatcccctactgtgcaactttctttgtctttactgactacatgagagctgccatgagaatctcagctttgtctgaagctggtgttatttacgtgatgacccatgattccattggtctcggagaagatgggccgacccaccagccagttgagcacttggtcagtttccgtgccatgcccaatattctgatgttccgtcctgctgatggtaacgaaacagctggtgcatacaagattgccgtctctaaacgcaagacaccctctgtcttagcactctctaggcaaaagctgcctcaacttcccggcacatccattgaaggcgtcgagaagggtggatacacaatctctgacaactcgtccggtaacaaacccgatgtgatcttgattggaactgggtctgagctagaaatcgctgctaaggcagctgaggaactcaggaaggaaggcaaagctgttagagtggtgtcctttgtgtgctgggagctctttgctgagcagtcagatgcatacaaggaaagcgttttgccatctgatgtatcggctagggttagcattgaagctggatcgactttcgggtgggaaaaggttgtcgggtcgaaagggaaggctatcgggattgactccttcggggccagtgcaccagcaggcttactctacaaggagttcggtataactgtggacgctgttattgcagcagctaaggcactgatctagatcttcttctctggtttgctatgtcacattacagagaagctgttctcagcattcccctctgttttaaatcaaataaaagaaaaaaaaagcaagatgaagagatttccttttgtttctttcttgtaattccttgagaagtcaacataggtttggagaagagcaaagccatgggaggactgggaactccattatctgtaacaactcttgtattgttatgcttcaaatccagagatttttttcccctaaaa

SEQ ID NO: 9060 - DNA, 2559 bp, Vitis vinifera
gtccccgtaacgaacccaatccatacaataagagccttcacatagagagagagacacccctatttctctctctacaactacccagagccaccatcaaccaccaccatggcggctgcttctgcttcgtcatcgctctatctcctcccccgcaccctcaaccaccacagctccaccccacaccccaaccgcctctccctgtcgggtctcaccccaaagacacaggctttacgcacccgccatggaaggcgcgcaagggccaccgttagggcggcggcggtggagacgctccagaaggcggacacgtctctggtggagaagtcgatcaacacgataagatttctgtcgatagacgcagtggagaaggcgaattccggtcacccaggtctgcccatggggtgtgctcccatgggtcatatactgtacgatgaggtcatgaggtacaacccctccaacccctactggttcaatcgtgatcgattcgttctctccgctggccacggctgtatgttgcagtatgctttacttcatcttgctggctatgacagtgttaaggaagaggatttgaagtctttccgacaatggggaagtagaactcctggtcacccagagaacttcgagacacctggggttgaagtgacaactggccctcttggtcagggtattgccaatgctgttggtttggccgctgtggagaagcatttggctgcaagattcaacaaacctgacaatgagattgtcgaccactacacgtatgtgatacttggtgatggatgtcaaatggaaggaatttcaaatgaagtttgttcccttgctgggcactgggggcttgggaagctgattgcattttatgatgataaccacatttcaattgatggtgacactgaaattgcatttactgaaagtgttgacacccgttttgagggacttgggtggcatgtgatttgggtgaagaatggtaacactgggtatgatgaaattcgtgctgccatcaaggaagcaaaggctgttaaagacaagcccacattgattaaggtgacaactaccattggttatggttctcctaacaaggcaaactcatatagtgttcatgggagtgcattgggtgctaaagaagtagatgcaacaaggaagaaccttggttggcctcacgagccattccacgtgccagaggatgtcaaaaagcactggagccgccacatccctgatggagctgcccttgaagctgaatggaatgccaagtttgcagagtatgagaagaaatacaaagaagaagcagcagaattaaagtccatcatcactggtgaactacctgctggttgggataaagcacttccgacttacactcctgaaagtgctgctgatgctaccagaaatctgtctcaacaatgtcttaatgctctggccaaagttcttcctgggctcctaggtggcagtgcagatcttgcttcctccaacatgactttgctgaaaatgtttggtgacttccaaaaaggcacccctgaagagcgaaatgtccgttttggtgtcagggagcacgggatgggtgccatctgcaatggaattgctctgcacagccttggccttattccctactgtgcgaccttctttgttttcaccgactacatgagggccgccattaggatttctgccttaagtgaagctggagttatttatgtgatgacccatgattcaattgggcttggagaggatggaccaactcatcaaccaattgagcatctggcaagcttcagagccatgccaaatattctaatgctccgtcctgctgatggaaatgagactgctggtgcatataaggttgcagttgttaacagaaagagaccctcgattcttgctctctcacgtcaaaagcttcctcagcttcctggaacatccattgcaggagttgagaaaggaggttacgccatttctgacaattcttcaggcaataagccagatgttattttgattggaactgggtccgaattggagattgctgccaaggcaggagatgagctgaggaaggaaggaaagactgtaagggtggtatccctggtttcctgggagttgtttgatgaccagtccgatgcatacaaggaaagtgtcctcccagctgctgtaacagctagagtcagtattgaagcaggatccacatttggatgggagaagattgtaggaagcaagggaaaggcgattggcattgaccgatttggagcaagtgcaccagcaggaaagatctacaaggagtttggaattacagtggaggctgtaattgaagcagctaaggcagtttggtaggcctagacctgtattgtagtccttcggttggttcattgtcattttgatgggatttcagggaattcagcagagaagagcttgagctttagctttagcaaaataagaaaaagtaataagggaatgtgtttttgttgttttttttggtcttttatcaatgaagttggtgatttctcatttgagatgagtctcccgggatatgacaaaatgtagttttacaaaggatggtctcaaatgtgttatattatcctcgcatgtttcttttta

SEQ ID NO: 9061 - DNA, 2678 bp, Panax ginseng
aagcagtggtatcaacgcagagtacatgggggaaccaattctgttctgtcctctgatttctttatttctctctctaaaatttcagagagagacttcaccggtactactttttctctagactctgccatggcttcttcatctctaactatttctcaagctatcctttctcgctctattcctcggcatgttggctccaattcttctacccaacaacccgcttcttctctctcctctttctctcacgtgcccactttctccacctccctcaaatcctcctctcgccgccgcaactccgccgccggacggctagtcagggccaccgccgtggagacgctcgaaaagacggagacttcactggtggagaaatcggtgaacacgattcggttcctggccattgatgcagtggagaaggccaattcgggtcacccaggtttacccatgggttgtgcccccatgggtcacattttgtatgatgaggtgatgaggtacaatcccaagaacccgtattggttcaatcgggatcgctttgttctctctgctggacatgggtgtatgcttcagtatgctttgctccaccttgctggatatgacagtgtactggaagaagacttgaagcagttccgtcagtgggggagcagaactccaggacaccctgagaactttgagacccctggtgttgaagtcactactggtcctcttggtcagggtattgccaatgctgttggtctggcccttgtggagaagcacttggctgctcgtttcaacagaccggacagtgagattgttgaccactacacatatgtgatacttggggatggctgtcagatggaggggatagcaaatgaagcttgttctcttgctggacattggggacttggaaaactaattgctttctacgatgacaaccatatttccattgatggtgacacagagattgcattcactgagagtgttgacacccgttttgagggtcttggttggcacattatctgggtgaagaatggtaacactggctatgatgacattcgtgctgccatcaaggaggcaaaggctgtaacagacaagcctactttaatcaaggtgaccacgactattggttttggatcgcctaacaaagcaaactcgtacagcgttcatggaagtgccctgggagctaaggaagttgatgccactaggaagaaccttgggtggccttatgagcctttccatgtacctgaggatgtgaaacagcattggagccgccattcctccgaaggtgcttctcttgaagctgaatggaatgccaagtttgccatgtatgagaagaagtatgcagaggaagctgcagaattgaagtctatcttcactggtgtgctaccttctgattgggattcagctctgccaaaatacactccagagagccctgctgatgccaccagaaatctatctcaaacatgcctgaacgcccttgcgccagttcttcccggtcttctaggtggcagtgctgatctagcttcctccaacatgacccttctgaaaatgtttggtgacttccaaaaaggtacaccagaagaacgtaatgtcagatttggtgtccgcgaacatggtatgggggctatctgcaatggaattgctctccacagccctggcctcattccctactgtgcaactttctttgtgttcactgactacatgagaggggccataaggatctccgccttgagtgaagctggagttatctatgtcatgacccatgattcaataggactaggagaagatggaccaactcatcagcctattgagcacttggccagtttcagggcaatgcccaacattttgatgcttcgtccagctgatggaaatgagaccgctggggcatacaaggttgcagtcgtcaacaggaagagaccatcaatccttgccctctcgaggcaaaagctgcccaaccttcctggaacttccattgaaggggtagaaaagggtggctacacaatatccgacaattcatctggtaacaagccagatgtcatcttgattggaactggttctgaattggagattgcagccaaagccgctgatgaactcagaaaagaagggaaagctgttagagttgtctcctttgtgtcttgggagttatttgacgagcaatcagatgtttacaaagaaagtattctgccagcagctgtaacagcaagagttagcattgaagctggatcaacatttggatgggaaaaaattgttgggagcggaggaaaggctattgggattgatggatttggagcaagtgctccagcgggaaaaatatacaaggagtatggcataacggcagaggcagttattgcagcagcgaaagaacttttctaggtattcactactgcatgcactccattgttgttagttctacagaaacttcttaaagtttggattctgggttggagatttttcactgaatcgttgttaatagactcagctcaattcatgatctcttaagtttttacaataaggaagataaaagtttttttttcgttgttttttatcttcttcagcgcaacagttgagactgcaaactgaatcaatctaaagagagattagatttcttgaatgttcatgaatttgtatcaatacacttgaacatgtatcgacttttgtaatcttatgtgttggattgcaagtgaaattatattcctccattacaaatg

SEQ ID NO: 9062 - DNA, 2826 bp, Panax ginseng
gcagtggtatcaacgcagagtacatggggaatttcgaaccaattctgttctgtcctctgatttctttatttctctctctaaaatttcagagagagacttcaccggtactactttttctctagactctgccatggcttcttcatctctaactatttctcaagctatcctttctcgctctattcctcggcatgttggctccaattcttctacccaacaacccgcttcttctctctcctctttctctcacgtgcccactttctccacctccctcaaatcctcctctcgccgccgcaactccgccgccggacggctagtcagggccaccgccgtggagacgctcgaaaagacggagacttcactggtggagaaatcggtgaacacgattcggttcctggccattgatgcagtggagaaggccaattcgggtcacccaggtttacccatgggttgtgcccccatgggtcacattttgtatgatgaggtgatgaggtacaatcccaagaacccgtattggttcaatcgggatcgctttgttctctctgctggacatgggtgtatgcttcagtatgctttgctccaccttgctggatatgacagtgtactggaagaagacttgaagcagttccgtcagtgggggagcagaactccaggacaccctgagaactttgagacccctggtgttgaagtcactactggtcctcttggtcagggtgttgccaatgctgttggtctggcccttgtggagaagcacttggctgctcgtttcaacaaaccggacagtgagattgttgaccactacacatatgtgatacttggggatggctgtcagatggaggggatagcaaatgaagcttgttctcttgctggacattggggacttggaaaactaattgctttctatgatgacaaccatatttccattgatggtgacacagagattgcattcactgagagtgttgacactcgttttgagggtcttggttggcacattatctgggtgaagaatggtaacactggctatgatgacattcgtgctgccatcaaggaggcaaaggctgtaacagacaagcctactttaatcaaggtgaccacgactattggttttggatcacctaacaaagcaaactcgtacagcgttcatggaagtgccctgggagctaaggaagttgatgccactaggaagaaccttgggtggccttatgagcctttccatgtacctgaggatgtgaaacagcattggagccgccatgcctccgaaggtgcttctcttgaagctgaatggaatgccaagtttgccatgtatgagaagaagtatgcagaggaagctgcagaattgaagtctatcttcactggtgtgctaccttctgattgggattcagctctgccaaaatacactccagagagccctgctgatgccaccagaaatctatctcaaacatgcctgaacgcccttgcgccagttcttcccggtcttctaggtggcagtgctgatctagcttcctccaacatgacccttctgaaaatgtttggtgacttccaaaaaggtacaccagaagaacgtaatgtcagatttggtgtccgcgaacatggtatgggggctatctgcaatggaattgctctccacagccctggcctcattccctactgtgcaactttctttgtgttcactgactacatgagaggggccataaggatctccgccttgagtgaagctggagttatctatgtcatgacccatgattcaataggactaggagaagatggaccaactcatcagcctattgagcacttggccagtttcagggcaatgcccaacattttgatgcttcgtccggctgatggaaatgagaccgctggggcatacaaggttgcagtcgtcaacaggaagagaccatcaatccttgccctctcgaggcaaaagctgcccaaccttcctggaacttccattgaaggggtagaaaagggtggctacacaatatccgacaattcatctggtaacaagccagatgtcatcttgattggaactggttctgaattggagattgcagccaaagccgctgatgaactcagaaaagaagggaaagctgttagagttgtctcctttgtgtcttgggagttatttgacgagcaatcagatgtttacaaagaaagtattctgccagcagctgtaacagcaagagttagcattgaagctggatcaacatttggatgggaaaaaattgttgggagcggaggaaaggctattgggattgatggatttggagcaagtgctccagcgggaaaaatatacaaggagtatggcataacggcagaggcagttattgcagcagcgaaagaacttttctaggtattcactactgcatgcactccattgttgttagttctacagaaacttcttaaagtttggattctgggttggagatttttcactgaatcgttgttaatagactcagctcaattcatgatctcttaagttttcacaataaggaagataaaagtttttttcttcttgttttttatcttcttcagtgcaacagttgagactgcagactgaatcaatctaaagagagattagatttcttgaatgttcatgaaattgtatcaatacacttgaacatgtattgacttttgtaatcttatgtgttggattgcaagtgaaattatattcctccaataaaaaaaaaaagaaaaaaaaaaaaaaaaaaaaaaaaaaaaaaaaaaaagaaaaaaaaaaaagaaaaaaaaaaaagaaaaaaaaaaaaaaaaaaaaagaaaaaaaaaagaaaaaaaaagaaaaaaaagaaaaaaaagaaaaaaagaaaaaag

SEQ ID NO: 9063 - DNA, 2618 bp, Fragaria vesca
atcaaagagaacgccttctcaaatcttcaacggtctctcctctcctctccttcactctctctcttcttcttcttcttcttctctgagaagagacccttcttctgcttccacaccatgacttcctcctcctccgtcactctctcccaggccctcctcgcccgggccatctcccactccaactccacctcagaccgcgtctccctctcctccgccatctccctcccctccttctccggcctcaaatccacctcctccgccgccgcctccgtcaagctcgcccgggtcccacggcgccgcctgagccgcccggtccgggctgcggcggtcgagactctcgacaagactactgagacctcactggtggagaagtcggtgaacacgatccggttcttggcgattgatgctgtcgagaaggccaactccggtcatccgggtttgccgatggggtgtgctccgatggggcatattttgtatgacgagatcatgaggtataacccaaagaatccttactggttcaaccgtgaccggttcgtgttgtctgctggccacggctgtatgctgcagtacgctctgcttcacctcgctggttacgacagtgtcaaggaagaggacttgaagggcttcaggcaatggggaagcaagacccctggacatcccgagaactttgagacacccggagttgaagtcaccactggtcctttggggcaaggtattgcaaatgctgttggtctggcccttgccgagaagcacttggctgcacgtttcaacaagccagacagtgagattgttgatcactacacatattgtatattgggtgatggttgtcaaatggagggtatttctaatgaagctgcttcccttgctgggcattggggacttggaaagctgatagccttctatgatgacaaccacatttccattgatggagacactgagattgcattcaccgagaatgttgatgcccgttatgaggctctcggatggcacgttctctgggtgaagaatggaaacaccgggtatgatgagattagagctgccattaaggaagcaaaggctgtgacagacaagcccactttgataaaggtgacaacaaccatcggttttggatctccaaacaaggcaaactcatacagtgttcatggtgccgctctgggtgccaaggaagttgatgctaccaggcagaaccttggatggccatatgagcctttccacgtgccagaggatgttaaaagtcattggagtcgccatactccggaaggtgcagctcttgaagctgaatggaatgccaagtttgctgaatatgagaagaagtacgcagaggaagctgcagagctgaaatccatcatcactggtgagctacccgctggttgggaaaaggcactcccgacttacactccagaagtcccagctgatgctaccaggaatttatctcaggcaaacctcaatgcacttgcaccagttcttcctggtctaattggtggcagtgcagatcttgcttcttccaacatgactttgatgaaaatgtttggagatttccagaagggtaccccagaagaacgcaatattaggtttggtgttagggagcatgcgatgggagccatctccaatggaatttctcttcacagccctggatttatcccgtactgtgccactttctttgttttcactgactacatgagaaatgccataaggctctctgcattggcagaatctcgagttatctatgttatgacccatgattcaattggacttggagaagatggaccgacccatcaaccgattgagcacttggcaagtttccgggcaatgcccaacattttgatgctccgcccagctgatgggaatgagactgctgggtcatacaaagttgcagttgagaacaagaagagaccatctatccttgccctctctaggcaaaagctgccaaaccttgctggaacttccgttgagggagtcgcaacgggtggctacattgtgtcagacaactctacaggtaacaagcctgatgttattttgatcggtactggctctgagttggaaattgcatacaaagctggtgaggaactcagaaaggaaggaaaagcagtcagagttgtctccttcgtttcttgggaactctttgaagatcaatcagatgcatacaaggaaagtgttttgcccgcggcagtaacagccagggttagcattgaggctggatccacatttgggtggcataagattattggaaccaaaggaaaggcaatcggaattgaccgatttggagcaagtgcaccagccccaattatatacaaggagtatggcattactgttgaggccgttattgcagcagcaaaagaagtttgctaggtaacttgtatttagccatttggttttgcatggggattagagaagaggccatatgcaagtgatttggttcatagtatggcctatggtctcattcgccttaataaaatattacttttcatttgttgcttataattcttctgtgtagcaacatagatcaaaatagggagagtagggcttgagagcgctcattgtattttataactcttggacctggcttgaattttgtaatgttctgtggttaattaatgagtttcactttcctccacctaaca

SEQ ID NO: 9064 - DNA, 2645 bp, Panax ginseng
aagcagtggtatcaacgcagagtacatggggacagcccccaatttctctcccaaattcccaaagggggagactttatcaagcccactttctctctctctactgtcagccatggcagcttcttcatctctaactctttctcaagccatcctttcccgctcaattcctcgccatggctccaattcctctacccaacaaaccccatcttcttctctttcttctttttctcacctacccactttctccacctccctcagatcctcctctcgccaccgcagctccgccgctggccgccaggtagtccgggccgccgttgtggagacgctcgacaagacggagacctcattggtggagaaatcggtgaacacgattcggttcttggctattgatgccgtggagaaggctaattcgggtcatccgggtttacccatggggtgtgccccgatgggtcatatattgtacgacgaggtgatgaggtacaaccccaagaacccgtattggtttaatcgggatcgctttgttttatccgctggacatgggtgcatgcttcagtatgctttgctacaccttgctggttatgacagtgtcctggaagaagacttgaagtccttccgtcaatgggggagcagaactccaggacaccctgaaaactttgagacccctggtgttgaagtcactacaggtcctcttggtcagggtgttgccaatgctgttggtctggcccttgtggagaagcacttggctgctcgcttcaacaaacctgacagtgagattgttgaccattacacatatgtcatacttggggatggctgtcaaatggaggggattgcaaatgaagcttgttcccttgctggacattggggacttggaaaactgattgctttctacgatgacaaccatatctccattgatggtgacacggagattgcattcactgagagtgttgacacccgttttgagggtcttgggtggcacattatctgggtgaagaacggtaacacaggttatgatgacattcgtgctgccatcaaggaggcaaaggctgtaacagacaagcctactttaatcaaggtgaccacgacaattggttttggatcacctaacaaagcaaactcgtacagcgtccatggaagtgccctgggagctaaggaagtcgatgccacaaggaagaaccttgggtggccttatgagcctttccatgtacctgaggatgtgaaacagcattggagccgccatacctccgaaggtgcttctcttgaagctgcatggaatgccaagtttgctgagtatgaaaagaagtatgcagaggaagctgtagaattaaagtctatcattactggtgtgctacctgctggttgggagacagctctgccgacatacactccagagagccctgctgatgccaccagaaatctctctcaaacatgtctgaatgcccttgcaaaggttcttcctggccttctgggcggcagtgctgatcttgcttcctccaacatgaccctgctgaaaatgtttggggacttccaaaagggtacaccagaagaacgtaatgtcaggtttggcgtccgtgagcatggtatgggagctatctgcaatggtattgctctccacagccctggcctcattccctactgcgcaactttctttgtgttcactgactacatgagaggggccatcaggatctccgccttgagtgaagctggagttatttatgtcatgacccatgattcaattgggctgggagaagatggaccaactcatcaacctatcgaacatctggccagcttcagggcaatgcccaacattttgatgctccgtccagctgacggaaacgagactgctggggcatacaaggttgcagtcctcaacaggaagagaccatcaatccttgccctatctaggcaaaagctgcccaaccttcctggaacttccattgaaggagttgaaaaaggtgggtacacgatatcagacaattcatctggtaacaagccagatgtcatcttgattggaaccggttctgaattggaaattgcagccaaagctgctgatgaactcagaaaggaagggaaggcagttagggtcgtctcttttgtgtcttgggagttatttgatgagcaatcagatgattataaggaaagtgtcctacctgcagctgtaactgcaagggttagcattgaagctgcatcaacatttggttggggcaaacttgttggaagagggattgacaagtttggagcaagtgctccagctggaaaaacatacaaggagtatggcattacgtcagaggcagttattgcagcagctaaagaacttatctagagcttcattactgaattccatttggaggctgtcagttctgcggaaactagtatttttggattttggagtttgggttggagaatttacacctagtcattgttaaaagactcatcttgattcagtacctcttaagatttcacaataacaaagataaaattttcttttgttgcttttcattttcttcagcactgcagctgaggctgcaaaataaatcgagatcaaaagagattagatttcattaacgttcatgaatttgtataccaatacttgaacatggatcgacttttgtaattttatgtgttggattgttagtgatgtttatattcct

SEQ ID NO: 9065 - DNA, 2504 bp, Cucumis melo
acttcttctctcaccctttctcaagctctcttatcccgcgaaatctctcgccatggctccaattcctcctccgaccgtgttcccctctctattcccacattctccggcctcaaatccaccaaaccacctcgtctcgccggctccgtccaccgtcccagagctacccactaccgccgtcagatcgttagagccgccgtcgctgagacattgggcaccactgcagaaactgccctcgttgagaagtccatcaatacaattcgattcttggccattgatgcggttgagaaagctaattccggtcaccctggtttgcccatggggtgtgcgccgatgggtcatattctttacgatgaggtcatgaagtataaccccaaaaacccttactggttcaatcgggaccgtttcattttgtccgctggacatggttgtatgttgcagtatgctctgcttcatcttgctggatacgacagtgtcagggaggaggacttgaagagcttccgtcagtggggaagtcgaacgcctggacatccggagaactttgagactcctggtgttgaggttacaactggtcctcttggacagggaattgcaaatgctgttggtctggcccttgctgagaaacacttggctgctcggtttaacaaaccagacagtgaggttgtcgaccactacacatatgttatattgggagatggctgtcaaatggagggaattgccaatgaggcttgttctttggctggtcactggggactaggaaagcttattgctctgtatgacgacaaccacatttcaattgatggagatacagagattgcattcaccgagagtgttgacactcgttttgaggctcttggatggcacgttatctgggtgaagaatggaaacactggctatgatgaaatccgtgcggcaattcaggaagctaaagctgttaaagacaagcctacaatgatcaaggtgacaacaaccattggttttggatctccaaacaaagccaattcatacagtgtgcatggtagtgcccttggtgcaaaagaagttgaggctactaggagcaaccttggatggccatatgaacctttccatgtgccagaggacgtccagaagcactggagtcgtcacactcctctgggtgcagattttgaagcagaatggaatgccaaatttgctgaatatgagaagaagtacccggaggaagcggctgagttgaagtcaatcatcactggtgaacgaccagcgggctgggaagatgcacttccgaaatatacacctgagagtccaggtgatgcaactagaaatctgtctcagcaatgtcttaatgctctcgcaaaagttcttcctggttttcttggtggcagtgctgacttggcatcatccaacatgacccttctgaaaatgtatggcgatttccaaaagaacactccagaagaacgcaatcttaggtttggtgttagggaacatggaatgggtgccatatgcaatgggattgcccttcacagccctgggtttatcccatactgtgccacattctttgttttcaccgactacatgagagctgctatgaggatttctgccttatctgaagctggtgtcatctacgtcatgactcacgattcgattgggcttggagaagatggtccaacccatcagccaatagagcatctggcaagctttagggcaatgcccaacatattgatgtttaggcctgctgatggtaacgagactgctggtgcttacaaagttgcagttgtaaacaggaagagaccttctattatggccctttcgcggcaaaagttgcctcatttacctggaacttcaattgaaggagtcgagaagggtggatacattatttccgacaactcttcaggcaacaagccagatgttatcttgattggaactggttctgaattggagattgctttccaagcaggagaggaactcagaaaggaaggaaaagctgttagagttgtttcctttgtctcttgggagctttttgaagaacagtcagatgcctacaaggaaagtgttttgccagaagctgtatcagctagagtcagcattgaggccggttcaacatttgggtggggaaagattgttggaagcaaagggaaggcaattggtattgatcgatttggcgcgagtgcaccagcaggaaaaatatacaaggagttcggtatcacagtagaggctgtcgtagcagcagctcgagaacttagctaggatcatttatatcagtatcttccatatatggaaatcagcggcccatgacatgaatttctttattgtaataaacgaatgaaagcgtgatccttcttgttaaaaaaaaaaacaaaacaaaaacgtgaagcacattctctgttacttatgattctgtttacagtaaatgaggtcacaatgagaaacagagagacgcattagtatttttgagtgaaaatgaagtctacaacagctcctggacctctcttttctgtatcttctatgctcaatcttaagaggtacttcat

SEQ ID NO: 9066 - DNA, 3338 bp, Citrus sinensis
ctctctctctctctctctctctctctctctctctctctctctctcaaaacaaaacaatggcttcttcatcttctttcactctatcccaagcccttctgaccagaggcacttctcaccatggcttcactcaatcatcagagcaccatcgtctcgctctctctacactctctctcccttccttttccggcctcaaatccacctcctcttccaccctacgcacccccacctcccgccgccgcctctccaccagccaagccagcctacccatccgcgcagcggccgtagaaacactcgaaacctcgactgatgccgctttggttgagaaatcagtcaacaccattagattcttggctgtcgacgccgtcgagaaggccaattcgggtcacccgggattgcccatgggatgtgctcctatgggtcatattttgtatgatgaggtcatgagatacaaccccaaaaacccctactggtttaaccgtgaccgcttcgttttgtccgccggacatggctgcatgttgcagtacgctctccttcaccttgctggttacgacagtgtccaggaagacgacttgaagaatttcagacaatggggaagcaaaacacctggacacccagaaaactttgagacacctggtatcgaggtcacaactggtcctcttggccagggtatggcgaatgctgttggtttggctcttgcagagaagcatttggctgctcgatacaacaagcctgacaatgagattgttgaccactacacatatgtgatactgggagatgggtgccaaatggaggggattgcaaatgaggcttcttcccttgctggacacttgggacttgggaagcttattgctttctacgatgacaatcacatctctattgatggagacacggagattgcctttacggagaacgttgacaagcgttttgaaggtcttggctggcatgttatctgggtgaagaatggaaacactggctatgatgatattcgtgctgctattaaggaagcaaaggctgtcacagataaacccactttgattagggtgactacaaccattggctttgggtctccaaacaaagccaacagctacagtgtacatggaagtgcgctgggtgccaaggaagtagatgctactagaaagaatcttggatggccatacgagcctttccatgtgccagaagatgttaaaaagcactggagtcgccatgttgctgagggcgccactcttgaagctgagtggaatgccaagtttgctgagtatgagaaaaaataccctgaagaagctgcagagtttaagtctatcagcagtggtcaattacctgctggttgggagaaagcccttccgacatacactccagagagcccagcggaagctaccagaaatttatctcagacatgtcttaatgcccttgcaaagactctccctggtcttcttggtggtagtgcagaccttgcttcttccaacatgaccctactaaaaatgtttggggacttccaaaaggacaccccagaggaacgtaatgttcggtttggtgttagggagcatgggatgggagccatctgcaatggcattgccctgcacagccctggcctaattccttactgtgctactttctttgttttcaccgactacatgagagctgctataaggatatctgctctgtgtgaagctggcgttatctatgttatgacccatgattctattggtcttggagaagatggacctacccatcagccaattgaacacttggcaagtttccgtgccatgcccaacattttgatgctccgtccggctgacggtaatgaaactgctggtgcatacaaggttgctgttgccaacaggaagagaccgtccatccttgccctttcccggcaaaagcttccccaccttgctggaacttccattgatggtgttgaaaagggtgcctacataatttcggacaattcttctggtaacaaacctgatgtcattttgattggaactggttctgaattggaaattgccgccaaagcagctgaggaacttagaaagggaggaaaggctgtaagagttgtctcctttgtttcttgggagctttttgatgagcaatcagatgcctacaaggaaagtgtgcttccggctgctgtctcagctagagttagcattgaagctggatctacatttgggtgggagaagattgttggaagcaaaggaaaggccatcggcattgaccgattcggtgctagtgcaccagcaggcaaaatatacaaggagtttggtatcaccgcggaggctgttatcactgcagccaaagaagtctgctaagcttggttagtcaaaaacttcttattattccatatgcatttgggaattggtgattacagtgaagagaccattcccaagagagttgcttcattatggtctctcttgttttaataaaagcaagattatttttcttccttttgcttattattccactgcagagcatcgtagattgaagagagagagagggagagagagtagggcttgttcatgttcatgaatttgtatcaaactcttggacctatcttgagatttgtaatgtttcctgttgattttgatgcaaatttgctcgtccatcatcatttttgagtgatttctgcttatataactacaaatttttttctttttgccaatgagataaattttctcgttttgcaaaatctgatctataaaaccaaatttggcgtcaagttgggttgtctatgtgatctcggtataaactgaaaatctcttcagaagactttccacttgcatatttcttgatttgggcaaacgagcggctgattcttcaccaacaccaaggtatgaaaacaaaatgataaatgagaagtgagaagggctttcgctttaccgtccccaccattgaaattgagccggattgtgtaatggtttcgagccattcaagaagggtgtgggattggacctacagaagttacttggtgaaactgaagcttgagaaatttgttgataaaagcaagcgtccacttgatgtttgatgataagtttgtggttgttgaagcttatgttcaatccatgttgtcttataccaccaataataaagttaagtttgcttataaaaattgattggttatgtttcgtatttggcagtgggcccatcttacttacatacactgagtcagctctcatcaacgaatatttcagcatattcaacatttatccagattctggcgtgcgctctttttgcgcaccagtcttgatggtttggcgaccgaagattttcctcgttagacggttacatcttgattgtaatgttttttctttttttcattcttaatccatgattgaagtctttctttg

SEQ ID NO: 9067 - DNA, 3416 bp, Citrus clementina
aactaaatgagtcttgacgcgaacaaaaggctcgattatatcaacgaactcaatcgcccttaacacaagaaacacaatcagaaggcgagctcaacctctctctctctctctctctctctctcaaaacaaaacaatggcttcttcatcttctttcactctatcccaagcccttctgaccagaggcacttctcaccatggcttcactcaatcatcagagcaccatcgtctcgctctctctacactctctctcccttccttttccggcctcaaatccacctcctcttccaccctacgcacccccacctcccgccgccgcctctccaccagccaagccagccgacccatccgcgcagcggccgtagaaacactcgaaacctcgactgatgccgctttggttgagaaatcagtcaacaccattagattcttggctgtcgacgccgtcgagaaggccaattcgggtcacccgggattgcccatgggatgtgctcctatgggtcatattttgtatgatgaggtcatgagatacaaccccaaaaacccctactggtttaaccgtgaccgcttcgttttgtccgccggacatggctgcatgttgcagtacgctctccttcaccttgctggttacgacagtgtccaggaagacgacttgaagaatttcagacaatggggaagcaaaacacctggacacccagaaaactttgagacacctggtatcgaggtcacaactggtcctcttggccagggtatggcgaatgctgttggtttggctcttgcagagaagcatttggctgctcgatacaacaagcctgacaatgatattgttgaccactacacatatgtgatactgggagatgggtgccaaatggaggggattgcaaatgaggcttcttcccttgctggacacttgggacttgggaagcttattgctttctacgatgacaatcacatctctattgatggagacacggagattgcctttacggagaacgttgacaagcgttttgaaggtcttggctggcatgttatctgggtgaagaatggaaacactggctatgatgatattcgtgctgctattaaggaagcaaaggctgtcacagataaacccactttgattagggtgactacaaccattggctttgggtctccaaacaaagccaacagctacagtgtacatggaagtgcgctgggtgccaaggaagtagatgctactagaaagaatcttggatggccatacgagcctttccatgtgccagaagatgttaaaaagcactggagtcgccatgttgctgagggcgccactcttgaagctgagtggaatgccaagtttgctgagtatgagaaaaaataccctgaagaagctgcagagtttaagtctatcagcagtggtcaattacctgctggttgggagaaagcccttccgacatacactccagagagcccagcggaagctaccagaaatttatctcagacatgtcttaatgcccttgcaaagactctccctggtcttcttggtggtagtgcagaccttgcttcttccaacatgaccctactaaaaatgtttggggacttccaaaaggacaccccagaggaacgtaatgttcggtttggtgttagggagcatgggatgggagccatctgcaatggcattgccctgcacagccctggcctaattccttactgtgctactttctttgttttcaccgactacatgagagctgctataaggatatctgctctgtgtgaagctggcgttatctatgttatgacccatgattctattggtcttggagaagatggacctacccatcagccaattgaacacttggcaagtttccgtgccatgcccaacattttgatgctccgtccggctgacggtaatgaaactgctggtgcatacaaggttgctgttgccaacaggaagagaccgtccatccttgccctttcccggcaaaagcttccccaccttgctggaacttccattgatggtgttgaaaagggtgcctacataatttcggacaattcttctggtaacaaacctgatgtcattttgattggaactggttctgaattggaaattgccgccaaagcagctgaggaacttagaaagggaggaaaggctgtaagagttgtctcctttgtttcttgggagctttttgatgagcaatcagatgcctacaaggaaagtgtgcttccggctgctgtctcagctagagttagcattgaagctggatctacatttgggtgggagaagattgttggaagcaaaggaaaggccatcggcattgaccgattcggtgctagtgcaccagcaggcaaaatatacaaggagtttggtatcaccgcggaggctgttatcactgcagccaaagaagtctgctaagcttggttagtcaaaaacttcttattattccatatgcatttgggaattggtgattacagtgaagagaccattcccaagagagttgcttcattatggtctctcttgttttaataaaagcaagattatttttcttccttttgcttattattccactgcagagcatcgtagattgaagagagagagagggagagagagtagggcttgttcatgttcatgaatttgtatcaaactcttggacctatcttgagatttgtaatgtttcctgttgattttgatgcaaatttgctcgtccatcatcatttttgagtgatttctgcttatataactacaaatttttttctttttgccaatgagataaattttctcgttttgcaaaatctgatctataaaaccaaatttggcgtcaagttgggttgtctatgtgatctcggtataaactgaaaatctcttcagaagactttccacttgcatatttcttgatttgggcaaacgagcggctgattcttcaccaacaccaaggtatgaaaacaaaatgataaatgagaagtgagaagggctttggctttaccgtccccaccattgaaattgagtcggattgtgtaatggtttcgagccattcaagaagggtgtgggattggacctacagaagttacttggtgaaactgaagcttgagaaatttgttgataaaagcaagcgtccacttgatgtttgatgataagtttgtggttgttgaagcttatgttcaatccatgttgtcttataccaccaataataaagttaagtttgcttataaaaattgattggttatgtttcgtatttggcagtgggcccatcttacttacatacactgagtcagctctcatcaacgaatatttcagcatattcaacatttatccagattctggcgtgcgctctttttgcgcaccagtcttgatggtttggcgaccgaagattttcctcgttagacggttacatcttgattgtaatgttttttcttttttttcattcttaatccatgattgaagtctttctttg

SEQ ID NO: 9068 - DNA, 2676 bp, Panax ginseng
aagcagtggtatcaacgcagagtacatggggacagcccccaatttctctcccaaattcccaaagggggagactttatcaagacctctctttctctactgtcagccatggcagcttcttcatctctaactctttctcaagccatcctttcccgctcaattcctcgccatggctccaattcctctagccaacaaaccccatcttctctttcctctttttctcacctacccactttctccacctccctcagatcctcctctcgccgctgcagctccgccgctggccgccaggtagtccgggccgccgttgtggagacgctcgacaagacggagacctcattggtggagaaatcggtgaacacaattcggttcttggctattgatgcagtggagaaggctaattcgggtcatccgggtttacccatggggtgtgccccgatgggtcatatattgtacgatgaggtgatgaggtacaaccccaagaacccgtattggtttaatcgggatcgctttgttttatccgctggacatgggtgcatgcttcagtatgctttgctacaccttgctggttatgacagtgtcctggaagaagatttgaagtccttccgtcaatgggggagcagaactccaggacaccctgaaaactttgagacccctggtgttgaagtcactacaggtcctcttggtcagggtattgccaatgctgttggtctggcccttgtggagaagcacttggctgctcgcttcaacaaacctgactgtgagattgttgaccattacacatatgccatacttggggatggctgtcaaatggaggggattgcaaatgaagcttgttcccttgctggacattggggacttggaaaactgattgctttctacgatgacaaccatatctccattgatggtgacacggagattgcattcactgagagtgttgacacccgttttgagggtcttgggtggcacattatctgggtgaagaacggtaacacaggttatgatgacattcgtgctgccatcaaggaggcaaaggctgtaacagacaggcctactttaatcaaggtgaccacgacaattggttttggatcacctaacaaagcaaactcgtacagcgtccatggaagtgccctgggagctaaggaagtcgatgccacaaggaagaaccttgggtggccttatgagcctttccatgtacctgaggatgtgaaacagcattggagccgccatacctccgaaggtgcttctcttgaagctgcatggaatgccaagtttgctgagtatgaaaagaagtatgcagaggaagctgcagaattaaagtctatcattactggtgtgctacctgatggttgggagacatctctgccaacatacactccagagatccctgctgatgccaccagaaatctctctcaaacatgtctgaatgcccttgcaaaggttcttcctggccttctgggtggcagtgctgatcttgcttcctccaacatgaccctgctgaaaatgtttggggacttccaaaagggtacaccagaagaacgtaatgtcaggtttggcgtccgtgagcatggtatgggagctatctgcaatggtattgctctccacagccctggcctcattccctactgcgcaactttctttgtgttcactgactacatgagaggggccatcaggatctccgccttgagtgaagctggagttatttatgtcatgacccatgattcaattgggctgggagaagatggaccaactcatcaacctatcgaacatctggccagcttcagggcaatgcccaacattttgatgctccgtccagctgacggaaacgagactgctggggcatacaaggttgcagtcctcaacaggaagagaccatcaatccttgccctatctaggcaaaagctgcccaaccttcctggaacttccattgaaggagttgaaaaaggtgggtacacgatatcagacaattcatctggtaacaagccagatgtcatcttgattggaaccggttctgaattggaaattgcagccaaagctgctgatgaactcagaaaggaagggaaggcagttagggtcgtctcttttgtgtcttgggagttatttgatgagcaatcagatgattataaggaaagtgtcctacctgcagctgtaactgcaagggttagcattgaagctgcatcaacatttggttggggcaaacttgttggaagagggattgacaagtttggagcaagtgctccagctggaaaaacatacaaggagtatggcattacgtcagaggcagttattgcagcagctaaagaacttatctagagcttcattactgaattccatttggaggctgtcagttctgcggaaactagtatttttggattttggagtttgggttggagaatttacacctagtcattgttaaaagactcatcttgattcagtacctcttaagatttcacaataacaaagataaaattttcttttgttgcttttcattttcttcagcactgcagctgaggctgcaaaataaatcgagatcaaaagagattagatttcattaacgttcatgaatttgtataccaatacttgaacatggatcgacttttgtaattttatgtgttggattgttagtgatgtttatattcctccaaaatgtaccatctttcaggatagttaagaagcaag

SEQ ID NO: 9069 - DNA, 2530 bp, Triphysaria pusilla
gggataaacgaagtaaacaacacacatcacatctatccatggcttcttcttcactcacactctctcaagccatcctctctcgctcctccatcccccgccatggatccacccacaacctcctcccttccccctcctcctccgctctcccctctttctccggcctcaaatccatctcctcttccagtgtctcccgccgccgcgcctccggagccgccatagcccgcctccccgtacgcgcttccgcagccgtagagaccctagagaaaacgacagacaccgagctcatcgataagtccgtcaacacaatccggttcctgtcgatcgacgccgtggagaaagcgaattcgggtcacccgggtctgcccatgggttgtgctccaatgggtcacttattgtacgatgaggtgatgaggtacaacccgaagaacccttactggtttaatcgcgaccggttcgtgctctccgctgggcatgggtgtatgctacagtacgcacttcttcacctcgccggatacgacgccgtcaaggaagaggacttgaagagttttcgtcaatggggaagcaagacacctggacatcctgagaactttgagacccccggaattgaagtcaccactggcccacttgggcaaggtattgccaatgctgttggattagcgcttgcagagaagcacttggctgcccgatacaacaaaccggatagcgaaatagttgaccactacacatattgtatcctcggtgatggttgtcaaatggagggtatctcaaacgaagcctgctcccttgctggacattgggggctcggaaaattgatcgctttctacgatgacaatcacatctccattgacggtgacacagagattgcttttactgagaatgttgatacccgttttgaggctcttggatggcatgtgatttgggtgaagaacggtaacactggttatgatgagattcgtgctgccatcaaggaagcaaagtctgtgacagacaagcccactttaatcaaggtaactacaaccatcggatttggttccccaaacaaggccaactcatacagtgtgcacggaagtgcgttgggctccaaagaagttgaagccaccagacagaaccttggatggccgtttgagcctttccatgtgcctgatgatgtcaagagccattggagccgacatactgctgagggagctgcttttgaagctgaatggaatgccaaatttgctgagtactcaaagaaatattcagaggaagctgctgagttgaaatctatcatcaccggtgaatttccagctggttgggagaaggcccttcctacatacacgcctgaaagcccagccgatgccactagaaacctatctcagcaaaatctgaatgctcttgcaaaagtcctccctggtctaatcggtggcagtgccgatcttgcctcttccaacatgacccttctcaaaacttttggcgatttccaaaagaatactccggaagagcgtaacgtgcgattcggggtccgcgaacatggaatgggtgctatttgcaacggcattgcccatcatagccccggcttcgtcccctactgcgccaccttcttcgtattcaccgactacatgaggggcgccatgagaatctccgccctgtccgaagccggagtcatctacgtcatgacccacgattctatcgggctcggagaagacggtcccacgcatcaacctatcgagcacttagccagtttccgagccatgcccaatatactaatgctccgcccggcagatggcaacgagacggccggcgcgtacaaggtggctgcggtcaacaggaagagaccctcggtccttgccctttcccggcaaaagctgacccaactgcccggaacctccattgaaggagtcgaaaagggagggtacattatatcggacaattcttccggtaataagcccgatgttatcttgatcggaactggttcggaattggaaattgcggcaaaggctgccgatgagctcagaaaggagggtaaggtggttagggttgtgtcgtttgtttcttgggagctttttgatgatcagtctgatgagtacaaggagagtgtattgccggcttctgtgacagctagggttagcattgaggctgcatcaacatttggatgggataagattgttgggtctaaagggaaggctattgggatcgatcgattcggggctagtgcgcctgctggcaaaatttaccaggagtttggtatcacagccgaagctgttatagctgcagcaaaagcattgtgttaatctttggttggtttcaatattattggttgcttgtgactagaaatcaccctgatctggatattggttttgtcgaaatcattctgaaagaacaaaaatgatcttaaattaccataataaagacggcgagttttaaatctttagttttcttttcttgaaattgaaattgagaagctgcttttagcagtttagaatgtgatcaggagatgtaatagagcatgaaatcctcctgaattgtacacttgaacatcgtttcgattttg

SEQ ID NO: 9070 - DNA, 2456 bp, Triphysaria pusilla
ccaagtgtagtgaagaaagtacactcccagagcagagttatctatggcttcttcttcttcactcacactctctcaggccatcctttctcgcccctccatccctcgccatgtctccgcccagcacatccacccttcttccacctcccccactctcccttcattctccggcctcaaatccacctcatcttcaaccgtctcccgtcgacgcgccaccgcttccgtgacccgactcccaatacgcgcctctgccgccgtagagaccctcgataaaacaacagacactgagctcatcgataaatccgtcaacacaatccgattcctggcgatcgactcagtggagaaggccaattcgggtcacccgggtcttcccatgggttgtgctccgatgggtcacttattgtacgatgaggtaatgagatacaacccgaagaacccttactggtttaatcgcgaccggttcgtgctatccgccgggcatgggtgtatgctacaatacgcacttcttcacctggctggatacgacgccgtcaaggaagaggacttgaagagttttcgtcaatggggaagcaaatcacctggacatcccgagaactttgagacgcctggtattgaagtcactaccggtccactcggacaaggtattgccaatgccgtcgggttggcgcttgtagagaagcacttggccgcccgatacaacaaaccggatagcgagatagttgaccactacacatattgtatcctcggtgatggttgtcaaatggagggtatctcgaacgaagcctgctcccttgctgggcactgggggctcggaaaactaatcgctttctatgacgacaatcacatttccattgatggtgacacagagattgcttttactgagaacgttgacacccgttttgaggctcttggttggcatgtgatttgggtgaagaacggtaacaccggttatgatgaaattcgtgctgccattaaggaagcaaagtctgtgacagacaagcccactttgatcaaggtaactacaaccatcgggtttggttctccaaataaagccaactcatacagtgtccatggaagtgcattgggctccaaagaagtcgacgcaaccagacagaaccttggatggccgtatgagcctttccacgtgcctgatgatgtcaagagccattggagccgacatactgctgagggagctgctattgaagctgaatgggatgccaaatttgctgattactcaaagaaatatccagaggaagctgctgagttgaaatctatcatcaccggtgaattcccagctggttgggagaaagcccttcctacatacacacctgagagcccagccgacgccaccagaaacctatctcagcaaaatctgaatgctcttgcaaaggttctccctggtctgatcggtggcagtgcagatcttgcctcttccaacatgacccttctcaaaactttcggcgacttccaaaagaacactccggaagagcgtaacgtgcgatttggggtccgtgaacatggaatgggcgccatttgcaacggcatcgctcttcacagcccaggatttgtcccctactgcgccaccttctttgtattcaccgactacatgcggggtgccatgagaatctccgctctttctgaagccggagtcatctacgtcatgacccatgactctattggtcttggagaagacgggcccactcatcagcccatcgagcacttggccagtttccgggccatgcccaatatattaatgctccgcccggctgacggcaacgagacagccggcgcatacaaggtggctgtggtcaacaggaagagaccctcggttcttgcactctctcggcaaaagctgactcagctgcccggaacctccattgaaggggtcgaaaagggagggtacattatatcagacaattcgtctggtaacaagcccgatgtgatattgattggaactggttcggagttggaaattgcggcaaaggctggtgatgagctaagaaaggaagggaaggcggttagagttgtgtcatttgtttcttgggagctctttgatgatcaaagtgacgagtacaaggagagtgtattgccggcctctgtgacggctagggttagcattgaagccgcatcgacattcggatggggaaagattgttgggtctaaagggaaggctattgggattgatcgattcggggctagtgcgcctgctgggaaaatttacgaggagtttgggattacagccgaagctgttatagccgcagctaaagaattgtgttaattttttattggcttagagactattgtttgcttgtggcaagtaattaccctgatcttgaatttgaaattgtgaatctgctttttcagtttaaatgtgatcaggagagataatagagctataaaatccttcctgtattgtacacgtgaacatcatctcgattttgtaagtgaatgtgtttttt

SEQ ID NO: 9071 - DNA, 2387 bp, Triphysaria pusilla
aaacaacacacatcacatccatccatggcttcttcttcactcacactctctcaagccatcctctctcgctcctccatcccccgccatggatccacccagaatctcctcccttccccctcctcctccgctctcccctctttctccggcctcaaatccatctcctcttccagtgtctcccgccgccgcgcctccggagccgccataacccgcctccccgtacgcgcttccgcagccgtcgagaccctagagaaaacgacagacaccgagctcatcgataagtccgtcaacacaatccggttcctgtcgatcgatgccgtggagaaagcgaattcgggtcacccgggtctgcccatgggttgtgctccaatgggtcacttattgtacgatgaggtgatgaggtacaacccgaagaacccttactggtttaatcgcgaccggttcgtgctctccgctgggcatgggtgtatgctacagtacgcacttcttcacctcgcaggatacgacgccgtcaaggaagaggacttgaagagttttcgtcaatggggaagcaagacacctggacatcctgagaactttgagactcccggtattgaagtgacaaccggtccacttggacaaggtattgccaatgctgttggattagcgcttgcagagaagcacttggccgcccgatacaacaaaccggatagtgaaatagttgaccactacacatattgtatcctcggtgatggttgtcaaatggagggtatctcaaacgaagcctgctcccttgctggacactggggtctcgggaagttgatcgctttctacgatgacaatcatatctccattgatggtgacacagagattgcttttactgagaatgttgatacccgttttgaggctcttggttggcatgtgatttgggtgaaaaacggtaacactggttatgatgagattcgtgctgccatcaaggaagcaaagtctgtgacagacaagcccactttaatcaaggtaactacaaccatcggatttggttccccaaacaaggccaactcatacagcgttcacggaagtgcattgggctccaaagaagttgaagccaccagacagaaccttggatggccgtttgagccattccatgtgcctgatgatgtcaagagccattggagccgacatactgctgagggagctgcttttgaagctgaatggaatgccaaatttgctgagtactcaaagaaatattcagaggaagctgctgagctgaaatctatcatcaccggtgaatttccagctggttgggagaaggcccttcctacatacacgcctgaaagcccagccgatgccaccagaaacctatctcagcaaaatctgaatgctcttgcaaaagtcctccctggtctaatcggtggcagtgccgatcttgcctcttccaacatgacccttctcaaaacttttggcgatttccaaaagaatactccggaagagcgtaacgtgcgattcggggtccgcgaacacggaatgggtgctatttgcaacggcattgcccatcatagccccggcttcgtcccctactgcgccaccttcttcgtattcaccgactacatgaggggcgccatgagaatctccgccctgtccgaagccggagtcatctacgtcatgacccacgattctatcgggctcggagaagacgggcccacacatcaacctatcgagcacttagccagtttccgagccatgcccaatatactaatgctccgcccggcagatggcaacgagacggccggcgcgtacaaggtggctgcggtcaacaggaagagaccctcggtccttgccctttcccggcaaaagctgacccaactgcccggaacctccattgaaggagtcgaaaagggagggtacattatatcggacaattcttccggtaataagcccgatgtgatcttgatcggaactggttcggaattggaaattgcggcaaaggctgccgacgagctcagaaaggaggggaagacggttagggttgtgtcgtttgtttcttgggagctttttgatgatcagtctgatgagtacaaggagagtgtattgccggcttctgtgacagctagggttagcattgaggctgcatcaacatttggatgggataagattgttgggtctaaagggaaggctattgggatcgatcgattcggggctagtgcgcctgctggcaaaatttaccaggagtttggtatcacagccgaagctgttatagctgcagcaaaagcattgtgttaatctttggttggtttcgatattattggttgcttgtgactagaaattatcctgatctggatattggttttgtcgaaatcattctgaaagaacagcaaatgatcttaaattaccctaataaagacaacgagttt

SEQ ID NO: 9072 - DNA, 2601 bp, Cleome gynandra
cccagacgcacttcaccaccatcttctctctctatcccttctctttctctctctagttacagttacagagagcgcatccatggcttccacctcttcccttgcgctctctcaagccctcctcgcacgcgccatctctcaccatggctccgaccagcgcgtctccttacctactaccttcaccggtctcaattctaccgccccacgcgccgcttcctcgtccttcagacgacgcgccggtcagacgggtcgccgctctctccgaccggtaattcgtgccgctgcagtcgagacactcgatccaaccaccgaggcctcgctggtggagaagtcagtcaacacaatcaggttcttggcgatcgacgctgtggagaaggctaagtcgggtcaccccgggttgcccatgggttgtgccccgatgggtcacattttgtacgatgaagtaatgagatacaaccccaagaacccttactggttcaaccgtgaccgcttcgttctctccgccgggcatggctgcatgttgcagtacgcattgcttcacctcgctggatacgacagcgttctggaagaagatttgaagaatttccgtcaatgggggagtaaaacaccgggacaccccgagaactttgagactcctggaatcgaagtgactactggtcctctcggacaaggtatagcgaatggtgttggtttagctcttgctgagaagcatttggcagcaagattcaacaaacccgacaatgaaattgttgaccattacacatatgtgatcctcggagatggttgtcagatggaaggaatttcaaatgaagcttgctctctggctggccattggggacttggaaaactaattgctttgtatgatgacaatcacatttccattgatggtgacacggacattgcctttaccgagagtgtggaccaacggttcgaatcccttggatggcatgttatctgggtgaagaacggaaacaatggctatgacgagattcgtgctgccatcaaggaagctaaggctgtgaaagacaaacccacattgatcaaggtgacaaccacgattggttttgggtctcccaacaaggcaaactcgtacagtgtccatggtagtgcgcttggtgataaagaggttgaggctactagaaagaaccttggttggccttatgaaccgttccatgtccctgacgatgttaaaagccactggagccgtcatacccctgaaggtgctgctcttgaagctgattggaacactaagtttgcagagtatgagaagaaatacccagaagaagctgcagagttaaaaagtatcattactggtgaattaccttctggatgggagaaggcactccctacatatacccctgaatccgcgggtgatgctaccagaaacctgtctcaacaatgccttaatgcccttgcgaatgttattcctggattcctcggtgggagtgctgaccttgcttcttcaaacatgacattgctgaaaatgttcggtgactttcaaaaggggacaccagaagaaagaaacctgaggtttggtgtaagggaacatggcatgggagccatctgcaatggcatttgccttcatagcccgggtcttatcccctactgtgcaacattctttgtgtttactgactacatgagagctgccatgagaatctcagctttgtctgaagccggtgttatttacgttatgacccatgattccattggtcttggagaggatggaccaacccatcaaccaatcgagcacttggtgagtttccgtgccatgcctaatattatgatgttccgtcctgctgatggcaacgaaacagccggtgcgtacaaaattgctgtctctaaacgcaagactccctcagtcttagccctctctagacaaaagttgcctcaacttcccggaacatccattgaaggtgtggagaagggtggatacaccatctctgacaactcatccggtaacaaacctgatgtgattttgattggaactgggtctgaactagaaatagctgccatggctgctgatgaacttaggaaagaaggcaaagctgttagagttgtgtcctttgtgtgctgggaactgttcaatgaacaatcagatgcatacaaggaaagtgttttgccatctgatgtatcagctagggttagcattgaagcgggttcgacattcggatgggaaaagatcgttggatcgaaaggaaaggctattggaattgattcatttggggcaagtgcaccagcaggcatactctacaaggagtttggtatcactgttgacgccgttgttgcagcagctaaggaactgatctagatcatcaatgacgtcagcattctcctctgtttttttaaaaaaaaaaaaaaaagcaagatccagaattttctttttgtttcttttgtattcttgagaggatcaacataggcttggaagagcagagccaccattgtgaactttgtaccattacgcttaaaattcagtggatgtcccattcatggcattgactgggacatccattgaatactgcttttttatctaaatttgtatggtaaaaataataattggattagggtcttcttgaggtccatataaaatttgagggcatatctatt

SEQ ID NO: 9073 - DNA, 2582 bp, Euphorbia peplus
aagaagacgacggtgaagctcaacaatggcgtccaccacctcatctctctccctctcccaagtcctcctcgcacgtgccatttcacatcaaacttccgacaaccaccaccgtctctccctctccacgccctccctcccagctttctccggtctcaaatccaccacctcctccatcccacgcgccacctcttccccccgcaacaaccgccgccgtgtctctcgagtacgcgcggctgctgttgaggcggttgatgtcaccactgagacggcgttggttgataaatcagtgaatacgattaggtttcttgcgattgatgctgtagagaaggcgaattcgggacatcccggtctacctatgggatgtgctcctatgggacatatattgtatgatgaggttatgaagtataaccccaagaatccttactggtttaaccgggataggtttgttcttagcgcggggcacggatgtatgttgcagtatgctcttcttcatcttgctggttatgatagtgttcaggaagaggacttgaagcaatttcgtcaatggggaagcagaaccccgggacaccctgagaattttgagactcctggtgttgaagttacaactggacctcttggacaaggaattgccaatgctgttggtttggcactagcggagaagcatttggctgctcggtttaacaaaccaggcagcgaagttgttgaccactacacatattgtatattgggagatggttgtcaaatggagggaattgcaaatgaagcttgttcccttgctggacattggggactaggaaagcttatagctttctatgatgacaaccacatttctattgacggtgacacagaaattgcattcactgagagtgttgacaagcgttttgagggtctcgggtggcatgttatttgggtgaagaatggaaacactgggtatgatgagattcgtgctgccattaaggaggccaaggctgtgacagataaacccaccatgattaaagtcacaacaacaattggttatggatctccgaacaagtcaaactcatacagcgtgcacggaagtgcactcggttccaaggaagttgatgctactagacagaaccttggatggccctatgagccattccatgttccagaggatgttaagaagcactggagtcgccatgttgacgggggtgcttccttcgaagctgaatggaatgccaagtttgccgagtatgagaagaaatacccccaggaagctgcagaattcaagtccatcatcactggtgaattgcctgctggttgggagaaagcacttcccacatacactccagaaaccccagcagaggctactagaaatctatcgcagaccaacctcaatgcccttgctacagtgcttcctggtctcattggtggtagtgcagatcttgcctcttcaaacatgaccttgttgaaaatgttcggtgacttccaaaaagacacccctgaagaacgaaatgtcaggtttggtgtcagggagcatgcaatgggagctatctgcaatggcattggactccacagtcctggcttcatcccgtattgtgcaactttctttgttttcactgattacatgagggcttctatgaggatttcagccttgagtgagactggtgtcatttatgttatgacccacgattccatcggtcttggggaagatggaccgacccatcagccaatcgagcacttggcaagtttccgtgcaatgccaaacatcttaatgctccgaccagctgatggaaacgaaactgctggatcatacaaggttgcggtcgacaacaggaagagaccctctgtccttgcactttctcggcaaaagctgcctaatcttcccggaacctccattgagggagtcgagaagggtgggtataccatttcagataactcaacaggaaacaagcctgatgtcattttgatcgccactggttccgaattggaaattgctgccaaggctggtgatgagctaagaaaggagggaaagaccgtaagagtcgtctcgttcgtgtcttgggaactctttgaggaccaatcagctgagtacaaggaaagtgttttaccagaagccgtaacagctagagttagtattgaagctgcaacaacatttggatggcacaagattgtcggaagcaaaggcaaggctatcggaatcgaccacttcggagcaagtgcaccagctggaaagatatacaaggaattcggcattacagccgaggcagttattgctgcagccaaagaagtttgttaagctggtattagttggtgttggaaatggagatttgtcttggaaaatatggcatagaggctaccggaaacgagttttccatgactcagtctctctgttcaaataataaagggaaaatacaagaaaaaaaaatagaaggttagatttttcttatgttgctcacaaagtgatgaaatgagcaacaaaatccgaaaaagaggagagtttgattatgaacattgttgagtttgtaacagctcttgacctatcttgagttttgtaatttgctgtggtttttacttgtagtgaggttgacaattatttaatgctgcatcttaatttactt

SEQ ID NO: 9074 - DNA, 2521 bp, Gossypium raimondii
aattgaactcatttcgatctccctttcaccaacctcactcagctgagtcgactcgatcaaaaaacagcaatggcctctacttcatctctcactctgtctcaagctctcctagctcgaaccatcttttccgatgggtccacccaattctccgactaccgtgtttcacttcccaccaccactttctccggtctcaagctcactaccccacgctcccgtcgagtccttcccacgcgcttaaaccggagtctccgagtccgttccgctgccgtcgagacaatcggcactcctgccgagacttccttattggaaaaatcagtcaacacgatcagattcttagctattgatgctgtcgaaaaggctaattccggtcaccctgggttacccatgggttgtgctccgatgggtcacattttatacgatgaaatcatgaggtataatcctaagaacccttattggttcaaccgtgatcgtttcgtcttgtctgctggtcatggttgtatgttgcaatatgctctgcttcaccttgctggttatgatagtgttcaggaagatgatttgaagaattttcgtcaatggcaaagcagaacaccaggacatcctgagaattttgaaactcctggagttgaagttacaactggtcctcttggtcaaggtattgcaaacgctgtcgggttggctctagccgagaagcacctagctgctaggttcaacaagcctgacaatgagattgttgaccactacacgtatgctattttaggtgatggttgtcaaatggagggtgttgcgaacgaagcttgttcgcttgccggacactggggacttggaaagcttatagctttctacgatgataatcacatttcgatcgatggtgacactgaaattgcctttaccgagaatgtcgaggaacgttttaaggggcttgggtggcatgttatttgggtcaagaatgggaatactggttacgatgagattcgtgctgctattaaggaagcaaaggctgtcaaagacaagcccactttgatcaaggtgacaaccaccattggttatggatctccaaacaaggcaaactcgtacagtgttcacggtagtgcattgggtgccaaggaagtggatgctactaggaaaaaccttgcgtggccacacgagccattccatgtacccgaagatgttaaagggcattggagtcgccatgtccaacagggagctgcccttgaagccgaatggaatgcaaagtttgctgaatacgagaagaaatacaaaaatgaagctgcagagctcaaattaatcatcaccggtgaaccaccggccggatgggagaaggcacttccaacatatactccggagagccccgctgatgctaccagaaacctctctcaacaaaatctcaatgctctcgttaaagtactccctggttttcttggtggaagtgcagaccttgcttcttccaacatgaccttgctcaaaatgtatggtaatttccagaaagacacccctgaggaacgtaatcttaggtttggtgttagagaacacggaatgggagccatctgcaatggcattgcacatcacagccccggacttattccatactgtgctactttcttcgttttcaccgactacatgagagctgctattagaatgtctgcattgagtcaagctggagttatttacgttatgacccacgattccatcggtctcggggaagacggaccaacccaccaaccaatcgagcacttagctagcctccgtgcaatgcctaatgttttcatgcttcgtccagctgatggaaacgaaactgccggtgcatacaaagttgctatcctcaacagaaacacaccctccattatcgcactctctcgacaaaaactaccccaactacccggaacttccatcgagggggttgaaaaaggtggctacattatatcagacaattcttcaggaaacaaccccgacataatcctgatcggaactggttctgagctggaaattgccgctaaagccgccgatgaactaaggaagggcggaaaagctgttcgggtcgtctcccttgtttcttgggaactcttcgataatcaatcagacgcctacaaagaaagtgttttaccatctggtgtatcagctagggtaagtattgaggcaggatcaactttcgggtgggaaaagattgtgggatcgaaagggaaggcaatcggaatcgatcggttcggggcaagtgcaccggctggtagattatacaaagaattcggtttaacaccagaggctgttgttgcagcagcaaaggaactttgctaggcattattaggtgccttttgtgactgtttttgtttttaataataaaaggaatcatccaattttcttatgttgctttgtgattctatgtgtatgaatttgtaattcctctttgaactattttcccatagtttttgcatcacttgttgctgctttaaatgcttctatgtgggaaagagttgataattttgcttttaaaaaaaagggttaatattacttttagcccctgagtttc

SEQ ID NO: 9075 - DNA, 2597 bp, Triphysaria pusilla
ttttttttttattcttaaaacgccctccactcctcatccattttaatcgacataaacgaagtaaacaacacacatcacatctatccatggcttcttcttcactcacactctctcaagccatcctctctcgctcctccatcccccgccatggatccacccagaccctcctcccttccccctcctcctccgctcttccctctttctccggcctcaaatccacctcctctttcagtgtctcccgccgccgcgcctccggagccgccatagcccgcctccacgtacgcgcttccgcagccgttgagaccctagagaaaacgacagacaccgagctcatcgataagtccgtcaacacaatccggttcctgtcaatcgacgccgtggagaaggcgaattcgggtcatccgggtctgcccatgggttgtgctccaatgggtcacttattgtacgatgaggtgatgaggtacaacccgaagaacccttactggtttaatcgcgaccggtttgtgctctccgctgggcatgggtgtatgctacagtacgcacttcttcacctggccggatacgacgccgtcaaggaagaggacttgaagagttttcgtcaatggggaagcaagacacctgggcatcctgagaactttgagactcccggtattgaagtgacaaccggcccacttggccaaggtattgccaatgctgttggattagcccttgcagagaagcacttggccgcccgatacaacaaaccggatagcgaaatagttgaccattacacatattgtatcctcggtgatggttgtcaaatggaaggtatctcaaacgaagcctgctcccttgctggacactgggggctcggaaaattgatcgccttctacgatgacaatcacatctccattgacggtgacacagagattgcttttactgagaatgttgatacccgttttgaggctcttggttggcatgtgatttgggtgaagaacggtaacactggttatgatgagattcgtgctgccatcaaggaagcaaagtctgtgacagacaagcccactttaatcaaggtaactacaaccatcggatttggttccccaaacaaggccaactcatacagcgtgcacggaagtgcgttgggctccaaagaagttgaagccaccagacagaaccttggatggccgttcgagcctttccatgtgcctgatgatgtcaagagccattggagccgacatactgctgagggagctgcttttgaagctgaatggaatgccaaatttgctgagtactcgaagaaatatccagaagaagctgctgagttgaaatctatcatcaccggtgaattcccagctggttgggagaaggcccttcctgtatacacacctgagagcccagccgatgccactagaaacctatctcagcaaaatctgaatgctcttgcaaaagtcctccctggtctgatcggtggcagtgccgatcttgcctcttccaacatgacccttctcaaaacttttggcgatttccaaaagaatactccggaagagcgtaacgtgcgattcggcgtccgcgaacacggaatgggtgctatttgcaacggcattgcccatcatagccccggcttcgtcccttactgcgccaccttcttcgtattcaccgactacatgaggggcgccatgagaatctccgccctgtccgaagccggagtcatttacgtcatgacccacgattctatcgggctcggagaagacggtcccacgcatcaacctatcgagcacttagccagtttccgagccatgcccaatatactaatgctccgcccagcagatggcaacgagacggccggcgcgtacaaggtggctgcggtcaacaggaagaggccctcggtccttgccctttctcggcaaaagctgacccaactgcccggaacctccattgaaggagtcgaaaagggaggctacattatatcggacaattcttccggtaataagcccgatgtgattttgatcggaactggttcggaattggaaattgcggcaaaggctgccgacgagctcagaaaggaggggaaggcggttagggttgtgtcgtttgtttcttgggagctttttgatgagcagtctgatgagtacaaggagagtgtattgccggcttctgtgactgctagggttagcattgaggctgcatcaacatttggatgggataagattgttgggtctaaagggaaggctattgggatcgatcgattcggggctagtgcgcctgctggcaaaatttaccaggagtttggtatcacagccgaagctgttatagctgcagcaaaagcattgtgttaatctttggttggtttcggtattattggttgcttgtgactagaaattaccctgatctggatattggaagaacagcaattgatcttaaattaccctaataaagacgagttttaaatctttagttttcctttcttgaaattgaaattgagaagctgcttttgcagtttgaatgtggtcaggagatgtaatagagcatgaaatcctcctgaattgtacacttgaacatcgtctcgattttgttattgaatgtcttttttacgaaaaaaaaaaaaaaaaaaaaac

SEQ ID NO: 9076 - DNA, 2368 bp, Tropaeolum majus
tagatcccaaaaagctttgacacaccatcaacaatggcttccacttcatctctcactctatcccaagctctcttggctaaatccatttccactcaatcatctgaccaccgtgtttccctatccactctctccgttccttcgttttccggtcttaaatcgtccacttcatctgcacgtgtttccgctgctgcggctttctctcgtcgtcgtcggttattctccacgggacaacaacaggttcaacgcaccgtgcgtgctgctgctgtcgagactgttgaaaccactacggaggcttcgctggtggataaatctgtgaatacgattaggtttttggctattgatgctgtggagaaggcgaagtctggacatcccggtttgcctatgggatgtgctccgatggggcatattttgtatgatgagattatgaagtataacccgaagaatccttattggttcaatcgtgatcgcttcgttttgtccgctggacatggatgtatgcttcagtatgctttgcttcaccttgctggatacgatagcgtcaaggaagaagacttgaagcaatttcgccaatggggaagcaagagtccaggacatccagagaatttcgagacccctggtgttgaagtcacaactggtcctctaggacaaggtattgcaaatgctgttggtttagcccttgcagagaagcatttggctgctagattcaacaaaccagacagtgaaattgttgatcattacacgtattgtatattgggagatggttgtcaaatggagggaatttccaatgaagcttgttccttggctggtcactgggggcttggaaagcttattgctttctatgacgacaaccacatttcaatcgatggtgacactgagattgcttttaccgagagtgtggaccaacgtttcgagggtctcggatggcatgttatttgggtgaagaatggaaacactggctatgatgaaatccgtgctgccatcaaggaagcaaaggctgtcacggacaaacccactttgatcaaggttactacaaccattggatatgggtctcccaacaaggcaaactcatacagtgtacacggaagtgcactaggtgaaaaagaagtggatgctactagacagaaccttggatggccatatgagccgttccatgtgcctgaagatgttaagagtcactggagtcgtcatactcctgagggagctgcttttgaagcagaatggaatgccaaattcgctgcgtatgagaagaagtatagcgaggaagctgcagagctgaattcaatcatcaagggtgaactccctgctggttgggagaaagcactacccacatatacgccagagaccccaggtgatgccacaagaaatttatctcaacaatgtcttaacgctctagcccctgttgtccctggtctagtcggtgggagtgcagatcttgcttcttccaacatgacattgctgaaaatgtttggtgacttccaaaaggccacaccagaagaacgtaacatcaggttcggtgttcgtgagcatggtatgggagctatctgtaacggtatcgccctccacacacccggactgattccctactgcgctactttcttcgttttcaccgactacatgagagctgccatgaggatatccgctttgtccgaagctggagttatctatgttatgactcacgactccattggtctcggagaagacggaccaacccatcaacctatcgaacatttggcaagcttccgagcaatgcccaacatcttgatgcttcgcccagctgacggaaacgaaacagctggttcgtacaaagtagccatccagaacaggaagagaccatctatccttgccctctctcgacaaaaactgcctaaccttcccggaagctcaatcgaaggagtcgaaaagggtgggtacattatttcggacaactcttcagacaacaaaccagatgtgatcttgatcggaactgggtctgaattggaaatcgctttcaaagcaggcgaagagctcagaaaggaaggtaagaccgttagagttgtttccttcgtttcttgggaacttttcgacgaccaatcagacgactacaaggaaagcgttcttccagctggcgtaaccgcaagggttagcattgaagccggaactacgttcggatggcataagattgttggaagtaaaggaaaggctatcggtatcgaccattttggagctagtgcaccagcaggtatcatttataaggagtttggtattactgttgaggctgttattgcagcagctaaggaagttctctaggcttttgtaatagggggtgggaaaatgtagtttgagtttgaactttgaagagaccaataaatttgtttaattcacagaatgt

SEQ ID NO: 9077 - DNA, 2539 bp, Triphysaria pusilla
aactcacagttcacacacacctcatattttcttttatcttcaaaacgccccatccattttatttaacaaacaccaagtgtagtgaagaaagtacactcccagagcagagttatctatggcttcttcttcttcactcacactctctcaggccatcctttctcgcccctccatccctcgccatgtctccgcccagcacatccacccttcttccacctcccccactctcccttcattctccggcctcaaatccacctcatcttcaaccgtctcccgtcgacgcgccaccgcctccgtaacccgactcccattacgcgcctccgccgctgtggagaccctcgataaaacaacagacactgagctcatcgataaatccgtcaacacaatccgattcctggcgatcgactcagtggagaaggcgaattcgggtcacccgggtctgcccatgggttgtgctccgatgggtcacttattgtatgatgaggtgatgagatacaacccgaagaacccttactggttcaatcgagaccggttcgttctctccgccgggcatgggtgtatgctacagtacgcacttcttcacctggctgggtacgacgcagtcaaggaagaggacttgaagagttttcgtcaatggggaagcaaatcacctggacatcccgaaaactttgagacgcctggtattgaagtcactaccggtccactcggacaaggtattgccaatgccgttggattggcccttgtagagaagcacttggctgcaagatacaacaaaccagatagcgagatagttgaccactacacatattgtatcctcggtgatggttgtcaaatggagggtatctcgaacgaagcctgctcccttgctgggcactgggggctcggaaaattaatcgctttctatgacgacaatcacatttccattgacggtgacacagagattgcctttactgagaacgttgacacccgttttgaggctcttggttggcatgtgatttgggtgaagaatggtaacaccggttatgatgaaattcgtgctgccattaaggaagcaaagtctgtgacagacaagcccactttgatcaaggtaactacaaccattgggtttggttccccaaataaggcaaactcatacagtgtccatggaagtgcattgggctcgaaagaagtcgatgcaaccagacagaaccttggatggccgtatgagcctttccacgtgcctgatgatgtcaagagccattggagccgacatactgctgagggagctgctattgaagctgaatgggatgccaaattttctgattactcaaagaaatatccagaggaagctgctgagttgaaatctatcatcaccggtgaattcccagctggttgggagaaagcccttcctacatacacacctgagagcccagccgacgccaccagaaacctatcacagcaaaatctgaatgctcttgcaaaggttctccccggtctgatcggtggcagtgccgatctcgcttcttccaacatgacccttctcaaaactttcggcgacttccaaaagaacactccggaagagcgtaacgtgcgatttggggtccgcgaacacggaatgggtgccatatgcaacggcattgcccttcacagcccgggcttcgtcccctactgcgccaccttctttgtattcaccgactacatgcggggcgccatgagaatctccgctctgtccgaagccggagtcatctacgtcatgacccatgactctattggtctcggagaagacggtcccactcatcagcccatcgagcacttggccagtttccgggccatgcccaatatactaatgctccgcccggccgacggcaacgagacagccggcgcatacaaggtggctgtggtcaacaggaagagaccctcggttcttgccctctctcggcaaaagctgacccaactgcccggaacctctattgaaggggtcgaaaagggaggatacattatatcagacaattcgtctggtaacaagcccgatgtgatattgatcggaactggttcggagttggaaattgcggcaaaggctggtgatgagctaagaaaggaaggaaaggcggttagagttgtgtcatttgtttcttgggagctttttgatgatcagtctgatgagtacaaggagagtgtattgccggcctctgtgacagctagggttagcattgaagccgcatcgacattcggatggggaaagattgttgggtctaaagggaaggctattgggattgatcgattcggggctagtgcgcctgctgggaaaatttacgaggagtttggaattacagccgaagctgttatagccgcagctaaagaattgtgttaattttttattggcttagagattattgtttgcttgtggcaactggcaagtaattaccctgatcttgaatgtgaaattgtgaatctgccttttcagtttaaatgagatcaggaaagataatagagctataaaatccttcctgtattgtacacgtgaacatcatatcgattttgtaagtgaatgtcttttattaac

SEQ ID NO: 9078 - DNA, 2469 bp, Amsonia hubrichtii
cgctccgtcccccgccatggctcttcctcttcttccaatcccagccttccttccatttcactccccacattttccggccttaaatccactgtcccaccaacaaccgtctctcgccgccgctcttctgttccagccatttctcgccgccaaaaccaggtctttgcttctgccgctgtagagacacttgagaaaaccgacactgaactggtcgagaagtccgtcaacacgatccgattcttggccatcgatgctgtcgagaaggccaactccggacaccctggtctgcccatgggttgtgctcccatggggcacatactctatgatgaggtcatgaggtataatccgaaaaatccttactggtttaaccgcgaccgctttgttctctccgccggccatggttgtatgctccagtatgctttgcttcatcttgctggctatgatgctgtcaaggatgaagatttgaagggtttccgccaatggggaagcaaaacccctggtcatcctgagaactttgagacccctggtgttgaagtcaccactggtcctcttggtcaaggtattgccaacgccgttggtttggcccttgctgagaagcacttggctgctcgttacaataagcctgactctgagattgttgaccactacacatattgtatacttggtgatggatgtcaaatggaggggatttcaaatgaagcttgttccctagctggccactggggacttggcaagctgattgcattctacgatgacaaccatatctcaattgatggtgacactgaaattgctttcaccgagaccgttgagactcgttttgaggctctcgggtggcatgttatctgggtgaagaatggtaacacaggttatgatgaaatccgtgctgccatcaaggaagcaaaggctgtgaaagacagacccaccttaatcaaggtgaccacaactattggttttggctcgcccaacaaggcaaactcatacagtgtacacggaagtgccctgggtgccaaggaagtagaagctacgaggaaaaaccttgggtggccttatgagcccttccatgtgcctgaggatgtgaagaagcattggagtcgccatgttccttctggcgctgcatatgaagctgaatggaatgccaaatttgcagaatacgaaaagaaatatgcagaggaggcagcagaattgaagtccatcattactggtgaactcccagcaggctgggagaaggctcttccaacatatactcctgagagtccagccgatgctaccagaaacctctcccagcaaaaccttaatgcccttgcaaaagttcttcctggtctgcttggtggtagtgctgaccttgcctcttccaacatgacccttcttaagatgtttggtgacttccagaagagcacaccagaagagcgtaatgtgaggtttggtgtccgtgaacatggtatgggagccatctgtaatggtattgctttgcacagccctggcctaattccctactgtgcaactttctttgtgttcaccgactacatgagagctgccatgaggatctctgccttgtgtgaagctggagttatctatgtgatgacacatgattcaattgggcttggagaagatggacccacccatcagcccattgagcacttggcgagtttccgggcaatgcccaacattctgatgctacgtccagctgacggcaatgaaacagctggtgcatacaaggttgctgtcgtcaacaggaagagaccgtcagtcctagctctttcccggcaaaagttgccccagcttgctggaagttctattgaaggagtagaaaagggtggatacactatatcagacaattcttctggcaacaaacctgatgtcatcttgattggaacaggttctgagttggagattgcagtcaaggctgctgacgaactcagaaaggaagggaaggccgtcagagttgtctcctttgtttcgtgggagctgtttgacgagcaatcagctgagtacaaggaaagtgtcttgccagcttcagtaacagctagggttagcattgaggctggatcaacatttggatgggagaaaattgttggatctaaaggaaaggcaattgggattgaccgatttggggctagtgctcctgcaggaaagatatacaaggagtttggccttactgcagaggctgttgtagcggcagctaaagaagttatgtaggctttgcaaatctagctttccagattgctggttgtctgtcgaaattatttaggtccgaaatttgagcttggaaattaccacaaaaacacttttaagggactcggctccgttcactgccgcggcttgagacttcataataagggaagataagttttctttgtccgtctgtcgtcagtagtggagcattttgagcctgcaaattgaattaaacagaggatgcagtttaggatgctcctgaatttgtacactttgacatggcttttgtaacttttatgt

SEQ ID NO: 9079 - DNA, 2647 bp, Phaseolus vulgaris
taactatcccttcttttatattttatgtattgggggttggtaggatagttttgtgagcgaaccgaagtgaagtgtttttaattaccactcatgcttaattagtaggtcaaactaataaagtacattcaaaacactgattcgtatatatcagaaaactctcattctctccgccactctcctccctccccgccggccacctcgtattctctccctccgccatatcactgaaaaccatggcttcctcttcttccctctccctctcccaagccctcctccgccccacccctctctcctcctcccactgcccctccctccgcgtctccccctcactccgccccgcccctcccaccgccccgctctccctccgccgccgtgcagccccagtgcgcgcctcggttcccctcaagacagttgagaaggccacttctgacatcgcgcttgtggagaagtctgtcaacacgatccgcttcctcgccatcgactccgtcgagaaggcgaattccggccacccgggtctccccatgggatgcgccccaatgggtcatgtactctacgacgaggccatgaagtacaaccccaaaaatccgaagtggttcaaccgggatcgctttgttttgtccgcgggtcacgggtgcatgctccagtacgccttgctgcacctcgctggcttcgatagtgtcaaggaagaggatttgaggcaatttcgacaatgggggagcagaaccccgggacacccagagaattttgagacccctggagttgaagtgacaacaggtcctcttggtcaggggattgccaatgctgttggtttggcccttgcggagaagcacttggctgcgagattcaacaagcctgataatgagattgttgatcattacacatatgctatactgggtgatggttgtcaaatggagggtattgcaaatgaggcgtgctcacttgctggccactggggactggggaagctgatagcattttatgatgacaatcacatttctattgatggtaacacagagattgcattcaccgagagtgttgatagtcgttttgagggacttggatggcatgttatatgggtgaagaacggaaataatggctatgatgatattcgtgctgccattgaggaagcaaaatctgtcaaagacaaacccacactaatcaaggtcacaacaaccattggttttggttctcccaacaaagctaactcctacagtgtgcatggaagtgcactgggtgccaaagaagtcgatgccacaaggcagaaccttggatggccatatgagccattccatgtgcccgaggatgtcaaaaagcattggagtcgccacatccccgagggtgctgcacttgaagctgagtggaatattaagtttgccgagtatgaaaagaaatacaaggaagaagctgcggaactaaaatctataatcaatggtgaattgcctgctggatgggagaaggcacttccgacatacactccagagagcccagctgatgccaccagaaatctgtctcagcaaaaccttaatgcccttgcaaaggttcttccgggtctgcttgggggtagtgcagatcttgcttcttccaacatgaccttgctaaaaatgtttggggacttccaaaaggatactccagcagaacgcaacgttagatttggtgttagggaacatggaatgggagcaatctgcaacggcattgctcttcacagccctgcactcattccgtattgtgctactttctttgttttcactgattacatgagaggtgccataaggctttctgcgctatctgaggctggggttatttatgtcatgactcatgattcaataggacttggagaggatggtccaacccaccaacctatagagcacctggcaagcttccgggcaatgccgaacattttgatgctccgtcctgccgatggcaatgaaacagctggggcatacaaagttgcggtgctcaacaggaagagaccctccatccttgccctttccaggcagaaactgcccaatcttccgggatcttctatcgaaggcgttgaaaagggtggttacaccatttcagacaactccactggaaacaagcctgatgccattttgattggaactggttctgaattggaaattgctgccaaagctgctgaggacctgagaaaggaagggaagactgttagagttgtttcccttgtttcttgggaactttttgatgagcagtcagaagcatacaaggagagtgttttgcctgctgctgtatcagccagagttagcatcgaggcaggatcaacatttgggtgggagaaaattgttggatctaagggaaaagccataggtattgatcgttttggagctagtgctccagcaggaaaaatatacaaagaattcggtatcactaaggaagctgttattgctgcagcaaaagagcttatctagatgtattagtttctttctgttcatgtaaaacttttcattttttcctcttttggttttatttgctagaggttgttttggcataagacgttgcttccactcactcactcactgttttgctggatttctcatgagaaatttgccatttgtaagagtaatagccttttggcaaaataaaaggaggttcctactttatacatgtattaagcatgacactgtcgtcc

SEQ ID NO: 9080 - DNA, 2520 bp, Orobanche aegyptiaca
cagccatggcttgttcgtcttcctttacactctctcaggccatcctttctcgatccgccaacccccgccatggctccgcccatcagctccacccctcatcctctgtctccattccctccttctccggtatcaaatccacctcctccacagtcacccgtcgccgcccctcctccgccgtaacccgccttccagtccgcgcctcctccgccatcgagaccctccagaaaacaaccgacaccgagctcgtagataagtccgttaacacaatacgctttctggcgattgacgctgttgagaaggcgaattcgggccacccaggtctgccgatggggtgtgctccgatgggtcacatattgtacgatgaggtgatgagatacaaccctaagagcccctactggtttaatcgtgatcggtttgtgctttccgctggacatggatgtatgctacagtacgcacttcttcacctggccggatatgacgccgtcaaggaagaggatttgaagagtttccgtcaatggggaagcaaaacacctggtcaccctgaaaactttgagacgcctggtgttgaagtcaccaccggcccacttggacaaggtgttgcgaatgcagttggcttagcacttgctgagaagcacttggctgcacgatacaacaaacaagatagtgaaatagttgaccattacacatatgtcatccttggtgatggatgtcaaatggagggtatatcaaatgaagcctgctctcttgctggacactgggggctcggaaagttgattgctttctatgacgataatcatatctccattgatggtgacacagagattgcttttactgagaatgttgagacccgttttgaggctcttggttggcatgtgatttgggtgaagaatggtaataatggttatgatgaaattcgtgctgccatcaaggaagcaaaggctgtgaaagacaagcccactttgatcaaggttactacaaccatcggcttcggctccccaaacaaggccaactcatacagtgtccatggaagtgcattgggtgccaaggaagtcaaagcgactagacaaaaccttggatggccatatgagcctttccacgtgcccgaagatgtgaagaaccattggagtcgtcatgttgctgagggtgctgcttttgaagctcaatggaacgccaagtttgctgaatatgcaaagaagtatccagaggaagctgctgaactgaaatctattatcactggtgaactccctggtggttgggagaaggcccttcctacatacactcccgaaagcccagcggatgccaccagaaacctctctcaacaaaacctgaacgcccttgctaaagtcctccctggtctccttggcggcagtgccgaccttgcctcctccaacatgaccctcttaaaaacattcggcgacttccaaaaaaccactccggaagaacgtaatattcgatttggcgtccgagaacacagcatgggcgcaatttgtaacggcatcgctctccatagcccgggccttatcccctattgtgccaccttcttcgtattcactgactacatgcgggctgccatgcgaatctctgccttgtccgaagccggagttatttacgtcatgacccatgactctatcgggcttggagaggacgggcccactcatcagcccatcgagcatttggcgagtttccgggccatgcccaatattctaatgttccgtccagctgatggcaatgagacggccggtgcatataaggtggcggtggttaacagaaagagaccctcggtgcttgccctttcccgccagaagctgccccaactgcccgggacctcgattgaaggggtcgaaaagggaggttatattgtttctgataactcatcgggtaataagccggacgttattttgattggaactgggtcggagttggaaattgcggtgagagctggcgatgagcttagaaaggaaggtaagggagttagggttgtgtcgtttgtttcttgggagctttttgatgagcaatcggatgagtataaggagggtgtactgccatcttctgtgacagctagggttagtattgaggccgggtcaacttttgggtgggaaaagattgtgggacctaaagggaaggcgatcgggattgatcggtttggggctagtgcacctgcggggaaaatttataaggaatttgggatcacatccgaagctgttatagccgcggctaaaaaattgtgttaaatcttgttttcttggtttgcttgtgccaacattaaccctaatttgggtgcgggctgggtgaaaaatcagaataaagcacatcaaagggcttggtttggggtggcctgaatcggggatttttataaagacgagacaaaaatagtttgttgtttgttttcttgaaactgaaacttagaaccagcttttgctgtctaaatgtgatcggagagacgtaggtgtaatttttctggattgtacacttgaacatcgtcttgattttgcaagttaaattgtttttgatgattgattt

SEQ ID NO: 9081 - DNA, 2515 bp, Cajanus cajan
ccatcactctcactctctcccaaccatgccttcctctctctccctctcccagcctgccctcctccgccccgccgccctcccctcctccgaccgcccctcgctccgcctccccctcgccctccgccatgccgccacccctctctccctcgccctccgccgccgccccgcctccgtgcgcgcctccgtctccgtgaggacagtcgagaaggcccccgcggaggccgcgctggtggagaagtcggtgaacacgatccggttcctggctgtggacgccgtggagaaggccaactccggccaccccggcctccccatggggtgcgcgccgatggggcacgtgctctacgacgaggccatgcggtacaaccctaagaaccctttctggttcaaccgcgatcgcttcgttctctccgctggacacggatgcatgctccagtacgcgctgctccacctcgccggatacgacagcgtcaagcaagaggatttgaaggaatttcgccaatgggggagtagaactccgggacaccctgagaatttcgagacacctggaatcgaagtcacaacaggtcctcttggtcagggtattgccaatgctgttggtttggcccttgcggagaagcacttggctgcaagatttaacaagcctgataacgagattattgaccattacacatatgttatattgggtgatggttgtcaaatggagggaattgcaaatgaagcgtgctcacttgctggccactggggactggggaagctgatagcattttatgatgacaatcacatttcaattgatggtaacacagagattgcgttcactgagagtgttgatagtcgttttgagggacttgggtggcatgttatctgggtaaagaatggaaataatggctatgatgatattcgtgctgccattaaggaagcaaaagctgttaaagacagacccaccctgatcaaggtcacgacaaccattggttatggttctcctaacaaggctaactcctacagtgtgcatggaagtgcattgggtgccaaagaagttgatgccacaagacagaatcttggatggccatatgagcctttccatgtgcctgaggatgtcaaaaagcattggagtcgccacatccctgagggtgctgcacttgaagctgagtggaatgctaagtttgctgaatatgaaaagaaatacaaggaagaagctgcagaattgaagtctattatcaatggtgaattgcctgccggttgggagaaagcacttccgacgtatacaccagagagcccagctgatgccaccagaaacctgtctcagcaaaacctcaacgcccttgcaaaggttcttcctggtcttcttggtggtagtgctgatcttgcttcttccaacatgaccttgctaaaaatgtctggggacttccaaaaggatactccttcagagcgcaatgtcagatttggtgtcagagaacacggtatgggagcgatctgcaatggcattgctcttcacagccctggactcattccatattgcgcaactttctttgttttcactgactacatgaggggtgccatacggctttcggccctatccgaagctggggtaatttatgtcatgacccatgattcaataggacttggagaggatgggccaacccaccagcctgtagagcacctggccagcttccgggcaatgccaaatattttgatgcttcgtcctgctgatggcaatgaaacagctggagcatacaaagttgctgtggtcaacaggaagagaccctccatccttgccctttccaggcaaaaactgccccagcttcccggaacttctatcgaaggagttgaaaagggtggttacaccatttcagacaactcaacaggcaacaagcctgatgtcattttgattggaaccggttccgagttggaaattgctgccaaagctgctgatgacttgagaaaggaagggaaggctgttagagttgtttcccttgtttcttgggaactttttgatgagcaatcagaagcctacaaggagagtgttttgcctgctgctgtttcagccagagttagcattgaggcaggatcaacatttgggtgggagaaaattgttggagccaaaggaaaagcaataggtattgatcgatttggagctagtgctccagcaggaaaaatatacaaagaatttggtatcactaaggaagctgttgttgctgcagcaaaagagcttatctagatgttttagtttctgctcatttagaacttttcatttttttcttctggttttggttgatatttacaaagagtgggggttgtttcaagagcattccgtggcttgaataagtaaaggttaaatatccttttattggggttcaaagtgaagaaaaagcacagatcaaagattttgtgaacttgtaataactatttgacaattgagttttgcactgccacatgattaaattcaattgctaatacactcatagcatttgttcattttccagccaaaccaagtcgagaaaagttgttgtggataact

SEQ ID NO: 9082 - DNA, 2640 bp, Triphysaria pusilla
aaacgccctccactcctcatccattttaatcgacataaacgaagtaaacaacacacatcacatctatccatggcttcttcttcactcacactctctcaagccatcctctctcgctcctccatcccccgccatggatccacccagaccctcctcccttcccctcctcctccgctcttccctctttctccggcctcaaatccacctcctctttcagtgtctcccgccgccgcgcctccggagccgccatagcccgccttcccgtacgcgcttccgcagccgttgagaccctagagaaaacgacagacaccgagctcatcgataagtccgtcaacacaatccggttcctgtcaatcgacgccgtggagaaagcgaattcgggtcacccgggtctgcccatgggttgtgctccaatgggtcacttattgtacgatgaggtgatgaggtacaacccgaagaacccttactggtttaatcgcgaccggtttgtgctctccgctgggcatgggtgtatgctacagtacgcacttcttcacctggccggatacgacgccgtcaaggaagaggacttgaagagttttcgtcaatggggaagcaagacacctggacatcctgagaactttgagacccccggaattgaagtcaccactggcccacttggccaaggtattgccaatgctgttggattagcacttgcagagaagcacttggctgcccgatacaacaaaccggatagcgaaatagttgaccactacacatattgtatcctcggtgatggttgtcaaatggagggtatctcaaacgaggcctgctcccttgctggacactgggggctcgggaagttgatcgctttctacgatgacaatcatatctccattgatggtgacacagagattgcttttactgagaatgttgatacccgttttgaggctcttggttggcatgtgatttgggtgaaaaacggtaacactggttatgatgagattcgtgctgccatcaaggaagcaaagtctgtgacagacaagcccactttaatcaaggtgactacaaccatcggattttggttccccaaacaaggccaactcatacagcgttcacggaagtgcattgggctccaaagaagttgaagaccaccagacagaaccttggatggccgttcgagcctttccatgtgcctgatgatgtcaagagccattggagccgacatactgctgagggagctgcttttgaagctgaatggaatgccaaatttgctgagtactcaaagaaatattcagaggaagctgctgagttgaaatctatcatcaccggtgaatttccagctggttgggagaaggcccttcctacatacacgcctgaaagcccagccgatgccaccagaaacctatctcagcaaaatctgaatgctcttgcaaaagtcctccctggtctgatcggtggcagtgccgatcttgcctcttccaacatgacccttctcaaaacttttggcgatttccaaaagaatactccggaagagcgtaacgtgcgattcggggtccgcgaacacggaatgggtgctatttgcaacggcattgctcatcatagccccggcttcgtcccttactgcgccaccttcttcgtattcaccgactacatgaggggcgccatgagaatctccgccctgtccgaagccggagtcatttacgtcatgacccacgattctatcgggctcggagaagacggtcccacacatcaacctatcgagcacttagccagtttccgagccatgcccaatatactaatgctccgcccggcagatggcaacgagacggccggcgcgtacaaggtggctgcggtcaacaggaagagaccctcggtccttgccctttcccggcaaaagctgacccaactgcccggaacctccattgaaggagtcgaaaagggagggtacattatatcggacaattcttccggtaataagcccgatgtgatcttgatcggaactggttcggaattggaaattgcggcaaaggctgccgacgagctcagaaaggaggggaaggcggttagggttgtgtcgtttgtttcttgggagctttttgatgatcagtctgatgagtacaaggagagtgtattgccggcttctgtgacagctagggttagcattgaggctgcatcaacatttggatgggataagattgttgggtctaaagggaaggctattgggatcgatcgattcggggctagtgcgcctgctggcaaaatttaccaggagtttggtatcacagccgaagctgttatagctgcagcaaaagcattgtgttaatctttggttggtttcgatattgttggttgcttgtgactagaaattatcctgatctggatattggttttgtcgaaatcattctgaaagaacagcaaatgatcttaaattaccctaataaagacgacgagttttaaatctttagttttcttttcttgaaattgaaattgagaagctgcttttgcagtttgaatgtgatcaggagatgtaatagagcatgaaatcctcctgaattgtacacttgaacatcgtctcgattttgttattgaatgtcttttttacgagtttcttgttacaatatttgcaaatttgatagggaatgatgttgaagttaaatgtcc

SEQ ID NO: 9083 - DNA, 2594 bp, Lupinus angustifolius
ggtaactatcacattcttcactctctctctctctctctctctctctcaccaaccatgtcttcttcttcttccctctctctctcccaatctctcctcaccaaacccacttcccaccgatctccctctctctcccccacccatctctccctcccaactcaccacctcaccaccacccgccgccgcatcaccaccctccaccaccgccgcatcactcccatcagagcctccgccgccgttgagacccttaacaaacccaccgcggatttgtcccttgtggagaaatcggtgaacacgatccgttttcttgcggtggatgctgttgaaaaagcgaactcgggtcacccgggtttaccaatggggtgtgccccaatgggtcatgttctatatgatgaagtgatgaggtataatccaaagaacccttattggtttaaccgtgatcgttttgttctttctgctggacatggatgtatgcttcagtatgcgttacttcaccttgctgggtatgatagcgttaaggaagaagatttaaagcaattccgccaatgggagagccggaccccaggacaccctgagaactttgagacgcctgggattgaagtcacaacaggtcctcttggtcagggtattgcaaatgcggttggtttggcgcttgccgagaagcacttggctgcgagatttaacaagcctgacaatgagattgttgatcattacacgtatgctatactgggtgatggttgccaaatggagggaattgcaaatgaggcgtgctcacttgctggccattggggactgggaaagctaatagcattttatgatgacaatcacatttctattgatggtaacacggagattgcgtttactgagaatgtcgatagtcgttttgagggactaggatggcatgttatttgggtaaagaatggaaataatggctatgatgatatccgtgctgccattaaggaagcaaaagctgtcaaagacaaaccaacattgatcaaggtcacaacaaccattggttttggttctcctaacaaggccaactcatacagtgtgcatggaagtgcactgggtgccaaggaagtagatgccactaggaataaccttggatggccatatgagcctttccacgtgcccgaggatgtcaaaaagcattggagtcgccacatccctgagggtgctgcacttgaagctgagtggaatgctaagtttgcagaatatgaaaagaaatacaaggaggaagctgcagagctgaagtctcttatcagtggtgaattacctgctggttgggagaaagcacttccgacatacactccagagatcccagccgatgccaccagaaatttgtctcagcaaaaccttaatgcccttgctaaggttcttccaggtctgcttggaggtagtgcagatcttgcgtcttccaacatgaccttgctgaaaacgtctggagactttcaaaagaatactccagcagagcgtaatattagatttggtgttagagaacatggaatgggggcaatctgcaacggcattgctcttcacagcccgggactgattccttattgtgcaactttctttgttttcactgactacatgagaggtgccataagactttctgccctgtctcaggctggggttatttatgttatgacccatgattcaataggactcggagaggatgggccaacccaccagccgatagagcacctggcaagcttccgggcaatgccaaatattttgatgttgcgtcccgctgatggtaatgaaactgctggagcatacaaagttgctgtgcttaacaggaagagaccctccatccttgctctctcccggcaaaagttgcccaaccttcccggatcatctattgaaggagttgaaaagggtgggtacatcatttcagacaactcaacaggcaacaagcctgatgtcattctgatcggaaccggttctgaattggaaattgcagccaaagctgccgatgatctacggaaggaagggaaggctgttagagttgtttcctttgtttcatgggaactttttgatgagcaatcagaatcctacaaggagagtgttctgcctgctgctgtttcggctagagttagcattgaggccgggacaacatttgggtgggagaaaattgttggaagcaagggaagagcgataggcatcgatcattttggagctagtgctccagcaggaaaaatatacaaagagtttggtatcaccaaagaagctgttatcgctgcagcaaaagagcttatttagatgtgttggtttctgctcatttagaagttctgaattttctttttccgggttttggtttgatatttacactggagttggaaactgcatgttatctttcaaaagcattcctttgcttgaataagaaaaaaagtgttaaaagtaatgaatttttctgaacttgtaataactttcacagttgagttatatattaacacatgtttaatttggtgctcatgattaacacatgtttaatttggtgctcatgatcatccatttatcccttccttaggtctgcaaatgtattttctttggcagtaataaaaattagaaggaaataactaagagcaaactccaaa

SEQ ID NO: 9084 - DNA, 2501 bp, Rosmarinus officinalis
gagagaaagagagagatcgctatggcttcttctacctctctcactgtctctaaagtcgtcctctctcgctcctccttcgccagccatggctccatcccggcatcatcctccctctccgttccctcctcgggcctcaagtctgccacctcgatcaccaccacctccgcctcccgccgccacggccccatcccaatccgcgcctctgcagctgtcgaaaccctaggtcagaccaccgacacggagttgatggagaaatccgtcaacacgatccgtttcctgtcaatcgacgccgtcgagaaggcgaattccggccaccccggactgcccatgggctgcgctccgattggccacgtgttgtacgatgaagtgatgaggtacaaccctaagaacccctattggttcaatcgcgatcgatttgtgctctccgccgggcacgggtgcatgctgcagtacgcgcttcttcacctcgctggatacgacgccgttaaggaagaggatttgagaaattttcgtcaatggggaagcaagacaccagggcatccggagaatttcgagacacctggtgttgaagtcactactggccctttaggccaaggtgctgccaatgccgttggcttggcgctggcagagaagcacttggctgcccgttacaacaagccagatagcaagattatcgaccactatacgtattgtatccttggcgatgggtgtcaaatggagggtattgcaaacgaagcctgttctcttgctggacactgggggcttgggaagttgatcgctttctatgatgataatcacatctctatagatggtaatacagaaattgcgtttactgagtctgttgaagcccgattcgaggctcttggttggcatgttatctgggtgaagaatggtaacactggttatgatgaaatccgtgctgcgatcgaggaagcgaaggctgtaaaagacaagcccactttgatcaaggttacaactaccattggtttcgggtcccccaacaaggccaactcatacagtgtgcatggaagtgcattgggtgccaaggaagttgaagccacgaggaagaaccttggatggcctcatgagcctttccatgtgcctgaggatgtgaagaaacattggagcagacacgtggctgatggtgctgctcttgaagcagaatggaacaccaaatttgctcaatacgagaagaagtatccagaggaagcggccgaactgaattccatcatcaccggccaactcccggcaggttgggagaaggctcttcctacatacacccccgagagcccagctgatgccaccagaaacctctctcagcaaaacctcaacgcgttagcaaaagttctccctggtctgcttggaggcagtgctgacctcgcgtcgtccaatatgaccctcctcaaaatgttcggtgacttccaaaagaacatacctgaagagcgtaatgtgagattcggtgttcgtgagcatagtatgggggccatatgtaacggaatcgcccttcacagccctggcctcattccttactgtgcgaccttctttgtgttcaccgactacatgagagcagccatgaggatctctgccttgtccgaagctagggttctctacgtgatgacccacgattctattggtcttggagaggacgggccgactcatcagcctatcgagcatctggctagtttccgagcaatgcccaacatattgatgctccgcccagctgatggcaacgagacagccggtgcttacagggttgctgtactcaacagaaagagaccgtcggtccttgccctttctcgacaaaagctgccgaacctgccgggtacctccatcgaaggtgtggagaagggaggctacaccatatcagacaactcaacaggtaacaagcccgatgtgatattgattggaactggttcggagctggaaattgcagcaaaggccggtgacgagctgaggaaggaagggaaggccgtgagggtcgtctcattcgtttcttgggagctttttgatgatcagtctgatgagtacaaggaaagtgtgctgccggctgctgtaacggccagggttagcattgaggcgggaacaacatttgggtggggcaagatcattggagataaaggaaaggcgattggaatcgatcgatttggggctagtgcacctgcacccaaaatatacaaggaatttgggctcacagtagaagctgttatagccgcagctaaagaagtctgttaagctaaggagcagccctcaagagttgggagagagagatgaggcaatatgaatgctactggatattttacgtacactagaacttcaatttgtaacttgatgtgtttccgatggattttacaagatttgcgtatgacatgcatgagttttgaaggtagcttgtgccgtgtgcgtatgttggcctagtggtagagtggttaatgttcgatgccaaaggtattgggttcgagtcgaccgtgacgcggtctttaaaatttctgtatttaattgac

SEQ ID NO: 9085 - DNA, 2470 bp, Glycine max
ctctctttctctctccctccagtctcaaccatggcttcttccacttcctctatctctctctcccaagccctcctccgccccaccaccacctctctcccctcctcctcctcctccctccgcctcacccccactctccgccctaccccacccgccctctccctccgccgccgcctcaccacctccatccgcgccgccgcctccgtcaaaaccgtcgagaaggcaaccgcggacgccgcgctggtcgaaaaatccgtcaacacgatccgcttcctcgccatcgacgccgtcgagaaggcgaattcgggtcacccggggctccccatgggatgcgctccgatgggtcacgtgctatatgatgaaaccatgaagtataaccctaagaaccctttctggttcaaccgcgatcgcttcgttctctccgctgggcacgggtgcatgcttcagtacgcgcttctgcacctcgctgggttcgatagcgtcaaggaagaggatttgagggaatttcgccaatgggggagcagaactccgggacaccctgagaattttgagactccgggaattgaagttacaacaggtcctcttggtcaggggattgccaatgctgttggtttggcccttgcagagaagcacttggctgcaagatacaacaagcctgacaatgagattgttgaccattacacgtatgctattctgggtgatggttgtcaaatggagggaattgcaaatgaagcatgctcacttgctggccactggggactggggaagctgatagcattttatgatgacaatcatatttctattgatggtaacacagagattgcgttcaccgagagtgttgatagtcgttttgagggacttgggtggcatgttatttgggtaaagaatggaaataatggctatgatgatattcgtgctgccattaaggaagcaaaagctgtcaaagacaaacccacattaatcaaggtcacaacaaccattggttatggttctcctaacaaggctaactcctacagtgtgcatggaagtgcactgggtgccaaagaagttgatgccaccaggcagaaccttggatggtcacatgagccattccacgtgcctgaggatgtcaaaaagcattggagtcgccacacccctgagggtgctgcacttgaagctgagtggaatgctaagtttgctgagtatgaaaagaaatacaaggaggaggctgcagaattgaaatctattatcaatggtgaattccctgctggttgggagaaagcacttccgacatacactccagagagcccagcggatgccaccagaaacctgtctcaaacaaaccttaatgcccttgcaaaggttcttcccggtctgcttggtggcagtgcagatcttgcttcttccaacatgaccttgctcaaaatgttcggggacttccaaaaggatactccagcagagcgtaatgttagattcggtgttagagaacacggaatgggagctatctgcaacggcattgctcttcacagccctggactgattccatattgtgcaaccttctttgtattcactgactacatgagaggtgccataaggctttctgcgctgtctgaggctggggttatttatgtcatgacccatgattcaataggacttggagaagatgggccaacccaccagccaattgagcacctagcaagcttccgggcaatgccaaacattttgatgcttcgtcccgccgacggtaacgaaacagccggagcatacaaagtggccgtgctcaacaggaagagaccctccattcttgccctatccaggcaaaaactgccccagcttcccggaacttccattgaaggagttgaaaagggtggttacaccatttcggacaactccactggcaacaagcctgatgtcattttgatcggaactggttcggaattggaaatcgctgccaaagctgctgatgacctaaggaaggaagggaaggctgttagagttgtttcccttgtttcttgggaactttttgatgagcaatcagaagcctacaaggagagtgttttccctgctgctgtttcagccagagttagcattgaggcaggatcaacatttgggtgggagaaaattgttggagcaaagggaaaagcaataggcattgatcgttttggagctagtgctccagctggaagaatatacaaagaatttggtatcactaaggaagctgttgttgctgcagctaaagagcttatctagaacttttgatttttttttgccttctggttttggttgagagcattccatgtcatgaataagaaaaaggttaaatatccttcgattgggaatttgggattctaagtgaagaagcaacatagatcaaagaattttgtgaacttgtaataactatttgacaatttagttttgcactgccacatggttaaattcaatgtttgatcatatcaaccatagatgctagtgtatactacttgtataatttgtt

SEQ ID NO: 9086 - DNA, 2543 bp, Vigna unguiculata
gagattcgtatacactcagaaaactctgttgtctccgcccctcctcactccacctacacctactagccattctcttcctcggtcaaaaccatggcttcctcttcttctctctccctctccaaagcccttctccgccccacacctctcccctcctcccaccacccctctctccgcctctccccctcactccgcccctcccctcccacacctcccctctccctccgtcgccgcgctacccatgtgcgcgcctccgttcctgttaagaccgccgagaaggccacctccgacgtcgcgctcgtggagaaatccgtcaacacgatccgcttcctcgccatcgacgccgtcgagaaggccaattccggccacccgggtctccccatgggatgcgccccaatgggtcacgtgctctatgacgaggtcatgaagtacaacccgaaaaatcccaagtggttcaaccgggatcgctttgttttgtccgcgggtcacgggtgcatgctccaatacgctttgctgcaccttgctggcttcgatagtgtcaaggaggaggatttgagggaatttcgacaatgggggagcagaaccccgggacacccagagaattttgaaactcctggagttgaagttacaacaggtcctcttggtcaggggattgccaatgctgttggtttggcccttgcggagaagcacttggctgcgagattcaacaagcctgataacgagattgttgatcattacacatatgttatactgggtgatggttgtcaaatggagggtatcgcaaatgaggcatgctcacttgctggccactggggactggggaaactgatagcattttatgatgacaatcacatttctattgatggtaacacagagattgcattcaccgagagtgttgatagtcgttttgagggacttggctggcatgttatttgggtgaagaatggaaataatggctatgaggatatccgtgctgccattgaggaagcaaaatctgtcaaagacaaacccacactgatcaaggtcacaacaaccattggttatggttctcccaacaaagctaactcctacagtgtgcacggaagtgcactgggtgccaaagaagttgatgccacaaggaagaaccttggatggccatatgagccattccatgtgcctgaggatgtcaaaaagcattggagtcgccacatccctgagggtgctgcatttgaagctgagtggaatattaagtttgctgagtatgaaaggaaatacaaggaagaagccgccgaactaaaatctataatcaatggtgaattgcctgctggatgggaggaagcacttccgacatacactccagagagcccagctgatgccaccagaaatctgtctcagcaaaacctcaatgcccttgcaaaggttcttccgggtctgctggggggtagtgcagatcttgcttcttccaacatgaccttgctaaaaacgtttggggacttccaaaaggatactccagcagaacgtaacgttagatttggtgttagagagcatggaatgggagcaatctgcaacggcattgctcttcacagccctggactgataccatactgtgccactttctttgttttcactgattacatgagaggtgccataaggctttctgcgctatctgaggccagggtggtttatgtcatgactcatgattcaataggacttggagaggatggtccaacccaccaacctatagagcacctggcaagtttccgggcaatgccgaacattttgatgcttcgtccggccgatggtaatgaaacagctggtgcgtacaaagttgcagtgctcaacaggaagagaccctccatccttgccctttcccggcagaaactgcccaatcttcccggatcgtccatcgaaggcgtcgaaaagggtggttacaccatttcagacaactccagtggcaacaagcctgatgtgattttgattggaactggttctgagttggaaattgctgctaaagctggtgaggagttgaggaaggaagggaagagtgttagagttgtttcccttgtttcttgggaactttttgatgagcagtcagaagaatacaaggagagtgttttgcctggtgctgtgtcagccagagttagcatcgaggcaggatcaacatttgggtgggagaaaatcgttggacctaagggaaaagccattggtattgatcgttttggagctagtgctccagcaggaaaaatatacaaagaattcggtattacaaaagaagctgttattgctgcagcaaaagagcttatctagaggggtttagtttctttcttttcatgtaaaacttttcatttttctcttttgcttttatttgcgagagcttgttttggcatgagacgttgtttccactcactcactgtttttactggatttctcctgataaatttgccatttataaaagcaatgagaggttcctacttaataagctggaagggaaatcgttgtaaactatatgtactaaatgaataagttttttttatatatttatataaattactcatattggaatgttc

SEQ ID NO: 9087 - DNA, 2608 bp, Glycine max
tctctctctctttctctctccctccagtctcaaccatggcttcttccacttcctctatctctctctcccaagccctcctccgccccaccaccacctctctcccctcctcctcctcctccctccgcctcacccccactctccgccctaccccacccgccctctccctccgccgccgcctcaccacctccatccgcgccgccgcctccgtcaaaaccgtcgagaaggcaaccgcggacgccgcgctggtcgaaaaatccgtcaacacgatccgcttcctcgccatcgacgccgtcgagaaggcgaattcgggtcacccggggctccccatgggatgcgctccgatgggtcacgtgctatatgatgaaaccatgaagtataaccctaagaaccctttctggttcaaccgcgatcgcttcgttctctctgctgggcacgggtgcatgcttcagtacgcgcttctgcacctcgctgggttcgatagcgtcaaggaagaggatttgagggaatttcgccaatgggggagcagaactccgggacaccctgagaattttgagactccgggaattgaagttacaacaggtcctcttggtcaggggattgccaatgctgttggtttggcccttgcagagaagcacttggctgcaagatacaacaagcctgacaatgagattgttgaccattacacgtatgctattctgggtgatggttgtcaaatggagggaattgcaaatgaagcatgctcacttgctggccactggggactggggaagctgatagcattttatgatgacaatcatatttctattgatggtaacacagagattgcgttcaccgagagtgttgatagtcgttttgagggacttgggtggcatgttatttgggtaaagaatggaaataatggctatgatgatattcgtgctgccattaaggaagcaaaagctgtcaaagacaaacccacattaatcaaggtcacaacaaccattggttatggttctcctaacaaggctaactcctacagtgtgcatggaagtgcactgggtgccaaagaagttgatgccacaaggcagaaccttggatggtcacatgagccattccacgtgcctgaggatgtcaaaaagcattggagtcgccacacccctgagggtgctgcacttgaagctgagtggaatgctaagtttgctgagtatgaaaagaaatacaaggaggaagctgcagaattgaaatctattatcaatggtgaattccctgctggttgggagaaagcacttccgacatacactccagagagcccagcggatgccaccagaaacctgtctcaaacaaaccttaatgcccttgcaaaggttcttcccggtctgcttggtggcagtgcagatcttgcttcttccaacatgaccttgctcaaaatgttcggggacttccaaaaggatactccagcagagcgtaatgttagattcggtgttagagaacacggaatgggagctatctgcaatggcattgctcttcacagccctggactgattccatattgtgcaaccttctttgtattcactgactacatgagaggtgccataaggctttctgcgctgtctgaggctggggttatttatgtcatgacccatgattcaataggacttggagaagatgggccaacccaccagcctattgagcacctagcaagcttccgggcaatgccaaacattttgatgcttcgtcccgccgacggtaacgaaacagccggagcatacaaagtggccgtgctcaacaggaagagaccctccattcttgccctatccaggcaaaaactgccccagcttcccggaacttccattgaaggagttgaaaagggtggttacaccatttcggacaactccactggcaacaagcctgatgtcattttgatcggaactggttcggaattggaaatcgctgccaaagctgctgatgacctaaggaaggaagggaaggctgttagagttgtttcccttgtttcttgggaactttttgatgagcaatcagaagcctacaaggagagtgttttccctgctgctgtttcagccagagttagcattgaggcaggatcaacatttgggtgggagaaaattgttggagcaaagggaaaagcaataggcattgatcgttttggagctagtgctccagctggaagaatatacaaagaatttggtatcactaaggaagctgttgttgctgcagctaaagagcttatctagaacttttgatttttttttgccttctggttttggttgagagcattccatgtcatgaataagaaaaaggttaaatatccttcgattgggaatttgggattctaagtgaagaagcaacatagatcaaagaattttgtgaacttgtaataactatttgacaatttagttttgcactgccacatggttaaattcaatgtttgatcatatcaaccatagatgctagtgtatactacttgtataatttgtttcacttgcagattcactcttagcatttgagtgtttggatggccgtgttttgttcattaagaaatgttgacatggatagtttgttgcatggtaaattggtgattaatacctttttaagcttcttttggcaagtt

SEQ ID NO: 9088 - DNA, 2785 bp, Lupinus angustifolius
gaaaacataaaaacatgaccattatttcactcattccctctctacctaaccccacgtgtttgtgtcaacaccaatctcaacaactctctctttctctctctacattttaaaacccattttctcactccccattttctccaccttctcttattctctctcttcaatggcttccacttcctctctctctctctcccaatctctcttcttcatcaaacccacctcccccaaaccctcttcctactctctctccatccccaccaatcatgggttctcctcaaaatcctctctttcttcctcctcctccctccgccgccgcaccatcacagcctccaccgccgcacccaccaccgagggaacaacaacattggttgataagtcagtgaactcgatccggttcctttccattgatgcggtggagaaagcgaattctggtcaccctggtcttccaatggggtgtgctccaatgggtcatatattgtatgatgaagtgatgaaatataatcctaagaaccctaaatggtttaatcgtgatcgatttgttttatctgctggtcatggttgtatgcttcaatatgctttgcttcaccttgctggttatgatagtgttaaagaagaagatttgaaggaattccgccaatggggtagcaaaaccccgggacatcctgagaactttgagacccctggagttgaagtgacaacaggaccacttggtcagggtattgccaatgctgttggtttggccttagcagagaagcacttagctgctagatttaacaagcctgacaacgagataattgatcattacacatatgctatacttggtgatggttgtcaaatggaggggattgcaaatgaagcatgttcacttgccgggcattggggactggggaagctaatagctttttatgatgacaatcacatttcaattgacggtgacacagagattgcatttactgagagcgttgatagtcgtttcgagggactagggtggcatgttatttgggtaaagaatggaaacaatggctatgatgatattcgtgctgccattaaggaagcaaaagccgtcaaagacaagcccacactcataaaggtaacaacaacaatcggttatggttctccgaacaagtctaactcctacagtgtgcatggaagtgcacttggtgcaaaagaagttgatgccacaaggaagaaccttggatggccacatgagcctttccaggtgcccgaggaagtcaaaaagcattggagtcgccacattcccgagggtgctgcacttgaaaccgagtggaatgctaagtttgcggaatatgaaaagaaatacgaagacgatgctgcagttctgaagtccattattagtggcgaattacctgctggttgggagaaagaacttccgacatatactccagagagcccagccgatgccaccagaaatttgtctcagcataaccttaatgcccttgcaaaggttcttcctggtctgcttggaggcagtgcggatcttgcatcttccaacatgaccttgttgaaggcgtttgggaacttccaaaaggatactccagaagagcgtaatgttagatttggtgtcagagaacatggaatgggagcaatctgcaatggcattgctcttcacagccctggactgattccttactgtgcaactttctttgttttcaccgactacatgagaggcgccataagactttctgccctttccgaggctggagttatttacgttatgacccatgattcaataggacttggagaggatggtccaacccatcagccaatagagcacttggcaagcttccgggcaatgccaaatattttgatgcttcgtcctgctgatggtaatgaaactgctggagcatacagagttgctgtccttaacaggaagagaccctctatcctcgcactttctcgacaaaaattgcccaatcttcccggaacttctattgaaggagttgaaaagggtggatacaccatttcagacaactcatcaggtaacaagcctgatgtcattttgattggaactggttccgagttggaaattgctgcccaagctgccgatgatctaagaaaggaagggaaagctgttagagttgtttcctttgtttcctgggaacttttcgatgagcaatcagatgcttacaaggagagtgttctacctgcttctgtatcagctagagttagcattgaggccgcatcaactttcggatgggcgaaaattgttggaagcaagggaaaagcaataggcattgatggttttggagctagtgcaccagctggaagaatatacaaagaatttggtatcactaaagaagctgttattgctgcagccaaagaacttatctagatatattagtttcttactcaattagaacttgtgattttgggttgtgatttgcatagatgggaatatacaggggatctttttcaagagaaatctcctttgcttgaataaggaatgattaaattgtggcttcttagcattctcattgaagcaaacattgatcaaagtaagagtgatgatttttatgaatttgcaataacacttgcctgtggaattttgtattgccacattgttaaattcaatggtgttcatgattatccatatagtccctatacaagtctctgatagttgcaatatttctagtcttttaagttaaaccaattacaacaacatacatcaatgtagatgatgattggaaaattgacattgaccaacattgggaaagttcaattctcaaaattttaatcacaaataacatcttaaaccagaaggaat

SEQ ID NO: 9089 - DNA, 2697 bp, Petroselinum crispum
tctctctctctgcatttctgagagagatttttgaactttaacgatggcagcttcgtcttcactcactctctctcaagcaattctctctcgctcgattcctcgtcacaacccaagttgttcatcacctcagcaacaaaacccatcttcatctctctcatctctcccgattttctcgctgaaatcggcgcctcgccggaggaattaccggccggcggttgtgagggcagctgcggtggagactttggagaagacagagatagaattggtggagaaaagtgtgaatacgataagattcttggcgattgatgcagttgaaaaggctaattcgggtcatccgggtttgcccatgggttgtgctccaatgggtcatattttgtatgatgaagtgatgaggtataatcctaagaatccttattggtttaatagggataggtttgttttgtctgctggacatgggtgtatgttgcagtatgctcttcttcatcttgctggttatgacagtgttctggaagaagatttgaagcagttccgacaatggggaagcagaaccccaggacaccctgaaaactttgagacccctggtgttgaagtcacaactggtcctcttgggcagggtattgccaatgctgtaggtcttgcccttgcagagaagcacttggctgctcgttttaacaagccagatagtgagattgttgaccactacacgtattgtatagttggtgatggttgtcaaatggagggtatctctaatgaagcgtgctcccttgctggacattggggactaggaaaactgattgctttctatgatgacaaccatatctcaattgacggggacacagagattgcattcactgagagtgtagatacccgttttgagggtcttgggtggcacattatctgggtgaaaaatggtaatacaggctacgatgaaattcgtgctgccataaaggaggcaaaggctgttactgacaagcctactttaatcaaggtgactacaacaatcggttttggatcacctaacaaagcaaactcatacagtgtccatggagctgccctgggagcctcagaagttgatgccacaaggaagaaccttggatggccatatgaaccattccatgtaccagaggatgtcaaacaacattggagccgccatacccctgcaggtgcttcgttggaagctgagtggaatgcaaagtttgccgagtatgaaaagaagtatgccgaggaagctgctgaattgaagtctatcatcaccggtgtacaacctgctggttgggaaaagtctttgccaacatacactcctgaggtccctgctgatgccaccagaaatctctctcaagcatgtctaaatgcccttgcaccagcagttcccggcctaattggtggtagtgctgatcttgcttcctccaacatgacgctactaaaaatgtttggggacttccaaaagggtactccagaagaacgtaacgtcagatttggtgttcgtgagcatggtatgggagctatctgcaatggcattgctcttcacagtcctggtttcgttccatattgtgcaactttctttgtgttcactgattacatgagaggggccatgagaatctctgccttgagtgaagctggagttatatatgtcatgacccacgactcaattggactgggagaagatggaccaactcatcagcctattgagcatttggctagttttagggcaatgcccaacatgttgatgtttcgaccagctgacggaaacgaaacagctggagcatacaaggttgctgtcatcaaccggaagagaccatcaatccttgccctttcaaggcaaaagctgccaaatcttcctggaacttccattgaaggagtagagaaaggaggatatacaatatcagacaattcgaccggaaacaaacctgatgtgatcttgatcggaactggttctgaattggagattgtggccaaagctgccgatgaactcagaaaggaaggaaaagcagttagagctgtctcctttgtttcttgggagttatttgatgaacagtctgccgagtacaaggaaagtgttctaccagcagctgtaacagcaagggttagcattgaagctgcatcaacatttgggtgggcaaaaatagttggaagtgcaggaaaggccatcgggattgacgggtttggagcaagtgctccagctggaaaaatatacaaggaatatggcattacagttgaggcagttgttgctgcagccaaggaactttgctaggtattcatcactgaattccggtgggattgttagttttccagaaactattccattttggattcttggttggaaaactcaaaccatatgattgttaatagactaaactctattcaagtactcataagatttatcgcaataatgaagataaaattttctttgctgcttttatcttcagtgcagcatctgagactgccaactgaatcaaagatgaactgagattagatttcttgaatgtttgtgaatttgtattaatacttaaacatgtgttgacttttgtaatattacgcattgtattgttagtgcactatatgttccaatttttggtataaatcaatctacaagctaactaatacgatgttcgatcgaagcaatctgaagtctttcggcttattgtataaatttttcatagagttgcacaaaacttgcataatttattttttcccttc

SEQ ID NO: 9090 - DNA, 2763 bp, Solanum lycopersicum
aatttatatcaactcaacttctcacatttctctctctgtgtaaagccatggcttcttcttcttctctcactctctctcaagctatcctttctcgttcagtttctcgccatggctcttcttcttcccctaactctcagctttccccttcttccatctctcttccgactttttccggtctcaaatccaccactgctacctcattccgccgccgtattcttccctccgctgccggcgccggaagacactcggcgattcgcgcttcagctgctgtagagactttacagaaaactgataatgcccttgttgagaaatctgtaaatacgatcagatttttggctattgatgctgttgaaaaggcgaattcgggtcatccgggtttacctatgggatgtgctcctatgggtcatatattgtatgatgagatcatgagatataaccccaaaaacccttattggtttaatcgtgatcgctttgttctctccgccggacatggatgtatgcttcagtatgctttgcttcacctcgctggctatgatgctgttagggaagaggacttgaagagcttccgccagtggggaagcaaaacccctggacaccccgagaactttgagacacctggtgttgaagtcactactgggcctctgggacaagggattgccaatgccgttggcttggccctctcggagaagcacttggctgctcgtttcaataaaccggatgctgagattgtagaccactacacctattgtattcttggtgatggttgtcagatggagggtatttcacaagaagctgcttctcttgctggacactgggggctcggaaagctgattgctttctatgatgacaaccacatctcaattgatggtgacacagaaatcgccttcaccgaggatgttgctgcccgttatgaggctctcggttggcatgtaatctgggtgaagaacggtaacactggttatgatgagattcgtgctgccattaaggaagcaaaagcagtgacagacaaacccactttgatcaaggtgactacaaccattggttttggctcgcccaacaagtcaaacagttacagtgtccacggaagcgcacttggagctaaggaagtagaagccacaaggcagaacttgggatggccttatgagcctttccatgtgcctgaagaagtcaagagccattggagccgtcatgttcccgagggtgctgctcttgaagctggatggaataccaagtttgctgaatatgagaagaagtacccagaggaagctgcagaccttaaatccatcatcactggtgaactacctgctgactgggagaaagctcttcctacctacacacctgaaagtccagcagatgccaccagaaacctgtcccaacaaaacttgaatgctcttgccaaggttcttcctggtttccttggtggtagtgctgatcttgcctcatcaaacatgaccctcatgaaaatgtttggcgacttccaaaagagcaccccagaggagcgtaatattagatttggtgttcgtgaacatggtatgggagctatctgtaatggaattgctctccacagccctggcttaattccctactgtgctactttctttgtgtttactgactacatgagagccgccattagaatttcagctttggctgaatcacgtgttatctatgtgatgactcacgattcaattgggcttggagaagatggacctacacatcagcccattgagcacttggcaagtttccgtgcaatgcccaatgttctgatgctccgtccagcggatggtaatgaaacagctggtgcttacagggtggcaatcctcaagaataagacaccatcaattctggctctttctcggcaaaagttgccccagcttgctggaacttctattgaaggaacagcaaagggtggctacactatatcagacaactcttcaggcaacaagcctgatgtcattttgattggtactggctcagagctggaaattgctgtcaaggctgctgatgaactcagaaaggaagggaaggcggtgagagttgtctccttcgtttcttgggagcttttcgatgaacaatcagctgagtacaaggaaagtgtcctcccagctgctgttaccgctagagttagcattgaagctggaaccacatttgggtgggagaagatcgtcggatccaaggggaaggccattggaattgacagattcggtgccagtgccccagctggaaaaatatacaaggagtttggaattacagcagaggctgttatagctgcagctaaacaagtttcttagactcttatgtgtctaccaaagctgttttcgttttggttctgaggttggagataatggtggaaaccgataccaagtagcctctgcagttctgatattttcaataaagacaatcacttcatcattttcttcagtttgagcagcggggcgaccagaatgaccccaagatgaggatagaaataggcttttatggatgctcctgacccatgtacacttaaacatatctttgagttttgtaacttctgtttggttgagtgataatgaggtccaattttcaattggaatttcaggtcttctgattaaaaaaggagcttcctttgtctttactatagttatcactttgtggttatctgttactaaataatcttttggcaacattcatgacaaagtattgccttaatggtactgatgaaagtacatgtgttctaccattaaactattttgtttctacaaatttttctgcttagttttaaatagc

SEQ ID NO: 9091 - DNA, 2617 bp, Panax ginseng
gactttatcaagacctctctctctctctctactgtcagccatggcagcttctgcatctctaactctttctcaagccatcctttcccgctcaattcctcgccatggctccaattcctctacccaacaaaccccatcttcttctctttcctctttttctcacctacccactttctccacctccctcagatcctcctctcgccaccgcagctccgccgctagcagccaggtagtccgggccgccgttgtggagacgctcgacaagacggagacctcattggtggagaaatcggtgaacacgattcggttcttggctattgatgcagtggagaaggctaattcgggtcatccgggtttacccatggggtgtgccccgatgggtcatatattgtacgatgaggtgatgaggtacaaccccaagaacccgtattggtttaatcgggatcgctttgttttatccgctggacatgggtgcatgcttcagtatgctttgctacaccttgctggttatgacagtgtcctggaagaagatttgaagtccttccgtcaatgggggagcagaactccaggacaccctgaaaactttgagacccctggtgttgaagtcactacaggtcctcttggtcagggtattgccaatgctgttggtctggcccttgtggagaagcacttggctgctcgcttcaacaaacctgacagtgagattgttgaccattacacatatgtcatacttggggatggctgtcaaatggaggggattgcaaatgaagcttgttcccttgctggacattggggacttggaaaactgattgctttctacgatgacaaccatatctccattgatggtgacacggagattgcattcactgagagtgttgacacccgttttgagggtcttgggtggcacattatctgggtgaagaacggtaacacaggttatgatgacattcgtgctgccatcaaggaggcaaaggctgtaacagacaagcctactttaatcaaggtgaccacgacaatggttttggatcacctaacaaagcaaactcgtacagcgtccatggaagtgccctgggagctaaggaagtcgatgccacaaggaagaaccttgggtggccttatgagcctttccatgtacctgaggatgtgaaacagcattggagccgccatacctccgaaggtgcttctcttgaagctgcatggaatgccaagtttgctgagtatgaaaagaagtatgcagaggaagctgtagaattaaagtctatcattactggtgtgctacctgctggttggagacagctctgccgacatacactccagagacccctgctgatgccaccagaaatctctctcaaacatgtctgaatgcccttgcaaaggttcttcctggccttctgggtggcagtgctgatcttgctcctccaacatgaccctgctgaaaatagtttggggacgttccaaacgggtaacaccagaagaacgtaatgtcaggtttggtcgtccgtgagcatggtatggagctatctgcaatggtattgctctccacagccctggcctcattccctactgcgcaactttctttgtgttcactgactacatgagaggggccgatcaggatctccgccttgagtgaagctggagttatctatgtcatgacccatgattcaattgggctgggagaagatggaccaactcatcaacctatcgaacatctggccagcttcagggcaatgcccaaccattttgtatgctccgtccagctgacggaacgagactgctggggcgatacaaggttgcagtcctcaacaggaagagaccatcaatccttgccctatctaggcaaaagactgcccaaccttcctggaacttccattgaaggagttgaaaaaggtgggtacacgatatcagacaattcatctggtaacaagccagatgtcatcttgattggaaccggttctgaattggaaattgcagccaaagctgctgatgaactcagaaaggaagggaaggcagttagggtcgtctcttttgtgtcttgggagttatttgatgagcaatcagatgattataaggaaagtgtcctacctgcagctgtaactgcaagggttagcattgaagctgcatcaacatttggttggggcaaacttgttggaagcgaagggaaagctatagggattgacaagtttggagcaagtgctccagctggaaaaacatacaaggagtatggcattacgtcagaggcagttattgcagcagctaaagaacttatctagagcttcattactgaattccatttagaggctgtcagttctgcggaaacttatttttggattttggagtttggagtttgggttggagaatttacacctagtcattgttaaaagactcatcttgattcagtacctcttaagatttcacaataacaaagataaaattttcttttgttgcttttcattttcttcagcgccgcagctgaggctgcaaaataaatcgagatcaaaagagagattagatttcattaacgttcatgaatttgtataccaatacttgaacatggatcgacttttgtaattttatgtgttggattgttagtgatgtttatattcctccaaaaaaaaaaaag

SEQ ID NO: 9092 - DNA, 2899 bp, Aristolochia fimbriata
tctacccagattcaagggctgggatgattcaacccgaaatctgagggcaacggggaaatcccacctcgagcgcgccgaaggggattaagatctgttggctgatgcgcctcttctatacagtttgctctctgctcatcatcatcgtcatcgtctgattgaatcttctccaccaaactgatccttttctgctccaacaacccagattgatttcaaatctaaggtaagcgtagagggagagagaagcggcagctgaacccccagctactccctcctcctctcctcaccaacccctccttacacagccatggcggcttcctcttccctcaccgtctcacacgctctcgttgctcgggccacggctcaccatggctccgccaaccaccccgaccgctccgccctaccgggcttcaaccttagtaccttcgccgggaaggctctcaaggcctcctcctccgcctctttgtgccgcaagggacgcaagctgccggccggtgctcgcaaggcgccggtccgcgccgccgccgtcgaggcgttgcccaaggcggagactgccctcgtcgagaagtccatcaacaccatcagatttcttgccattgatgccgtcgagaaggctaattctggacacccgggtctgcctatgggatgtgcgcccatgggtcacatcctctacgatgaggtgatgaggtacaaccccaagaatccttactggttcaatcgtgacaggttcgtgctttcggccggccatggttgcatgctccagtacgcgcttctgcatcttgctggatacgatagcgtcaaggaagaagatttgaaatccttccgccagtggggaagcagaactcctggacaccctgagaactttgagactcctgggattgaagtaaccacaggccccctcggacagggtatcgcaaatgcagtgggattggctctggttgaaaagcatttagctgccagatttaataaacctgacaatgagattgttgatcactacacatatgctattcttggggatgggtgtcaaatggaggggattgcgaatgaagcttgctctcttgctggacactggggtcttggaaagctgattgctttctatgatgacaaccatatatctattgatggtgacacggagattgctttcactgagagtgtggacacccgttttgaaggtcttggctggcatgtcatttgggtaaagaatggtaacacgggttatgatgagatccgtgcggccattgaagaagcaaaggctgtgaaggacaaacccacattgattaaggtgacgaccaccatcggttatggatccccaaacaaggccaattcgtacagtgtgcatggtagtgcattgggagccaaagaagtggatgccacaaggcaaaatcttggatggccttatgagcctttccatgtgcctgaagatgtgaagagccactggagccgccatgctgaagcaggtgcaactcttgaagctgagtggaatgcgaaatttgccgagtatgaaaagaagtacaaggaagaggcagcagaactaaaatccctcgttagtggtgaatttcctgctggctgggaaaaagctcttcctacctacactcctgagagtcctgcagatgccaccagaaatctgtcccagcagtgcctaaatgctcttgcaaaggttctcccaggtcttcttggaggaagtgctgatcttgcttcatccaacatgaccctgttaaaaatgtttggtgacttccagaaggaaactcctgctgaaagaaatgttcgttttggtgttagagagcacggaatgggtgccatctgcaatggcattgcccttcacagtcctgggctcatcccatactgtgcaaccttttttgtcttcacagactacatgagagctgccatgaggatctcagcattgtctgaggctggagtcatttatgtgatgacccatgactcaattggacttggagaggatggtcctactcatcagccaattgagcacttggcaagcttcagagccatgccaaacattctgatgctccgcccagctgacggtaatgagactgctggagcttacaaggttgcagttctcaacaggaaaaggccatctgttcttgctctctcccgtcagaagcttccccagcttcctggcacttcaattgaaggagttgagaaaggagggtacgtcatttctgacaactcttctggcggcaaaccagaagttattttgattggtactggttctgaattggagattgcagctaaagctgcggatgaactgaggaaagaagggaagaaggtccgagtggtttcttttatttcttgggaattgtttgacgagcagtccgacgagtacaaagaaagcgttcttccatccgatgtcactgcacgggtaagtatcgaggctggttcaacattcggctgggagaagatcgtgggaagcaagggcaagtccatcggtatcgacaggttcggtgcaagtgctcctgcaggaaagatatacaaggagtttggaataacagcagaaaatgtcattgctgttgccaagtcaatactataaattaggcaccatccatgagaatcattagcctcattctgttttccaggatgcagcaatttagtagggtccctttcccccttctccagactgggaagaaatggcatcggagaagaagccagtttttaaagagatttttagtctttggcgtttggacgaaaataaaccccacccgttttgccttttagtttttgtgtttttgatttaattggcaaagcttctccttgctaccaaaaactcttgagcatgtactgtttgtaatctgtttcagtaaccatatttctgcgaaaccccttttgcatctttctttcacacatcattcagtacataagccaagaaactatcttctttgggctcctt

SEQ ID NO: 9093 - DNA, 2697 bp, Solanum tuberosum
catttctctctctgtgtaaagccatggcttcttcttcttctctcactctctctcaagctatcctttctcgttcagtttctcgccatggctcttcttcttccactaactctcagctttccccttcttccctctctcttccaactttttccggtcttaaatccaccactgctacctcattccgccgccatattcttccctccgccgccgcctccggcagacactcagcgattcgcgcttcagctgctgtagagactttagagaaaactgataatgcccttgttgagaaatctgtaaatacgatcagatttttggctattgatgctgttgaaaaggcgaattcgggtcatccgggtttacctatgggatgtgctcctatgggtcatatattgtacgatgagatcatgaggtataaccccaagaacccttattggtttaatcgtgatcgctttgttctctccgccggacatggatgtatgcttcagtatgctttgcttcacctcgctggctatgatgctgtcagggaagaggacttgaagagcttccgtcagtggggaagcaaaacccctggacaccccgagaactttgagacacctggtgttgaagtcactactgggcctcttggacaagggattgccaatgccgttggcttggccctctcagagaagcacttggctgctcgtttcaataagcctgacgctgagattgtagaccactacacctattgtattgttggtgatggttgccagatggagggtatttcacaagaagctgcctctcttgctggacactgggggctcggaaagttgattgctttctatgatgacaaccacatctcaatcgatggtgacacagaaatcgctttcactgaggatgttgctgcccgttatgaggctcttggttggcatgtaatctgggtgaagaatggtaacactggttatgatgagattcgtgctgccattaaggaagcaaaagcagtcacagacaaacccactttgatcaaggtgactacaaccattggttttggctcgcccaacaagtcaaacagttacagtgtacacggaagcgcacttggagctaaggaagtagaagccacaaggcagaacttgggatggccttatgagcctttccatgtgcctgaagaagtcaagagccattggagccgtcatgttcccgagggtgctgctcttgaagctggatggaattccaagtttgctgaatatgagaagaagtacccagaggaagctgcagacctcaaatccatcatcactggtgaactacctgctgactgggaaaaagctcttcctacctacacacctgaaagtccagcagatgccaccagaaacttgtcccaacaaaacttgaatgctcttgccaaggttcttcctggtttccttggtggtagtgctgatcttgcctcatcaaacatgaccctcatgaaaatgtttggtgacttccaaaagagcaccccagaggagcgtaatataagatttggtgttcgtgaacatggtatgggagctatctgtaatggaattgctctccacagccccggcttgattccctactgtgctactttctttgtgtttactgactacatgagagcagccattagaatttcagctttggctgaatcgcgcgttatctatgttatgactcacgattcaattgggcttggagaagatggacctacacatcagcccattgagcacttggcaagtttccgtgcaatgcccaatgttctgatgctccgtccagcagatggtaatgaaacagctggtgcttacagggtggccatcctcaagagtaagacaccatccatcctggctctttctcggcaaaagttgccccagcttgctggaacttctattgaaggaacagcaaaaggtggctacactatatcagacaactcttcaggcaacaagcctgatgtcattttgattggtactggctcagagctggaaattgctgtcaaggctgctgatgaactcagaaaggaaggaaaggccgtgagagttgtctccttcgtttcttgggagcttttcgatgagcaatcagctgagtacaaggaaagtgtccttccagcagctgttaccgctagagttagcattgaagctggaaccacatttgggtgggagaagatcgtcggatccaaggggaaggccattggaattgacagattcggtgccagtgcccctgctggaaaaatatacaaggagtttggaatcacagcagaggctgttatagctgcagctaaacaagtttcttagactcttattacttacccttggttgctggtgtctaccaaaagttgttttcgttttggttctgaggttggagataatggtggaaatcgataccaagtggcctcggcagttctgatattttcaataaagacaatttcttcatcattttcttcagtttgagcagcggggcgaccagaatgaacccaagatgaggatagaaataggcttttatggatgctcctgacccatgtacacttaaacatatctttgagttttgtaacttttgtttggtcgagtgataatgaggtccaatttataattggaatttcaggtcttctgataaacaaggggctttctttgtctttactatagttatcactttgtggctatctgttccaaagcaattggactaaataatcttttggcaacattcattacaaagtattgccttaatggt

SEQ ID NO: 9094 - DNA, 2759 bp, Solanum phureja
atcaactcatcttctcacatttctctctctgtgtaaagccatggcttcttcttcttctctcactctctctcaagctatcctttctcgttcagtttctcgccatggctcttcttcttccactaactctcagctttccccttcttccctctctcttccaactttttccggtcttaaatccaccactgctacctcattccgccgccatattcttccctccgccgccgcctccggcagacactcagcgattcgcgcttcagctgctgtagagactttagagaaaactgataatgcccttgttgagaaatctgtaaatacgatcagatttttggctattgatgctgttgaaaaggcgaattcgggtcatccgggtttacctatgggatgtgctcctatgggtcatatattgtacgatgagatcatgaggtataaccccaagaacccttattggtttaatcgtgatcgctttgttctctccgccggacatggatgtatgcttcagtatgctttgcttcacctcgctggctatgatgctgtcagggaagaggacttgaagagcttccgtcagtggggaagcaaaacccctggacaccccgagaactttgagacacctggtgttgaagtcactactgggcctcttggacaagggattgccaatgccgttggcttggccctctcagagaagcacttggctgctcgtttcaataagcctgacgctgagattgtagaccactacacctattgtattgttggtgatggttgccagatggagggtatttcacaagaagctgcctctcttgctggacactgggggctcggaaagttgattgctttctatgatgacaaccacatctcaatcgatggtgacacagaaatcgctttcactgaggatgttgctgcccgttatgaggctcttggttggcatgtaatctgggtgaagaatggtaacactggttatgatgagattcgtgctgccattaaggaagcaaaagcagtcacagacaaacccactttgatcaaggtgactacaaccattggttttggctcgcccaacaagtcaaacagttacagtgtacacggaagtgcacttggagctaaggaagtagaagccacaaggcagaacttgggatggccttatgagcctttccatgtgcctgaagaagtcaagagccattggagccgtcatgttcccgagggtgctgctcttgaagctggatggaattccaagtttgctgaatatgagaagaagtacccagaggaagctgcagacctcaaatccatcatcactggtgaactacctgctgactgggagaaagctcttcctacctacacacctgaaagtccagcagatgccaccagaaacttgtcccaacaaaacttgaatgctcttgccaaggttcttcctggtttccttggtggtagtgctgatcttgcctcatcaaacatgaccctcatgaaaatgtttggtgacttccaaaagagcaccccagaggagcgtaatataagatttggtgttcgtgaacatggtatgggagctatctgtaatggaattgctctccacagccccggcttaattccctactgtgctactttctttgtgtttactgactacatgagagcagccattagaatttcagctttggctgaatcacgcgttatctatgttatgactcatgattcaattgggcttggagaagatggacctacacatcagcccattgagcacttggcaagtttccgtgcaatgcccaatgttctgatgctccgcccagcagatggtaatgaaacagctggtgcttacagggtggccatcctcaagagtaagacaccatccatcctggctctttctcggcaaaagttgccccagcttgctggaacttctattgaaggaacagcaaaaggtggctacactatatcagacaactcttcaggcaacaagcctgatgtcattttgattggtactggctcagagctggaaattgctgtcaaggctgctgatgaactcagaaaggaaggaaaggccgtgagagttgtctccttcgtttcttgggagcttttcgatgagcaatcagctgagtacaaggaaagtgtccttccagcagctgttaccgctagagttagcattgaagctggaaccacatttgggtgggcgaagattgtcggatccaaggggaaggccattggaattgacagattcggtgccagtgcccctgctggaaaaatatacaaggagtttggaatcacagcagaggctgttatagctgcagctaaacaagtttcttagactcttattacttacccttggttgctggcatctaccaaagttgttttcgttttggttctgaggttggagataatggtggaaatcgataccaagtggcctcggcagttctgatattttcaataaagacaatttcttcatcattttcttcagtttgagcagcggggcgtccagaatgaacccaagatgaggatagaaataggcttttatggatgctcctgacccatgtacacttaaacatatctttgagttttgtaacttttgtttggtcgagtgataatgaggtccaatttataattggaatttcaggtcttctgataaacaagggactttctttgtctttactatagttatcactttgtggctatctgttccaaagcaattggactaaataatcttttggcaacattcattacaaagtattgccttaatggtactgatgaaagtacatatgttctaccattaaactagattgtttctg

SEQ ID NO: 9095 - DNA, 2518 bp, Chelidonium majus
agaatcaatcaataatcatggccgcctcttcatctctaacaatctcccaagcccttgttggtcggaaaattgcacaccatggttctacatctcactccgaccgtctatctctacccggattcagtctcagtactctttccggccgtaccctcaaatcatcatcttcttctaagatctcatcagttggatctcgcaaaagagtaaactctctatcttctacagttcgtgctgctgctgttgaaactctacagaaaactgataacgctttggttgataaatcggtcaacaccattagatttcttgctattgatgctgttgagaaagctaactcaggtcaccctggtttgccgatgggatgtgctccgatgggtcacatcttgtatgatgagatcatgagatataaccctaagaacccttactggttcaaccgtgacagatttgtgctttctgctggacatggttgtatgttgcagtacgctttgcttcatcttgctggatatgacagtgttcaggaagatgatttgaagtctttccgccagtggggaagcagaacccctggtcaccctgagaacttcgagacacccggtgttgaagttaccactggtcctcttggacagggtgttgctaatgctgttggattggcccttgcggagaagcacttggctgctcgattcaacaagcccgatagcgagattgtcgaccattacacatattgtattcttggggatggttgtcaaatggaaggaattgcaaatgaagcttgttcccttgctgggcattggggacttggaaagttgattgctttctacgatgacaaccacatctccattgacggtgacacagagattgctttcactgagagcgttgatacccgttttgaaggtcttgggtggcacgttatttgggtgaaaaatggtaacactgggtatgatgaaatccgtgctgccatcaaggaagcaaaggctgtcactgacaagcccactttgatcaaggtaacaactaccattggttttgggtccccaaacaaggcgaactcatacagtgtacacggggctgcattgggtgctaaagaagtggatgccacaaggcagaaccttggttggccgtatgagccattccacgtgccagaggatgttaagaagcactggagccgccatgcttctgaaggcgctgcccttgaagctgaatggaatgccaagttcgcagagtatgaaaagaagtacaaggaggaagccgctgagttgaagtccatcattactggtgaattccctgccggttgggagaaggctcttccaacttacactccagagatccctgctgatgccactagaaacctatctcaaacgtgccttaatgcacttgccccagttattcctggtcttgtcggtggtagtgcagatcttgcttcctccaacatgaccttgatgaagatgtttggggacttccaaaaggacaccccagaagagagaaacattcgatttggtgtcagagagcatgcaatgggtgccatctgtaatggaattgctcttcacgcccctggctttgtcccctactgtgcaaccttctttgtgttcaccgattacatgagaggtgccatgagaatatcagctttatccgaggctggagttatttacgtaatgacccatgactcaattggtcttggagaggatggcccaacccatcagcccattgaacatttggcaagctttagagctatgcccaacatccttatgttccgccctgctgatggaaatgagactgctggtgcatacaaggttgctgttgttaacaggaaaagaccctcaattctcgccctttcccgtcagaagctttctaaccttccaggaacttccattgaaggagttgagaagggaggttacattatctcatgtaacgcttcaggtaacaaaccagatgtgatcttagctgccactggttctgaattggaaattgctgccaaggccggtgatgaactcaggaaggaagggaagacagtcagggttgtttcctttgtttcttgggaattgtttgatgagcagtccgatgaatacaaggaaagtgttcttcctgaagctgtcactgccagagttagtattgaagcagcaagcacttttggttggcaaaagatagtgggaagcaaagggaaatcaatcggaattgacaggttcggagcaagtgcacctgcaccaaaaatatacaaggagtatggcataacggcagaggctgtcattgcagcagctaaatcacttctttagagtgttttttttttccatttttcatcttaagcttatttgtcatttggttttggattcctactcttccaagtttaaaatgacatcagaggagaggcctgccctaagataatttgagttagaaaaacaggctcttgaattataataaaaagccaaaaaaaaagagtactttgtttcatctagatgagtttgtatctccaaattgaacgaagaactagtgactttgaattgaactttcacaagaaaatatgtgtacatgcaagtcg

SEQ ID NO: 9096 - DNA, 2421 bp, Trifolium pratense
ctcaactctgatcgtgctgcttcatcactatcttctacttcaactctctccttcccaactctcaaaccagctacatcatcttcatccggttcccgtcgtagaaacgccactacaaccatacgtgcaactgctgtagaaacactcgataaaacagctgaagtttctcttgttgagaaatccgttaacactattcgtttccttgctattgatgctgttgagaaagctaattcgggtcaccctggtttacccatgggttgtgctccaatgggtcacattctttatgatgaaattatgagatataatccaaagaatccttcttggtttaatcgtgatcgttttgttttgtctgctggacatggttgtatgcttcagtatgctcttcttcatcttgctggttatgacagtgtcaaggaagaagacttgaagcaatttcgacaatggggaagcaaaactcctggacatcctgagaatttcgagacatatggaattgaagtcacaacaggtcctcttggtcagggcattgccaatggtgttggtttagcccttgcagagaagcacttggctgcaagatttaacaaacccgacaatgagatcattgatcattacacgtattgtatattgggagatggttgtcaaatggagggaattgcaaatgaagcttgctcacttgcaggacactggggactagggaagctaattgcgttttatgatgacaaccacatttctattgacggtgacacggaaattgctttcactgagagtgttgaaaaacgttttgagggactcgggtggcatgttatttgggtacagaatggaaacactggctttgatgagattcgtgctgccattaaggaagcaaaagctgtcaaagacagacctacattgatcaagttcacaacaaccataggttatggttctccaaataaatcaaactcctacagtgtgcatggaagtgcacttggtgccaaagaagttgatgccacaagaaataatcttggatggccatatgagcctttccacgtgcccgaggatgtcaaaaagcattggagtcgccacattcccgagggtgctgcacttgaatctgagtggaatgctaagtttgctgcatacgaaaagaagtacaaggaggaagccgcagtattaaaatctattatcagtggtgaattaccctctggttgggagaaagcacttccgacttacactccagaggtcccagctgatgccacgagaaatctgtcccagacaaaccttaatgcccttgcgaaggttcttcccggtcttctcggtggcagtgcagatcttgcttcttccaatatgaccttgctgaaagcgtttgggaacttccaaagtgaaactccagcagagcgtaatgttagattcggtgttagagaacatggaatgggagcaatctgcaacggcattgctcttcacagcccaggactgattccatattgtgcaaccttctttgttttcaccgactacatgcgtggtgccataaggctttctgccctttccgaagctggtgttatatatgtcatgactcacgattcaataggactcggagaggatgggccaacccaccagcctatagagcacttggcaagcttccgagcaatgccaaatatcttgatgctccgtcctgccgacggtaatgaaaccgctggagcatacaaagttgccgtgctcaacagaaagagaccctctatcctcgccctttctagacaaaaattgccaaaccttcccggaacttctattgaaggagttggaaagggtggatacatcgtctcagacaactcaacaggaaacaaacctgatgtcattttgatcggaaccggttccgaattggaaattgcttactatgctgccgaagatctaagaaaagaaggaaaggctgttagagttgtttcctttgtttcttgggaacttttcgatgaacaatcagacgcttacaaggagagtgttctccctggtgctgtttcggctagagtcagcattgaggccggatcaacattcggatgggagaaaattgttggaagcaaaggtaaagcaatcggaatcgaccgtttcggagctagtgctcctgcaggaagaatatacaaagagtttggcatcactaaagaagctgttattgctgcagcaaaagagcttatttagaactattagtttctgtttatttaataattttctctctttcttttcttcttgttttagttttgatatatctacacaaagaaggatgttttagtagcattgtgttgttgcttgaataagaaaaaggttagaagattattgttgcttgggattgtgagtgaagttaagcaacacagatcaaagagtacactaataaatttttatgaacttgtaaacttttcaaccaattgaattttgtattgccacattgttaaattcaattattttcat

SEQ ID NO: 9097 - DNA, 2482 bp, Gossypium hirsutum
atcgattgaactcatttcgatctccctttcaccaacctcactcagctgagtcgactcgatcaaaaaacagcaatggcctctacttcatctctcactctgtctcaagctctcctagctcgaaccatcttttccgatgggtccacccaattctccgactgcagtgtttcacttcccaccaccactttttccggtctcaagctcactaccccacgctcccgtcgagtccttcccacgcgctttaaccggagtctccgagtccgttccgctgccgtcgagacaatcggcactcctgccgagacttccttattggaaaaatcagtcaacacgatcagattcttagctattgatgctgtcgaaaaggctaattccggtcaccctgggttacccatgggttgtgctccgatgggtcacattttatacgatgaaatcatgaggtataatcctaagaacccttattggttcaaccgtgatcgtttcgtcttgtctgctggtcatggttgtatgttgcaatatgctctgcttcaccttgctggttatgatagtgttcaggaagatgatttgaagaattttcgtcaatggcaaagcagaacaccaggacatcctgagaattttgaaacacctggagttgaagttacaactggtcctcttggtcaaggtattgcaaatgctgtcggattggctctagccgagaagcacctagctgctaggttcaacaagcctgacaatgagattgttgatcactacacgtatgctattttaggtgatggttgtcaaatggagggtgttgcgaacgaagcttgttcgcttgccggacactggggacttggaaagcttatagctttctacgatgataatcacatttcgatcgatggtgacactgaaattgcctttactgagaatgtcgaggaacgttttaaggggcttgggtggcatgttatttgggtcaagaatgggaatactggttacgatgagattcgtgctgctattaaggaagcaaaggctgtcaaagacaagcccactttgatcaaggtgacaaccactattggttatggatctccaaacaaggcaaactcgtacagcgttcacggtagtgcattgggtgccaaggaagtggatgctactaggaaaaaccttgtgtggccacacgagccattccatgtacccgaagatgttaaagggcattggagtcgccttgtccaacagggagctgcccttgaagcagaatggaatgcaaagtttgctgaatacgagaagaaatacaaagatgaagctgcagagctcaaattaatcatcaccggtgaactaccggccggatgggagaaggcacttccaacatatactccggagagccccgctgatgctaccagaaacctctctcaacaaaatctcaatgctctcgtaaaagtactccctggtttttttggtggaagtgcagaccttgcttcttccaacatgaccttgctcaaaatgtatggtaatttccagaaagacacccccgaggaacgtaatcttaggttcggtgttagagaacacggaatgggagccatctgcaatggcattgcacatcacagccccggacttattccgtactgtgctactttcttcgttttcactgactacatgagagctgctattaggatgtctgcattgagtcaagcgggagttatttacgttatgacccatgattccattggtctcggggaagacggaccaacccaccaaccaatcgagcacttagctagcctccgtgcaatgcctaatgttttcatgcttcgtccagctgatggaaacgaaactgccggtgcatacaaagttgctatcctcaacaggaacactccctccattatcgcactctctcgacaaaaactaacccaactacccggaacttccatcaagggggtcgaaaaaggtggctacataatatcagacaattcttcaggaaacaaccctgacataatcctgatcggaactggctctgagctggaaattgccgctaaagctgccgatgaactaaggaaggctggaaaagctgttcgggtcgtctcccttgtttcttgggaactcttcgataatcaatcagacgcctacaaagaaagtgttttaccatctggtgtatcagctagggtaagtattgaggcgggatcaacttttgggtgggaaaagattgtgggatcgaaagggaaggcaatcggaatcgatcggttcggggcaagtgcaccagctggtagattatacaaagaattcggtttaacaccagaggctgttgttgcagcagcaaaggaactttgctggcattattaggtgccttttgtgacttttttgtttttaataataaaaggaatcatccaaatttcttatgttgctttgtgattttatatgtttatgaatttgtaattcctctttgaactattttcccatagtttttgtatcacttcttgctgctttaaatgcttattacgcaagaaagagttgataatcttgc

SEQ ID NO: 9098 - DNA, 2442 bp, Cyclamen graecum
ctccctctctctaaaacctctctttacctcccggccatggcagcatcttcgtccctgtctctctctaacgccattctctctcatcgccgccatgcctccgcccccaaaccctccctccccgctttctccggcctcaaaccggccccacgcgccaccctggccccctcacgagccgccaaatccctccggcgcgtggcacaccttacgcgcgcgtccgccgccgtggaaacggtcgagaagaccgcgaccgagctcgtcgacaagtcggtcaacacgatacggttcctcgcgatcgatgcggtggagaaggcgaattccggacacccggggttgcccatggggtgtgccccgatgggacacattttgtacgacgaggtgatgaggtataacccaaagaacccgtattggtttaaccgggatcgcttcgtgctctcggccgggcacgggtgtatgctgcagtatgctttgctgcacctggctgggtatgacagtgttcaggaagaagacttgaaacaattccgtcagtggggaagcagaacccctggtcaccctgagaactttgagacccccggcattgaggtcactactggtcctcttggtcagggtgttgctaatgccgttggactagcccttgctgagaagcatttggctgctcgctttaacaaacccggcagcgagattgttgaccattacacatatgtaatattgggagatggttgtcaaatggagggcattgcaaacgaagcttgttctattgctgctcactggggacttggaaagcttatagctttctatgatgacaaccacatatccatcgatggtaacacggagattgcgtttaccgagaatgtagatacacgttttgagggtctagggtggcatgttatctgggtgaagaatgggaacacaggttacgatgagatccgagctgctattgaggaagcaaagtctgtcaaggacaagcccactctgatcaaggttactacaaccattggttatggttctcccaacaaagctaattcgtacagtgtccacggggctgcactgggtgctaaggaagttgatgctacaaggcaaaacctcggatggccatatgaaccttttcatgtgcccgaggatgtaaagaagcactgggcccgccatacccctgagggtgctgctcttgaagctgagtggaatgctaaatttgccgagtatgagaagaaatatgcagaggaagctacagaattgaaatctatcatcactggggaattgcctgctggttgggagaaggttttgccgaaatatactccagacagccccccggaggccaccagaaacctctctcagacaaacctcaatgctctagcgacggttattcccggcttcctcggtggaagtgcggatctggcatcttccaacatgacccttctaaagatgtttggagatttccaaaagaacacccctgaggaacgcaacatccgtttcggggtgcgtgaacacgggatgggagccatctgtaatgggattgcactccacagccctgggctcatcccttattgcgccacctttttcgtcttcaccgattatatgagagccgctattagaatctcggccttgtgtgaagctggtgttatatatgtaatgacccatgattctatcgggctcggagaagatgggcccacgcatcagcccatcgagcacctcgccagcttccgagcaatgccgaacgtgttgatgctccgcccggccgatggaaatgagacagctggctcgtacaaggtcgctgttcttaatagaaagaggccttcgatccttgccctttctcggcaaaagctgcccaatctaccgggaacttcaattgaaggggtcggaaaaggaggatacatcatatcagataactctataagtggtaacaagccggatgttattttgattggcactggttctgagctcgagatcgctgctaaagctgcggatgagctgagaaagaaactaaaggctgtgagggttgtgtcgtttgtgtcgtgggaactcttcgatgaacaatctgatgagtataaggagagtgttttgcccgaggaggttacagccagggtcagtattgaggctggttcgacttttgggtggcaaaagattgtggggagcaaagggaaagctattgggatcgatcggtttggggcgagtgctcctgctgggaaaatatacaaggagtttggtattacagtcgaggccgtgattgaagcagctaaagctcttttttaggccttttaacaagattttttggatcttgttttgaggtattggatttaaaacatgtatggcgagaggccattatgtagaataattccgagtttagttattcatctcatggtctcgtaattttcttaataaaaaggagatttgtttcttctcttgaaagggaaattctgtatgtttgttgcttttgaagctttcttttac

SEQ ID NO: 9099 - DNA, 2773 bp, Panax ginseng
aagcagtggtatcaacgcagagtacgcggggctcttcaactaaattatactccattagatatagagagagaaagctcaactcctctgccacctaaatctctctacccatggctgctgcttcgtcatctttatctccctcccaatccctcatctcccgctctatcccaaacaaccatggctccacacagcagcattctgatcgtctcgcccttcctgggatcaatctcagctccatttccgcaaccagaaccctctcacacgcctcacgcgccgtcatacagtctcggagagtgggattacgcgcatccgtgagggcttcggcggtggcggagactctagagaagacagataccgcattagtggagaaatcggtcaacacgatccggttcctagctatcgatgcggtcgagaaggcaaattctggtcacccgggtctgcccatggggtgtgctccgatgggtcacgtgttgtacgatgaggttatgaggtataacccgaaaaatccatattggttcaaccgtgatcggtttgtgctctcggctggacatgggtgtatgttacagtatgcactacttcacctggctggctacgacagtgtcaaggaagaagacttgaaaagtttccgacagtggggaagcaaaacacctggtcaccctgaaaactttgagacacctggcattgaagtcaccactggtccccttggtcagggtgttgctaatgcggttggtttggcccttgctgagaagcatttagctgctcgatataacaaacctggcaatgagattgttgatcactacacgtatgtgatacttggggatggatgtcaaatggaaggaatttcaaatgaagcttgctcccttgctagtcactggggacttggaaagctgattgcattctatgatgacaaccacatttcaatcgatggtaacactggtattgcattcacagagagtgttgataagcgctttgaaggactcggttggcatgttatatgggtgaagaatggtaacactggatatgatgagatccgtgctgccattgaggaagctaaggcagttaaagataaacctactttaatcaaggtcacaactaccattggttttgggtcacctaacaaggcaaactcatatagtgtacatggtagtgcattgggtgccaaagaagtggatgccacaaggaagaaccttggatggtcacatgagccattccatgtgccagaggatgttagaaagcactggagccaccacaccactaaaggagctgctttggaagctgaatggaatgccaagtttgccgagtatgagaagaagtatgcagaggaagctgcagaattgaagtctatcttcactggtgtgctaccttctggttgggagtcagctctgccaaaatacactccagagagccctgctgatgccaccagaaatctctctcaaacatgcctgaacgcccttgcgccagttcttcccggtcttctaggtggcagtgctgatctagcttcctccaacatgacccttctgaaaatgtttggtgacttccaaaaaggtacaccagaagaacgtaatgtcagatttggtgtccgtgaacatggtatgggggctatctgcaatggaattgctctccacagccctggcctcattccctactgtgcaactttctttgtgttcactgactacatgagaggggccataaggatctccgccttgagtgaagctggagttatctatgtcatgacccatgattcaataggactaggagaagatggaccaactcatcagcctattgagcacttggccagtttcagggcaatgcccaacattttgatgcttcgtccagctgatggaaatgagaccgctggggcatacaaggttgcagtcgtcaacaggaagagaccatcaatccttgccctctcgaggcaaaagctgcccaaccttcctggaacttccattgaaggggtagaaaagggtggctacacaatatccgacaattcatctggtaacaagccagatgtcatcttgattggaactggttctgaattggagattgcagccaaagccgctgatgaactcagaaaagaagggaaagctgttagagttgtctcctttgtgtcttgggagttatttgacgagcaatcagatgtttacaaagaaagtgttctgccagcagctgtaacagcaagagttagcattgaagctggatcaacatttggatgggtaaaaattgttgggagcggaggaaaggctattgggattgacggatttggagcaagtgctccagcgggaaaaatatacaaggagtatggcataacggcagaggcagttattgcagcagcgaaagaacttttctaggtattcactactgcatgcactccattgttgttagttctgcggaaacttcttaaagtttggattctgggttggagatttttcaccgaaatgttgttaatagactcagctcaattcatgatctcctaagttttcacaataaggaagataaaagtttttttcttcttgttttttatcttcttcagtgcaacagttgagactgcaaactgaatcaatctaaagagagattagatttcttgaatgttcatgaaattgtatcaatacacttgaacatgtattgacttttgtaatcttatgtgttggattgcaagtgaaattatattcctccattacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 9100 - DNA, 2740 bp, Daucus carota
caaccactcaaacccatttcctacctctatctcccactctctctctacttttcttgagagagatttcgcaacttcaacaatggcagcttcttcttcactcactctctcccaagccattctctctcgctcgattcctcgtcacaaccccacttgctcttcacctcagcagcaaaatccatcttcatctctctcgtctctcccgattttctcgctgaagtcggcgcctcgccggaggaattaccgtccggcggtggtaagggcggcggcggtagagacgttggagaagacggagatagagctggtggagaagagtgtgaatacgattagattcttggctattgatgcagttgagaaggctaattcgggtcatccgggtttgcccatgggttgtgctccaatggggcatattttgtatgatgaagtgatgaggtataaccccaagaatccttattggtttaatagggataggtttgttttgtctgctggacatgggtgtatgttgcagtatgctcttcttcacttggctggttatgacagtgttctggaagaagatctgaagcagttccgtcagtggggaagcaaaactccaggacaccccgaaaactttgagacccctggcgttgaagtcacaactggtcctcttgggcagggtattgccaatgctgttggtcttgcccttgcagagaagcacttagctgctcgttttaacaagccagatagtgagattgttgatcactacacgtattgtatagttggggatggatgccaaatggagggtatttctaatgaagcatgctcccttgctggacattggggactaggaaaactgattgctttctatgacgacaaccatatctcaattgatggggacacagagattgccttcaccgagagtgtagatacccgttttgagggtcttgggtggcacattatttgggtgaaaaatggaaataccggttatgatgaaattcgtgctgccataaaggaagcaaaggctgttactgacaagcctactttgatcaaggtgaccacaacaattggttttggctcacctaacaaagcaaactcatacagtgtacatggagctgccctgggagcctcagaagttgatgccacaaggaagaaccttggatggccatacgagccattccatgtaccagaggatgtcaaaaaacattggagccgccatacccctgatggtgctgcattggaagctgagtggaatacaaagtttgccgagtatgaaaagaagtatgcagaggacgctgctgaattgaagtccatcatcaccggtgtacaacctgctggttgggaaaaatctctgccaacatacactcctgaggtccctgccgatgccaccagaaatctctctcaggcatgtctaaatgcccttgcaccagcagttcctggcctaatcggtggtagtgctgatcttgcttcctccaacatgacactactgaaaatgtttggggacttccaaaagggtactccagaagaacgtaacgtcagatttggtgttcgtgagcatggtatgggagctatctgcaatggaattgctcttcacagtcctggttttgttccatactgtgcaactttctttgtgttcacggattacatgagaggggccatgaggatttctgccttgagtgaagctggagttatatatgtcatgacccacgactcaattggactgggagaagatggaccaactcatcagcctattgagcacttggctagtttcagggcaatgcccaacatgttgatgtttcgaccagctgacggcaacgaaactgctggagcatacaaggttgctgtcatcaacaggaaaagaccatcaattcttgccctctccaggcaaaagctgccaaaccttcctggaacttctattgaaggagtagaaaaaggaggatatacaatatcagacaattcaaccggcaacaaacctgatgtgatcttgattggaactggttctgaattggagattgtggccaaagctgctgatgaactcagaaaggaagggaaagcagttagagctgtctcctttgtttcttgggagctattcgatgaacagtctgctgagtacaaggaaagcgttctaccagcagctgtaacagcaagggttagcattgaagctgcatcaacatttgggtgggcaaagatagtcggaagtgcaggaaaggccatcgggattgacgggtttggagccagtgctccagctggaaaaatatacaaggaatacggcattacagtcgaggcagttgttgctgcagctaaggaactttgctaggtattcatcactgaattccagtgggcttgttagttttccagaaactattcctgtttggattcttggttggaaaactcaaaccatatgattgttaatagactaaactctattcaagtactcataagatttctcgcaataatgaagataaaattttctttgctgcttttatcttcagtgcagcatctgagactgccaactgaatcaaagatgaactgagattagatttcttgaatgttcgtggatttgtatcaatacttaaacagttgttgacttctgtaatattacatattggattgttactgcattctatgttccatcttcaggataaatcaaataacgagctaatacgatgtcggatggaacgaatctgaacttacaaattttttcttctgtattcagactatcttttccttgaaaattttgttttccttgaaagtcggtatttgaagaatg

SEQ ID NO: 9101 - DNA, 2425 bp, Olea europaea
acgatcacaagaaaagagctatggcatcttcttcttctctcactgtttccccacctaccctctctggctcctctacacgccgccatggatcggcccaagagcttcacatggcccccaactctctttcccttcccaagtttaccggcctcaaatccaccaactcaactgccaccgccgccgtcttccgctgccgcacccccatcatcaccagcctcccggttcgggcctccgccgtagagacaatcgaaaaaacaacagacagcacacttctcgataagtccgtcaacacgatcaggttcttggccatcgatgctgtcgagaaggccaattccggacatccgggtttacccatgggatgcgctccgatgggccacatattgtatgatgaggtcatgaggtataaccccaagaatcccaagtggttcaatcgcgatcgctttgtgctctccgccggccatggatgcatgctccagtatgcactcctccacctcgccggctatgactccgtaaaggaagaagatttgaggagtttccgtcaatggggaagcaaaacaccaggtcatcctgagaattttgagactcctggtgttgaagttaccactggcccgcttggtcaaggtgttgccaatgcagttggcttagcgcttgcagagaagcacttggctgctcgttacaacaaaccagattgtgaggttgttgaccactacacatatgtcatcctcggagatggatgtcaaatggaaggtattgcaaatgaagcttcttcccttgctgcgcactggggacttggaaagctgatagccttttatgatgacaaccacatttccattgatggtaacacagaaattgctttctctgagagcgttgacgcccgttttgaaggtcttgggtggcatgtaatctgggtaaagaacggtaacactggttatgaagaaattcgtgcagctatcgaggaagcaaaggcggtgaaagacaagccaactttgatcaaggtgactacgaccattggttatggatcccctaacaaggcaaactcatatagtgtacatggaagtgcattaggtgccaaggaagttgaggccaccagaaagagccttagctggcctcatgagcctttccatgttcctgaggatgtgaagaagcactggagccgacatgtccctgatggtgctgcccttgaagccgaatggaatgccaaatttgctgaatacgagaagaagtatccagagaaagctgcagagttgaaatctatcattactggtgaactccctgctggttgggagaaagctcttcctacatacactccggaggctccagctgatgccacaagaaatctatcacaacaaaacctcaatgctcttgcaaaggttctacctggtttgcttggtggaagtgctgatcttgcctcctctaacatgactcttctgaaaatgtttggcgacttccaaaagagcacaccagaagagcgtaatgtaaggttcggtgttcgtgaacatggcatgggagccatctgcaatggaattgcctgccacacccctggtctcattccctattgtgcaactttctttgtgttcacggactacatgagagcagccatgaggatctcagctttgtctgaagccagagttatctatgtcatgactcacgattcaattggacttggagaagatggaccaactcatcagcccattgagcatttggcaagtttccgagcaatgcccaacatattgatgctccgcccagctgatggcaatgagacagctggtgcatacaaggtggcagttcttaacaggaagagaccgtcagtcctcgccctgtctcgtcaaaagctgccccagcttgctggaacatccatcgaaggagtagaaaagggaggctacatcatatcagataattcatccagtaacaagcccgatgtcattttgattggaacaggttcggagttggaaattgcagttaaggctgctgacgaactcagaaaagaaggcaaggcagtcagagttgtctcctttgtttcttgggagctttttgatgagcaatcgaatgattacaaggaaagtgtccttccatctgctgtaacagctagggttagcattgaagctggatcaacatttggatgggagaagattgttggagttaaaggaaaggccattggaattgatggatttggagccagtgctcctgcaggaaagatatacaaggaatttggtattacaatggaagctgttgtagcagctgccaaagaagtctcttaagccttggttgctgaacttacttggttgattgtggccttcaataattacttgcatttgaattcgggaatggtaaattttaaagtggaaaccatgcaggatttacttcattctggttctccacttgggtcttgagagatctcataataaagagaaaattttctctgtttgct

SEQ ID NO: 9102 - DNA, 3082 bp, Mimulus guttatus
attttctttttatcttcacccaatctcccttcaaaagcctcaaatcatttttcgacaatcacaaagaaaacacacacacagatagagcagagccatggcttcttcttcttccctcacactctctcaggccatactctctcgctccaccatctctcgccacggctctgcccagcagctccacccttctcccacatccgccgctctctccatcccctcattctccggccttaaagccgcctcctcctccgccgctgcttccgtctcccgccgccgcgcacccgccacccgtctgcccgtccgcgcatcagccgccgtcgagaccctcgagaagaccaccgatgccctcgttgagaagtccgtcaacacaatccggttcctcgcgattgacgccgtcgagaaggcgaactccggccaccctggtctgccgatgggatgcgctccgatgggacacgttctgtacgatgaggtgatgaggtacaaccctaagaacccttattggttcaatcgcgatcgcttcgttctctccgccggacacgggtgtatgctgcagtacgcactccttcacctcgccggatacgacgccgtcaaggaagaggatttgaagagtttccgtcaatggggaagcaagacccctggtcaccccgagaactttgagacacctggcgttgaagtcaccactggcccgctcggtcaaggtattgcaaatgctgttggtttggcacttgccgagagtcacttggctgcccgatacaacaaacctgatagcaagatcgttgaccactacacatactgtattcttggtgatgggtgtcaaatggagggtatctctaatgaagcctgctcccttgctggacattggggacttgggaagttgattgcattttacgatgacaatcacatctccattgacggtgacacagagattgctttcaccgaaaatgttgaccaacgtttcgaggctctgggatggcatgtaatctgggtgaagaacggtaacaccggttatgatgaaatccgtgatgcaatcaaggaagcaaagtctgtcacagacaagcccactctaatcaaggttactaccaccattggatttggctcgccaaacaaggcgaattcatacagtgtccatggagctgctttgggcaccaaagaagtggaagccaccagagaaaacctcggatggccatatgagccattccacgtacccgatgaagtcaagaaacattggagccgacacactcccgaaggagctgcttatgaatccgaatggaactccaaattcgccgaatacgagaagaagtacccagaggaagcagctgagctgaaatcaatcatcaccggtgaactaccttccggttgggagaaggctcttcccaaatacacacccgaaaccccaggcgatgcaacaagaaacctctcccaaacaaacctcaacgcactcgcaaaggttcttcctggtctaatcggaggcagtgcagatcttgcctcatccaacatgaccctcttgaaaatgttcggcgactaccaaaagaaaacacccgaagagcgaaacgttcgcttcggtgtgcgtgagcacagcatgggagccatatgcaacggaattgccctccacagcccaggcttcattccttactgtgcaaccttcttcgtctttacagactacatgagatcagccatgagaatctcagccctcagcgaagctggagtcatctatgtcatgacccacgactcaatcgggctcggtgaagatggccccacccatcagcccatcgaacacttggccagtttcagggcaatgcccaacatactcatgctccgccccgccgatggaaacgagacagctggctgttacaaagttgccgtcgacaacagaaaacgaccctcagttcttgcactctctcgtcagaagctgcccaatctggccggaacttcgatcgagggggtcgaaaaggggggctacaccatttcagacaattcttctgacaacaagccggatgttatcttgattggaactggctctgagttggagattgcagctaaagctgcggatgaactgagaaaggaaggcaagaaagtgagagttgtgtcgtttgtttcttgggagctttttgaggaccagtcagccgagtacaaggaaagtgtgctgccgagtgctgtgacagctagggttagcattgaggctggaacaactttcgggtggcataagattgttgggagtaaaggaaaggcgatcgggattgataaatttggagcgagtgcacctgcagggaagatatacaaggagtacggtattacggccgaagctgttatagctgcagctaaggaagtatgttaagcaacaatggtggttttttgagcttcttggattctgcttgtgtcgaaaaaagaaaataacaaacagagttcgaataaagaagaccatttacagtcttttgttccccttctttttttttttgtagtcgaaaaacgatgaggagagagactaggcaatatgaatccattctccttgatttgtacaacttgaacatcatctttgattttgtaagtcaatgtgtttttttgattgatcataagttcttttcgttaacagtttcgcctcttcgacgtgatctcgatatataatttgaagattttcttcttcttttaaaccaggaaatgaggtgaaacttacatatttcacaagggaatattactattgacatgttatcagtttgaatggctatgagttttagtggataagagaaagatcttgtctgaaatggtggaattgaaaccacatgagacaaagatagggcaatcttgatatttgcaagaaaattgaggccctttgaagtaaaataaaacgtaggcaattttatccaaaaggagatgatgtatagtagatcaaataagtattgtgtggttgttggaatagatttgtaatatgaggttgttgacagatttctccagatttttttttattatttattattttcttttttctctttttattttatttatttggatgttgaaagctatgtttgcaattatatgttgtgggctcataatctcatatcatggaatataggcctaaaacttaagcata

SEQ ID NO: 9103 - DNA, 2510 bp, Arachis hypogaea
ttcttctctctttctctatctcactctctcatactcgcacaccaaccaccaaccatggcatcttcctctctctccgtctcccaatccatcctctcccgtcccgcctcctcatcccgccgctcttccctcccctcattttccggcctccgcccaactgcctcatctaacccgacccagcccgcaatctccctccgccgcatccccccaatctccgccctcaaggtctccgcttcctcctcctccgccgtcgataccgtcgaccgcacagccgccgaccccgccatcgttgagaagtcggtcaacacgatccggttcctcgcaatcgatgccgttgagaaagcgaattcgggtcacccgggtcttcccatgggttgcgccccgatgggtcacgtgctctatgacgaggttatgaggtacaacccgaagaatccgaaatggttcaaccgtgatcgctttgttctctccgctggacatggttgcatgcttcagtatgcgttgcttcaccttgctggctatgatagcgtcaaggaggaggatttgaagcaattccgccagtgggaaagcaggaccccgggacaccctgagaatttcgagacacctggaattgaagttacaacaggtcctcttggtcagggtattgccaatgctgtgggtttggccctcgcagagaagcacttggctgcgagatttaataagcctgacaatgagattgttgatcattacacgtatgctatattgggtgatggttgtcagatggagggaattgcaaatgaagcatgctcacttgctggccactggggattagggaagctaatagcattctatgatgacaatcacatttctattgatggtaacactgaaattgcattcaccgagagtgttgatagacgatttgagggacttggatggcatgttatttgggtaaagaatggaaacaatggttatgatgaaattcgtgctgccatcaaggaggcaaaggctgtgaaagacagacccacactaatcaaggtcacgaccacaattggttatggttctcctaacaaggctaactcctacagtgtgcacggaagtgcattgggtgccaaagaagttgaggctacaaggcagaaccttggatgggcacatgagcctttccatgtgcccgaggatgtcaaaaagcactggagtcgtcacatccctgagggtgctgcacttgaagccgagtggaataaaaagtttgccgaatatgagaagaaatacaaggaggaagctgcagaactgaagtgtattatcaatggagaatttcctgctggatgggagaaagcacttccaacatacacccccgagaccccaggtgatgccaccagaaatctctctcagcacaaccttaatgcccttgcaaaggttcttcccggtctgcttggtggtagtgcggatcttgcatcctccaacatgaccttgatgaaaatgtttgggaacttccaaaaggacactcctgctgagcgtaatattagatttggcgtcagagaacatggcatgggagcaatcagcaacggcattgctctacacagccctggcctgattccttactgtgcaactttctttgttttcaccgactacatgagagctgccataaggctttctgccctgtctcaggctggtgttatttatgtgatgacccatgattcaataggactcggagaggatgggccgacccaccaacctattgagcacctggcaagcttccgggcaatgcctaatgttttgatgcttcgtcctgctgatggtaatgaaactgccggatcatacaaagttgccgtgcttaacaggaagagaccctctatcctcgccctttctaggcaaaagttgcccaatcttcctggaacttctattgaaggagtcgggaagggtggatacaccatctcagacaactcaacaggcaataagcctgatgtcattttgattggaactggttccgaattggagattgccgccaaggctgctgatgatctcagaaaggaaggtaaggctgttagagtcgtttcgttcgtttcatgggaacttttcaacgagcaatcggaagcatacaaggagagtgttctccctgctgctgtttcagctagagttagcattgaggcaggatcaacatttgggtgggagagaatcattggaagcaaaggaaaagcaataggcattgatcgattcggagctagtgccccagcaggaaaaatatacaaagagtttggcattacaaaggaagctgttattgctgcagcaaaatcacttatctaagatgtattagtttcttaatttttgtttttgccttggtttgagttgatgtttacattgagaggggaatttgcatgaggcatgtttaaagggcattccttcacttgaataaggaatatattaggttacagatgcttgtgattctcatttgagtttcttagatcaaagcaggagatggaagtatgaacttgtaataacactttgaacagttgagttatgcatttgccacacggtcaaaatca

SEQ ID NO: 9104 - DNA, 2569 bp, Valeriana officinalis
ccatttgctctctcccgattcatatcttattataatctctcaccaaccatttcatatcacacaatcctcttctctctctatacactcccccagaaagaagaagaagaggaagagaagaagaatttctatattcaaatctgacttctctctaaaccactacccatggctgcttcttcttcacttactctctcacaagccattctcacccgctcttctccccgccatgcctcctctactcaagaattttcttctctttccaccttcacccgcctccccgctttctccggtctcaaatcctcagccccactgcccacccgggttgcctcacgccgtcgctctgctccccggagctcagttcgcgcctccgctgccgtagagactctcgacaagacggatacagcgcttgtggataagtccgtcaacacgattaggttcctggccatcgatgcagtcgagaaggctaattcgggtcatccgggtctacccatgggttgtgccccgatgggtcacatattgtacgacgaagtgatgagatacaaccccaaaaacccttattggttcaatcgtgatcgcttcgttctctccgccggccatggatgtatgcttcagtatgctctgcttcacctcgctggatacgacgccgtcaaggaagaagatttgaagagtttccgtcaatggggaagcaaaacccctggtcacccagaaaactttgaaacccctggtgttgaagtcactactggtcctcttggtcaaggtatagccaatgctgttggtctagctcttgcagagaaacatttggctgctcgtttcaacaaggccggcgatgaaatcgttgaccactacacatactgcattgttggagatggttgtcaaatggagggaattgcaaatgaagcatgttcactagctggacattggggacttggaaaattgattgcattttacgacgataaccatatctccattgatggtgatactgagattgcattcacagagagcgttgatactcgttttgaaggtcttggctggcatattatctgggtcaagaacggtaacacgggttacgatgagatccgtgctgccattgaggaagccaagaaagtaaccgataaaccaactttgatcaaggttacaacaactatcggatatggatccccaaacaaggcaaattcgtacagcgtgcacggtgctgcactcggtgctaaagaagtcgatgctactagaagcaacctcggatggccttatgagcccttccatgtccccgaggacgtcaagaagcactggagccgccatactcctgaaggtgccgcccttgaagctgcatggaatgccaagtttgccgaatacgagaagaagtatccggaagaggctgctgaattgaagtctattaccgacggtgttttgcctgctggttgggaaaaggctcttcctacatacacaccagatatccctggagatgcaacgagaaacctatcacaaacaatgctaaacgccctagcgaaggttcttcccggtcttatcggtggaagtgctgacctcgcatcttccaacatgaccctaatgaaaatgttcggcgacttccagaagaacactccggaagaacgcaacgtgcgtttcggagttcgtgaacacggcatgggagccatatgcaacggcattgccctccacagccccggatttgttccgtactgtgccactttcttcgtcttcactgattacatgcgtggagctattagaatctcggcattatctgaagccggagtcatatacgtaatgacccacgattctattggtttgggtgaagatgggccgacccatcaacctattgaacaccttgccagtttccgggcaatgcccaacatcttgatgttccggccagcggatggaaacgagaccgccggagcttacaaggttgccgtcgagaaccggaagagaccatccatcctcgccttgtctcgtcaaaagctgcccaacctgcccggaacctcaatcgagggcgtggagaaaggagggtacacgataactgacaactcgtcagggaacaagcccgatgtcatcttgatcggaacagggtcggagctcgagattgcggctaaggctgctgacgagcttagaaaggaaggaaaaactgtgagagttgtgtcgtttgtgtcgtgggagcttttcgaggatcagtctgaggagtacaaggagagcgttttacctgcggcagtgactgctagggttagtatcgaggctgcatcaacttttgggtggcataagattgttggaagcggtggaaaggctatcgggatcgataaattcggagcgagtgcaccggctcccaagatctacaaggagtacggtataacagcggaggctgttattgaggcggctaaatctctttggtagggttcttaatttgtgtaatttgttatcaaggaatgaatatttgggtttgatagaatttgtggtttatgttgagattacataataatttgatttgatgttggggagatcgagacttgaaaattcacgtcggattttcattgacatttcaaagagtaaaaagaaaacgcgaattttgagt

SEQ ID NO: 9105 - DNA, 2844 bp, Eucalyptus grandis
gtggggctcgtttaaaacgaccccccgtttcccccatttctcttcgtcgccatctctctctctctctctctacgatcgccgccgagaggtgtagagagagaaacccgccgccgccgccgccgccgccgccaactacctaacctactacacacacactcttctctctcttcgcccgccaccgtcaagaaccgccgaagcggcaaaggcaatggcgtccgcctcgtccctgaccgtctcccaggccgtcctggcccgatccgcctccgccccccgcggcggcgccggccagtccccctcctccgaccgcctctccgtcccctccccccgcctccccaccttctccggcctcaagtcctcccccgccgccgccgccgccgccggctccgcccaccgccggctccgccgcctcgccgtcccccggccgatcagggccacggccgccgtcgagaccctcggcccctccgccgccgccgagaccgccctcgtcgacaagtccgtcaacaccatccggttcctggccatcgactcagtcgagaaggccaactccggtcacccgggcctgcccatgggctgcgccccgatcggccacgtcctgtacgacgaggtcatgaggtacaaccccaagaacccctattggttcaaccgcgatcggttcgtgctgtcggccgggcacggctgcatgttgcagtacgccctgttgcatctcgccggctacgacagcgtcaaggaggaggatttgaagagtttccgtcaatggggaagcaagacacctgggcatcctgagaacttcgagacgcccggtattgaagttacgacaggtccacttggccaaggaatcgccaatgctgttggtttggctcttgccgagaaacatttggctgctcgtttcaacaaaccggacaatgaaattgtcgaccactacacatatgccgttcttggagatggatgtcaaatggaaggcattgcgaatgaagcttgttccctcgctgggcactggggacttgggaagctgattgccttttatgatgacaaccacatctccattgatggtaacacagagattgcattcaccgagaatgttgagaaacgttttgagggtctgggttggcatgttatatgggtgaaaaatggtaacactggttatgatgaaattcgtgctgccatcaaagaagcaaaggctgttaaagacaagcctactttgattaaggtaactacgaccataggttatggttcacctaacaagtccaacagctacagtgtgcatggtagtgcactaggcgccaaggaagttgatgcaactaggaataaccttggttggccatatgagcctttccatgtgcctgaggatgttaaaaagcactggagtcgccatactcctgttggtgctgccgttgaagctgaatggaatgcaaaatttgctgaatatgagaagaaatacaaggatgaagctgcagtgctgaaatctatcattaagggcgaactacctgctggttgggagaaagccctgccgacgtacaccccagagattccagcagacgctaccagaaacctctctcaacaatgcctcaatgcccttgtggatgtggtgcctggtcttcttggtggaagtgcagatcttgcttcctccaacatgactcttctcaaaaagttcggcaatttccaaaaggatacccctgaggaacgtaatgttagatttggtgttagggagcatggaatgggggccatctgcaatgggattgctctccatagcccaggacttatcccgtactgtgccaccttctttgtcttcacagactacatgagggcagcgatgaggatctctgcgcttgctgaatctggggtcatctacgtcatgacccacgattctattggtcttggagaggatgggcccacgcatcagccagttgagcacttggctagcttccgtgctatgccaaacattctaatgctccgcccagctgatgggaatgaaactgctggtgcatacaaggttgctattgtaaacaggaagagaccttccgtcctcgctctctccaggcaaaagcttcccaaccttcctggaacctccatcgaaggagtcgagaagggaggttatgtcatctctgacaattcctcaggcaacaagccagatgttattctgattggaactggttctgagttggaaattgctgcgaaagcagccgatgagctcaggaaggaaggcaagactgtgagggttgcgtccttcatttcttgggaactatttgacgagcaatctcctgagtacaaggagagtgtgttgccttctggtgtaacagctagagtcagcatcgaagctggatcgacttttgggtgggagaagatcgttggaagcaaaggtaaggctattggaatcgacagattcggtgccagtgctccggcaggtaaattatacaaggaattcggcattactgtggaggcggtcattgctgcagccaagcaagtgtcttagactaagtaatagcctgtttatcttgttttttttcttgggattgggttttggagaagagcttaagatggagacgccgcccaagagatcctcacgaggtctcttatgctttaataaaggagcaataagaagttttcgaccgcttaaatttccttaatgcagcaaagcgtagatttagaatggagttgattgagtaacactgcacttgtaaaaacacctggagcttcttcttcttgagatttgtatcgacttgtggccgattcactttaagcatatttatcctccatgtccatccttttgcatgactacaattcagcaaaaccttgtttcctgtttggatttgaagcttgaatattcaaatctttattgatcctggc

SEQ ID NO: 9106 - DNA, 2613 bp, Solanum tuberosum
gatctatatctacctattctcatcctcatcttcttcattcattcaacacacacaaacagagccatggcttcttcatcttctctcactctttctcaagctatcttctctccttctctccctcgccatggctcatcttcttcgtcttctccttctctctctttctccactttctctggccttaaatccacccctttcacttcctcccaccgtcgtattcttccttccactaccgtcactaaacaacagttctctgttcgtgcctccgcagctgtagagactttggagaaaactgatgcagccattgttgagaaatctgttaacactattcgatttttggctattgatgctgttgaaaaagctaattccggtcatccgggtttacccatgggatgtgctccaatgggtcatatattgtatgatgaagtaatgaaatataacccgaagaatccttactggtttaatcgtgaccgatttgttctatctgctggtcatggttgtatgctgcaatatgctcttcttcatcttgctggttatgactctgttcaggaagacgatttgaaaagtttccgtcaatggggaagcagaattcccggtcaccctgagaattttgagacacctggtgttgaagttaccactggtcctctggggcaaggtattgccaatgctgttggattggctgttgcagagaagcacttggctgctcggttcaacaagcctgacgctgagattgttgaccactatacatatgttattcttggtgatggttgtcagatggagggtatctcaaatgaagtttgttcccttgctggccattggggacttggaaagctgattgctttctatgacgataatcacatttccattgacggagacacagaaattgctttcactgaggatgtctctgctcgtttcgagtctttaggatggcatgtaatctgggtgaagaatggtaacacaggttatgatgagattcgtgcagctattaaggaagctaaagctgtcaaagacaaacctactatgatcaaggtaactacaacgattggttttggctctcctaacaaggcaaactcttacagtgtgcacggtagtgcacttggagcaaaggaagtcgaggcaactagaaataacctgggatggccttatgagcctttccatgtgcctgaagatgtgaagagccattggagtcgtcatacaccggagggtgctgcccttgaaactgaatggaatgctaagtttgctgaatatgagaagaagtatgcagaggaagctgcagatttgaaatccatcattactggtgaactacctgctggctgggagaaagctcttcctacttacactcccgagagcccagctgatgccacgagaaacttgtcacaacaaaaccttaatgctcttgccaaggttctacctggtttccttggtggtagtgctgatcttgcatcatcaaacatgactcttttgaaaatgtttggtgacttccaaaagaacactccagaagagcgtaatttaaggtttggtgttcgtgaacatggtatgggagccatatgtaatggaattgctctacacagccttggcttgatcccctattgtgctactttctttgtgttcactgactacatgagaggagccatgaggatttcagccttgtctgaagctggagttatttatgttatgactcacgattcaattggtctaggagaagacggtccaacccatcaacccattgagcacttggcaagtttccgtgccatgcccaacattctgatgttccgtccagcagatggcaatgagacagcaggagcttacaaggtggctgtccttaagaggaaaacaccatcaatccttgccctctctcggcaaaagttgccacaacttgctggaacttctattgaaggagcagcaaagggtggctacattgtatcagacaattcatctggcaacaaacctgatgtcattttgatcggtactggctccgagttggaaattgctgtcaaggctgctgaggaactaaagaaagaaggaaagacagtgagggttgtttcctttgtttgttgggagctttatgatgaacaatcagctgaatacaaggaaagtgtccttccatcatctgttacagctagagttagcattgaagctggatcaacatttgggtggcaaaaatttgttggcgataaaggaaaagccattgggattgacgggtttggtgctagtgctcctgctgataagatatacaaagagtttggtattacagcagaagctgttgtagctgcagctaaacaagtttcttaggcgatgttcgttacaattcttggttgcttgccttgtggtctactgaatgagataatgttcgagacgacatcaaatggataataaatctaagattaggatagaaattaggcacattgatgtacctaaacttgtacactacatatgttgagtttgtaatttcattttggttcattgataaagatgtcgctttcgccattagagtttcatgtgtctctggcaatgagatttttgttttccttcattttaatccatttgaggcatcattctgataaaaagaaaaaacaattgaacttgatgatatcccacatagggcaattctactac

SEQ ID NO: 9107 - DNA, 2792 bp, Chenopodium quinoa
cccacaaccaacgtccaagattcaccccttccctaatccaacggccatcattcctcctcctatcaacggccattcataattcaaaacaagatttaatggaccccacttctttctcctcatcctctcataatactctcctctccaacaaactaacactctcatcttccactcttttatcccatcttctttcaagagagaaagaagtaagattgccattttcattatccaaaaccaatatcaatggcagcttcttcttctcttagcacactatctcatcaaacactcctttcgcacccgaaaacacaccttgcaaccacccctacttcatcccttattgtccctacaacctctaaggtcaatggagtgctccttaagtcatcctcctctaggaggaggcgtgctgcgcctcgtgcaaccgttgtgagggctgcagctgtggaagcgttggagtcaacagacactgatcaacttgtcgaaaagtctgtcaacaccataaggttcttggctattgatgctgttgaaaaggctaactctggtcacccgggtttgcctatgggatgtgctcccatggggcatatattgtatgatgagatcatgaggtataacccgaagaacccgtattggtttaaccgtgaccgctttgttctctctgctggtcatggttgtatgcttcagtatgctcttcttcatcttgctggctatgacagtgtcttggaagaggatttgaagactttccgccaatggggaagcagaattcccggacatccagagaatttcgagacacctggagttgaagttacaactgggccacttggtcagggtatagccaatgctgttggtttggctcttgcagagaagcatctggctgctcgtttcaacaaacctgatgctgaaatcgtagatcattacacgtactgcattcttggtgatggttgccagatggaaggaatcgcccaggaagcttgctcacttgctggccactgggggcttggaaaattgattgccctgtatgatgataatcacatttctattgatggcgacactgccattgcattcactgagagtgttgatttgaggtttgaggcccttggctggcatgttatttgggtgaagaatggtaacactggttacgatgaaattcgtgctgctatcaaggaagctcagtctgtcaaggacaaacccactttgatcaaggttactaccactattggttttgggtctcccaacaagtcaaactcgtacagtgtgcacggaagtgcattgggttctaaggaagttgaggctacaaggcagaatcttggctggccttacgagccattccacgttccagaggaagtgaagaagcactggagccgccatacccctgagggagcctccttggaagctgagtggacttctaagtttgcagagtatgagaagaagtatcctacagaagcagctgagttcaagtcaatcattaccggtgaattgcctgctggttgggagaaagctcttcctacttacacacctgagaccccaggtgatgcaaccagaaacctgtcgcagcaatgcttaaacgcccttgcaaaggttcttccaggacttcttggtggtagtgcagatcttgcatcttcaaatatgaccttactaaaaatgttcggagacttccaaaaggacacaccggaagaaagaaatgttcgttttggtgttagagagcatggaatgggagccatttgcaatggaattgcccttcacagcccagggctaatcccttactgtgctaccttctttgtgttcactgactacatgagaggagcaatgaggatctctgccttgtcagaatctggagtcatctatgttatgacccacgactctattgggcttggagaagatggacccacccatcaacccatcgagcacttggcaagttttcgtgccatgcccaacattctaatgctccgcccagctgatggtaacgagactgctggttcatacaaggttgctgttgaaaacagaaagacaccatccattcttgctctttctaggcaaaagcttcctaacttgccaggaacatccattgaaggagttgcaaagggagggtacaccatctcagacaactcttcaggcaacaagcctgatgttattctgattggaactggttcagagctggaaattgctgccaaagctggtgacgagctaagaaaagaaggaaaatctgtcagagttgtatcgtttgtgtcttgggagttgtttgaacagcaatctgatgaatacaaggagagtgtccttcctgcagatgttacagcaagagtaagcattgaggctggatcaaccttcggatggcacaagattgtgggatcaaaggggaaggccatcggtattgacaagtttggagctagtgcaccagcaggaataatatacaaggagtatggaatcacagccgaggcagttattgaagcggcaaaatcagtttgttaggccacggtgctgcagattctttttgcctcctgttttccatttttgttaactgatcaagtagacaaggctccctggtcaatctagtgagtactgtattacagtaaatcccgaaaaaaaaaaattagttactgtaaagaaagcggatttgatcgttccatttgtcaagatgaatttctaaggcttcttacagtaagagtgtttgttgatttgtatttaaaatcttgcattcaatgttaaagtatggacagcatattttctaataaggaacaatgacagtgatgctgattatgtgaagcagttttctcttcccattcaattaggacttgttttcttga

SEQ ID NO: 9108 - DNA, 2641 bp, Solanum phureja
tcaatttcatccacaaaacatcatccaaattctatatctacctattctcatcctcatcttcttcattcattcaacacacacaaacagagccatggcttcttcatcttctctcactctttctcaagctatcttctctccttctctccctcgccatggctcatcttcttcgtcttctccttctctctctttctccactttctctggccttaaatccacccctttcacttcctcccaccgtcgtattcttccttccactaccgtcactaaacaacagttctctgttcgtgcctccgcagctgtagagactttggagaaaactgatgcagccattgttgagaaatctgttaacactattcgatttttggctattgatgctgttgaaaaagctaattccggtcatccgggtttacccatgggatgtgctccaatgggtcatatattgtatgatgaagtaatgaaatataacccgaagaatccttactggtttaatcgtgaccgatttgttctatctgctggtcatggttgtatgctgcaatatgctcttcttcatcttgctggttatgactctgttcaggaagacgatttgaaaagtttccgtcaatggggaagcagaattcccggtcaccctgagaattttgagacacctggtgttgaagttaccactggtcctctggggcaaggtattgccaatgctgttggattggctgttgcagagaagcacttggctgctcggttcaacaagcctgacgctgagattgttgaccactatacatatgttattcttggtgatggttgtcagatggagggtatctcaaatgaagtttgttcccttgctggccattggggacttggaaagctgattgctttctatgacgataatcacatttccattgacggagacacggaaattgctttcactgaggatgtctctgctcgtttcgagtctttaggatggcatgtaatctgggtgaagaatggtaacacaggttatgatgagattcgtgcagctattaaggaagctaaagctgtcaaagacaaacctactatgatcaaggtaactacaacgattggttttggctctcctaacaaggcaaactcttacagtgtgcacggtagtgcacttggagcaaaggaagtcgaggcaactagaaataacctgggatggccttatgagcctttccatgtgcctgaagatgtgaagagccattggagtcgtcatacaccggagggtgctgcccttgaaactgaatggaatgctaagtttgctgaatatgagaagaagtatgcagaggaagctgcagatttgaaatccatcattactggtgaactacctgctggctgggagaaagctcttcctacttacactcccgagagcccagctgatgccacgagaaacttgtcacaacaaaaccttaatgctcttgccaaggttctacctggtttccttggtggtagtgctgatcttgcatcatcaaacatgactcttttgaaaatgtttggtgacttccaaaagaacactccagaagagcgtaatttaaggtttggtgttcgtgaacatggtatgggagccatatgtaatggaattgctctacacagccttggcttgatcccctattgtgctactttctttgtgttcactgactacatgagaggagccatgaggatttcagccttgtctgaagctggagttatttatgttatgactcacgattcaattggtctaggagaagacggtccaacccatcaacccattgagcacttggcaagtttccgtgccatgcccaacattctgatgttccgtccagcagatggcaatgagacagcaggagcttacaaggtggctgtccttaagaggaaaacaccatcaatccttgccctctctcggcaaaagttgccacaacttgctggaacttctattgaaggagcagcaaagggtggctacattgtatcagacaattcatctggcaacaaacctgatgtcattttgatcggtactggctccgagttggaaattgctgtcaaggctgctgaggaactaaagaaagaaggaaagacagtgagggttgtttcctttgtttgttgggagctttatgatgaacaatcagctgaatacaaggaaagtgtccttccatcatctgttacagctagagttagcattgaagctggatcaacatttgggtggcaaaaatttgttggcgataaaggaaaagccattgggattgacgggtttggtgctagtgctcctgctgataagatatacaaagagtttggtattacagcagaagctgttgtagctgcagctaaacaagtttcttaggcgatgttcgttacaattcttggttgcttgccttgtggtctactgaatgagataatgttcgagacgacatcaaatggataataaatctaagattaggatagaaattaggcacattgatgtacctaaacttgtacactacatatgttgagtttgtaatttcattttggttcattgataaagatgtcgctttcgccattagagtttcatgtgtctctggcaatgagatttttgttttccttcattttaatccatttgaggcatcattctgataaaaagaaaaaacaattgaacttgatgatatcccacatagggcaattctactac

SEQ ID NO: 9109 - DNA, 2443 bp, Panax ginseng
ttcttctttttctcacctacccactttctccacctccctcagatcctcctctcgccaccgcagctccgccgctggccaccaggtagtccgggccgccgttgtggagacgctcgacaagacggagacctcattggtggagaaatcggtgaacacgattcggttcttggctattgatgccgtggagaaggctaattcgggtcatccgggtttacctatggggtgtgccccgatgggtcatatattgtacgacgaggtgatgaggtacaaccccaagaacccgtattggtttaatcgggatcgctttgttttatccgctggacatgggtgcatgcttcagtatgctttgctacaccttgctggttatgacagtgtcctggaagaagacttgaagtccttccgtcaatgggggagcagaactccaggacaccctgaaaactttgagacccctggtgttgaagtcactacaggtcctcttggtcagggtgttgccaatgctgttggtctggcccttgtggagaagcacttggctgctcgcttcaacaaacctgacagtgagattgttgaccattacacatatgtcatacttggggatggctgtcaaatggaggggattgcaaatgaagcttgttcccttgctggacattggggacttggaaaactgattgctttctacgatgacaaccatatctccattgatggtgacacagagattgcattcactgagagtgttgacacccgttttgagggtcttgggtggcacattatctgggtgaagaacggtaacacaggttatgatgacattcgtgctgccatcaaggaggcaaaggctgtaacagacaagcctactttaatcaaggtgaccacgacaattggttttggatcacctaacaaagcaaactcgtacagcgtccatggaagtgccctgggagctaaggaagttgatgccacaaggaagaaccttgggtggccttatgagcctttccatgtacctgaggatgtgaaacagcattggagccgccatacctctgaaggtgcttctcttgaagctgcatggaatgccaagtttgctgagtatgaaaagaagtatgcagaggaagcggcagaattaaagtctatcattactggtgtgctacctgatggttgggagacagctctgccaacatacactccagagatccctgctgatgccaccagaaatctctctcaaacatgtctgaatgcccttgcaaaggttcttcctggccttctgggtggcagtgctgatcttgcttcctccaacatgaccctgctgaaaatgtttggggacttccaaaagggtacaccagaagaacgtaatgtcaggtttggcgtccgtgagcatggtatgggagctatctgcaatggtattgctctccacagccctggcctcattccctactgcgcaactttctttgtgttcactgactacatgagaggggccatcaggatctccgccttgagtgaagctggagttatttatgtcatgacccatgattcaattgggctgggagaagatggaccaactcatcaacctatcgaacatctggccagcttcagggcaatgcccaacattttgatgctccgtccagctgacggaaacgagactgctggggcatacaaggttgcagtcctcaacaggaagagaccatcaatccttgccctatctaggcaaaagctgcccaaccttcctggaacttccattgaaggagttgaaaaaggtgggtacatgatatcagacaattcatctggtaacaagccagacgtcatcttgattggaaccggttctgaattggaaattgcagccaaagctgctgatgaactcagaaaggaagggaaggcagttagggtcgtctcttttgtgtcttgggagttatttgatgagcaatcagatgattataaggaaagtgtcctacctgcagctgtaactgcaagggttagcattgaagctgcatcaacatttggttgggggaaacttgttggaagcgaagggaaagctattgggatcgacaagtttggagcaagtgctccagctggaaaaacatacaaggagtatggcattacggtagaggcaattattgcagcagctaaagaacttatctagagcttcattacagaattccatttggaggctgtcagttcagcggaaacttagtatttttggagtttgggttggagaatttacacctaatcattgttaaaagactcatcttgattcagtacctcttaagatttcacaataacaaagatgaaattttcttttgttgcttttcattatcttcagcgctgcagctgaggctgcaaaatgaatcgagatcaaaagagagattagatttcattaacgttcatgaatttgtataccaatacttgaacatgtatcaacttttgtacttttatgtgttggattgttagtgatgtttatattcct

SEQ ID NO: 9110 - DNA, 2616 bp, Lotus japonicus
cttcttcttcttcttcttcttcttcttctcactctctctctcacttcaccaaccatggcttctacctcaacctccccctccctctctctctcccaagccctcctcacgcgcccctcttccctcccctcctccacgcgcctctccctccccgccttctccggcctccgccaatccaccaccctctccctctccctctcccacactccaaccactcaccgccgccttcccgccgccgtcaaagcctccgttgcggcggagactgcgaagaaggtgaccactgatgagtcgctggtggacaagtcggtcaacacgatccggttcctggctgtggatgcggtggagaaggcgaattccggtcacccgggtctccccatgggttgcgctccgatgggtcacgtgctctacgatgagatcatgaggtacaaccccaaaaaccccaagtggttcaaccgcgatcggttcgttctgtctgcgggtcatggttgcatgctccactatgctctgcttcaccttgctggcttcgacagcgttaaggaagaagatttgaaggaattccggcaatgggggagcagaactccgggacatcctgagaactttgagacccctggaattgaagtcacaacaggtcctcttggtcaggggattgccaatgctgttggtttggcccttgcagagaagcacttggcagcaagatataacaagcctgacagtgaaattgttgatcattacacgtatgttatattgggtgatggttgtcagatggaggggattgcaaatgaagcatgctcacttgccggtcactggggactggggaagcttatagcattttatgatgacaatcacatttctattgatggtaacacagatattgcattcactgagagtgttgatagtcgttttgagggacttggatggcatgttatttgggtgaagaatggaaacaatggctatgatgatattcgtgctgctattaaggaagcaaaagctgtcccagacaaacccacattgatcaaggtcacaacaaccattggttttggttctcctaacaaagctaactcctacagtgtgcatggaagtgcacttggtgccaaagaagttgaagccaccagagcgaaccttgcatggccgcatgagcctttccatgtgcctgaggatgtcaaaaaacactggagtcgccatatccctgagggtgctgcacttgaggctgagtggaatgccaagtttgctgaatatgaaaagaaatacaaggaggaagctgcagagtttaagtctattattaatggtgatttacctgctggttgggagaaagcacttccgacatacactccagagaccccagctgatgccaccagaaatctgtctcagactaacctaaatgcccttgcaaaggttcttcctggtctgcttggtggtagtgcagatcttgcttcttccaacatgaccttgctgaaaatgtttgggaacttccaaaaggacactccggcggagcgtaatgtcagatttggtgttagagaacatggaatgggagctatctgcaatggtattgctcttcacagccctggactgattccttactgtgcaactttctttgttttcaccgactacatgagaggtgccataaggctttctgccctgtctgaggctggggttatatatgtcatgacccatgattccatagggctcggagaggatgggccaacccaccagccgatagagcatcttgcgagcttccgggcaatgccgaacatcctgatgcttcgtcctgcagatggtaatgaaacagctggagcttacaaagttgctgtggttaacaggaagagaccctctatccttgccctttccaggcaaaaattgcccaatcttcctggaacttcaattgaaggagttgaaaagggtgggtacaccatttccgacaactcaaccggcaacaagcccgatgtcattctgatcggaactggttctgagttggaaattgctgccaaagctgctgatgatctaagaaaggaagggaaggcagttagagttgtttccttcgtctcatgggaacttttcgatgagcaatcagaagcttacaaggagagtgttctaccttccgctgtttcagctagagttagcattgaggcagggtcaacatttgggtgggagaaaattgttggaagcaaggggaaggcaataggtattgatcattttggagccagtgctcctgcggggagaatatacaaggagttcggtatcactaaggaagctgttattgctgcagctaaagagcttatctagattgtattagtttctgcacattttgaactttctgttttccttctgatttcgggtttgatatttacagagagggctgtttcaagagcattccgttgcttgaataagaaaaggttagattactgttgcttgggattgtaagtgaagcaacatagatcaaagaagagtgtaatgcaactaataaatttttatgaactcggattgtcacttgtttgaattttcatgcccgttcatctagtccttcaagtatgcttgtgtattttctttcactctttggcagtgtacaattatagatgcatttgaataatttggaatccctgcaggaaatactaaaatcacgta

SEQ ID NO: 9111 - DNA, 2685 bp, Panax ginseng
aagcagtggtatcaacgcagagtacatggggatcattaccttacctgcttctcatttctcatctacagcccccaatttctctcccaaattcccaaagggggagactttatcaagcccactttctctctctctactgtcagccatggcagcttcttcatctctaactctttctcaagccatcctttcccgctcaattcctcgccatggctccaattcctctacccacaaaccccatcttcttctctttctctttttctcacctacccactttctccacctccctcagatcctcctctcgccaccgcagctccgccgctggccgccaggtagtccgggccgccgttgtggagacgctcgacaagacggagacctcattggtggagaaatcggtgaacacgattcggttcttggctattgatgccgtggagaaggctaattcgggtcatccgggtttacccatggggtgtgccccgatgggtcatatattgtacgacgaggtgatgaggtacaaccccaagaacccgtattggtttaatcgggatcgctttgttttatccgctggacatgggtgcatgcttcagtatgctttgctacaccttgctggttatgacagtgtcctggaagaagacttgaagtccttccgtcaatgggggagcagaactccaggacaccctgaaaactttgagacccctggtgttgaagtcactacaggtcctcttggtcagggtgttgccaatgctgttggtctggcccttgtggagaagcacttggctgctcgcttcaacaaacctgacagtgagattgttgaccattacacatatgtcatacttggggatggctgtcaaatggaggggattgcaaatgaagcttgttcccttgctggacattggggacttggaaaactgattgctttctacgatgacaaccatatctccattgatggtgacacagagattgcattcactgagagtgttgacacccgttttgagggtcttgggtggcacattatctgggtgaagaacggtaacacaggttatgatgacattcgtgctgccatcaaggaggcaaaggctgtaacagacaagcctactttaatcaaggtgaccacgacaattggttttggatcacctaacaaagcaaactcgtacagcgtccatggaagtgccctgggagctaaggaagttgatgccacaaggaagaaccttgggtggccttatgagcctttccatgtacctgaggatgtgaaacagcattggagccgccatacctctgaaggtgcttctcttgaagctgcatggaatgccaagtttgctgagtatgaaaagaagtatgcagaggaagcggcagaattaaagtctatcattactggtgtgctacctgatggttgggagacagctctgccaacatacactccagagatccctgctgatgccaccagaaatctctctcaaacatgtctgaatgcccttgcaaaggttcttcctggccttctgggtggcagtgctgatcttgcttcctccaacatgaccctgctgaaaatgtttggggacttccaaaagggtacaccagaagaacgtaatgtcaggtttggcgtccgtgagcatggtatgggagctatctgcaatggtattgctctccacagccctggcctcattccctactgcgcaactttctttgtgttcactgactacatgagaggggccatcaggatctccgccttgagtgaagctggagttatctatgtcatgacccatgattcaattgggctgggagaagatggaccaactcatcaacctatcgaacatctggccagcttcagggcaatgcccaacattttgatgctccgtccagctgacggaaacgagactgctggggcatacaaggttgcagtcctcaacaggaagagaccatcaatccttgccctatctaggcaaaagctgcccaaccttcctggaacttccattgaaggagttgaaaaaggtgggtacacgatatcagacaattcatctggtaacaagccagatgtcatcttgattggaaccggttctgaattggaaattgcagccaaagctgctgatgaactcagaaaggaagggaaggcagttagggtcgtctcttttgtgtcttgggagttatttgatgagcaatcagatgattataaggaaagtgtcctacctgcagctgtaactgcaagggttagcattgaagctgcatcaacatttggttggggcaaacttgttggaagcgaagggaaagctatagggattgacaagtttggagcaagtgctccagctggaaaaacatacaaggagtatggcattacgtcagaggcagttattgcagcagctaaagaacttatctagagcttcattactgaattccatttagaggctgtcagttctgcggaaacttatttttggattttggagtttggagtttgggttggagaatttacacctagtcattgttaaaagactcatcttgattcagtacctcttaagatttcacaataacaaagataaaattttcttttgttgcttttcattttcttcagcgccgcagctgaggctgcaaaataaatcgagatcaaaagagagattagatttcattaacgttcatgaatttgtataccaatacttgaacatggatcgacttttgtaattttatgtgttggattgttagtga

SEQ ID NO: 9112 - DNA, 2573 bp, Solanum lycopersicum
atccacaaaacatcatccaaattctatatctacctatttctcatcctcatctttattcattcattcattcaacacacacaaacagagccatggcttcttcatcttctctcactctttctcaagctattttctctccttctctccctcgccatggctcatcttcttcctcttctccttctatctctttctccactttttctggccttaaatccacccctttcacttcctctcaccgtcgtattcttccttccactaccgtcactaaacagcacttctctgttcgtgcatcctcagctgtagagactttagagaaaactgatgcagccattgttgaaaaatctgttaacaccattcgatttttggctattgatgctgttgaaaaagctaattccggtcatcccggtttacccatgggatgtgctccaatgggtcatatattgtatgatgaagtaatgaaatataaccccaagaatccttactggtttaatcgtgaccgatttgttctatctgctggtcatggttgtatgctgcaatatgcgcttcttcatcttgctggttacgactctgttcaggaagacgatttgaaaagtttccgtcaatggggaagcaaaattccgggtcaccctgagaattttgagacacctggtgttgaagtcactactggtcctctggggcaaggtattgccaatgctgttggattggctgttgccgagaagcacttggctgctcgattcaacaagcctgatgctgagattgttgaccactatacatatgttatacttggggatggttgtcagatggagggtatctcaaatgaagcttgttcccttgctggccattggggacttggaaagctgattgctttctatgacgataatcacatttccattgacggagacacagaaattgctttcactgaggatgtttctgctcgtttcgaggctctaggatggcacgtgatctgggtgaagaatggtaacacgggttatgatgagattcgtgcagctattaaggaagctaaagctgtcaaagacaaacctactatgatcaaggtaactacaacgattggttttggctctcctaacaaggcaaactcttacagtgtgcacggtagtgcacttggagcaaaggaagtcgaggcaactagaaataacctgggatggccttatgagcctttccatgtgcctgaagatgtgaagagccattggagccgtcatacaccggagggtgctgccctagaaactgaatggaatgctaagtttgctgaatatgagaagaagtatgcagaggaagctgcagatttgaaatccatcattactggtgaactacctgctggctgggagaaagctcttcctacttacactcccgagagcccagctgatgccacgagaaacttgtcacaacaaaaccttaatgctcttgccaaggttgtacctggtttccttggtggtagtgctgatcttgcttcatcaaacatgactcttttgaaaatgtttggtgacttccaaaagaacactccagaagagcgtaacttaaggtttggtgttcgtgaacatggtatgggagcgatatgtaatgggattgctctacacagccttggcttgatcccgtattgtgctactttctttgtgttcactgactacatgagaggagccatgagaatatcagccttgtctgaagctggagttatttatgttatgactcacgattcaattggtctaggagaagacggtccaactcatcaacccattgagcacttggctagtttccgtgccatgccaaacattctgatgttccgtccagcagatggtaatgagacagcaggagcttacaaggtggctgtccttaagaggaaaacaccatcaatccttgccctctctcggcaaaagttgccacaacttgcgggaacttctattgaaggagcagcaaagggtggctacattgtatcagacaattcttcaggcaacaaacctgatgtcattttgatcggtactggttccgagttggaaattgctgtcaaggctgctgaggaactaaagaaagaaggaaagacagtgagggttgtttcctttgtttgttgggagctttatgatgaacaatcagctgaatacaaggaaagtgtccttccatcatctgttacagctagagttagtattgaagctggatcaacattcgggtggcaaaaatttgttggcgataaaggaaaagctattggggttgacgggtttggtgctagtgctcctgctgataagatatacaaagagtttggtattacagcagaagctgttgtagctgcagctaaacaagtttcttaggcgatgtccattacaattcttgctggtctactctactgaatgagataatgaattgagacgacatcaaatggataataaatctaagattaggatagaaattaggcacattgatgtacctaaacttgtacactacatatgttgagtttgtaatttcattttggttcattggtaaagatgtcgctttcgccattagagtttcatgtgtctatggcaatgagattttttttcttcattttaatccatttggggcattcaaca

SEQ ID NO: 9113 - DNA, 2473 bp, Cyclamen graecum
ctctccctctctctgctcccccgccatggctccacccccaaaatctccatccccgccttctcgggcctcaaacccacctcccaatccgccacacgcgccgccctagatccctcacgcgcctccctagctcacccacgcgcggccccgaggaggttttggaccccacgcgcgtcggctgctgtcgaggcacttccgaaggcggggaccgagctggtggacaagtcggtcaacacgatccggttcctggcgatcgatgcagtggagaaggcgaattcggggcacccgggactgcccatggggtgcgccccgataggacatgtgttgtacgatgaggtgatgaggtataacccgaagaacccgtattggtttaacagggatcggttcgtgttgtcggccgggcacgggtgtatgctgcagtatgctttgcttcacctggctgggtatgacagtgttcaggaagaagacctaaaacaattccgtcagtggggaagcagaaccccaggtcaccccgagaactttgagacccctggtgtcgaagtcactactggtcctcttggtcagggtattgccaatgccgttgggttagcccttgctgagaagcatttggctgctcgctttaacaaacccggcagtgagattgttgaccattacacgtatgcgattttgggagatggttgtcagatggaaggcattgcaaacgaagtttgttcacttgctggtcactggggacttggaaagctcattgctttctatgacgacaaccacatctctattgatggtgatactgagattgcattcactgagagtgtggataaacgttttgagggtcttggttggcacgttatctgggtgaagaatggtaacacgggctatgatgagattcgtgctgcaatcaaggaagctaaatctgttacagacaagcccactttgatcaaggtaactacgaccatcggttttggttctcccaacaaagcaaactcatacagcgtccatggggctgcactcggtgccaaggaagttgatgccactaggcaaaaccttgggtggccatatgagccattccatgtgcccgaggatgtgaagaaacactggagccgccacacccccgagggtgctgctcttgaagctgaatggaatgccaaatttgccgagtatgagaagaaatatgctgaggaagctgcagaattaaaatctatcatcactggggaattgccggctggttgggtaaaggctctgccgacatacactccagagagccctgccgaggccaccagaaacctctctcagaccaacctcaatgccctagcaacagtccttcccggcttcctcggtggcagtgctgatctggcatcttccaacatgacccttctaaaaatgtttggagacttccaaaagaacaccccggaggagcgtaacatccgatttggtgtccgtgagcacgggatgggagccatctgtaatggtattgccctctacagccccggtctcattccatactgcgcgaccttctttgtattcaccgattacatgagagccgctattagaatctcagccttgagcgaagctggtgtcatatacgtaatgacccacgattctatcgggcttggagaggatggccccacccatcagcccatcgagcacattgccagcttccgtgcaatgcccaatgttctgatgctccgcccagctgatggaaatgagactgctggctcgtacaaggttgcggttctcaacaggaagaggccttcaatccttgccctttctcggcaaaagctgcccaatctgcccggaacttctatcgaaggagtggaaaaaggagggtatacaatctcagataattctacgggtaacaagcccgatgtcattttgatcggtactggttctgagcttgaaattgccgctaaggcagctgatgagctgagaaaggaaggaaaggctgtgagggttgtttcgtttgtatcgtgggagcttttcgacgagcaaacggatgagtataaggaaagtgttctgccagaggctgttacggctagggtcagtattgaagcagcttcgactttcgggtggcaaaaacttgttgggagcaaagggaaggcaattgggatagatcgatttggggcgagtgctccagctgggaaaatatacaaggagtttggtattacagccgaggctgtggtcgaagcagctaaagctctaatctaatagccgaatcggatttaaaacatctgcggtgaaaggccacagtgtagagtaacttcaacttatgaagacctcatatatttttcttaataaaaaggagataagtttctcatgttggatatttttcggaagctttttattccggtctttctcgacttctgccaggtgccgcgaatgttgaattagtgattgataacgaggttttaatcatttatgtaattttgagttctttttgttacttatttctcgggtttttctccgtactgatctcgaaagg

SEQ ID NO: 9114 - DNA, 2858 bp, Nicotiana benthamiana
gacacctacccacgtatctctcagagccacaaggagccaatccctaaataaatcctcaaaagtcattttaagaccactctttcctcattttctcctcccatatatcacctcctcttcactctcttttctctttaagacaaatcatcaaacatcttactggtaaagccatggcttcttcttcttcttctctcactctctctcaagctatcctctctcgttccgtccctcgccatggctctgcctcttcttctcaactttccccttcttctctcaccttttccggccttaaatccaatcccaatatcaccacctcccgccgccgtactcctccctccgccgccgtacggtctccggcgattcgtgcctcggcagcaactgaaaccatagagaaaactgagactgctcttgttgacaagtctgtaaacacgattcgatttttggctattgatgctgtcgaaaaggcaaattcgggtcaccccggtttgcccatgggttgtgctccgatgggtcatatattgtacgatgaggttatgaggtataacccaaaaaacccgtattggtttaatcgggatcggtttgttctatcagctggacatggttgtatgcttcagtatgctttgcttcatctagctggctatgatgctgtcaaggaagaggacttgaagagcttccgtcagtggggaagcaaaacccctggacaccctgaaaactttgagacacctggtgttgaagtcaccaccgggcctctgggacaaggtattgccaacgccgttggcttggcccttgcggagaaacacttggctgctcgtttcaataagcctgatgctgagattgtagaccactacacatatgttattcttggtgatggttgccagatggagggtatttcacaagaagcttgttcccttgctggacactggggacttggaaagctgattgctttctatgatgacaaccacatctcaattgatggtgacacagaaatcgctttcactgaggatgttggtgcccgttttgaggctcttgggtggcacgtaatctgggtgaagaacggtaacactggttatgatgagattcgtgctgctattaaggaagcaaaagctgtcacagacaaacccactatgatcaaggtgactacaaccattggttttggctcgcccaacaaggcaaacagttacagtgtacatggaagtgcacttggagctaaggaagtagaggccaccaggagtaacttgggatggccttatgagccgttccacgtgcctgaagatgtcaagagccattggagtcgtcatgttcccgagggtgctgctcttgaagctggatggaataccaagtttgctgaatatgagaagaagtacccagaggaagctgcagaactcaaatccattgtcactggtgaactacctgctggctgggagaaagctctgcctacctacacacctgaaagtccagcagatgccaccagaaacctgtcccaacaaaacctgaatgctcttgccaaggttctccctggtttccttggtggtagtgctgatcttgcctcatcaaacatgactctcttgaaaatgtttggtgacttccaaaagaacaccccagaggagcgtaatctgaggtttggtgttcgtgaacatggtatgggagctatatgtaatgggattgctctacacagccaaggcttgattccctactgtgctactttctttgtgttcactgactacatgagaggagccatgagaatttcagccttgtctgaggctggagttatttatgttatgacccacgattcaattggtctaggagaagatgggcctacccatcaacccattgagcacttggcaagtttccgtgcaatgcccaacattctgatgttccgtccagcagacggcaatgagacagcaggagcttacaagatggctgtcctcaagaggaagacaccatcaatccttgcactctctcgacaaaagttaccacaacttactggaagctctatggaaggagcagcaaagggtggatacattttatcagacaattcttctggcaacaaacctgatgtcattttgattggtactggctcagagttagaaattgctgtcaaggctgctgatgaactcaggaaagaaggaaagacagtgagagttgtttcctttgtttgttgggagcttttcgaagaacaatcagccgactacaaggaaagtgtccttccatcatctgttacagctagagttagcattgaagctggatccacatttgggtgggagaaatatgtcggatcaaaggggaaggccatcggaattgatagatggggtgccagtgcccctgctggaataatataccaggagtacggaattacagcagaggctgttgtagctgcagctaaacaagtttcttaggctttattacttacacttggttgctggtgtctaccaaatttgttttcagtttgacactgaggttggaggtgatggtggaaaccaataccaaacggactcggcagttcactgttgcctggtattttcaataaaaactatttcttcatctgccctttgttttcttcagttttagtagcggagcggccaaaatgaatccaagatgaggatagaaataggattatggatgctcctgaccatgtacactttaaaccatatctttgagttttgtaatttcatttggtcgagtgataccaagatcttattttcaattggaaattcatgtcttctgaaaagggctttctttgtctttactatggtcatcatcttgtagctatctgttccaaagcaaagtggacttgcataatcttttggcaacattgatgacaaagtctgcatggtgcacttaaaagtacaatgaaacctcta

SEQ ID NO: 9115 - DNA, 2561 bp, Epimedium sagittatum
tttacggtccggggggcacaagcacgaacactaaacccacccaaaaactaaccatggctgcttcgtcctctctcacagtctcgcaagccctcgtgggccgagccatagcccaccttacatccacatcccattccgaccgaactctcccttcccggtttcaccctatctggccgatctattaaatcctcctcttcccaagtctctcgcgccatcggatctcgtaaacgaactgtcatatcatcgtcaagatcatcttctgctatccgcgctgcggctgtagaaactcttgagaagacagagaccgtggttgataaatctgttaacactattcggtttcttgctgtcgacgctgttgagaaggccaattcagggcatcctggtttgcccatgggttgtgctccgattggtcatatattgtatgatgagatcatgaggtataaccccaagaacccttattggttcaacagggataggtttgttctttctgctggtcatggttgtatgcttcagtacgctcttcttcaccttgctggttacgacagtgttaaggaggaagatttgaaacaattccgtcaatggggtagcagaacacccggtcatcccgagaattttgagacacccggaattgaagtcactactggtcctcttggtcaaggtattgccaacgctgtaggattggccttagctgaaaagcatttggctgctcgtttcaataagcctgatgctgagattgtcgaccactatacatatgcaattgttggagatggttgtcaaatggaagggattgcaaatgaagcttgttcccttgctgggcattggggacttggaaagctgattgctttctatgatgacaaccacatctccattgatggtgacaccgagattgcattcactgagagcgttgatactcgatttgagggtctcgggtggcatgtaatttgggtgaagaacggaaacaccgggtatgatgaaatccgtgctgccatcaaggaagccaagaccgttacagacaagcccactttgattaaggtgacgacaaccattggttacggatcaccaaacaaagcaaactcctacagcgtacacggagctgctttgggtgccaaggaagtagatgcaacaaggcagaaccttggttggccatatgatccattcttcgtgcccgaggatgttaagaagcactggagccgtcataccccagaaggtgcttctcttgaggctgaatggaatgccaaattcgcagaatatgaaaagaaatacagtgaggaagctgccgagttgaagtctattattactggtgaactccctgccggctgggagaaggctcttcccaaatatactccagagacccctgcagaggccactaggaatctgtctcagacaatgttgaatgcacttgcacccgtgcttcctggacttatcggtggtagtgcagatcttgcttcttccaacatgaccttgctgaagatgtatggagacttccaaaagagcaccccagaggagcgaaatgtccgttttggtgttagggagcatgccatgggagccatttgcaacgggattgccctccacgcacctgggcttatcccatattgtgccactttctttgttttcactgattacatgagggctgctatgcgaatctcagccttgtgtgaggctggagttatctatgtaatgacccatgactccattggccttggagaggatggtccaacccatcaacccattgagcacttggcaagcttcagggcaatgcccaacattctgatgctccgtccagctgatggaaatgagaccgctggagcatacaaggttgcagtcgacaacaggaaaagaccctcggtccttgccctttctcgtcaaaagctttctaacctccctggaacatccatcgaaggagtcgagaagggagggtataccatcacagacaactcaaccggtaacaagcctgatgtcatcttgatctctaccggttctgaactagagattgctgccaaggctggagatgcactgaggaaggacggactagcagtcagggttgtctcctttgtttcgtgggagttgtttgatgatcagtcagatgaatacaaggagagcgtgttgccgtcagccgtcactgccagagtaagtattgaggcaggttcaacattcgggtgggctaaaattgttggtagcaaaggaaagtcaatcggtatcgatcattttggagccagtgccccagcaggaataatctacaaggaattcggtattacagcagaggctgtgattgcagcagcgaaatcacttctttaggcgtatttagatcttgtgttatttattcaacttctgcacttttggcaatttgagttttggaatcgtgtgctcttccaagtacgttaaaaatacggtggtgtagaggcaaagtttttaagagaaattgagttagaaacattatgtctctgtggtcataataaagaaaagagaaagttggttcttccctttttttcttgtgtgtgtgttcgttagtttggaacagctgaatcataattctccgatgaaattccaagttctctgtttatacg

SEQ ID NO: 9116 - DNA, 3083 bp, Mesembryanthemum crystallinum
cactacctagtgctgagcgatcggcacgactgaagaaattttcctcaagctttcaacaatggcggcttcatcttctctcactctctctcatcagtctctcctctctcactccctcccccaccccaaatcctccgctgccgtcgccgctgcctccctcttgatccccacttcttccaccaacccctccgctaagctcctcctcaagtccacctccaggaggcggcgcgtggcctcacgcgcctccgtagtaaaggcggcggtagcggaaactcttgaaaagaccgacagtgagctggtggagaagtcggtgaacacgattaggtttttggcgatcgatgcggtggagaaggcgaattcgggtcacccgggtttgcccatgggttgtgctccgatgggtcatatattgtacgatgaggtgatgcggtacaacccgaagaacccgtattggtttaacagggaccggtttgtgctatcggccggacatggttgtatgcttcagtatgccctgcttcaccttgctggttacgacagtgttctggaagatgacttgaagtctttccgccaatggggaagcaggagccctggtcaccccgagaactttgagacacccgggattgaagtcaccaccggaccacttggtcagggtattgccaacgctgtaggtttggctcttgcagagaagcatttggctgctagatacaacaagcctgatgcagaaattgtcgatcattacacatactgtatccttggagacggttgccaaatggaaggaatttcaaacgaagcttgttcccttgctggtcactggggactagggaaactaattgccttctatgatgacaaccacatttccattgatggtgacactgccattgccttcaccgagaatgttgatcagcggtttgaggccctcggctggcacattatctgggtcaagaatggtaacactgggtatgatgagatccgtgctgccatcaaggaagccaaggcagtcacagacaagcctactttgatcaaggttaccactacaattggttttggatcgcctaacaaggccaactcatacagtgttcacggagctgcattgggtgccaaggaagtcgatgctacaaggcagaatcttggttggccatatgagccattccacgttcctgaggaagtaaagagccattggagccgccatactcctgaaggagctgcccttgaagctgaatggaacgccaagtttgcagagtacgagaagaagtacgctgcagaagcagcagagttgaagtccatcattactggtgaattacctgctgggtgggagaaagcacttcctacttacacacctgaggtcccagctgatgcaaccagaaacctatctcaaacgtgcctaaatgcccttgcaaacgttcttcccggacttattggtggtagtgcagatctcgcttcctccaacatgaccttgatgaaaatgttcggagacttccaaaaggaaacacctgaagaaagaaatgtccgttttggtgttagggaacatggaatgggagccatctgcaatggcattgccctacacagcccaggttttgtcccctactgtgccaccttctttgtcttcacagattacatgagaggagcgatgagaatctccgccttgtcagaggctggagtgatctacgtgatgacccacgactcaattgggcttggagaggatggaccaacccatcagcccatcgagcacctagccagtttccgtgccatgcccaacatttttatgctccgaccagcagatgggaacgagacagctggagcatacaaggtagcagtcgaaaacagaaagaccccatccatcctagctctgtctaggcaaaagctacccaacttgccaggaacttccattgaaggagttgagaaaggagggtacattatctctgacaactcttcaggtaacaaacctgatgtgattcttgctggaactggttctgagctagaaattgctgccaaagccggtgatgagctcaggaaagaaggcaaaactgttagggtcgtgtccttagtgtcatgggagttgtatgagaagcaatccgatgaatacaaggagagcgtcttcccagctgctgttacagccagggtaagtatcgaggctgcatcaacattcggatgggggaagttcgttggttccaaggggaaagccattggtattgacaaatttggagctagtgcaccagctggaaagatatacaaggagtatggaattacagttgaggcagttattgaagcggccaaatctctcttttaaggtttcatttttgcctctcatctttaatttttcgcgttaacttgtgatacttgagtagacatgctcagatcagaggtgggacgaacaaaggttagctcttgagatgagtgtagtggagtcggaggcctaatgtgttatggtaagaaatgaatctttacttactgtaaaggaaaagcaaacactcagttccttctttttgcagtgtccatttcctttctgttgattaagatgagaactccttaggccttcttatggtgaatgtttgtttatttgtaatcaaaagtcccctctgtgtactgttcatattctcttgctgaaaaattaataatgacagtaagtcaatgaggctgatttgtaaagaacatctcctctttctctctcctccctttcccttcttggggggtgcccgttacccaatatcgtcctattgagggtttaattaacacgcttctactgtactgtttttttaacacttttgagattggaataaaccatgggtttcccaaattttttctttctttgcattcaatacccctttcgctagttttgtttataataataatattctactactctttctcttctttcaaaaattattcacaactctttcgtgctatggtacctcctcttgtatcgcatattaatattctcttattatttaaagattattcctctcatgtattttatctcttcaattatatcatctttacctaacatccctttgtttatctttatcttatttactttctactattctggttatcttcattcctctcttagttattattgtgcgcccgtctct

SEQ ID NO: 9117 - DNA, 2572 bp, Amaranthus tuberculatus
tgatgatgatgattttgatctgatggttgaggaagcacgacagatagatcatcaaaagagaagttggtcatactggtagtcctctttatagggtagcgccgcctctttcccagcatcatcttggatcctcactttctctctctaagatcatctcagctccctcatctcgcaacccatcaactccaacccacaaattttcttcatctacttctctcttatattcttcttcttcttcactttataaaccctctcatttctctcttaaatcatcttctcgcgcatcaccacgcactgcagtaatcgcatcagctgtggaatctctcgataaatccgccactgaagatgtcactttgatcgaaaaatctgtgaatacaatcagattcttggcgatcgatgctgtcgaaaaggcaaactccggtcacccgggtttacccatgggttgtgctcccatgggtcacattttgtatgatgaagctatgcgatataaccctaaaaatccttattggtttaacagggatcgttttgttttgtctgcgggtcatggatgtatgcttcaatatgcacttcttcatttggctggttatgacagtgtcactgaagaagatctgaagaactttcgccagtgggaaagtaggactcctggtcatcctgagaattttgaaactcctggagttgaagtcactactggcccccttggtcagggtattgccaatgctgttgggttggctcttgcagagaagcacttggctgctcgatttaataagccagataatgagatcgttgatcactacacgtatgctattcttggtgatggttgtcaaatggaaggtgtttcccaagaagcttgctcactcgcaggacattggggacttggaaagctcattgcattttatgacgataaccatatttctattgacggtagcactgatatcgcattcactgaagatgttgacaagcgttttgaagctcttgggtggcacgtaatatgggtgaagaatggtaacactggctacgatgagattcgtgctgcgattaaagaagctaaggcggtcaaggacaaaccaaccttaattaaggtgacgacgaccattggttatggttcccccaacaaatcaaattcttacagtgttcatggaagtgctttgggagctaaagaagtggaagcgacgaggagcaatctcggatggccatatgagccattccatgtacctgaagatgttaagaaacattggagccgtcacacccctgagggagctgctcttgaagcagaatggaatgccaagtttgccgaatatgaaaagaagtaccaggaggaagctgcagaattgaagtccatcattactggcgaattaccttctgattgggagaaagcacttccgacctataccccagagagccctgctgatgctaccagaaacctatctcaacaatgcctgaacgctcttgccaaagttcttccaggtttccttggtggtagtgctgaccttgcttcctcaaacatgacattgctgaagatgttcggaaattttcagaaagatactcctgaggaaaggaacttgcgatttggtgttagagagcacggaatgggatcgatttgcaatggcattgccctccacagccctggcttcatcccctattgtgcaactttctttgtttttactgactacatgagagcttctataaggatggctgccttgtcccaggctggggtcatctttgtcatgacccacgactctattgggcttggagaagacggaccaactcatcagcccatagagcatttggcaagtttccgggccatgccaaatgtgttgatgcttcgtccagcagatggaacagagacagctggggcttacagaattgcagtgttgaagaggaaaacaccttctattcttgccctttcacgtcaaaagcttccacagcttcccggaacttctgttgaaggggttgagaagggtggttacatcatttctgacaactcatcagggaacaaaccagatgttattttgatgggaactggttctgaactagagattgctgcaaaagctgcagatgatcttagaaaggaaggaaaggctgttagagttgtgtcgttcgtttcatgggagctgtttgaatctcaaccagagtcctataaagagagtgttttgccagctgatgtaagtgctagagtgagcattgaagctggatcgacattcggatggttgaaatatgtgggaagtaagggcaaggcaattggcattgataggtttggtgcgagtgcccctgctggaaagatctataaggagcttggaatcacaaaagaggcagtgattgaagcagctaaatcactttggtagacattctcaacctccatggtttatcaagtctctgtatcctacttttttttttattgtgtttcccatacattttttcgtagtaatttaagaagagaggggaaatatcagaataagaggggtttgtatgagtttcatgtgtagcaagtagcaaccggcagacgatggcagaggacagaggcgtatagaattgagtttggggtcataaggagtcctgagttttagatgtatttgat

SEQ ID NO: 9118 - DNA, 2448 bp, Daucus carota
tctcccaatctctctccctctcccgatctctcccagccatttctcagcacccacatcgaatctctctccccaccgtcaatctctccgcagcctctctcaaatgttcgaggcgcgtgggctcacgcgccgccgcagtgcgggcgtcggcggcggtggacgtggcggagaagacggagacggggttggtggagaagtcagtgaacacgattaggttcctggcgattgatgcggtggagaaggcgaattcgggtcatccgggtctgcccatgggttgtgcacccatgggtcatatactgtacgatgagatcatgaaatataatccgaagaacccgttttggtttaatagggataggtttgttttgtctgctggacatgggtgtatgttgcagtatgctcttcttcacttagctggttatgacagtgttaaggaagaagacctgaaaagtttccggcagtggggaagcaaaacacctggtcaccctgaaaactttgagactccgggaattgaagtcactactggtccccttggccagggtgttgcaaatgcagttggtttagcccttgcagagaagcatttggctgcacgatttaacaaacctggcagcgaaattgttgatcactacacgtacgtgatacttggagatggttgtcaaatggaaggaatttctaatgaagcttgctctcttgctagtcattggggacttggaaagctgattgcattttatgatgacaaccatatttcaattgacggtgacacagctattgcattcactgaatctgttgataagcgctttgaaggtcttggttggcatgtcatatgggtaaagaatggtaacactggatatgatgagatccgtgctgctatagaggaagctaaagctgttacagacaaacctactttgattaaggtcacgaccacaattggttttgggtcacctaacaaggccaactcatatagtgtacatggtagtgcattgggtgccaaagaagttgatgcaacaaggaagaaccttgggtggccacacgagccattccatgtgccagaggatgttaaaaagcactggagccgccatacccctgaaggtgctgctttggaagctgaatggaatgccaaatttgcagattatgagaagaaatacaaagaagaagcacaagaactgaaatctcttattagtggtgaacttccagttggttgggaaaaggctcttccgacttataccccagaaaccccaggggattccactcgtaatctttctcaggcaaacctgaatgctcttgcaaaagttcttcctggacttttaggggggagtgcagaccttgcttcttccaacatgacactgctgaaaatgttcggcgactttcaaaaggacacccccgaggaacgtaatgtacgatttggtgttagggaacatggaatgggtgctatatgtaatggaattgcactccacagtcctggcctcatcccctactgtgctaccttctttgttttcacggactatatgcgagcagccatgaggctttctgcactctgtgaagctggggtcatctatgtgatgactcatgattccatcgggcttggagaggatggtccaactcatcaacctattgagcatatagcaagtttccgcgccatgccaaacatcctgatgctccgaccagctgacgggaacgagactgctggtgcatataaggttgcagttctcaacagaaagaggccttcagttctagccctctcacgtcaaaagcttcccaatctccctggaacatctattgaaggagtcgagaaaggtgggtatattattactgataactcttcaggtaacaagcctgatattatcttgattggaactggttccgaacttgaaatcgctgcaaaagcagctgatgagctgaggaagagcggaaagacagttcgggtggtatcattcgtatcttgggagttgtttgacgaacaatctgctgcatacaaagaaagtgttctgccagctgatgtatcagctagggtcagcatagaggctggaacgacctttgggtgggagaagattgtgggatccaagggaaaggcgattggaatagatcattttggcgcaagtgcaccagcagataagatatacaaagaattcggattaactgtggaagctgtgattgcagcagccaaggaattgtgttaaagccagtgatagtcgtagtgctgctactagtactttcttctcagtttgttttttatccctgattcttcagggagcttctgctgcacaatcaggttcaagacgggtgtatcttcataccgagaatgtagttttatgagtatctttgacaatttaaaaattaatttgccatagatttgcagttttgcagactctgttgtgattttaagcttctgtagtatgttttgtaatgtgacattactctatgataatgaaaagggatatattccgctataaaaag

SEQ ID NO: 9119 - DNA, 2508 bp, Eschscholzia californica
cgcctcttcatctctatcagtttcacaagccctacttgcccggaaaattaccaacctcatcggatcaacttccaactccgatcgtctctctcttcctggattcaatctaagcactctttctggtcgaacccttaaatcatcaacttcatctaagatctcttctgttcccagatctcgtaaaaataccatctctcgatcttctattcgtgcttcagttgttgaaacagtagagaaagctgatacagctttgattgacaaatcggttaatacgatccgatttctttcaattgatgctgttgaaaaagctaattccggtcacccaggtttacctatgggttgtgctccaatgggtcatatcttgtatgatgagatcatgagatataaccctaaaaacccttactggtttaatcgtgatagatttgttctttcagctggacatgggtgtatgttgcattatgctttacttcatcttgctggttatgacagtgtcaaggaagaagatttgaagaatttccgtcagtggggaagcaaaactcctggtcatcctgagaactttgaaactcctggtattgaagtcaccacaggtccacttggacaaggtattgctaatgctgttgggttagccctcgcggagaagcacttggctgcccgtttcaacaagcccgatagtgaagtcgtcgatcattacacatattgtattctcggagatggatgtcaaatggaaggggttgcgaatgaagcttgttcccttgctggacattggggacttggaaagctgattgctttctatgatgacaaccacatctccattgacggtgatacagagattgctttcactgagagcgttgacacccgttttgaagctcttgggtggcatgttatttgggtcaagaatggcaacactgggtatgatgaaatccgtgctgctattagggaagctaaggccgtcacagacaagcccactttgatcaaggtaaccaccaccattgggtacgggtcaccaaacaaggcaaactcatacagtgttcatgggagtgcattgggtactaaagaagttgatgccacaaggcagaaccttggctggccatttgagcccttccacgttccagaggatgttaagaaacactggtcccgtcatgagtctgttggtgcttcccttgaaaccgagtggaataccaagttcgcagaatatgaaaagaagtacaaggaagaagcagcagagttgaagacctttattactggtgaattccctgcaggttgggaaaaggctcttccggcttatactccagaaatccctggtgatgcaaccagaaacctatctcaaacttgcttaaacgcacttgccaaggtgcttcctggtcttgttggtggaagtgctgatcttgcttcatccaacatgaccttgatgaaaatgttcgggaacttccaaaaagacaccccagcagagagaaacattcgatttggtgtcagagagcacggaatgggtgctatctgcaatggaattgttcaccatagccctggtttcatcccatactgtgcaaccttctttgtcttcaccgattacatgagaggtgctatgagaatctcagctttatcagaagctggagttatttacgtaatgacccatgactctattgggcttggagaggatggcccaacccatcaacccatcgagcatttggcaagctttagggcaatgcccaatattctcatgctccgcccagctgacggaaacgaaactgctggggcttacaaggttgctgttgttaataggaagcgaccttcagttcttgccctttcacgtcagaagcttccaaatcttccaggaacttccattgaaggtgtagagaaaggaggatacacgatatctgacaactctactggaaacaaaccagacgtgattttgatcggtactggttcagaattggaaatcgcagccaaggctgccgatgaactaaggaaggaaggaaagacagttcgagttgtttcctttgtttcttgggaattgtttgatgaacaatcggatgaatacaaggagagtgttcttccagctgcagtcactgctagagttagtatagaagcaggatcaacgttcgggtgggagaagattgtaggaagcaagggaaaagcaatcggaatcgacacgttcggagcaagtgcacctgcaggaaagatatacaaggagtacggtattacatcagaagccgttattgctgcagctaaatcgatctcttagacatgtttattagtgagtttttccgttcgatttcaatcttctgcatgtttgtcatttgggttttggatttcttctgttccaagtttgaaatgacagcagaagtgaggcctatattatgagtgttttaagtgagaaactagcctcttccaattaaaataaaaggcaaaaccgagtattttgtttcatttagaacagcctgtatctccgtatctaaattagcgtttgaatagaatttcataaacacagtaatgtgtatttctttgtaaaaaaaa

SEQ ID NO: 9120 - DNA, 2780 bp, Eutrema parvulum
taaaaattgcggaaggcatagaggatcactaaactcttagcctcaatcagcggtcacgatgataccctttgataggattcaacggtcagatttgatcttacttgtcccttagtgaagacgaagagatggcgaaattttgtttgattggctaaaaatcatctctcactcataaaataagttgcagagagtctcttcttcatttctccaccattagcttccttctctctacaccaaagagagcaaaaaaatcaaatctatggcttcaacttcctccctcgctctctctcaagctctccttgctcgtgccatctctcaccatggctctgaccagcgtgtctccttaccagctttctctgggctcaaatccaccgcctcacgcgcctccgcttcgtctcgtcgacggagcgccacatccatgagcaaaatccgctctccctgccctctcgtacgcgccgcagctgtggagacgatggagccgaccaccgattcgtctattgtggacaaatcggtcaacacgatcaggtttttggccatcgatgctgtggagaaggcgaattctggtcatcctgggcttcctatgggttgtgccccgatggctcacattttgtacgatgaggttatgaggtataacccgaagaacccttactggttcaaccgtgaccgattcgttctatctgctgggcatggttgtatgttgctttactcgttgcttcatctcgccggctacgacagcgtcttggaggaggatttgaagagcttccgtcaatggggaagcaagacaccaggacatcctgagaatttcgagactcctggaattgaagtcactactggtcctcttggacaaggaattgcgaatgctgttggtttggctcttgctgagaagcatttggctgctaggttcaacaaacccgatgctgaagttgtcgaccactacacgtatgtgatcctcggagatggttgtcagatggagggtatttcaaatgaagctgcctctctagctggccactggggacttggaaagctcatcgctttctacgatgacaatcacatttccattgatggagacactgaaattgcctttactgagaacgtggaccagcgtttcgaagcccttggatggcatgttatctgggtgaagaatggaaacactgggtatgacgagatccgtgctgccattaaggaagctaaaactgttacagacaagcctacattgattaaggtcactactacaattggttatggatctcccaacaaggcgaactcatacagtgtccatggagctgcacttggtgagaaggaagttgaggctacgagaaacaaccttggatggccgtatgagccattccaggtacctgaggaagttaaaagccactggagccgtcatacgcctgaaggcactgcccttgaatctgactggaatgcaacgtttgcagcgtatgaaaagaagtacccagaggaagctgcggagttgaaatctattatctctggtgaattacctgctggctgggagaaggcattaccaacatacacaccagagtctccagctgatgccaccagaaacctgtcgcagcaatgtcttaacgcgctcgctaaagttgttcccggtttccttggtgggagtgctgaccttgcatcctccaacatgactttgctaaaagcgtttggtgacttccaaaaggccacacctgaagaaagaaatcttaggtttggtgttagggagcacggaatgggagccatcagtaacggtatttgccttcacagccccggtcttatcccttactgcgcaactttctttgtgttcactgactacatgagaggtgccatgagaatctcagctttgtctgaagctggtgttatctatgttatgacccatgactccattggtcttggagaagatggaccaacccatcagccgattgagcacatcgccagtttccgtgcaatgcccaacactcttatgttccgtcctgctgatggaaacgaaacagccggtgcgtacaagatcgctgtcaccaagcgcaagacaccatctatcttagctctgtctaggcaaaagcttcctcaacttccaggtacatccattgaaggagtcgaaaagggtggatacacaatttctgacaactcatcaggaaacaaacccgatgtcatcttgattggaactggatctgagctagagattgctgcacaggctgcagaggtgcttaagaaagaaggcaaaaccgttagagttgtttctttcgtctgctgggagctctttgacgagcaatcagatgaatacaaggaaagtgttttgccatctgatgtatcagctagagtaagtatcgaagcaggttcgactttcggatggggaaagcttgttggaagcaaaggaaagtccattggtgttaattcgttcggggccagcgcaccagctcccttactctacaaggagtttggtatcaccgcggaagctgttgttgatgcggcgaagtcactcttttaagagacttaaagatcagaccatcctctctgtagggtttgtctgaacttgatttggaagcaaagctattcgcaacattgtctcatatctcaaaataaagtgcaaaaagacgcaaagacattcgcttctttttttttttggttcttgtaattcgggtcaacataggttttgggtttgggaagagaacgaagtagaagacaatgtaaaactctcatgatcatccgtttgttgttaaatgcttgaatttcagcaaactttcccgttatttctttgtagtgtaacgacaaaaatgacctaccta

SEQ ID NO: 9121 - DNA, 2638 bp, Amaranthus tuberculatus
cttcttcattcaaatttcttgatcaagaagatcagatagagagagaaagcttgccattcttcaaacccttcaacaatggcggcttcttcctcactcactctatctcatcatcaaactatcttatcacacccaaaaacccacctccccaactcatccacatcctccatattagtccctacaacttcctccaaggtcaatggaatactccttaaggcaactaactcaagaagacggcgcgtgggatcacgtgtaactgttgtgaaggctgcagccgtagaaactcttgaatcaacgggtacagaacaagtggttgagaagtctataaatacgattaggtttttggctattgatgctgttgagaaggctaattcgggtcatccgggtttacccatgggttgtgcaccaatgggtcatatattgtatgatgaggttatgaggtataacccgaagaacccgtattggtttaaccgtgaccgttttgttctatctgctggtcatggttgtatgcttcaatatgctcttcttcatcttgctggatatgacagtgtcttggaagaagacttgaagactttccgacaatggggaagcaaaattcctggtcacccagaaaattttgagactcctggagttgaagttacaactgggccactcggtcaaggtattgccaatgcagttggtttggctcttgctgagaagcatttagctgctcgattcaacaaacctgatgctgaaatcgttgaccattacacgtactgtatacttggtgatggttgccaaatggaagggatagctcaggaagcttgttcacttgctggacattgggggcttggaaaattaattgctctatatgacgataaccacatttctattgatggtgatactgccattgccttcactgagagtgttgacacgcggtttgaggcccttggctggcatgttatctgggtcaagaatggtaacacagggtacgatgaaatccgtgctgctatcaaggaagctcaggccgtcaaagacaaacccactttgattaaggttacaacaaccattggttttggttctcctaacaagtcaaattcatacagtgtgcatggaagcgcattaggtgctaaggaagtagaggctacaaggcagaatcttggttggccttacgagccattctatgttccagatgaagttaaaaagcactggagccgccatactcctgaaggagcttccttggaagcggagtggaatgccaagtttgcagagtatgagaagaagtaccctgcagaagcaacagagttgaagtctatcattactggtgaattgcctgctggttgggagaaggcacttcctacatacacacctgaaatcccaggtgatgcaaccagaaacctatcacaacaatgcttaaatgcccttgcaaaggttcttccaggactcattggtggcagtgctgatcttgcatcttcaaacatgaccttactcaaaatgtttggagatttccaaaaggacacacccgaggaaagaaatgttcgttttggtgtcagggaacacggaatgggagccatttgtaatggtattgcccttcacagtccagggttcatcccttattgtgctaccttctttgtgttcactgactacatgagaggagcaatgagaatctcagctttgtcagaagctggagtcatctatgttatgacccacgattctattggtctcggagaagatgggcctactcaccagcccatcgagcacttggcaagtttccgtgccatgcccaacatcctaatgctccgtccagctgatggaaacgagactgctggtgcatacaaggttgccgttgaacaaagaaagacaccatctattctcgctctttctagacaaaagcttccaaatctgcctggaacatccattgaaggtgttgagaaaggagggtacaccataacagacaattcgtcgggcaacaagcctgatgttattctgattggaactggttctgaactggaaattgctgctaaagctggagatgagctaagaaaagaaggaaaagctgtcagagttgtatcgtttgtatcttgggagttgtttgatcaacaatctgatgaatacaaggagagtgttcttccttcagatgtaactgcgagagtaagcattgaggctggatcaactttcggatgggagaaaatcgttggcgcaaaaggaaaggccattggtattgacaagtttggagcaagtgcacctgcaggaacgatttacaaggagtatggcattactgttgaagctgttattgaagctgcaaattcattttcttaggttttgtcatcgaggattctttttgcttcatgttttgcatttttgttgagtggacaaggctcatagtgagttaatggcctactgtgctgcgctaagaaacataaacactgtaatgaaagtaaatttatatatgtcaatggataaacttccaaggccttcttacagtattaatgtgtaacatctcggaaaaactcggatcgtttcgaaagagaatttgatccttataactaaatttgggtaggatccaagttaaatcatgatgtcataaaggcaagataaacaaatttttataataaaccttgcagatcgagttctactagagttattataaactactcggcga

SEQ ID NO: 9122 - DNA, 2646 bp, Arabidopsis lyrata
gtttgattggctaaaaatcatcttgctcataaaataagagttgcagagagtctctcatcttcttcatttcttcaccatcatcacacacaccttcttcttcttcttctctctctctctctctatcacaagagagcgaaaaaaacgatggcttctacttcttccctcgctctctctcaagctctcctagctcgtgcaatctctcaccatgggtctgaccaacgtggatctttaccagctttctctggactcaaatccactggctcacgcgcctctgcttcgtctcgtcgacgtatcgctcaatccatgaacaagaaccgctctctccgtcctcttgttcgcgctgcagctgttgagactgttgagccaaccactgattcgtcgattgtggacaaatcggtcaactcgattaggtttttggctatcgatgcggtggagaaggcgaattcaggtcatcctggtcttcctatgggttgtgctccgatggctcacattttgtatgatgaggtcatgaggtataaccccaagaacccttattggttcaaccgtgaccgattcgttctatctgctggacatggatgtatgttgctctacgcgttgcttcatcttgccggctacgacagtgtccaggaggaagatttgaagcagttccgtcaattgggaagcaagacaccaggacatcctgagaatttcgagactcctggaattgaagtcactactggtcctcttggacaaggaatcgctaatgctgttggtttagctcttgctgagaagcatttggctgctagattcaacaaacctgatgctgaagttgtcgaccactacacatatgcgatccttggagatggttgtcagatggagggtatttctaatgaagcttgctctctagctggccattggggactcggaaagctcattgctttctacgatgacaatcacatttccattgatggagacacagaaattgccttcactgagaacgtggaccagcgtttcgaagcccttggatggcatgttatctgggtgaagaatggaaacactgggtatgacgagatccgtgctgccattaaggaagctaaagctgttacagacaagcctacattgatcaaggtcactactaccattggttatgggtctcccaacaaggcaaactcatacagtgtccatggagctgcacttggcgagaaggaagttgaggctaccagaaataaccttggatggccgtatgagccgttccaggtacctgacgatgttaaaagccactggagtcgtcatacacctgaaggagctactcttgaatctgactggagtgcaaagtttgcagcatatgaaaagaagtacccagaggaagctgctgagttgaaatctattatcacgggtgaattacctgctggctgggagaaggctctacctacatacacaccagagtctccaggtgatgccaccagaaacctgtcacagcaatgtcttaacgcccttgctaaagttattcccggtttccttggtggaagtgctgaccttgcatcatccaacatgacattgctgaaagcctttggcgacttccaaaaggccacacctgaagaaagaaatcttaggtttggtgttagggagcacggaatgggagccatcagcaacggcattgcccttcacagccctggtcttatcccttattgtgcgactttctttgtcttcactgactacatgagaggtgccatgagaatctcggctttgtctgaagctggtgttatctatgttatgacccatgactctattggtcttggtgaggatggaccaacccatcagcccattgagcacattgcaagtttccgtgctatgcccaacactcttatgttccgtcctgctgatggaaacgaaacagccggtgcatacaagatcgctgtcaccaaacgaaagaccccatctatcttagctctgtctaggcaaaagctgcctcagcttccaggtacatccattgaaggagtcgaaaagggtggatatacaatttctgacgactcttcaggcaacaaacccgatgtgatcttgattggaactggatctgagctagagattgctgcacaggctgcagaggtgctgaggaaagaaggcaaaaccgttagagttgtttctttcgtgtgctgggaactatttgacgagcagtcagatgaatacaaggagagtgtgttgccatctgatgtatcagctagagtcagtatcgaagcagcttcgactttcggatggggaaagattgttggaggcaaaggaaagtccattggtattaattcattcggggccagcgcaccagcacccttactctacaaggagttcggtatcaccgttgaagctgttgttgatgcggccaagtcattcttctaagagatttaagatcggaccatcctctctgtggggttttgtctgaaacttgatttggaaacaaaggctattcacaacattgtctcatatctcgaaataaagtgcaacaagacacaaagactttcaccttttttttgtttttttgtttattgtacttcaggtcaacataggttttgggtttgagaagagaaacaaattagaaagacaatgtaaaactcccatgatcattcgtgtaatgtcaaatgcttgaatttcagcaaaactttctagcaattgttt

SEQ ID NO: 9123 - DNA, 2323 bp, Cucumis melo
agtggttcgagcttcagtcgccgagacgctggataaaaccatgagacttcgttgattgagaagtctgtcaatacgatccgtttcctctcgattgatgctgtggagaaggcgaattcgggtcacccgggattgcctatgggttgtgctccgatgggtcatgttttgtacgatgaggttatgaggtataatcccaagaatccttactggtttaatcgggatcggttcgtcttgtcagctggccatggctgcatgttgcagtacgctttgcttcaccttgctggatatgatagtgttaaggaagaggacttaaagaatttccgtcaatgggaaagcagaactcctgggcatcccgagaacttcgagacacctggaattgaagtaacaactggtcctcttggtcagggtgttgcaaatgctgttggtttggcacttgctgagaagcatttagccgctcgcttcaacaaaccagataacgaaattgttgaccattacacgtatgttatactgggagatgggtgccaaatggagggaattgccaacgaagcttgttctcttgctgggcactggggactaggaaagctaattgctttctacgatgacaaccacatctcaattgatggtgacacagagattgcattcactgagagtgttgacaaacgattcgatgctctagggtggcatgtcatctgggtgaaaaatggaaataatggttatgatgagattcgcgctgccattagggaagcgaaagctgtaaaagacaaacccactttgatcaaggtgacaacaactattggttacggatctccaaacaaggcaaattcctacagcgtacatggtagtgcactaggtgcgaaggaagttgatgccacaagacagaaccttggatggccatacgagcctttccatgtgcccgaggatgttaaaaagcactggagtcgtcacactcctcaaggagctgctcttgaagccgaatggaacgctaagtttgccgaatatgagaagaaatatgcagaggaagctgctgaactgaagtctattattagtggcaaactacctgctggttgggaaaaagcattgccaacatacaccccagagagcccagcagatgctacaagaaatctttcccaacaaaaccttaatgcccttgcaaaggttcttcctggtttccttggtggaagtgcggaccttgcttcatcaaacatgaccctgcttaaatcatttggaaacttccaaaaggatactcctgaagagcgtaatctccgatttggtgttagagagcacgggatgggagccatctgcaatggaattgcccttcacagtcctggactcattccttattgtgctacgttctttgttttcaccgactacatgagagctgccattaggatatctgccttaagtcaagctggtgtaatctatgtcatgactcacgattcaatcggtcttggtgaagatgggccgacccatcagccaattgaacatctggcaagctttagggctatgccaaacatattgatgctccgaccagctgatggtaatgagaccgcaggggcatataaagttgcagtacttaaccgaaagagaccttccattcttgccctttctcgacaaaagttgccaaatcttcctggaacttccattgagggagttgaaaagggtggatacattctctcagacaattcctcaggcaacaagcctgatgttatcttgattggaaccggttctgaacttgaaattgctgccaaagctgcagaagaactaagaaaggaaggaaaggccgttcgacttgtttccttcgtctcctgggagctcttcaacgagcaatcagatgcatataaggaaagtgttctgccggctgctgtttctgccagagtgagtattgaggctggaacaacatttgggtgggagaagattgttggaagcaaaggaaaagcaatcggcattgaccgcttcggagcaagtgctccagcagggaaaatttacaaagagttcggtataaccgtggaagctgttattgccgctgccaaacaagttatttagaacaggttagttgtaattcgcggaaacgtatccaacagctacaatttgtttgaatttgggcgggaatttctgtagagaccacttccaagaggttccgttctaatgacatgatctcttatgttgcaataaaaaggtctgagtattctgtccattgtgtgtctatgtctatgtttttctgtgaagaggcattgtttgacgacgatagaaactaggatttctctgtttcttaagaaacaaactcccaacttttttgaacttttgttcttttaagtaatgagcttca

SEQ ID NO: 9124 - DNA, 2837 bp, Lactuca sativa
aagaaatccaaaaatccaaaggtgccaacaacttgaggcattcatttcctaccctcactcaacggctatcatttctcctccaaatcaatccaacggtctccctttcccctattcatctcaaccacccctctccaatcttcttctctctctcaaatttcatccgaatctaaaactgataaaacccccctatcaactgtataataacaacaatcactcctcctcgttctctctactttctctctctacaaagagccatggccgcctctacctcacttactctatctcaagccgctctctcccgttccgccgttccccgccatggctcttccacgactgccacccaacaatccacttccttggccaccctctcaatacccactttctctggactcaaatccacctccacatcatcttcacgcgcccccactcgccgtcaggtatcctccacgcgccgccgtgtgattgccaacgcagccgtggagacccttgagaagacggataccgcgctggtggataagtccgtcaacaccatcaggttcttggcgattgatgctgtggagaaggcgaattcgggtcaccctggtcttcccatgggctgtgctccgatgggtcatatattgtacgatgaggtcatgaggtataaccccaagaacccgtattggttcaacagggatcgctttgttctctccgccggacatggatgtatgctccagtatgctctgttgcaccttgctggctacgacagcgtcctagaagaggacttgaagcaattccgtcaatggggaagcagaactccaggccaccctgaaaactttgaaacccctggtattgaagtcaccactggtcctcttggtcaaggtattgccaatgctgttggtcttgctcttgctgagaagcatttagctgcccgatacaacaaacccgatgctgagattgttgaccactacacatactgtattcttggagatgggtgtcaaatggaagggattgcaaatgaagcatgttcacttgctggccattggggtcttggaaagctgattgctttctatgatgacaaccacatctccattgatggtgacacagagattgccttcactgagagtgtggatacacgttttgaggctcttgggtggcatattatctgggtcaagaatggtaacactggttatgatgagattcgtgctgccattaaagaagctaaagctgtcacagataaacccactttgataaaggtgacaacaacaattggttttggatcaccaaacaaggcgaattcatacagtgtccatggagctgctttgggtgcaaaagaagttgatgccaccagacaaaacctcggatggccttatgagccattccatgtaccagaagaagtgaaaaagcactggagccgccacacccctgaaggtgctgcccttgaagccgaatggaacactaaatttgcagaatatgaaaagaaatacgccgaagatgctgcagaattaaagtctattgctgaaggcgtattccccgccggatgggaaaaggctcttccgatatacaccccggagacacccggcgacgcgacaagaaacctctcacaaacaatgctaaacgcattagcacccgtcctcccgggtctcattggtggaagtgccgatctcgcatcatcaaacatgactctaatgaaaatgtttggagatttccaaaaaagcacccccgaagaacgcaacgtccgattcggtgtgcgtgaacacggaatgggagccatttgtaacggaatcgccctccacagcccgggattcgtcccctactgtgccaccttctttgtcttcaccgattacatgagaggtgcaatgagaatctccgccctctcagaagccggagtcatctatgtcatgactcacgattccatcgggctaggagaagacgggcccacccatcaacccatcgaacacttggcaagtttccgtgccatgcccaacatcttgatgttccgcccggccgacggaaacgagaccgccggagcctacaaggtggcggtggagagccggaaaagaccgtctatcctcgctctttcccgccaaaagctgcccaacctgaccggaacttcgattgaaggcgtcgcgaaaggtgggtacacgattaccgataattccacgggcaacaagcccgatgtgatcttgatcgggaccgggtcggagctggagattgcagcgaaagcggcggatgaacttagaaaggaagggaaagcggtccgggttgtttcgtttgtatcatgggagctttttgaggaacagagtgaggagtacaaggagagtgttcttccttctggtgtaacggctcgtgttagcattgaggctgcatcgacttttggatgggccaagattgttggaagcaaagggaaggcgattgggattgataaatttggagcaagtgcaccggctccaaagatctataaggagtatgggattactgctgaagctgtcattgcagctgctaaagaagtttgttaggttttgatgtctttgattcataatggtctggtcggataaataataaagggttgaaactgctttttttagtctttgatgcatttcatcgaacacctaatgtgcgaactgaacaaagatgagaagagaagagtagaagttgaatgaatttgtgtaccaaaattgaaacgtatttctacaagttttgtgaatttatatgtttgattatcgatgtggtgttctttcgagtaatgtacaatttttaaaccgaatagctataagttcgtataacaacaatatttttatttctcactgcataaaatatcattccccgaagggactcgctgcataaaatataagttatca

SEQ ID NO: 9125 - DNA, 2883 bp, Cicer arietinum
ctttctctcctcacaatgtattctataggcgacaacctcaacaacaatcttcttctctctctacaaaaccaaacaactttcaaaatcataatgaacacatcaaactcacctacacattttcttccttcttcctcttcttgttattatcatcgctcatcactcactcactctctttctctctcttcccaccaaccatgtcttcttccacttcctcactctctctcaccaacccccatctcacgcgcctcacttccaccacgcgcctctcctctctcccttccactatctccctccgctcaccaacaaccccttccactcatctctccctctcccacacccacctccgccgcacctccgtcaaatcatccgccgtcgtaacacaaacgtccgaaaattccactgcagacttgtcactcgttgagaaatcagttaacacgatccgattcttggcgattgattcggttgagaaagctaattcgggtcacccgggtttacccatgggttgtgctccgatgggtcatgtgatttatgatgaggttttgaggtataaccccaaaaaccctaaatggtttaaccgtgatcggtttgttttgtctgctggtcatggttgtatgcttcagtatgctttgcttcaccttgctggatacgatagtgtcaaggaagaagatttgaaggcattccgtcaatgggagagcaaaacccccggacaccctgagaattttgagactcctggagttgaagtcacaacaggtcctcttggtcagggaattgccaatgctgttggtttggcccttgcagagaagcacttagctgccagatttaacaaacccgataatgagattattgatcattacacgtattgtatactcggtgatggttgtcaaatggagggaattgcaaatgaagcttgctcacttgctggccactggggattagggaagctaatagcgttttatgatgacaatcatatttctattgatggtgacacggaaattgcattcaccgagagtgttgaaaagcgttttgagggacttgggtggcatgttatttgggtaaagaatggaaacactggctatgatgagattcgtgctgctattagggaagcaaaatctgtcaaagacagacctacattgatcaaggtcacaacaacaattggttatggttctcccaataaatctaactcctacagtgtgcacggtagtgcacttggtgccaaagaagtggacgctaccagaaacaaccttggatggtcacacgagcctttccacgtgcctgcagatgttaaaaagcactggagtcgccacatccccgagggtgctgcacttgaatccgagtggaatgcaaagtttgccgaatacgaaaagaagtacaaggaggaagctgcagttttgaaatctattatcagtggtgatttaccttctggttgggagaaagcacttccgacatacactccagagaccccagccgatgcaaccagaattctttcacagcaaaaccttaacgcccttgcaaaagttcttcccggtctgcttggtggcagtgcagatcttgcttcttccaacatgaccttgctgaaaacatttggggacttccaaagcgattctccaggggagcgtaatgtaaggtttggtgttcgagaacatggaatgggagcaatttgcaacggcattgctcttcacagccccggattgattccatactgtgcaaccttctttgttttcaccgactacatgcgtggtgccataaggctttctgccctatccgaagctggtgttatatatgtaatgactcatgattcaataggacttggagaggatggtccaacccaccagccgattgagcaccttgcaagcttccgggcaatgccgaatatcttgatgcttcgtccagctgacggtaatgaaacggctggagcatacaaagtcgccgtgctcaacagaaagagaccctctatcctcgccctttctcgacaaaaattgcctaaccttgctggaacttctatcgaaggagttgaaaaaggtggatacatcgtctctgacaactcaacaggaaacaaacctgatgtcattttgatcggaactggttccgaattggaaattgcttacaaagctgccgaggatctaagaaaggaagggaaggctgttagagttgtttcctttgtttcttgggagcttttcgatgagcaatcagaagcatacaaggagagtgttctccctgctgcggtttcggccagagttagcatcgaggccggatcaacattcgggtggcataaaattgtcggaagtaaaggaaaagcgataggtattgatcgtttcggtgctagtgctcctgccggaagaatatacaaagagttcggtatcactaaagaagctgttattgctgcagcaaaagagcttatttaaatttattagtttcttgtcatttaagaacttttgttttggttttgagttttgatatatctacagaaaaaaggttgtttcaatagcattttgttgtttgttttgaataagaaaaggttagattattgttgcttgagattgtgagtgaagctaagcaacatagcaacatagatcaaaacgagtacactaaataaatttttatgagcttgcaaacttttcaaccaatttagttttgtattgcccccactgttaaatttaatgattttcacgagagaattctatgataggtgtatattttctttcacctgtttgcagtgtgcaattgtaatacactaaacatgtgtgttaggaaaattgttccgagtggatggataaatctttatggaattaggtgagaaagatattaattagttcttagattctgttttatgataaaatcactacttatgtatgtataaatataaatatggggctgctaatttac

SEQ ID NO: 9126 - DNA, 2689 bp, Capsicum annuum
tcattcaacagacaaattccatatagagccatggcttcatcttctctcactctctctcaagctatcttttctccttctctccctcgccatggctcttcgtcttcttcctctccttctctttctttccccattttctctggccttaaatccacccctttcacttcctcccaccgccgttttcttcttccctccacatccttcactaaacagcagctttctgttcgcgcctccgcagctgtagagactttggagaaaactgatgctgcacttgttgagaaatctgtaaacactattcgatttttggctgttgatgctgttgaaaaggctaattcgggtcatccgggtttgccgatgggatgtgctccaatgggtcatatattgtacgatgaagtcatgaagtataatccaaagaatccttactggtttaatcgtgaccgatttgttctatctgctggtcatggttgtatgcttcaatatgctcttctccacctcgctggttatgactctgttcaggaagaggacttgaaaagtttccgtcagtggggtagcagaatccccggtcaccctgagaacttcgagacacctggagtcgaagtcaccactggtcctctggggcaaggtattgccaatgctgttggcttggcccttgcagagagacacttggccgctcggttcaacaagccagacagtgagattgttgaccactacacatatgttatacttggtgatggttgccagatggagggtatctcaaatgaagcttgttcccttgctggccactggggacttgggaagctgattgctttctatgatgataatcacatctccattgatggcgacacagaaattgctttcactgaggatgtctctgctcgttttgagtctctaggatggcatgtgatctgggtgaagaatggtaacacaggttatgatgaaattcgtgctgccattaaggaagccaaagctgtcaaagacaaacccactatgatcaaggtaactactaccattggttttggctctccgaacaaggcaaactcctacagtgtgcatggcagtgcacttggagcaaaggaagtggaggccactagaaataacctgggatggccttatgagcctttccatgtgcctggagatgtgaagacccattggagccgtcatacgtctgagggtgctgcccttgaaactgaatggaatgctaagtttgctgaatatgagaaaaagtacccagaggaagctgcagatttgaaatccatcattactggtgaactacctgctggctgggcgaaagctcttcctacttaccttcctgagagcccagcggatgccaccagaaacttgtcacaacaaaaccttaatgctcttgccaaggttctacctggtttcctgggtggtagtgctgatcttgcctcatcaaacatgactcttttgaaaatgtttggtgacttccagaagaactctccggaagagcgtaatttaaggtttggtgttcgcgaacatggtatgggagccatatgtaatgggattgctctacacagccttggcttgattccctattgtgctactttctttgtgttcactgactacatgagaggagccatgagaatttcagccttgtctgaagctggagttatttatgttatgacccatgattcaattggtctaggagaagatgggccaacccatcaacccattgagcacttggcaagtttccgtgcgatgcccaacattctgatgttccgtccagcagatggaaatgaaacagcaggagcttacaaagtggctgtcctcaagaggaagacaccatcagtccttgccctctctcggcaaaagttaccgcaacttgctggaacttctattgacggagtagcaaagggtggctacattgtatcagacaattcttcaggcaacaaacctgacatcattttgcttggtactggctcagagttggaaattgctgtcaaggctgctgatgaactcaggaaagaaggaaagacagtgagggttgtttccttagtttcttgggagctttatgatgaacaaccagctgactacaaggaaagtgttcttccagcatctgttacagctagagttagcattgaagctggatcaacattcgggtggcaaaaatttcttggagataaaggaaaagccattggggttgacggattcggtgccagtgctcctgctgacaggatatacaaagagtttggtattacagcagaggctgttgtagctgcagctaaagaagtttcttaggtgatgtcggttgtgattcttggttgctggtggtctaccaaatttatttcgttaggttatgagatgaagataatggtggaaacgatatcaaatagactcagcacagttcacagccaccagagattttaaataagggagaaaatttcctctgcacttctttttcttcagttaagttgcagagccaccagaatgaatccacgatgaggatagaaattaggcacattgttgttcctaaacttgtacactacatatcttgagtttgttatttcatttggttcattgataaagatgtcattttcccaattggagtttcgtgtgtgtctggcaatgggattttgttttccttcgttttaatccattcagagtattctgataaaaaaataattgaactttgtaggctagcttgatgatatgttaaagaggaggaactccc

SEQ ID NO: 9127 - DNA, 2514 bp, Chenopodium quinoa
ttgtccctacaacctctaaggtcaatggagtgctccttaagtcatcctcctctaggaggaggcgtgctgcgcctcgtgcaaccgttgtgagggctgcggctgtggaagcgttggagtcgacagacactgatcaacttgtcgaaaagtctgtcaataccataaggttcttggctattgatgctgttgagaaggcaaactctggtcacccgggtttgcctatggggtgtgctcccatgggacatatattgtatgatgagatcatgaggtataacccgaagaacccgtattggtttaaccgtgaccgctttgttctctctgctggtcatggttgtatgcttcagtatgctcttcttcatcttgcaggctatgacagtgtcttggaagaggatttgaagactttccgccaatggggaagcagaattcctggtcatccagagaatttcgagacacctggagttgaagttacaactgggccacttggtcagggcatagccaatgctgttggtttggctcttgcagagaagcatctggctgctcgatttaacaaacctgatgctgaaatcgttgatcattacacatactgcattcttggtgatggttgccagatggaaggaattgcccaggaagcttgctcgcttgctggtcactgggggcttggaaaattgattgccctttatgatgataatcacatttctattgatggtgacactgccattgcattcactgagaatgttgatttgaggtttgaggcccttggctggcatgttatttgggtgaagaatggtaacactggttacgatgaaattcgtgctgctattaaggaagctcagtctgtcaaggacaaacccactttgatcaaggttaccaccaccattggttttgggtctcctaacaagtcaaactcatacagtgtgcacggaagtgcattgggttctaaggaagttgaggctacaaggcagaatcttggctggccttacgagccattccacgttccagaggaggtgaaaaagcactggagccgccatacccctgagggagcttccttggaagctgagtggactgcaaagtttgcagagtatgagaagaagtatcctacagaagcagcagagttcaagtcaatcattactggtgaattgcctgctggttgggagaaagctcttcctacttacacacctgagaccccaggtgacgcaaccagaaacctgtcacaacaatgcttaaacgcccttgcaaaggttcttccaggacttcttggtggtagtgcagatcttgcgtcttcaaacatgaccttactaaaaatgttcggagacttccaaaaggacacaccggaagaaaggaatgttcgttttggtgttagagagcatggaatgggagccatttgcaatggaattgcccttcacagccctgggctaatcccttactgtgctaccttctttgtgttcactgactacatgagaggagcaatgaggatctctgccttgtcagagtctggagtcatatatgttatgacccatgactctatcgggcttggagaagatggacccacccatcaacccatcgagcacttggcaagtttccgtgccatgcccaacattctaatgctccgcccagctgatggtaacgagactgctggttcatacaaggttgctgttgaaaacagaaagacaccatccattcttgctctttctaggcaaaaacttcctaacttgcccggaacatccattgaaggagttgcaaaaggaggttacaccatctcagacaactcttcaggcaacaagcctgatgttattctgattggaactggttcagagctggaaattgctgccaaagctggtgatgagctaagaaaagaaggaaaatactgttagagttgtatcgtttgtgtcttgggagctgttcgaacagcaatcagatgaatacaaggagagtgtccttcctgcagatgttacagcaagagtaagcattgaggcaggatcaaccttcggatggcacaagatagtgggatcgaaggggaaggcaatcggtattgacaagtttggagctagtgcaccagcagggaggatatacaaggagtatggaatcacagttgaggcagttgttgaagcggcaaaatcagtttgttaggccacggtgctgcagattctttttgcctcctgttttccatttttgttaactgatcaagtagacaaggctccctggtcaatctagtgagtactgtattacagtaaaatcgaaaaaaaattagttactgtaaagaaagcggatttgatcgttccatttgtctagatgaatttctaaggcttcttacagtaagaatgtttgttgatttgtatttaaatctggcattcaatgtcaaagtatggacaacatatttctaataaggaacaatgacagtgatgccgattatgtgaagcagttttctcttcccattcaataaggacttgttttcttgaggtatggctgcttattcaacctcgtttctttctatgatatatgtgtggtttgttgatgtgc

SEQ ID NO: 9128 - DNA, 2625 bp, Arabidopsis thaliana
ggctaaaaatcaacacactgataaaataagagttgcagagagagtctctcatcttcttcatttcttcaccaccatcatcacacaccttcttcttcttcttcttctctctctatcacaagagagtcaaatccatggcttctacttcttccctcgctctctctcaagctctcctagctcgtgcaatctctcaccatggttctgaccaacgtggatctttaccagctttctctggactcaaatccaccggttcacgcgcctcagcttcgtctcgtcgacgtatcgctcaatccatgaccaaaaaccgatctctccgtcctcttgttcgcgctgcagctgttgagactgttgagccaaccactgattcgtcgattgtggacaaatcggtcaactcgattaggtttttggctatcgatgcggtggagaaggccaaatcaggtcatcctggtcttcctatgggttgtgctccgatggctcacattttgtatgatgaggtcatgaggtataaccccaagaacccttattggttcaaccgtgaccgattcgttctatctgctggacatggatgtatgttgctctacgcgttgcttcatcttgccggctacgacagcgtccaggaggaagatttgaagcagttccgtcaatggggaagcaagacaccaggacatcctgagaatttcgagactcctggaattgaagtcactactggtcctcttggacaaggaatcgctaatgctgttggtttagctcttgctgagaagcatttggctgctagattcaacaaacctgatgctgaagtagtcgaccactacacatatgcgatccttggagatggttgtcagatggagggtatttctaatgaagcttgctctctagctggccattggggacttggaaagctcattgctttctacgatgacaatcacatttctatagatggagacacagaaattgccttcactgagaacgtggaccagcgatttgaagcccttggatggcatgttatctgggtgaagaatggaaacactgggtatgacgagatccgtgctgccattaaggaagctaaaactgttactgacaagcctactttgatcaaggtcactactaccattggttatgggtctcccaacaaggcgaactcatacagtgtccatggagctgcacttggcgagaaggaagttgaggctaccagaaataaccttggatggccgtatgagccgttccaggtacctgacgatgtaaaaagccactggagtcgtcatacacctgaaggagctactcttgaatctgactggagtgcaaagtttgcagcatatgaaaagaagtacccagaggaagcttctgagttgaaatctattatcactggtgaattacctgctggctgggagaaggctctacctacatacacaccagagtctccaggtgatgccaccagaaacctgtcacagcaatgtcttaacgcccttgctaaagttgttcccggtttccttggtggaagtgctgaccttgcatcatccaacatgacattgctgaaagcctttggcgacttccaaaaggccacacctgaagaaagaaatcttaggtttggtgttagggagcacggaatgggagccatctgcaatggcattgcccttcacagccccggtcttatcccttactgtgcgacgttctttgtcttcaccgactacatgagaggtgccatgagaatctcagctttgtctgaagctggtgttatctatgttatgacccatgattccattggtcttggagaagatggaccaacccatcagcccattgagcacattgcaagtttccgtgctatgcccaacactcttatgttccgtcctgctgatggaaatgaaacagccggtgcatacaagatcgctgtcaccaagcgcaagacaccatctatcttagctctgtctaggcaaaagctgcctcatcttccaggtacatccatcgaaggagtggaaaagggtggatatacaatttctgacgactcttcaggcaacaaacccgatgtgatcttgattggaactggttctgagctagagattgctgcacaggctgcggaggtgctcaggaaagacggcaaaaccgttagagttgtttctttcgtgtgctgggaactatttgacgagcaatcagatgaatacaaggagagtgtgttgccatcggatgtatcagctagagttagcattgaagcagcttcgactttcggatggggaaagattgttggaggcaaaggaaagtccattggtattaattcattcggagccagcgcaccagcacccttactctacaaggagtttggtatcaccgttgaagctgttgttgatgcggccaagtcattcttctaagagatttaagatcggaccattctctctgagggggttttgtctgaaacttgatttggaaacaaggctattcacaacattgtctcatatctcgaaataaagtgcaacaagacacaaagactttcactttcttttttgtttttgttttttgtacttcaggtcaagataggttttcggtttgagaagagaaacaaattagaaagacaatgtaaaactcccatgatcattcgtgtaatgctaaatgcttgaatttcagcaaaactttctagca

SEQ ID NO: 9129 - DNA, 2802 bp, Chrysanthemum coronarium
aaacaatccaaaacaatccaactagcaattgaagccaaagcattcatttcctagccttagtcaagggtcaagatcttttacaaaaaccaatccaagggtcatattttctcttgttcatctcaaccaccccattttcatcccccctcatctttacaaataacacaaaccccatctttttattccttcaaactcttttttctaaacccaaaccaaaagagccatggcttctctcactctctcccaagctgctctcacacgcgccaccgtcacgcgccatggctcttccaccaccacaccccaacaacccacctccctctcaactctccaaatacccactttctcaggcttgaaatccaccccacccacctcctcacgcgctcccacgcgccgtcatgtctccgccacgcgccggcgcgttgtcacaaacgccgccgtggagacgctcgagaagaccgacaccgcccttgtggacaagtcggtgaacactatcaggttcttggctattgatgctgttgagaaagcgaattcgggtcatccgggtttgcccatgggttgtgcacccatgggtcatattttgtatgatgaggttatgaggtataacccaaagaacccttattggtttaacagagatcggtttgttttgtctgctggtcatggttgtatgcttcagtatgctctccttcatcttgctggttatgatgctgtcacaacggaggacttgaagcaattccgtcaatggggaagcaagactcctggtcatcccgagaacttcgaaactcctggagttgaagttaccactggtcctcttggtcaaggtattgccaatgctgttggtcttgctcttgctgagaagcatttggctgcaagatacaacaaacccgatgccgagattgttgaccactacacatactgtattgttggagatggttgtcaaatggaaggtattgcaaatgaagcatgttcacttgctggacattggggacttggaaagttgattgctttctacgatgacaaccacatttccattgatggtgacaccgagattgcctttactgaaagcgttgacacacgttttgaggctcttgggtggcacatcatttgggtgaagaacggtaacactggttatgatgagatccgtgctgccattaaggaagccaaggctgtgactgataagcccactttgatcaaggtgacaacaacaatcggttttggatcaccaaacaaggccaactcatacagtgtccacggagcagctttgggtgcaaaagaagtagatgcaaccagacaaaaccttggatggccttatgagccattccatgtaccagatgatgtcaaggcacattggagccgccacacccctgaaggtgctgctcttgaagctgaatggaatgctaaatttgcagagtacgagaagaaatacgctgaagatgcagcagaattgaaatctattgctgatggtgtattgcctgccggatgggaaaaggctcttcccacatacacacctgaaactcccggtgatgccacaagaaacctttcacaaacaatgcttaacgctttggcaccagttctccctggtctcattggtggaagtgccgatcttgcttcatcaaacatgactctaatgaaaatgtttggtgatttccaaaaagccacacccgaagaacgcaatgtcaggtttggtgtccgtgaacacggtatgggagccatctgtaacggtatcgccctccacagccccgggttcatcccttactgtgctaccttctttgttttcactgattacatgagaggtgccataagaatctcagctttatcggaagctggtgtcatctacgtgatgacccacgactccattggtctaggagaagacggtcccacccatcagcccatcgaacatttagccagtttccgtgccatgcccaacatcttaatgttccgaccagctgacggtaacgagaccgctggagcttacaaggtcgcagttgagagccgaaaacgaccctcaatccttgctctttccagacaaaagctacccaacttgcccggaacttcaattgaaggaaccgcaaagggtggttacacaataaccgacaattctaccggaaacaaacccgatgttatcttgatcgcaactggttccgagctggaaattgcagctaaagctggtgatgaactcagaaaggaggggaaaaccgttagggtcgtgtcttttgtctcatgggagctttttgatgaacaatctgccgactaccaagaaagtgtccttccatcaagtgtaacagcccgtgtcagcattgaagctggttcaactttcggatgggggaaaatcgttggaaccaaaggaaaggccatcggtattgacaaattcggagccagtgcaccagcaccaaagatttacaaggagtatgggatcactgttgaagctgtgatagcagcagctaaagaacttatataggccggtttgaacctgagatcaagttctgagctttggaaacttgaacaaaagacgatcattgtttagttttcagtaatcttgattcataatgctcagacaaacaataaaaagtcggttttttagtctttgatgctttcatggaataccttagatgtgaatcgaacgaagatcaagagagaagattaaatgttgaaagtattgatgatgctctcacgaatttgtatactaaaatttaaacattaatttttcctaagttttgtgatttttatatgtttgattacctctgaggtgttcttttgagttatgtacaattttacaacttataattgacactattattctgaattttt

SEQ ID NO: 9130 - DNA, 2538 bp, Beta vulgaris
caaaacactttctctctcctcaacaacaatggcagcctcagcctcatcatccttcactctctctcatcaaaccatcctctcccaccccaaaaccaccccttccacctcgattgtcgtgccggtcaactccaaagtcaacggggggctattactaaagtcaagacggcggcgcgtggggggtgtggggcgcgtggaatcacgcgccgccgtggtgagggctgcggctgtggaggcgttggagacgacggagaaggatcaggtggttgagaagtctgtgaatactataaggtttttggctattgatgcggtagagaaggcgaattcggggcatccgggtttgcccatgggttgtgcacccatgggtcatatattgtatgatgaggttatgcgctataatcccaaaacccgtattggtttaaccgtgaccgttttgttttatctgcgggtcatgggtgtatgcttcagtatgctcttcttcaccttgctggttatgacagtgtcacggaagaggatttgaagactttccgtcaatggggaagcagaattcctggtcacccagagaattttgagacacctggagttgaagttacaactgggccacttggtcagggtattgccaatggcgttggtttggccctcgcagagaagcatttggctgctcgattcaacaagcctgatgcggaaatcattgatcattacacatatgtcattcttggtgacggttgccaaatggaaggaattgcgcaggaagcttgctcccttgctggtcactgggggcttgggaaattgattgcattctatgatgataaccacatttctattgatggtgatactgccatagcctttactgagagcgttgatcagcgttttgaggcccttggctggcacgttatctgggtcaagaatggtaacacagggtatgatgaaattcgtgctgctgtcaaggaagctcagtcagtcactgacaaacccactctgatcaaggttaccaccaccatcggttttgggtctcctaacaagtcaaactcatacagtgtacatggaagtgcattgggtgctaaggaagttgaggctacaaggcaaaacctgggctggccgtatgagccattccacgttccagaggaagttaagaagcactggagccgccatactcctgagggtgcctccttggaagctgagtggaattctaagtttgcagagtacgagaagaagtaccctgctgaagcagcggagttgaagtctatcattactggtgaattgccagctggctgggagaaagcacttcctacttatacacctgagaccccaggtgatgcaaccagaaacttatcacaacagtgcttgaacgcccttgcaaaggttcttccaggactccttggtggtagtgcagatcttgcatcttctaacatgaccttactgaagatgtttggagacttccaaaaggacacacctgaagaaaggaatgttcggtttggtgttagagagcacggaatgggagccatttgcaatggcattgctcttcacagcccaggattcatcccttactgtgctaccttctttgtattcactgactacatgagaggagcaatgagaatctcagccttgtcagaagctggagtcatctatgttatgacccatgactctattgggctcggagaagatggacccactcatcaacccattgagcacttggcaagtttccgtgcaatgcccaacattctaatgctccgcccagctgacggaaacgagactgctggtgcatacaaagttgctgttgaaaacagaaagacaccatctattcttgctctttctagacaaaaacttcccaaccttcctggaacttccattgaaggagttgagaaaggagggtacactatcacagacaactcttcaggtaacaagcctgatgttattctgattggaactggttcggaactggaaattgctgctaaagctggtgatgagctaagaaaagaaggaaaatctgtaagagttgtatcatttgtatcttgggagttgtttgatcagcaatccgatgaatacaaggagagcgtccttcctgctgcagttacagcaagagtaagcattgaagctggaacaactttcggatggcagaagattgtggggtcgaaggggaaggccatcggtattgacaagtttggacagagtgcaccagctggaaaaatatacaaggagtatggtatcacagctgaggcagttattgaagctgcgaaatcagtttgttaagtcactcatggctcctgtttccatttttgttaactcaagtagacaaggctcctggtgaatctagtgagtactgtacctcggtgagaaacggaaacttttagtcccatttgtcaagataaaacttaattctaaggccttcttatagtataaatgtttgttgatttgtattaaagaaaatttcatccaattcgtaatatggaccaactcatttctgtacaaggataaataatgacagtgaagctgatatgtgattatgtgaattaagcagtttttccaccccttcattttaaa

SEQ ID NO: 9131 - DNA, 2602 bp, Artemisia annua
aaaaccaagagccatggcttctctcactctctcccaagctgctctcacacgcgccaccgtcacgcgccatggctcttccaccaccacaccccaacaacccacttccctctcaactctccaaatacccactttctcaggcttgaaatccaccccagccgcctcctcacgcgcccccacgcgccgccatgtctccgccacgcgccggcgcgtggtcacaaacgccgccgtggagactctcgagaagaccgacaccgcccttgtggacaagtcggtgaacactatcaggttcttggctattgatgctgtggagaaagcgaattcgggtcatccgggtttgcccatgggttgtgcacccatgggtcatattttgtatgatgaggttatgaggtataacccaaagaacccttattggtttaacagagatcggtttgttttgtctgctggtcatggttgtatgcttcagtatgctctccttcatcttgctggttatgatgctgtcactactgaggacttgaagcaattccgtcaatggggaagcaagactcctggtcaccccgagaactttgaaactcctggagttgaagttaccactggtcctcttggtcaaggtattgccaatgctgttggtcttgctcttgctgagaagcatttggctgcaagatacaacaaacccgatgccgagattgttgaccactacacatactgtattcttggagatggttgtcaaatggaaggtattgcaaacgaagcatgttctcttgctggacattggggacttggaaagttgattgctttctacgatgacaaccacatttccattgatggtgacaccgagattgcctttactgaaagcgttgacacacgttttgaggctcttgggtggcacatcatttgggtgaagaacggtaacactggttatgatgagatccgtgctgccattcaggaagccaaggctgtgactgataagcccactttgatcaaggtgacaacaacaatcggttttggatcaccaaacaaggccaactcatacagtgtccacggagcagctttgggtgcaaaagaagtggatgcaaccagacaaaaccttggatggccttatgagccattccatgtaccagatgatgtcaaggcacactggagccgccacacccctgacggtgctgctcttgaagctgaatggaatgctaaatttgcagagtacgagaagaaatacgctgaagatgcagcagaattgaaatctattgctgatggtgtattgcctgccggatgggaaaaagctcttcctacatacacacctgaaactcccggtgatgccacaagaaacctttcacaaacaatgcttaatgctttggcaccagttctccctggtctcattggtggaagtgctgatcttgcttcatcaaacatgaccctaatgaaaatgtttggtgatttccaaaaagccacacccgaagaacgcaatgtcaggtttggtgtccgtgaacacggtatgggagccatctgtaacggtatcgccctccacagccccgggttcatcccttactgtgctaccttctttgttttcactgattacatgagaggtgccataagaatctcagctttatcggaagctggtgtcatctacgtgatgacccacgactccattggtctaggagaagacggtcccacccatcagcccatcgaacatttagccagtttccgtgccatgcccaacatcttaatgttccgaccagctgacggtaacgagaccgctggagcttacaaggtcgcagttgagagccgaaaacgaccctcaatccttgctctttctagacaaaagctacccaacttgcaaggaacttcaattgaaggaaccgcaaagggtggttacacaataaccgacaactctaccggaaacaaacccgatgttatcttgattggaactggttctgagcttgaaattgcagctaaagctgctgatgaactcagaaaggaagggaaaaccgttagggtcgtgtcttttgtctcatgggagcttttcgatgaacaatctgccgactaccaagaaagtgtccttccatcaagtgtaacagcccgtgtcagcattgaagctggttcaactttcggatgggggaaaatcgttggaaccaaaggaaaggccatcggtatcgacaaattcggagccagtgcaccagcaccaaagatttacaaggagtacgggatcaccgttgaagctgtggtcgcagcagctaaagcagttatataggccggtttgaacctgagatcaagttctgagctttggaaacttgacaaaagacgatcattgttagttttcagtaatcttgattcataatgctcagacaaacaataaaaaagtcgttttttagtctttgatgctttcatggaataccttagctgtgaatcgaacgaagatcaagagagaagattaaatgttgaaagattgatgatgctctcacgaatttgtatcaaaatttaaacatattttttccgagttttatgatttttatatgtttgattacctctgaggtgttcttttgagtaatgtacaattttacacttataatgacactattattctgaatttttggagcatctatcttct

SEQ ID NO: 9132 - DNA, 2417 bp, Musa acuminata
tccatcccgtagccaatcgagagagtgagagacatggccgcttcatcctccgtgaacgccgcccaagccatcgttggcctcgccgtctctagccatggttcccactccgccgaccgcgtcgccgtccccgccggcggattcgccctcagctccctcgccggccgctccctcacctgctcccactccccccgtttccagcagcagcgccggtgcccgcggcaggcgtcacgcgccgcgcgtcgcgcggcgcccgccagggccgccgcggtggagaccctcgaggccgccgccacggaggccctcgtcgagaagtccatcaacaccatcaggttcctcgccatcgacgccgtcgagaaggccaactccggccacccgggcctccccatggggtgcgcgcccatgggccacatcctgtacgacgaggtcatgaggtacaaccccaagaacccctactggttcaaccgcgaccgcttcgtcctctccgccggccatggctgcatgctccagtacgccttgctccaccttgctggctacgacagcgtccagatggaggacataaagcaattccggcaatgggggagcagaactcccggccatcctgagaatttcgagacgcccggagttgaagtcaccaccgggccacttggtcaaggcgtagccaatgccgtaggattggcacttgctgagagacaccttgcggcccgtttcaataagcctgacaacgagatcgtcgaccattacacatatgttatactcggggatggttgccaaatggagggcatcgcaaacgaagcttgttcgatcgccggacactggggtctcggcaaactcatcgccttctacgatgacaaccacatctccatcgatggagacacagagatcgcgtttacagaagatgtgtctgctcgtttcgacgctctcgggtggcatactatctgggtgaagaacggtaacaccgggtatgatgacattcgtgccgcgatcagggaagcaaaggctgtcaaagataaaccaacactcatcaaggtcaccactaccatcggatatggatcgcccaacaaggcgaactcgtacagcgtgcatggaagtgcattgggtgccaaggaagtcgatgcaactcgacagaatcttggatggccgtacgagcctttccatgtgcccgaggatatcaagagtcactggagccgccatgtcgctgaaggtgcatcccttgaagctgagtggaacgccaagtttgcagagtacgagaagaagtacaaggaggatgctgcagagctgaaagccatcgtatcgggagaattgcctgccggatgggagaaagctcttccgacatacactcctgagagtcctgccgatgctaccagaaacttatcgcaacagaacttgaatgcgcttgcgaaagttctacctggacttctcgggggtagtgcagatctcgcatcctccaacatgacattgctcaagatgtttggggacttccagaagggcacgcccgaggagcgtaatgttcgttttggtgtacgggagcacgggatgggcgccatctgcaacggcatcgccctccacagccccggccttctcccctactgtgcgaccttctttgttttcacggactacatgagagctgccatcaggatctcagctttgtgcgaggcaggagtcatctatgtgatgacgcatgattccatcggtctcggggaggacggtccgactcaccagccgatcgaacacttgataagtttccgagccatgccgaacattctaatgctcaggcctgccgatggaaatgagaccgccggagcatacaaggtcgcggtgctcaacaggaagaggccatcggtgctcgctctctcgcggcagaagcttcctcagcttgcgggaacatcaatcgagggagtagagaagggagggtacatcgtttcagacaactcctcaggtaacaaaccagacctgatcttgatgggcaccggttcggaactggaaattgcagcgaaggcggccgacgagctgaggaagacggggaaaacggtccgagtggtatcgctcgtctgttgggagttgttcgaggagcaatcagatgaatacaaggagagtgtgctccccgctgcggtgactgctaagatcagtatcgaggcaggtgccacgcttggatgggagaagtacgtcggcggcaaagggaaggccatcgggatagatcggtttggagcgagcgctcctgcggggagaatatacaaggagttcggcatatcggcagacagtatcattaccgcagccaaatcgctctaaggtttgtgataagcttttgttccagcttgctctttctctttctttcatgatttgaggatgctataaagaacggattcaaatctgggatttggactgtaataaagttttcgtatgtccttcatcatttggtt

SEQ ID NO: 9133 - DNA, 2709 bp, Chrysanthemum coronarium
gcaattgaagccaaagcattcatttcctagccttactcaagggtcaagatcttttacaaaaaacaatccaagggtcaaattttctcttggtcatctcaactaccccattttcatcccccctcatctttacaaataacagtataacacaaaccccatcttttttattccttcaaacttttctttctacaccaaaccaaaagagccatggcttctctcactctctcccaagctgctctcacacgcgccaccgtcacgcgccatggctcttccaccaccacaccccaacaacccacctccctctcaactctccaaatacccactttctcaggcttgaaatccaccccacccacctcctcacgcgctcccacgcgccgtcatgtctccgccacgcgccggcgcgtggtcacaaacgccgccgtggaaactcttgaaaagaccgacaccgcacttgtggacaagtctgtgaacactatcaggttcttggctattgatgctgttgagaaagcgaattcgggtcatccgggtttgcccatgggttgtgcacccatgggtcatattttgtatgatgaggttatgaggtataacccaaagaacccttattggtttaacagagatcggtttgttttgtctgctggtcatggttgtatgcttcagtatgctctccttcatcttgctggttatgatgctgttacaacggaggacttgaagcaattccgtcaatggggaagcaagactcctggtcaccccgagaacttcgaaactcctggagttgaagttaccactggtcctcttggtcaaggtattgccaatgctgttggtcttgctcttgctgagaagcatttggctgcaagatacaacaaacccgatgccgagattgttgaccactacacatactgtattcttggagatggttgtcaaatggaaggtattgcaaatgaagcatgttcacttgctggacattggggacttggaaagttgattgctttctacgatgacaaccacatttccattgatggtgacaccgagattgcctttactgaaagcgttgacacacgttttgaggctcttgggtggcacatcatttgggtgaagaacggtaacactggttatgatgagatccgtgctgccattaaggaagccaaggctgtgactgataagcccactttgatcaaggtgacaacaacaatcggttttggatcaccaaacaaggccaactcatacagtgtccacggagcagctttgggtgcaaaagaagtagatgcaaccagacaaaaccttggatggccttatgagccattccatgtaccagatgatgtcaaggcacactggagccgccacacccctgaaggtgctgctcttgaagctgaatggaatgctaaatttgcagagtacgagaagaaatacgctgaagatgcagcagaattgaaatctattgctgatggtgtattgcctgctggatgggaaaaggctcttcccacatacacacctgaaactcccggtgatgccacaagaaacctttcacaaacaatgcttaacgctttggcaccagttctccctggtctcattggtggaagtgccgatcttgcttcatcaaacatgactctaatgaaaatgtttggtgatttccaaaaagccacacccgaagaacgcaatgtcaggtttggtgtccgtgaacacggtatgggagccatctgtaacggtatcgccctccacagccccgggttcatcccttactgtgctaccttctttgttttcactgattacatgagaggtgccataagaatctcagctttatcggaagctggtgtcatctacgtgatgacccacgactccattggtctaggagaagacggtcccacccatcagcccatcgaacatttagccagtttccgtgccatgcccaacatcttaatgttccgaccagctgacggtaacgagaccgctggagcttacaaggtcgcagttgagagccgaaaacgaccctcaatccttgctctttccagacaaaagctacccaacttgcccggaacttcaattgaaggaaccgcaaagggtggttacacaataaccgacaattctaccggaaacaaacccgatgttatcttgatcgcaactggttccgagctggaaattgcagctaaagctggtgatgaactcagaaaggaggggaaaaccgttagggtcgtgtcttttgtctcatgggagctttttgatgaacaatctgccgactaccaagaaagtgtccttccatcaagtgtaacagcccgtgtcagcattgaagctggttcaactttcggatgggggaaaatcgttggaaccaaaggaaaggccatcggtatcgacaaattcggagccagtgcaccagcaccaaagatatacaaggaatacgggatcactgttgaagctgtggtcgcagcagctaaagaagttatataggccggtttgaacctgagatcaagttctgagctttggaaacttaacaaaaaacgatcgttgttagttttcagtaatcttgattcataatgctcagacaaaacaataaaaagtcggttttttagtctttgatgctttcatggaataccttagctgtgaatcgaacgaagatcaagagagaagattaaatgttgaaagattgatgatgctctcacgaatttgtatcaaaataacatattttttccaagttttgtgatttttatatgtttgattacc

SEQ ID NO: 9134 - DNA, 2500 bp, Echinacea purpurea
catcaactttctctctctaaaggagccatggcctccctcactctctcccacgccgccctctcccgctccgccgtcccccgccatggctcttccacccccgccaccgccaccattcccaccttctccggactcaaatccacctcctcacgcgctcccacgcgacagatttccgccacgcgccgacaggtttgttccacgcgccgccgtgtgattgttaatgcggctgtggagactttggagaagacggatacggctttggtggagaagtcgattaatacgatcaggtttttggcgattgatgctgttgagaaggcgaattcgggtcatccgggtttgcccatgggttgtgcgcccatgggtcatattttgtatgatgaggttatgaggtataacccgaagaacccgtattggtttaacagggatcgctttgttttatccgctggtcatggatgcatgctccagtatgctctgcttcatcttgctggctacgattctgtccaagaagaagacttgaagcagttccgtcaatggggaagcaggactcctggccatcccgagaacttcgaaactcctggtgttgaagtcaccactggtcctcttggtcaaggtattgccaacgctgttggtcttgctcttgctgagaagcatttggctgctcgttacaacaaacccgatgctgagattgtcgaccactacacatactgtattcttggagatggttgtcaaatggaaggaattgcaaatgaagcatgttcacttgctggtcactggggacttggaaagttgattgctttttatgatgacaaccacatctccattgatggtgacacagagattgccttcactgagagcgttgacaaacgttttgaagctcttgggtggcatgtcatttgggtgaagaacggtaacactggttatgatgagattcgtgctgccattcaagaagctaagtctgtaactgataagcccactatgatcaaggtgacaacaacgatcggttttgggtcgccaaacaaggcgaactcatacagtgttcatggagctgctttgggtgcaaaagaggtagatgcaaccagacagaacctcggatggccttacgagccgttccatgtaccagatgaagttaagaagcactggagccgccacacccctgatggtgctgctcttgaagctgaatggaatgctaaatttgcagcttatgagagtaagtatcctgaagaagctgctgaattgaaatctattgttactggtgtattgcctgccggatgggagaaggctcttccgacatacacaccagaatcacccggtgatgctacaagaaacctctcacaaacaatgcttaacgcactggcaccagttcttcctggtctcattggtggaagtgcagatcttgcatcttccaacatgaccttaatgaaaatgttcggtgacttccaaaagaacacacccgaagaacgcaacgttcgtttcggtgtccgggaacacggtatgggagccatttctaacgggattgccctccatagccctggtttcgttccttactgtgctacattcttcgtcttcactgattacatgagaggtgctatgagaatctcagctttatcagaagcaggagttatttatgtaatgacccatgactccattggtctaggagaagacgggccgacccatcagcccattgaacatctagccagtttccgggccatgcccaacatcttaatgttccgcccggctgatggaaatgaaacagctggagcttacaaggttgcagtcgagagcagaaaacgaccatcagttcttgctctttctaggcaaaagctgcccaacctacctggaacttcaattgaaggaaccagtaaaggtgggtacacgataaccgacaattcaacaggtaacaagcctgatgttatcttgattggaaccggttctgagctggaaattgcggttaaagctgctgatgaactcagaaaagaagggaaaacagttcgggttgtgtcttttgtgtcatgggaacttttttatgaacaatctgatgaatacaaggaaagtgttcttccatctggtgtcacggctcgtgttagcattgaagctggatcaactttcggttgggatagaattgttggaagcgcgggaaaagccattgggattgacaaatgggggtccagtgcacctgcaggaaagatctacaaggaatatggcataactgttgaagctgtgattgcagctgctaaacaagtgtcttaggcttgtatcttgatctagtaacgctcggacgaacaataagaagttggtttttagtctttgatgcttttcatcggacaccttacctgcaaatcgaacggaatagagggttagaagtttgaatgattgatgctctcctcgtttatttgtaccaaaattgaaacataattttcgaagttttgtgatttgtttggttactactgaggtgttcttttgagtaatgtacaattttacaagttattacaagattattattatt

SEQ ID NO: 9135 - DNA, 2299 bp, Flaveria ramosissima
acactcactccgtcattctctctctagaccaccaacacccatggctacctccgcctctctcaccctctctcaacccaccatctctcgctccgccgtcccccgccatggtgctaccaccgccaccgccacccagcaatcgacttccctctcaatacccactttctcaggcctcaaatccgtcgctacatcctcctcacgcgccaccacgcgccggcaggtgattcacacgcgccgccgtgtcatctccaacgcggcggtggagactctcgacaagacggacactgctttggtggagaagtcgattaacaccatcagattcttggcgattgatgctgtggagaaggcgaattcgggtcatccgggtttgcccatgggttgtgcgcccatgggtcatatattgtacgatgaggtcatgaggtataaccccaagaacccttattggttcaatagggatcgctttgttctctccgccggacatgggtgcatgctccagtatgctctgcttcaccttgctggctacgattctgtcaaagaagaggacttgaagcaattccgtcaatggggaagcaaaactcccggtcatcccgagaactttgaaactcctggtgttgaagtcacaactggtcctcttggccaaggtattgccaatgctgttggtcttgctcttgctgagaagcatttggctgctcgttacaacaagcctgatgctgagattgttgaccactacacttattgtattcttggagatggttgtcaaatggaagggattgcaaatgaagcgtgttcgcttgcaggccattggggacttggaaagttgattgcgctttatgatgacaaccacatttccattgacggtgacaccgagattgcgttcactgagaatgttgatcaacgttttgaagctcttgggtggcacataatttgggtgaagaatggaaacactggttatgatgaaatccgtgctgccattaaagaagctaaagctgtgactgataaaccaactttgatcaaggtgacaacaacaatcggctttgggtcaccaaataaggcgaactcatacagcgtccatggagcagctttgggtgcaaaagaagtagatgcaaccagacaaaaccttggatggccttatgagccattccatgtaccagatgaagtgaagaagcactggagtcgccacaccccagatggtgctgctcttgaagctgaatggaatgctaaatttgcagagtatgagaagaaatacccagaagatgctgctgaattgaagtctattgctactggtgtattgcctgccggatgggagaaggctcttccgacctacacaccagaaacacccggtgatgccacaagaaacctctcacaaacaatgcttaatgcattagcaccggttctccctggtcttattggtggaagtgcagatcttgcatcttcaaacatgactttgatgaaaatgtttggtgatttccaaaagaacacacctgaagaacgcaacgttcgattcggtgttcgggaacatggtatgggagccatttgtaacgggatcgccctccacagccctgggttcgtcccttactgtgctacattcttcgttttcactgattacatgagaggtgccatgagaatttcagcattatcagaagctggagttatttatgtcatgacccatgactccattggtctaggagaagacgggccgacccatcaacctgttgaacatttagccagtttccgtgccatgcccaacatgttaatgttccgcccagcagatggaaatgaaacagctggagcttataaggttgcagtcgaaagcagaaaaagaccctcaattcttgctctttcaaggcaaaagctgcccaacctgcccggaacttcaattgaaggaaccgggaaaggtggttacacaataactgataactcaacagggaacaaacctgatgttatcttgatggcgacaggttctgagctggaaattgcagttaaagctgctgatgaacttagaaaagaagggaaaaccgttcgtgtcgtgtctttcgtgtcatgggaactttttgatgaacaatctgatgaatacaaagaaagtgttcttccgtctggtgtaactgctcgtgtcagcattgaggctgcatcaactttcggttgggggaaacatgttggaagcaaagggaaggcgatcgggattgacaaatttggggccagtgcgccagctggaaagatctacaaggaatatgggataactgttgaagctgtggttgccgcggctaaagaagtttgttaggttggttcttaactgacatcaact

SEQ ID NO: 9136 - DNA, 2534 bp, Taraxacum officinale
actgtatataaaacgatcactccccccattcctctactttctctctcaacaaagagccatggccgcctctacctctcttactctctcccaaaccgctctctcccgcaccgccgtcccccgccatggctcttccaccacaaccacccacatatagacctccctcgccactctctcaattcccactttctctggactcaaatccacctctacatcatcctcacgcgcgcccaatcgccgtcaggtgtccgccacgcgccgccgtgtgattgccaacgcggctgtggagacccttgagaagacggataccgcgctggtggagaagtctatcaacaccatcagattcttggcaattgattccgtagagaaggcgaattccggtcatcctggtttacccatgggatgtgctccgatggggcatatattgtacgatgaggtcatgaggtataacccgaagaacccgtattggttcaacagggatcgcttcgttctctccgccggacatggatgtatgctccagtatgctctgttgcaccttgctggctacgacagcgtcctagaagaggacttgaagcagttccgtcaatggggaagcagaactccaggccaccctgagaactttgaaacccctggtattgaagtcacaactggtcctcttggtcaaggtattgccaatgctgttggtcttgctcttgctgaaaagcatttggctgcccgatacaacaaacctgatgccgaaattgttgaccactacacatactgtattgttggagacggttgtcaaatggaaggaatttcaaacgaagcatgttcacttgctggccattggggacttggaaagctgattgctttctatgatgataaccacatttcaatcgatggtgacactgaaatcgccttcactgaaaatgtggacacacgttttgaatctcttggatggcacatcatttgggtcaagaacggtaacacgggttatgatgagatccgtgctgccattgcagaagctaaatccgtaaccgataaacccactttgatcaaggtgacaacaacaattgggtttggatcaccaaacaaggcgaattcatacagtgttcatggagctgctttgggtgctaaagaagttgatgcaactagggcgaatcttggatggccttatgagccattccatgtaccagaagaagtgaaaaagcactggagccgccatacccccgatggtgctgcccttgaagccgaatggaacgctaaatttgcagagtacgagaaaaagtaccctgaagatgctgcagaattaaagggtatcgccgatggtgtcttccctaccggttgggaaaaagcacttccgacatacacccccgagacacccggtgacgcgacacgtaacctctcacaagcatgcctaaacgcgctcgcacctgtcctccccggtctcattggtggaagtgccgatctcgcctcatcaaacatgaccctcatgaaaatgttcggcgacttccaaaaagccacccccgaagaacgcaacgtgcggttcggcgtccgcgaacacggcatgggcgcgatatgcaacggcatcgcgctccatagcccaggcttcgtcccctactgcgccaccttcttcgtcttcactgactacatgagaggcgcgatgagaatctccgcactgtctgaagccggtgtcatctacgtcatgacacacgactccatcgggttgggcgaagacgggcccacgcaccaaccgatcgaacacctcgcgagcttccgcgccatgccgaacatcctaatgttccgccctgcagacgggaacgaaaccgcgggggcgtacaaggtcgcagtcgaaagcaggaaaagaccgtccatcctcgcgctttcccgccaaaaactcccgaacctcgagggaacatcaatcgagggtgttgcaaaaggtggttacacgatcacggacaactccacggggaactcccccgatgtgatcttgatcgggaccggatctgagctcgagatcgcggcgaaggccgcagacgagctcagaaaggagggaaaagcggttagggttgtttcgtttgtttcatgggagctttttgatgaacagagtgacgagtataaggaaagtgtgctcccgagtggggtaacggctcgtgttagcatcgaggcggcatcgacttttgggtgggggaagattgtgggaagcaaagggaaggcgatcgggattgataaatttggggcgagtgcgccagctggcaagatctataaggagtatgggatcacggctgaagccgtggtggcggccgctaaggaagtttgttagcttttctaatgaatgaataataatgaaactgcttttttagtctttgatgcatttcatcgaacacgtatatgtgcgaaattggaaattggaaattggtcggagatgagaagagaaaagagtagaatttgtaccaaaattgaaaacgtatttctacaagttttgtgaatttatatgtttgattattgatgtggtgtacaatttttaaaccatatagttgtaatttcttataataatg

SEQ ID NO: 9137 - DNA, 2165 bp, Rosmarinus officinalis
gagaagaccaccgaaaccgagctcgtggagaagtccgtcaacaccatccggttcctggccatcgacgccgtggagaaggccaattccggccaccccggtttgccgatgggatgcgccccgatgggtcacatattgtacgacgaggtgatgaggtacaaccctaagaatccctactggttcaaccgtgaccgcttcgttctctccgccggccacggctgtatgctgcagtacgcgcttcttcacctcgccggttacgattccgtcaaggaagacgatctgaagaatttccgacaatgggaaagcaggacaccgggtcatcccgagaactttgagacacctggtgtcgaagtcaccactggcccacttggtcaaggtattgccaatgccgttggtctggcgcttgcagagaagcacttggctgcacggtacaacaagctcgatagcgagatagttgatcactacacatatgttatccttggtgatgggtgtcaaatggagggtatctcgaatgaagccgcctcccttgctggccactgggggcttgggaagttgattgctttctacgacgacaatcacatctctattgatggtgacacagagattgctttcaccgagagtgttgacactcgctttgaaggtcttgggtggcatataatctgggtgaagaatggtaacactgggtatgatgaaattcgtgctgccatcaaggaagccaaggctgtgacggacaagcccactctgattaaggttaccacaaccattggttttggttcccctaacaaagccaactcgtacagtgtccatggaagtgcattgggtgccaaagaagttgaggccaccagacagaatcttggatggccatttgagcctttccacgtgcccgaagatgtgaaaagtcattggagccgacacactcctgaaggggctgctttggaagctgaatggaacgccaagtttgctgaatacgagaagaagtacccagaggaatcagctgagctgaaatctatcatcaccggtgcctttccagctggttgggagaaggctcttcctacatatactcccgagagcgcggctgatgccacaagaaatctatctcagcaaaatctgaattctcttgcaaaggtgctccccggtctgattggtggcagtgctgatcttgcctcgtccaacatgacgcttctgaaaatgttcggggacttccagaagaacaccccagaagagcgtaacgtgaggtttggtgtccgtgaacacggtatgggagccatctgtaacggaatcgccctccacagcccgggtttcatcccctactgtgcaactttcttcgtgttcacggattacatgagggcagccatgaggatctccgccttgtccgaagctggagtcatctacgtcatgacccacgactctatcgggctgggagaagacgggcccacccatcagcccatcgagcatttggcaagcttccgggccatgcccaacatattgatgctccgtccagctgatggcaacgagacagcaggatcgtacaaggtggctgttctcaacaggaagagaccctccgttcttgccctttctcgtcagaagctaccccagcttcccggcacctccatcgaaggcgtggagaagggagggtataccatctcagacaactcgtctggcaacaagcccgacatcattctgattggaaccggttcggagctggagattgcagccaaggctgctgatgagctcagaaaggaaggcaaggcggtgagagtcgtctccttcgtttcttgggagctctttgatgaccaatccgctgagtacaaggagagtgtgctgcctgcctccgtgactgctagggttagcattgaggctggaacaacattcgggtgggagaagatcgttggttcgaaaggaaaagccattggaattgatcgatttggagcgagtgcacctgctgggaagatatacaaggagtttggcctcacgacagaagctgttgtagccgcagccaaagagttgatctaagctttcttcttttcattcggaatgtcgatttgtggttgattgaagcacataagaaaaaatgactcgatttggagcagcagagctgagaattcctaataaagaagacacaaatctcttgtttccttttgtttgagctttgtagtctgaaatgtgac

SEQ ID NO: 9138 - DNA, 2594 bp, Musa acuminata
cttcaactcacgcctttcttaacccgaaccaaatctcagggggagagggaagagaggcggatcaaacgtagcagtagactgagagcccatggccgcttcctcctccgtgaacgccgcccgagccctcgtgggcctcgccgtctacgaccatggctcatcttccaacgcccgccccgaccgcgtcgccctcccggccggcggatccgccctcagatcccacgccgcctggtcactcacgtcctctccccgcttccagcagtgcgcctctcgccgacggcccaagccctgctcctctcgccgcgctgcgcccgccagggccgctgcggtggagaccctcgaggccgccgccacggatgccctcgtggagaagtccgtcaacaccatccggtttctcgccatcgacgccgtcgagaaggccaactcaggccacccgggcctccccatggggtgcgcgcccatgggccacatcttgtacgacgaggtcatgaattacaaccccaagaacccctactggttcaaccgcgaccggtttgtgctctccgccggccatggatgcatgctccattacgccctgctccatcttgctggctacgatagcgtcaagatggaagacttgaagcaattccgtcaatggggaagcaaaactcctggtcatcctgagaacttcgagacaccaggaattgaagtcactactggtccgctcggtcaaggtgttgctaatgctgttggtttggctcttgctgagcgacacctagctgcccgtttcaataagcctgacaatgagattattgaccattacacatatgtgatgcttggggatggttgccaaatggagggcatcgcaaacgaagcttgttctcttgctgggcactggggtctagggaaacttatcgctttttacgatgacaaccacatctccattgatggtgacacagagattgcatttacagaagatgttattgatcgttttgaggctctcggatggcataccatctgggtgaagaatggaaacaccgggtatgatgatattcgtgctgccattaaggaagcaaaggcagtgaaagacaaaccgactcttatcaaggtcactacgaccattggatatggatcaccaaacaaggcaaacacatacagcgtacatggaagtgcattgggtgccaaggaagttgatgcaactaggcaaagtctcgaatggccatatgaacctttctatgtgcctgaggatgtgaagagtcactggagccgccatgcccctgaaggtgctgctcttgaagctgagtggaatgccagatttgcggagtatgaagagaagtacaaggaggatgctgcagagctgaaagctatcatatcaggagaattgcccgctggatgggagaaagcccttccgagatatactcctgaaagtcctgcagatgcaactagaaatttatcgcagcagaacctaaatgcacttgcaaaagtactacctgggcttcttggtggtagtgcggacctcgcatcctccaacatgacattgttgaagatgtttggtaacttccaaaagggcacacctgaggagcggaatgttcgtttcggggttagggaacatgggatgggtgccatctgcaacggcattgcccttcacagccctggtcttctcccttactgtgctactttctttgttttcaccgactacatgagagctgccatgaggatctcggccttgtctgaggcaggagtcatctatgtgatgacacatgattcaattggtcttggggaagatggccctacccatcagccaattgagcatttgataagcttccgagccatgcccaacattctgatgctcaggcctgctgatgggaacgagactgctggggcctacaaggttgcggtgctcaacaggaagagaccgtcagtccttgctctctcacgacagaagcttcctcaacttccaggaacatcaattgaagatgttgagaagggaggatataccatttctgataattctactggtaacaaaccagatctgattttgatcggcactggttcagaattggagattgcagcgaaggccgcagatgagctaaggaaggaggggaaaacagtacgtgtggtatctcttgtttgctgggagttgtttgatgagcaaccagacgaatacaaggagagtgtcttccctgctgctgtcactgcaaggattagtatcgaagcaggggtcacgcttggatgggagaagtatgtcggaagcaaaggcaaggcgatcgggattgaccggtttggagcaagtgctcctgctgggagaatatacaaggagtttggcataacagcagagagtattattgcggcagccaaatctctgtgaggtaagctctgtcagtgatcacaaggagaatttagatttcagtgtcagtttgaggattctctagggcaaaggaaccttgcttagtagattgaaaccttgcctttaacctgcaataaaattttcaaatgtccttgagcttttcctttctcataattgatggagttttcttctttaatgaatgattgcatttagttgtgcaacaaaccgtaatatgtattaattatttgaatgtcgaatactgtttcgggaa

SEQ ID NO: 9139 - DNA, 2826 bp, Chrysanthemum coronarium
ttcatcccccctcatctttacaaataacagtataacacaaaccccatcttttttattccttcaaacttttctttctacaccaaaccaaaagagccatggcttctctcactctctcccaagctgctctcacacgcgccaccgtcacgcgccatggctcttccaccaccacaccccaacaacccacctccctctcaactctccaaatacccactttctcaggcttgaaatccaccccacccacctcctcacgcgctcccacgcgccgtcatgtctccgccacgcgccggcgcgtggtcacaaacgccgcagtggagacgctcgagaagaccgacaccgcccttgtggacaagtcggtgaacactatcaggttcttggctattgatgctgttgagaaagcgaattcgggtcatccgggtttgcccatgggttgtgcacccatgggtcatattttgtatgatgaggttatgaggtataacccaaagaacccttattggtttaacagagatcggtttgttttgtctgctggtcatggttgtatgcttcagtatgctctccttcatcttgctggttatgatgctgtcacaacggaggacttgaagcaattccgtcaatggggaagcaagactcctggtcaccccgagaacttcgaaactcctggagttgaagttaccactggtcctcttggtcaaggtattgccaatgctgttggtcttgctcttgctgagaagcatttggctgcaagatacaacaaacccgatgccgagattgttgaccactacacatactgtattcttggagatggttgtcaaatggaaggtattgcaaacgaagcatgttcacttgctggacattggggacttggaaagttgattgctttctacgatgacaaccacatttcgattgatggtgacaccgagattgcctttactgaaagcgttgacacacgttttgaggctcttgggtggcacatcatttgggtgaagaacggtaacactggttatgatgagatccgtgctgccattaaggaagccaaggctgtgactgataagcccactttgatcaaggtgacaacaacaatcggttttggatcaccaaacaaggccaactcatacagtgtccacggagcagctttgggtgcaaaagaagtagatgcaaccagacaaaaccttggatggccttatgagccattccatgtaccagatgatgtcaaggcacattggagccgccacacccctgaaggtgctgctcttgaagctgaatggaatgctaaatttgcagagtacgagaagaaatacgctgaagatgcagcagaattgaaatctattgctgatggtgtattgcctgccggatgggaaaaggctcttcccacatacacacctgaaactcccggtgatgccacaagaaacctttcacaaacaatgcttaacgctttggcaccagttctccctggtctcattggtggaagtgccgatcttgcttcatcaaacatgactctaatgaaaatgtttggtgatttccaaaaagccacacccgaagaacgcaatgtcaggtttggtgtccgtgaacacggtatgggagccatctgtaacggtatcgccctccacagccccgggttcatcccttactgtgctaccttctttgttttcactgattacatgagaggtgccataagaatctcagctttatcggaagctggtgtcatctacgtgatgacccacgactccattggtctaggagaagacggtcccacccatcagcccatcgaacatttagccagtttccgtgccatgcccaacatcttaatgttccgaccagctgacggtaacgagaccgctggagcttacaaggtcgcagttgagagccgaaaacgaccctcaatccttgctctttccagacaaaagctacccaacttgcccggaacttcaattgaaggaaccgcaaagggtggttacacaataaccgacaattctaccggaaacaaacccgatgttatcttgatcgcaactggttccgagctggaaattgcagctaaagctggtgatgaactcagaaaggaggggaaaaccgttagggtcgtgtcttttgtctcatgggagctttttgatgaacaatctgccgactaccaagaaagtgtccttccatcaagtgtaacagcccgtgtcagcattgaagctgcttcaactttcggatgggggaaaatcgttggaaccaaaggaaaggccatcggcatcgacaaattcggagccagtgcaccagcaccaaagatatacaaggaatacgggatcactgttgaagctgtggtcgcagcagctaaagaagttatataggccggtttgaacctgagatcaagttctgagctttggaaacttaacaaaagacgatggttgttagttttcaataatcttgattcataatgctcagacatacaataaaaagtcggttttttagtctttgatgctttcatggaataccttagctgtgaatcgaacgaagatcaagagagaagattaaatgttgaaagattgatgatgctctcacgaatttgtatcaaaatttaaacatattttttccaagttttgtgatttttatatgtttgattacctctgaggtgttcttttgagtaatgtacaattttacaacttataattgacactattattctgaatttttggagcatctatcttcttccttaatgaactctcaaagtctgttctaataatgtcaaatgacactaatgtatgttttttagtgtcttgtatgttggctatctatacaagataacacatggattttgaaatatatgatatgagacacaagtttaatcat

SEQ ID NO: 9140 - DNA, 2633 bp, Eutrema halophilum
aaaatgtgaaaaggcgtagaggatcatcgaaccagattgtgttccatttcgaatccaacggtcagtttttctttagcttgatttgtccgaggagttggcgagatctgattggttgactattctttctctctctctctctttaaagcagcaagtctcatgaaataagttgcacagaaagcttagtcttacgtttcttcatttcattagactctgagagcatccatggcttctacttcttcgtctctagcgatctctcaagctctccttggccgagccatctctcaaaatggctctgacaagtgcgtctctatcccagctttctctggtctcaaatccacttccccacgcaccaccttctccagtcgacgcatcgcctccacgaacagtcactccctacgccctctcgttcgtgcagccgccgtagagacgaagactgagtcgtccctggttgaaaaatcggttaacacgatcaggtttctggcgatcgatgcggtagagaaggcgaaatcgggtcatccgggtcttcccatgggttgtgctccgatgtctcacatattgttcgatgaggtcatgaggtataacccgaagaacccttactggtttaaccgtgatcgcttcgttctctccgctggacatggctgcatgctgcaatacgctctgcttcacctcgctggctacgacagcgtcagggaggaggatttgaagagcttccgtcaatggagaagtaagacgccaggacaccctgagaattttgagactcctggtgttgaagtcactactggtcctcttggacaaggtattgcaaatgctgttggtttagctcttgctgagaagcatctggctgctagattcaacaaacctgacaatgaaatcgttgaccactacacatattcgattcttggagatggttgtcagatggaagggataacaaatgaagtttgctctctggctggccactggggacttggaaagctcattgctttctacgatgacaatcacatttccattgacggagacacagaaattgccttgacagagagcgtggacaagcgctttgaagctcttggatggcatgttatttgggttaagaatggaaacaatggatatgatgatatccgtgctgccattaaggaagctaaggctgtaacagacaagccctctttgattaagatcactactacaattggttatggatctcccaacaaggcaaactcatacagtgctcacggagctgcccttggagagaaggaagttgaggctaccagacaaaaccttggatggccatatgagccgttccaggtacctgaggatgtcaaaagccattggagccgtcacactcccaaaggcgctgctcttgaagctgattggaatgccaagtttgcagcttatgagaagaagtacgcagaggaagcaagagaactaaaatctattatgtcaggggaattgcctgccggttgggagaaggcacttcctacatatacaccagattctccaggtgatgccactagaaacctgtctcagcaatgtcttaacgcacttgcgaaagttgtgcccggtttccttggcgggagtgctgaccttgcatcttccaacatgacattgcttaaagcatttggcgacttccaaaaagccacacctgaagagagaaacctccggtttggtgtaagggaacacggtatgggagctatctgcaacggcattgcccatcacagccccggtttgatcccttactgcgcaactttctttgtgtttactgactacatgagagctgcaatgagaatcgcggctctgtctgaaggtggtgttatatacgttatgacacatgactccattggtctgggagaagatggaccaacccatcaacccgttgaacacttgtccagtttccgtgccatgcccaatattctaatgttccgtcctgctgatggcaatgaaacagccggtgcatacaaaatcgctgtcactaaacggaagacaccttctgtcttagccttatctagacaaaagctgcaacaacttccaggaacatccattgaaagcgtcgagaaaggtggatacaccatttctgataactcaacaggtaacaaacccgatgtgatcttgatcggaactggatcagagctggagattgctgctcaagctgcagaggagttaaggaaagaaggcaaaactgtaagagttgtttcttttgtatgttgggaactgtttgatgagcaatcagatgcatacaaggaaagtgttttgccatctgatgtatcagctagagttagtatcgaagccggatcgacatttggatgggaaaagattgttggtggaaaaggaaaatcgattggaattgattcatttggggcaagtgcaccagcagggaagctttataaagagtttggtttcaccattgaagctgtggttgcagcagctaagtcacttatctaaagagaatcttccggtttgggtttggatttgatgtaagagacgatccacaagcattgtcctctttgtccaagtatgaaaaaacaaacgaattgttttcttgtaattcttggagagatatcatcataggtttggtttttgtaacaagtctttttgtactcatggctgatttaaataaaaataatgcagttgaacacttcaat

SEQ ID NO: 9141 - DNA, 2854 bp, Arabidopsis thaliana
agagaagctttctcttctattttctctctctcagttaaccagagagagcatcaatggcttctacttcttctctagcgctctcacaagctctccttacacgagccatctctcacaatggctctgaaaactgcgtctctataccagctttctctgctctcaaatccacttctccacgcaccagtggcaccatctcttcccgtcgacgcaacgcctccacgatcagtcactctctccgccctctggttcgtgcagccgccgtagaggcaatcgtgacaagttctgattcgtccctggttgataagtcggtgaacacgatcaggtttctggcaatagatgcggttgagaaggcgaaatcaggtcatccaggtcttcctatgggctgtgctccgatgtctcacattttgtacgatgaagtcatgaagtataaccccaagaatccttactggtttaaccgtgatcgtttcgttctctctgctggacatggatgcatgttgcaatacgctctgcttcaccttgctggctacgacagcgttagggaggaagatttgaagagcttccgtcaatggggaagtaagactccaggacatcctgagaattttgagactcctggtgttgaagccactactggtcctcttggacaaggtattgcaaatgctgttggtttagctcttgcggagaagcatttggctgctagatttaacaaacctgacaatgagattgttgaccactacacgtattcgattcttggagatggttgtcagatggaagggatttcaaatgaagtttgctctctagctggtcactggggacttggaaagctaatcgctttctacgatgacaatcacatttccattgatggagacacagatattgcttttaccgagagtgtggacaaacgctttgaagctcttggatggcatgttatctgggtaaagaatggaaacaatggttatgatgagatccgtgctgccattagggaagctaaggctgtaacagacaagcccactttgattaaggtcactactacaattggttatggttctcccaacaaggcaaactcatacagtgtccatggagctgcgcttggtgagaaggaagttgaggctacccgaaacaatcttgggtggccatatgagccgttccatgtacctgaggatgtcaaaagccattggagccgtcacacgcccgaaggggctgctcttgaagctgattggaatgccaaatttgcagcttatgagaggaaatatccggaggaagctgcagagttgaaatctattatctcaggtgaattgcccgttggttgggagaaggcacttcctacatatacaccagactctccgggtgatgccaccagaaacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttctgacaactcaaccggtaacaaacccgatgtgatcttgatcggaactggatcagagctagagattgctgctcaagctgcagagaagttaagggaacaaggcaaaagtgtgagagttgtttcctttgtatgttgggagcttttcgacgagcaatcagatgcatacaaggaaagtgttttgccatctgatgtatcagctagagttagtatcgaagctggatcgacttttggatggggaaagatcgtcggaggaaaagggaaatcgattggaattgatacgtttggagcaagtgcaccagcaggaaagctttataaagagtttggtatcaccattgaagctatggttgaagcagccaagtcacttatttaaaaaagtatcttacaggtactaccgaggtttgcatttgaagtaagagacattccataagcattatcttctttgtccaaataaaaatatactccttccaatctttttataaatgatgtttaaagctttcattttggtttttaaataaatgatgttttaaattttcaatgcaaaattatttttattggttgattaaataaatgatgttttaggcttttatttatatttttattgttttcttgtaattaacatagttttgatctttgtaaacaacaactctattgtacttttattcttgattagttgattttatttcgcaaagacatgtaatccttacatgttaattgcaatcgtctcaactagtcttacatctactttgtagtctaattggttggcacaaaaggaatttacggaattctgtctagaatctttccatttttgcttacaaatatggcacaaccggaaattcccttatttatttatggaaaaacaaaagtgtcatgtgttatatatattggtccctttttatgtttgtagggctatcactaccaatccacaatggaagattcacaaccgtg

SEQ ID NO: 9142 - DNA, 2583 bp, Brassica napus
taaaaattagctaaagacacagagcatcactaaactcttaccctcgttcaacgccacgatgaaaccttcgatcatattcaacggtcagatcggatcctccatcatcatcatctctaactcataaaaacaaagtttgcagagtctctcatttcatttcttcttcaccaccctcaatggcttcaacttcctccctcgctctctctcaagccctcctcgctcgcgccatctcccaccatggctctgaccaacgcatctccttaccatcacctttctcacgcgcctccgcctcctcccgccgccgcagcaacgccgccacgaccaaaccccgctctctccgccccctcgttgttcgcgccgcggccgtggatacgctagagccgaccaccgacgcctctatcgtggacaaatctgtgaacacgatcaggttcttggccatcgacgcggtggagaaggcgaagtcgggtcatccgggtcttcccatgggatgtgctcccatggctcacattctctacgacgaggtcatgaggtataaccccaagaacccttactggttcaaccgtgaccggttcgttctctctgctggtcatggttgtatgttgctttacgccttgcttcacctcgctggatacgacagcgtattggaggaggatttgaagagtttcagacaatggggaagcaagacaccagggcatcctgagaatttcgagactcctgggattgaagtcactactggtcctcttggacaagggattgctaatgctgttggtttagctcttgctgagaagcatttagctgctaggttcaacaaacctgatgctgaagtcgtcgaccactacacgtatgtgattcttggagatggttgtcagatggagggtatttcaaacgaagctgcctctctagctggtcactggggacttggaaagctcattgctttctacgatgacaatcacatttccattgatggagataccgagattgcctttactgagaacgtggaccagcgttttgaagcccttggatggcatgttatctgggtgaagaatggtaacactgggtatgatgagatccgtgctgccattaaggaagctaaagctgttacagacaagcccacattgattaaggtcactactacaattggttatggatctcccaacaaggccaactcttacagtgtccatggagctgctcttggtgagaaggaagttgaggctaccagaaacaacctcggatggccctatgagccattcaaggtacctgatgaagttaaaagccactggagccgtcacacgcctgatggcaaagctcttgaatctgactggaatgcagcgttttcagcgtatgagaagaagtatccagaggaagctgcagagttgaaatctatcatcactggtgaattacctgctggttgggaaaaggcactaccaacatacacaccagagtctccaggtgatgccaccagaaacttgtcacagcaatgtctcaacgcccttgctaaagttgttcccggcttcctcggaggaagtgccgaccttgcatcttccaacatgacactcctgaaagcctttggcgacttccaaaaggcaacgcccgaagagagaaaccttaggtttggtgttagggagcatggaatgggagccatctgcaacggcattgctctccacagccctggtctcatcccttactgtgcaactttcttcgtcttcactgactacatgagaggtgccatgagaatctcagctttgtctgaagctggagtcatctacgtgatgactcatgactccattggtctcggagaagatggaccaacccatcagcccgttgagcacttggctagcttccgcgcgatgcccaacactctcatgttccgtcctgctgatggaaacgaaacagccggtgcgtacaagatcgctgtcacgaagcgcaagacgccgtctatcttggctttgtctagacaaaagcttcctcagcttccggggacttccattgaaggagtggagaagggtggatacacaatctctgacaactcgtcggggaacaaacctgatgtgatcttggttggaactggttcagagcttgagattgctgcacaggctgcggaggtgctgaggaaagaaggcaaaaccgtgagagttgtgtctttcgtctgctgggagctgtttgacgagcagacggatgagtacaaggagagtgtgttgccgtctggtgtgtctgctagagttagtattgaagcggcttcgactttcgggtgggggaagattgttggaggtgaagggaagtcgattggtattaattcgtttggggctagtgcaccagctcccttgctctacaaggagtttggtatcactgttgaagctgttgttgatgcggctaagtcattcttctaagtgagttaccatttcacaacattgtctcattgcctcaaaataaagtgcaaacaagacgcaaagactctcccctttctttttgtttttgtttcttgtaatgcgggtcaacataggttttgggtttgggaagaggagagagtagaaggcaatgtaaaactctctatgatcattcgtgtattgttgttataacttatatcgc

SEQ ID NO: 9143 - DNA, 2886 bp, Papaver somniferum
tatggtccatactatgccttttgaatatctaaggctctgcttcagtcagtcccctcttctcttcatcatcaccaaaaaccaacacgaagaggaacagaggataaaggaaaataaaataattcctttattccgataatagcctcaaccatggcagcatcttcatcacttacagtatcacaagccctagttggcagaaaaatctctggtattaacacttcctcgcgttctcaatcattacctggattcagtctaagtactttatcaggaagaacattgaaatcttcattgatatcatcgattgcatcatcaagatctaatcgggttaatacaccatcgttagcgagatctttggtggttcgtgctgcagctgttgagactttggaaaagacagatacagcattagttgataaatcagtgaatactattagatttctagcaattgatgctgttgagaaagctaattcaggtcatcctggtttacctatgggttgtgcacccatgggtcatattttgtacgatgaaaccatgagatataaccctaagaacccttactggtttaacagagatagatttgttctttctgctggtcacggttgtatgttgcagtatgctttgcttcatcttgctggttatgacagtgttacgacagaagatttgaagactttccgtcagtggggaagcaaaatccctggtcaccctgagaactttgagactcccggtgttgaagttactacaggtccccttggacaaggtattgctaatgctgttggattggcacttgcggagaagcacttggctgcccgtttcaacaagcctgacagcgagattgttgatcattacacgtactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatacccgttttgaaggtctaggatggcacgtaatttgggtgaagaatggcaacaatggttacgatgaaattcgtgctgccatcaaggaagcaaaggctgtcacagacaagcccactttgatcaaggtgactaccaccattggttttggttctccaaacaaggccaactcatacgccgtacacggtgctgcattgggttccaaagaggttgatgccacaaggaagaaccttgactggccatttgagcctttccacgtgccagaggatgttaagagccactggagccgccatactgctgaaggcgctgccctggaagctgaatggacagctaaatttgcagagtacgaaaagaagtactcagaggatgctgcagaatttaagtccatcatgactggtgaattccctgctggttgggagaaggctcttcctacttacactccagagatcccagctgatgccaccagaaacctatcccagacgtgccttaatgcacttgctccagtcctccccggtcttattggtggtagtgcagatcttgcttcctccaacatgaccttgatgaaaatgttcggagacttccaaaaggccactccagaagagagaaatgttcgatttggtgtcagagagcatgctatgggggccatctgtaacggaattgctcttcacagtcctggttttgtcccctactgtgcaaccttcttcgttttcaccgattacatgagaggtgccatgagaatttcagctttatctgaagctggagtcatttacgtcatgacccacgactctattggtcttggagaggatggtccaactcatcagcccatcgagcatttggcaagctttagagccatgcctaacattcttatgctccgtcccgctgacggaaacgagactgcaggatcatacaaggttgcagttgaaaacagaaagagaccctcaattcttgccctctcacgtcaaaagcttgcaaaccttccaggaacctccattgaaggagtcgccaagggaggttacacaatatcagacaactctacaggtaacaaaccagatgtcatcttgtgtgctactggttcagaattagaaattgctgaaaaggccgctggtgagctcaggaaggaaggaaaggcagttagggttgtttcttttgtttcctgggaattatatgacgagcagaccgacgaatacaaggagtctgttcttccagctgccgtcactgctagggttagtattgaggcaggttcaacattcggatggcacaagattatcggaagcaaaggaaaggctattggtgtcgacggtttcggagcaagtgcgcctgcaccaattatatacaaagagttcggcatcacatcagaggccgttatcgcagcagctaaatcagttatgtagattgttttctttgtccttttttcagctgaagcttatttgtcattttggtttttggatttctgctcttccaaatttagaagtgacaccggaggagagaggcctgtctttaagagtaattcgagttcagaaaaacagcctcgtgaacgaattataataataattataaaaagaatcaaaaaagcttccctgtttcgtccacagtagtttgtatcttcacattaactgatgaatcagagttgtcttattgaaattcatgagaaacaaaataatgtaccttcttttcacagtttctcttataggatccatttgttttatatcaattttatgcacaatttctacagggtcttttctttcatcttctatgtttccattttcttcatttagcaaataaaaggttgtcgcctctgaaccaggtcatggttggtgtctgtgcatatccagtccaattgtctagtattacagcaaggtttccttattcgtttttgtatatagtttggc

SEQ ID NO: 9144 - DNA, 2549 bp, Papaver somniferum
cgtgctctgagagcgccgacaccactatagctctgcggctcctctcttctaggaggcaaccaaccaacaagagagagagagaagaagaaaaaatatttcctttattccgataatagcctcaaccatggcagcatcttcatcacttacagtatcacaagccctagttggcagaaaaatctctggtattaacacttcttctcgttctcaatcattacctggatttagtctaagtactttatcaggaggagcattgaaatcttcattgatatcatcgattgcatcatcaagatctaatcgggttaatacaccatcgttatcgagatctttggtggttcgtgctgcagctgttgagactttggaaaagacagatacagcattagttgataaatcagttaatactattagatttctagcaattgatgctgttgagaaagctaattcaggtcatcctggtttacctatgggttgtgcacccatgggtcatattttgtacgatgaaactatgagatataaccctaagaacccttattggtttaacagagatagatttgttctttctgctggtcatggttgtatgttgcagtatgctttgctccatcttgctggttatgacagtgttacgacagaagatttgaagactttccgtcagtggggaagcaaaatccctggtcaccctgagaacttcgagactcccggtgttgaagtcactacaggtcctcttggacaaggtattgctaatgctgttggattggctcttgcggagaagcacttggctgcccgtttcaacaagcccgatagcgagattgttgatcattacacgtactgtattcttggagatggatgtcaaatggagggaattgcaaatgaagcttgttcactagctgggcattggggacttggaaagctgattgctttctatgatgataaccacatctccattgatggtgacaccgagatcgctttcacagagagtgtagatacccgttttgaaggtctagggtggcacgttatttgggtgaagaatggaaacaatggttatgatgaaattcgtgctgccatcaaggaagcaaaggctgtcacagacaagcccactttgatcaaggtgactaccaccattggttttggttctccaaacaaggcaaactcatatgccgtacacggtgctgcattgggttccaaagaggttgatgccacaaggaagaatcttgactggtcatatgagcctttccacgtgccagaggatgttaagagccattggagccgccatactgctgaaggcgctgccctggaagctgaatggactgctaaatttgcagagtatgaaaagaagtactcagaggatgctgcagaatttaagtccatcatgactggtgaattccctgctggttgggagaaggctcttcctacttacactccagagatcccagctgatgccaccagaaacctatcccagacatgccttaatgcacttgctccagtcctccccggtcttattggtggtagtgcagatctcgcttcctccaacatgaccttgatgaaaatgtttggagacttccaaaaggccactccagaagagagaaacgttcgatttggtgtcagagagcatgctatgggggccatatgtaacggaattgctcttcacagtcctggttttgtcccctactgtgcaaccttctttgttttcacagattacatgagaggtgccatcagaatttcagctttatctgaagctggagtcatttacgtcatgacccacgactctattggtcttggagaggatggtccaactcatcagcccatcgagcatttggcaagctttagagccatgcctaacattcttatgctccgtcctgctgatggaaacgagactgccgggtcatacaaggttgcagttgaaaacagaaagagaccctcgattcttgccctttcacgtcaaaagcttgcaaaccttccaggaacctccattgaaggagtcgccaagggaggttacacaatatcagacaactctacaggtaacaaaccagatgtcatcttgtgtgctactggttcagaattagaaattgctgaaaaggccgctggtgagctcaggaaggaaggaaagacagttagggttgtttcttttgtttcctgggaattatatgatgagcagaccgacgaatacaaggagtctgttcttccagctgccgtcactgctagggttagtattgaggcaggttcaacattcggatggcacaagattatcggaagcaaaggaaaggctattggtgtcgacggtttcggagcgagtgcccctgcaccaattatatacaaagagttcggcatcacatcagaagccgttattgcagcagctaaatcagttatgtagattgttttctttgtccttttttcagctgaagcttatttgtcattttggtttttggatttctgctcttccaaatctagaagtgacaccggaggagagaggcctgtctttaagagtaatttgagttcagaaaaacagcctcgtgaacgaattatgataataattaaaaaaagaacacagcaagcga

SEQ ID NO: 9145 - DNA, 2508 bp, Papaver somniferum
atcctttattccgataatagcctcaatcatggcagcatcttcatcacttacagtatcacaagccctagttggcagaaaaatctctggtattaacacttcttctcgttcacaatcattacctggattcagtctaagtactttatcaggaagaacattgaaatcttcattgatatcatcgattgcatcatcaagatctaatcgggttaatacaccatcgttatcgagatctttggtggttcgtgctgcagctgttgagactttggaaaagacagatacagcattagttgataaatcagtgaatactattagatttctagcaattgatgctgttgagaaagctaattcaggtcatcctggtttacctatgggttgtgcacccatgggtcatattttatacgatgaaaccatgagatataaccctaagaacccttattggtttaacagagatcgatttgttctttctgctggtcatggttgtatgttgcagtatgctttgcttcatcttgctggttatgacagtgttacgacagaagatttgaagactttccgtcagtggggaagcaaaatccctggtcaccctgagaacttcgagactcccggtgttgaagtcactacaggtcctcttggacaaggtattgctaatgctgttggattggctcttgcggagaagcacttggctgcccgtttcaacaagcccgatagcgagattgttgatcattacacgtactgtattcttggagatggatgtcaaatggagggaattgcaaatgaagcttgttcactagctgggcattggggacttggaaagctgattgctttctatgatgataaccacatctccattgatggtgacaccgagatcgctttcacagagaatgtagatacccgttttgaaggtctagggtggcacgttatttgggtgaagaatggaaacaatggttatgatgaaattcgtgctgccatcaaggaagcaaaggctgtcacagacaagcccactttgatcaaggtgactacgaccattggttttggttctccaaacaaggcaaactcatacgccgtacacggtgctgcattgggttccaaagaggttgatgccacaaggaagaaccttgactggccatttgagcctttccacgtgccagaggatgttaagagccattggagccgccatactgctgaaggcgctgccctggaagctgaatggacagctaaatttgcagagtatgaaaagaagtactcagaggatgctgcagaattcaagtccatcattactggtgaattccctgctggttgggagaaggctcttcctacttacactccagagatcccagctgatgccaccagaaacctatcccagacgtgccttaatgcacttgctccagtcctccctggtcttattggtggtagtgcagatctcgcttcctccaacatgaccttgatgaaaatgttcggagacttccaaaaggccactccagaagagagaaacgttcgatttggtgtcagagagcatgctatgggggccatatgtaacggaattgctcttcacagtcctggttttgtcccctactgtgcaaccttctttgttttcacagattacatgagaggtgccatcagaatttcagctttatctgaagctggagtcatttatgtcatgacccacgactctattggtcttggagaggatggtccaactcatcagcccatcgagcatttggcaagctttagagccatgcctaacattcttatgctccgtcctgctgacggaaacgagactgccgggtcatacaaggttgcagttgaaaacagaaagagaccctcaattcttgccctttcacgtcaaaagcttgcaaaccttccaggaacctccattgaaggagtcgccaagggaggttacacaatatcagacaactctacaggtaacaaaccaggtgtcatcttgtgtgctactggttcagaattagaaattgctgaaaaggccgctggtgagctcaggaaggaaggaaaaaccgttagggttgtttcttttgtttcctgggaattatatgatgagcagaccgacgaatacaaggagtctgttcttccagctgccgtcactgctagggttagtattgaggcaggttcaacattcggatggcacaagattatcggaagcaaaggaaaggctattggtgttgacagtttcggagcgagtgcccctgcaccaattatatacaaagagttcggcatcacatcagaagccgttattgcagcagctaaatcagttatgtagattgttttctttgtccttttttcagctgaagcttatttgtcattttggttttggatttctgctcttccaaatttagaagtgacaccggaggagagaggcatgtctttaagagtaatttgagttcagaaaaacagcctcgtgaacgaattatgataataattaaaaaaagaacaaaacaagcgaccttgtttcatctacagtagtttgtatcttcacattaactgatgaatcagagttgt

SEQ ID NO: 9146 - DNA, 2511 bp, Eutrema parvulum
ctactctctctctccatttctaaaataaaagcgcagagaagccttctccttcatttcgtcattagtctctatttcactctctcccaactaaccagagagcatccatggcttccacttcttctctagcgctctctcaagctctcctttctcgaaccatctctcacaatggctctgacaagcacgtctctttctcagctttttctggtctcaaatccacttccccacgcaccacctcttcctatcgacgcagcgcctccaggagcagtcactccctccgccctctcgttcgtgcagctgccttagagacaatcgggacaaccactgattctaccctggttgataaatcggttaatacgatcaggtttctggcgatcgatgcggttgagaaggcgaaatcgggtcatccgggtcttccaatgggttgtgctccgatgtctcacattttgtacgatgaggtcatgaggtataacccgaagaacccttactggtttaaccgtgatcgcttcgttctctccgctggacatggatgcatgttgcactacgctttgcttcacctcgctggctacgacagcgtcagggaggaagatttgaagagcttccgtcaatggggaagtaagacgccagggcaccctgagaatttcgagactcctggtgttgaagtcactactggtcctcttggacaaggtattgcaaatgctgttggtttagctcttgctgagaagcatctggctgctagattcaacaaacctgacaatgaaatcgttgaccactacacatattcgattattggagatggttgtcagatggaagggatttcaaatgaagtttgctctctggctggccactggggacttggaaagctcattgctttctacgatgacaatcacatttctattgacggagacacagagatcgcctttacagagaacgtggacaagcgctttgaagctctcggatggcatgttatttgggtaaagaatggaaacaatggatatgatgagatccgtgctgccattagggaagctaaggctgtaacagacaagcccactttgattaaggtcactactacaattggttatggatctcccaacaaggcaaactcatacagtgtccacggagctgcgcttggagagaaggaagttgaggctaccagaaataaccttggatggtcatatgagccgttccaggtacctgaggatgtcaaaagccattggagccgtcacatccctgagggcgctgctcttgaagttgattggaatgccaaatttgcagcttatgagaagaagtacccagaggaagcggcagagttgaaatctattatctcaggtgaattgcctgccggttgggagaaggcacttcctacatttacaccagagtctgcaggtgatgccaccagaaacctgtctcagcaatgtcttaacgcccttgcgaaagttgtgcccggtttccttggcgggagtgctgaccttgcatcttccaacatgacattgcttaaagcattcggcgacttccaaaaagccacacctgaaggaagaaacctaaggtttggtgtcagggaacacggtatgggagctatctgcaacggcattgcccttcacagccccggttttattccttactgcgcaactttctttgtgtttactgactacatgagagctgcaatgagaatcgcggctctgtctgaaggaggtgttatatacgttatgacacatgactccattggtctgggagaagatggaccaacccatcaacccgttgaacacttgtccagtttccgtgccatgcccaatattctaatgttccgtcctgctgatggcaatgaaacagccggtgcatacaaaatcgctgtcactaaacggaagacaccttctgtcttagccttatctagacaaaagctgcaacaacttccaggaacatccattgaaaacgtcgagaaaggtggatacaccatttctgataactcaaccggtaacaaacccgatgtggtcttgattggaactggatccgagctagagattgctgctcaagctgcagagaagttaaggaaagaaggcaaaactgtaagagttgtttcttttgtatgttgggaactgtttgatgagcaatcagatgcatacaaggaaagtgttttgccatctgatgtatcagctagagttagtatcgaagccggatcgacatttggatgggaaaagattgttggtggtaaagggaaatcgattggaattgattcatttggggcaagtgcaccagcagggaagctttataaagagtttggtttcaccattgaagctgtggttgcagcagctaagtcacttatctaaagagaatcttccggtttgggtttggatttgatgtaagagacgatccacaagcattgtcctctttgtccaagtatgaaaaaacaaaaaattgttttcttgtaattctgagagagatcatcataggtttggtttttgtaacaagtctttttgtactcatggctgatttggttcacaattatgcagtagcaca

SEQ ID NO: 9147 - DNA, 2883 bp, Chrysanthemum coronarium
agatcttttataaaaaccaatccaaaggtccaaatttctcttgttcatctcaaccaccccattttcatcccccctcatctttacaaataacacaaaccccatctttttattccttcaaactcttctttctaaaaccaaaccaaaagagccatggcttctctcactctctcccaagctgctctcacacgcgccaccgtcacgcgccatggctcttccaccaccacaccccaacaacccacctctctctcaactctccaaatacccactttctcaggcttgaaatccaccccacccacctcctcacgcgctcccacgcgccgtcatgtctccgccacgcgccggcgcgtggtcacaaacgccgccgtggaaactcttgaaaagaccgacaccgcacttgtggacaagtctgtgaacactatcaggttcttggctattgatgctgttgagaaagcgaattcgggtcatccgggtttgcccatgggttgtgcacccatgggtcatattttgtatgatgaggttatgaggtataacccaaagaacccttattggtttaacagagatcggtttgttttgtctgctggtcatggttgtatgcttcagtatgctcttcttcatcttgctggttatgatgctgtcacaacggaggacttgaagcaattccgtcagtggggaagcaagactcctggtcaccctgagaacttcgaaactcccggagttgaagttaccactggtcctcttggtcaaggtattgccaatgctgttggtcttgctcttgctgagaagcatttggctgcaagatacaacaaacccgatgccgagattgttgaccactacacatactgtattcttggagatggttgtcaaatggaaggtattgcaaacgaagcatgttcacttgctggacattggggacttggaaagttgattgctttctacgatgacaaccacatttccattgatggtgacaccgagattgcctttactgaaagcgttgacacacgttttgaggctcttgggtggcacatcatttgggtgaagaacggtaacactggttatgatgagatccgtgctgccattaaggaagccaaggctgtgactgataagcccactttgatcaaggtgacaacaacaatcggttttggatcaccaaacaaggccaactcatacagtgtccacggagcagctttgggtgcaaaagaagtagatgcaaccagacaaaaccttggatggccttatgagccattccatgtaccagatgatgtcaaggcacattggagccgccacacccctgaaggtgctgctcttgaagctgaatggaatgctaaatttgcagagtacgagaagaaatacgctgaagatgcagcagaattgaaatctattgctgatggtgtattgcctgctggatgggaaaaggctcttcccacatacacacctgaaactcccggtgatgccacaagaaacctttcacaaacaatgcttaacgctttggcaccagttctccctggtctcattggtggaagtgccgatcttgcttcatcaaacatgactctaatgaaaatgtttggtgatttccaaaaagccacacccgaagaacgcaatgtcaggtttggtgtccgtgaacacggtatgggagccatctgtaacggtatcgccctccacagccccgggttcatcccttactgtgctaccttctttgttttcactgattacatgagaggtgccataagaatctcagctttatcggaagctggtgtcatctacgtgatgacccacgactccattggtctaggagaagacggtcccacccatcagcccattgaacatttagccagtttccgtgccatgcccaacattttaatgttccgaccagctgacggtaacgagaccgctggagcttacaaggtcgcagttgagagccgaaaacgaccctcaatccttgctctttccagacaaaagctacccaacttgcccggaacttcaattgaaggaaccgcaaagggtggttacacaataaccgacaattctaccggaaacaaacccgatgttatcttgatcgcaactggttccgagctggaaattgcagctaaagctggtgatgaactcagaaaggaagggaaaaccgttagggtcgtgtcttttgtctcatgggagtctttttgatgaacaatctgccgattaccaagaaagtgtccttccatcaagtgtaacagcccgtgtcagcattgaagctggttcaacttttggatgggggaaaatcgtcggaaccaaaggaaaggccatcggtatcgacaaattcggagccagtgcaccagcaccaaagatttacaaggagtacgggatcactgttgaagctgtggtcgcagcagctaaagaagttatataggccagtttgaactcgaggtcaagttctgagctttggaaacttaacagaaaacgatcgttgttagttttcagtaatcttgattcataatgctcagacaaaacaataaaaagtcggttttttagtctttgatgctttcatggaataccttagctgtgaatcgaacgaagatcaagagagaagattaaatgttgaaagattgatgatgctctcacgaatttgtatcaaaatttaaacatattttttccaagttttgtgatttttatatgtttgattacctctgaggtgttcttttgagttatgtacaattttacaacttataattgacactattattctgaatttttggagcatctatcttcttccttaatgaactctcaaagtctgttctaataatgtcaaatgacactaatgtatgttttttagtgtcttgtatgttggctatctatacaagataacacatggattttgaaatatatgatatgagacacaagtttaatcat

SEQ ID NO: 9148 - DNA, 2445 bp, Brassica oleracea
tccttccgagagcgagaaaccataatccaatggcttcaacttcctccctcgctctctctcaagccctcctcgctcgcgccatctcccaccatggctctgaccaacgcatctccttaccatcacctttctcacgcgcctccgcctcctcctctcgccgccgcaacaacgccgccgcgtccacgaccaaactccgctctctccgccctctcgctgttcgcgccgcggccgtcgatacgctagagccgaccaccgacgcctctatcgtggacaaatctgtgaacacgatcaggttcttggccatcgacgcggtggagaaggcgaagtcgggtcatccgggtcttcccatgggatgtgctcccatggctcacattctctacgacgaggtcatgaggtataaccccaagaacccttactggttcaaccgtgaccggttcgttctctctgctggtcatggttgtatgttgctttacgccttgcttcacctcgctggatacgacagcgtattggaggaggatttgaagagtttcagacaatggggaagcaagacaccagggcatcctgagaatttcgagactcctgggattgaagtcactactggtcctcttggacaagggattgctaatgctgttggtttagctcttgctgagaagcatttggctgctaggttcaacaaacctgatgctgaagttgtcgaccactacacgtatgtgatccttggagatggttgtcagatggagggtatttcaaatgaagctgcctctctagctggtcactggggacttggaaagctcattgctttctacgatgacaaccacatctctattgatggagataccgagattgcattcactgagaatgttgaccagcgttttgaagctcttggatggcatgttatctgggtgaagaatggtaacactgggtatgacgagatccgtgctgctattaaagaagctaaagctgttacagacaagcctacattgattaaggtcactactacaattggttatggatctccaaacaaggcgaactcatacagtgtccatggagctgctcttggtgagaaggaagtcgaggctaccagaaacaaccttggatggccgtatgagccattcaaggtacctgatgaagttaaaagccactggagccgtcacacgccagatggcaaagctcttgaatctgactggaatgcatcatttgcagcgtatgaaaagaagtacccagaggaagctgcggagttgaaatctatcatcactggtgaattacctgctggctgggagaaggcactaccaacatacacaccagagtctccaggtgacgccacaagaaacttatcacagcaatgtctcaacgccctagctaaagtcgtccccggcttcctcggaggaagtgctgaccttgcatcttccaacatgacactgctaaaagcctttggtgacttccaaaaggcaacacccgaagagagaaaccttaggtttggtgttagggagcacggaatgggaggcatctgcaacggcattgctcttcacagccctggtctcatcccttactgtgcaactttcttcgtcttcactgactacatgagaggcgcgatgagaatctcagctttgtctgaagctggagtcatctacgtgatgactcatgactccattggtctcggagaagatggaccaacccatcagcccgttgagcacttggctagcttccgcgcgatgcccaacactctcatgttccgtcccgctgatggaaacgaaacagccggtgcgtacaagatcgctgtcaccaagcgcaagacaccgtctatcttggctctgtctagacaaaagcttcctcagcttccggggacatccatcgaaggagttgagaagggtggatacacgatctctgacaactcgtctggaaacaaacctgatgtgatcttggttggaactggttcagagcttgagattgctgctcaggctgcggaggtgctgaggaaagaaggcaaaaccgtgagagttgtgtctttcgtctgctgggagctgtttgacgagcagacggatgagtacaaggagagtgtgttgccgtctggtgtgtctgctagagttagtattgaagcggcttcgacttttggatgggggaagattgttggaggtgaagggaagtccattggtattaattcgtttggggctagtgcaccagctccattgctctacaaggagtttggtatcactgttgaagctgttgttgatgcggctaagtcattcttctaagtgactttaccatttcacaacattgtctcactacctcaaaataaagtgcaacaagacgcaaagagactcttcgttcttttttttgtttcttgtaatgcgggtcaagataggttttgggtttgggaagaggagaaagtagaagacaatgtaaaactctctatgatcagttgtgtattgttgttatatgctttgagtt

SEQ ID NO: 9149 - DNA, 2294 bp, Panax ginseng
atactccattagatatagagagagaaagctcaactcctctgccacctaaatctctctacccatggctgctgcttcgtcatctttatctccctcccaatccctcatctcccgctctatcccaaacaaccatggctccacacagcagcattctgatcgtctcgcccttcctgggatcaatctcagctccatttccgcaaccagaaccctctcacacgtctcacgcgccgtcatacagtctcggagagtgggattacgcgcatccgtgagggcttcggtggtggcggagactctagagaagacagataccgcattagtggagaaatcagtcaacacgatccggttcctagctatcgatgcggtcgagaaggcaaattctggtcacccgggtctgcccatggggtgtgctccgatgggtcacgtgttgtacgatgaggttatgaggtataacccgaaaaatccatattggttcaaccgtgatcggtttgtgctctcggctggacatgggtgtatgttacagtatgcactacttcacctggctggctacgacagtgtcaaggaagaagacttgaaaagtttccgacagtggggaagcaaaacacctggtcaccctgaaaactttgagacacctggcattgaagtcaccactggtccccttggtcagggtgttgctaatgcggttggtttggcccttgctgagaagcatttagctgctcgatataacaaacctggcaatgagattgttgatcactacacgtatgtgatacttggggatggatgtcaaatggaaggaatttcaaatgaagcttgctcccttgctagtcactggggacttggaaagctgattgcattctatgatgacaaccacatttcaatcgatggtaacactggtattgcattcacagagagtgttgataagcgctttgaaggactcggttggcatgttatatgggtgaagaatggtaacactggatatgatgagatccgtgctgccattgaggaagctaaggcagttaaagataaacctactttaatcaaggtcacaactaccattggttttgggtcacctaacaaggcaaactcatatagtgtacatggtagtgcattgggtgccaaagaagtggatgccacaaggaagaaccttggatggtcacatgagccattccatgtgccagaggatgttagaaagcactggagccaccacaccactaaaggagctgctttggaagctgaatggaatgccaagtttgcagagtatgagaagaactacaagggtgaagcaaaagaattgaaatctcttattactggtgaacttcctactggttgggaaaaagcgcttccgacgtatactcctgaaagtccagcagatgccactcgtaatctgtctcagacaaatctcaatgcccttgcaaaagttcttcctggacttcttggaggaagtgcagaccttgcttcttccaatatgacactgctcaaaatgtttggtgactaccaaaaggacacccctgaggaacgtaatgtacgatttggggttagggaacatggaatgggtgccatttgtaacgggattgctctccacagccccggccttattccctactgtgctaccttctttgttttcacagactacatgcgagcagccatgaggctttctgcattgtgtgaagctggagtcatttacgtgatgactcatgattccatcgggcttggagaggatgggccgactcatcaacctattgagcatttggcaagcttccgagccatgccaaacatcctaatgctccgaccagctgatggaaacgagactgctggtgcatacaaggttgcagttctcaacagaaagagaccctccgttcttgccctctctcgtcaaaagcttcctaatcttacgggaacatcaattgaaggagttgagaaaggtgggtatattatttctgataactcctcaggtaacaagccagagataattttgataggaactggttccgaattggaaattgctgcaaaagcagctgatgagctcaggaagggtggaaagactgtacgagttgtgtcctttgtttcttgggagttgttcgatgaacaatctgatgcatataaggaaagtgtactgccagctggtgtatcggctagggtcagtattgaggctggatcaacatttgggtgggacaagatcgtgggatccgagggtaaggcgattgggatagatcattttggagcaagtgcaccggcagataagatatataaagaatttggattaactgtagaagctgtgataacagcagccaaagcagtgt

SEQ ID NO: 9150 - DNA, 2664 bp, Papaver somniferum
catcatcaccaaaacccaacaagaagaggaacagaggagaaaggaaaaaaataaatcgtttattccgataatagactcaaccatggcagcatcttcatcacttacagtatcacaagccctagttggcagaaaaatctctggtattaacacttcttctcgttctcaatcattacctggattcagtctaagtactttatcaggaagaacattgaaatcttcattgatatcatcgattgcatcatcaagatctaatcgggttaatacaccatcgttatcgagatctttggtggttcgtgctgcagctgttgagactttggaaaagacagatacagcattagttgataaatcagtgaacactattagatttctagcaatcgatgctgttgagaaagctaattcaggtcatcctggtttacctatgggttgtgcgcccatgggtcatattttgtacgatgaaaccatgagatataaccctaagaacccttattggtttaacagagatagatttgttctttctgctggtcacggttgtatgttgcagtatgctttgcttcatcttgctggttatgacagtgttacgacagaagatttgaagactttccgtcagtggggaagcaaaatccctggtcaccctgagaacttcgagactcccggtgttgaagtcactacaggtccccttggacaaggtattgctaatgctgttggattggctcttgcggagaagcacttggctgcccgtttcaacaagcctgacagcgagattgttgatcattacacgtactgtattcttggagatggatgtcaaatggagggaattgcaaatgaagcttgttcactagctgggcattggggacttggaaagctgattgctttctacgatgacaaccacatctctattgatggtgacacagagattgctttcacagagagtgtagatacccgttttgaaggtctaggatggcacgtaatttgggtgaagaatggtaacaatggttacgatgaaattcgtgctgccatcaaggaagcaaaggctgtcacagacaagcccactttgatcaaggtgactaccaccattggttttggttctccaaacaaggcaaactcatacgccgtacacggtgctgcattgggttccaaagaggttgatgccacaaggaagaaccttgactggccatttgagcctttccacgtgccagaggatgttaagagccactggagccgccatactgctgaaggcgctgccctggaagctgaatggacagctaaatttgcagagtacgaaaagaagtactcagaggatgctgcagaatttaagtccatcatgactggtgaattccctgctggttgggagaaggctcttcctacttacactccagagattccagctgatgccaccagaaacctatcgcaaacgtgccttaatgcacttgctccagtccttcccggtcttattggtggtagtgcagatcttgcttcctccaacatgaccttgatgaaaatgttcggagacttccaaaaggccactccagaagagagaaatgttcgatttggtgtcagagagcatgctatgggggccatctgtaacggaattgctcttcacagtcctggttttgtcccctactgtgcaaccttctttgttttcaccgattacatgagaggtgccatgagaatttcagctttatctgaagctggagtcatttacgtcatgacccacgactctattggtcttggagaggatggtccaactcatcagcccatcgagcatttggcaagctttagagccatgcctaacattcttatgctccgtcccgctgacggaaacgagactgcaggatcatacaaggttgcagttgaaaacagaaagagaccctcaattcttgccctctcacgtcaaaagcttgcaaatcttccaggaacctccattgaaggagtcgccaagggaggttacacaatatcagacaactctacaggtaacaaaccagatgtcatcttgtgtgctactggttcagaattagaaattgctgagaaggccgctggtgagctcaggaaggaaggaaagacagttagggttgtttcttttgtttcctgggaattatatgatgagcagaccgacgaatacaaggagtctgttcttccagctgccgtcactgctagggttagtattgaggcaggttcaacattcggatggcacaagattatcggaagcaaaggaaaggctatcggtgttgacggtttcggagcaagtgcgcctgcaccaattatatacaaagagttcggcatcacatcagaggccgttatcgcagcagctaaatcagttatgtagattgttttctttgtccttttttcagctgaagcttatttgtcattttggtttttggatttctgctcttccaaattcagaagtgacaccggaggagagaggcctgtctttaagcgtaatttgagttcagaaaaacagcctcgtgaacgaattataataataattaaaaaaagaacaaaaaaagcgaccttgtttcatctgcagtagtttgtatcttcacattaactgatgaatcagagttgtcttattgaaattcatgagaaacaaaataatgtaatgtctttcacagtttctcttgtaggatccattagttttatatcaattttatgcagaaattccgagtc

SEQ ID NO: 9151 - DNA, 2504 bp, Helianthus annuus
ctctcatcacctttctctctctaaccaagagccatggcttctctcactctctcccatgccgccctcgtcccccgccatggctcttccacccccacccccaccgtctcaatcccagccttcaccggactcaaatccacctccgcacgcgcctccacgcgcggacaagtttccgccacgcgccgtcaggttgcacccacgcgccgccgcgtgatcgtcaacgcggctgtggagacgttgcagaagacggatactgctttggtggagaagtcgattaatactattaggtttttggcgattgatgcggttgagaaagcgaattcgggtcatcctggtttgcccatgggttgtgcgcccatgggtcatatattgtatgatgagattatgaggtataacccgaagaacccgtattggtttaacagagatcggtttgttctttctgctggtcatggatgtatgcttcagtatgctctgcttcatcttgctggatatgatgctgttaaagaagaagacttgaagcaattccgtcaatggggaagcaaaactccgggccatcctgagaactttgaaactcctggtgttgaagtcaccactggtcctcttggtcaaggtattgccaacgctgttggtcttgctcttgccgagaagcatttggccgctcgttacaacaaacctgatgccgagattgtcgaccactacacatactgtattcttggagatggttgccaaatggaaggaattgcaaacgaagcatgttcacttgccggccattggggactcggaaagttgattgctttctatgacgacaaccacatctccattgacggtgacaccgagatcgccttcaccgagaacgttgacaaacgttttgaagctcttgggtggcacgtcatttgggtgaagaacggtaacactggttacgatgagatccgtgctgccattcaagaagccaaggccgtgaccgataagcccactacgatcaaggttacaacaacaattggtttcgggtcaccgaacaaggcgaactcatacagtgtccatggagctgcgttgggtgcgaaagaagtagacgcaacccgacaaaacctcggatggccttacgagccattccacgtacccgatgaagttaaaaagcactggagccgccacacccctgacggtgccgctcttgaagccgaatggaatgctaaatttgcagcttacgagagtaagtatcccgaagaagccgctgaattgaaatctattgttaccggtgtattgcctgcaggatgggagaaggctcttccgacatacacaccagaaacacccggtgatgctacaagaaatctttcgcaaacaatgcttaatgcattagcaccagttctacccggtctcattggtggaagtgcggatcttgcatcttcaaacatgacgttaatgaaaatgttcggtgatttccaaaaagccacacccgaagaacgcaacgttcgtttcggtgtccgggaacacggtatgggagctatttgtaacggtatcgctcttcacagccccgggttcgttccttactgtgctacgttctttgtcttcaccgattacatgagaggtgctatgagaatctcggctttatcagaagcaggagtcatttatgtaatgacccatgactccattggtctaggagaagacgggccgacccatcagcccattgaacatctagccagtttccgggccatgcccaacatcttgatgttccgaccagctgacggtaacgaaacagccggagcttacaaggttgcagtcgaaagccgaaaacgaccatcggttcttgctctttctaggcaaaaactacccaacctacccggaacttcaatcgaaggaaccacgaaaggtgggtacacgataaccgacaactcaacaggcaacaagcccgatgttatcttgatcggaactggttctgagctcgaaatcgcggttaaagccgccgatgaactcagaaaagaagggaaaacggtccgggttgtgtcgtttgtgtcatgggagcttttctatgaacaatccgatgaatacaaggaaagcgttctcccatcgggtgtgaccgctcgtgtcagcattgaggctggatcaactttcggttgggatagaattgttggaagcgcgggaaaagctatcgggattgacaaatgggggtcgagtgcgccagctggaaagatctacaaggaatatggtattaccgttgaagctgtgattgcggctgctaaacaagtgtgttaggcttgtatcttgattcgtaatggttgaacgaacaataagaagtcggttttttagtctttgatgcatttcagcgaacaccttacttgcgaatcgaacgaaaaatcagaagagaggattagaagttgaatgtttgatgctctttcctcctttatttgtaccaaaactgaaacataattttcaaagttttgtgatttgtttggttactagtgaggtgttcttttgagtaatgtacaattttacaagttatcataagattatta

SEQ ID NO: 9152 - DNA, 2516 bp, Brassica rapa
agagtctctcatttcatttcttcttcaccactctcaatggcttcaacttcctccctcgctctctctcaagccctcctcgctcgcgccatctcccaccatggctctgaccaacgcatctccttaccatcacctttctcacgcgcctccgcctccgcctcctctcgccgccgcagcaacgccgccacgaccaaaccccgctctctccgccccctcgttgttcgcgccgcggccgtggatacgctagagccgaccaccgacgcctctatcgtggacaaatctgtgaacacgatcaggttcttggccatcgacgcggtggagaaggcgaagtcgggtcatccgggtcttcccatgggatgtgctcccatggctcacattctctacgacgaggtcatgaggtataaccccaagaacccttactggttcaaccgtgaccggttcgttctctctgctggtcatggttgtatgttgctttacgccttgcttcacctcgctggatacgacagcgtattggaggaggatttgaagagtttcagacaatggggaagcaagacaccagggcatcctgagaatttcgagactcctgggattgaagtcactactggtcctcttggacaagggattgctaatgctgttggtttagctcttgctgagaagcatttagctgctaggttcaacaaacctgatgctgaagtcgtcgaccactacacgtatgtgattcttggagatggttgtcagatggagggtatttcaaacgaagctgcctctctagctggtcactggggacttggaaagctcattgctttctacgatgacaatcacatttccattgatggagataccgagattgcctttactgagaacgtggaccagcgttttgaagcccttggatggcatgttatctgggtgaagaatggtaacactgggtatgatgagatccgtgctgccattaaggaagctaaagctgttacagacaagcccacattgattaaggtcactactacaattggttatggatctcccaacaaggccaactcttacagtgtccatggagctgctcttggtgagaaggaagttgaggctaccagaaacaacctcggatggccctatgagccattcaaggtacctgatgaagttaaaagccactggagccgtcacacgcctgatggcaaagctcttgaatctgactggaatgcagcgttttcagcgtatgagaagaagtatccagaggaagctgcagagttgaaatctatcatcactggtgaattacctgctggttgggaaaaggcactaccaacatacacaccagagtctccaggtgatgccaccagaaacttgtcacagcaatgtctcaacgcccttgctaaagttgttcccggcttcctcggaggaagtgccgaccttgcatcttccaacatgacactcctgaaagcctttggcgacttccaaaaggcaacgcccgaagagagaaaccttaggcttggtgttagggagcatggaatgggagccatctgcaacggcattgctctccacagccctggtctcatcccttactgtgcaactttcttcgtcttcactgactacatgagaggtgccatgagaatctcagctttgtctgaagctggagtcatctacgtgatgactcatgactccattggtctcggagaagatggaccaacccatcagcccgttgagcacttggctagcttccgcgcgatgcccaacactctcatgttccgtcctgctgatggaaacgaaacagccggtgcgtacaagatcgctgtcacgaagcgcaagacgccgtctatcttggctttgtctagacaaaagcttcctcagcttccggggacttccattgaaggagtggagaagggtggatacacaatctctgacaactcgtcggggaacaaacctgatgtgatcttggttggaactggttcagagcttgagattgctgcacaggctgcggaggtgctgaggaaagaaggcaaaaccgtgagagttgtgtctttcgtctgctgggagctgtttgacgagcagacggatgagtacaaggagagtgtgttgccgtctggtgtgtctgctagagttagtattgaagcggcttcgactttcgggtgggggaagattgttggaggtgaagggaagtcgattggtattaattcgtttggggctagtgcaccagctcccttgctctacaaggagtttggtatcactgttgaagctgttgttgatgcggctaagtcattcttctaagtgagttaccatttcacaacattgtctcattgcctcaaaataaagtgcaaacaagacgcaaagactctcccctttctttttgttttttgtttcttgtaatgcgggtcaacataggttttgggtttgggaagaggagagagtagaaggcaatgtaaaactctctatgatcattcgtgtattgttgttataacttatatcgcttgagtttcagcaaactttcaccgctatttcttggtgtgtaacagacaaaagtgacttaccta

SEQ ID NO: 9153 - DNA, 2739 bp, Chrysanthemum coronarium
agagccatggcttctctcactctctcccaagctgccctcacacgcgccaccgtcacgcgccatggctcttcctcccccactccccacgcgccacattccctctcttctctccaaatacccactttctccggcttaaaatcctccaccgtagccacctcacgcgctcccacgcgccgtcatgtctccgccactcgcaggcgcgtggtcacaaacgcggccgtagaaacccttgaaaagaccgacacagcacttgtggacaagtcggtgaacaccatcaggttcttggcgattgacgctgttgagaaagcgaattctggtcatcctggtttgccaatgggttgtgcacccatgggtcatattttgtatgatgaggttatgaggtataacccaaagaacccttattggtttaacagagatcggttcgttttgtctgctggtcatggttgtatgcttcagtatgctcttcttcatcttgctggttatgacgctgttacaacggaggatttgaagcaattccgtcaatggggaagtaagactcctggtcatcctgagaactttgaaactcccggagttgaagttaccactggtcctcttggtcaaggtattgccaatgctgttggtcttgctcttgctgagaagcatttggctgccagatacaacaaaccagatgccgagattgttgaccactacacatactgtattgttggagatggttgtcaaatggaaggtattgcaaatgaagcgtgttcacttgctggacattggggacttggaaagttgattgctttctacgatgacaaccacatttccattgatggtgacaccgagattgcctttactgaaagtgttgacacacgttttgaggctcttgggtggcacatcatttgggtgaagaacggtaacaccggttatgatgagatccgtgctgccattcaggaagccaaggctgtgactgataagcccactttgatcaaggtgacaacaacaatcggttttggatcaccaaacaaggccaactcatacagtgtccacggagcagctttgggtgcaaaagaagtagacgcaaccagacaaaaccttggatggccttatgagccattccatgtacctgatgatgtcaaggcacactggagccgccacactcccgagggtgctgctcttgaagcggaatggaatgctaaattcgcagagtacgagaagaagtatgctgaagatgcagcagagttgaagtctattgctgatggtgtattgcctgccggatgggagaaagctcttcccacatacacaccggaaactcctggtgacgccacaagaaacctttcacaaacaatgcttaacgcattggcaccggttctccctggtttcattggtggaagtgcagatcttgcctcatcgaacatgactttaatgaaaatgtacggtgatttccaaaaagctacacccgaagaacgcaacgtcaggtttggtgtccgtgaacacggtatgggagccatctgtaacggaattgccctccacagccctgggttcatcccatactgtgctaccttctttgttttcactgattacatgagaggtgccatgagaatctcagctttatcagaagccggtgtcatctacgtgatgacccacgactccattggtctaggagaagacggtcccacccatcagcccattgaacatttagccagtttccgtgccatgcccaacatcttaatgttccgaccagccgacggtaatgagaccgctggagcttacaaggtcgcagttgagagccgaaaacgaccctcagtccttgctctttctagacaaaagctgcccaacttgcaaggaacttcaattgaaggaaccgcaaagggtggttacacaataaccgacaattctaccggaaacaaacccgatgttatcttgatcggaactggttctgagctagaaattgcagctaaagctgccgatgaactcagaaaggaagggaaaaccgttagggttgtgtcttttgtctcatgggagctttttgatgaacaatctgccgactaccaggaaagtgttcttccatcaagtgtaacagcccgtgtcagtattgaagctgcaacaactttcggatgggcgaaaatcgttggaagcaaaggaaaggccatcggtattgacaaattcggagccagtgcaccagcaggaaagatttacaaggagtatggaatcactgttgaagctgtggtcgcagcagccaaagaagttatataggccgttttgaaccagagatcaagttctgagctttggaaacttgcaaaaagacgatccttgttagttttctgtaatcttgattcataatgctcagacaaacaataaaaagtcggttttttagtctttgatgctttcatggaataccttagctgtaaatcgaacgaagatcaagagagaagattagaagttgaaagattgacgatgctctcacaaatttgtatcaaaattaaaacatattttttccaagttttgtgatttttgtatgtttgattacctctgaggtgttcttttgagtactgtacaattttacaacttataacgacactatattattctgaatttttggagcatctagcttcttccttaatgaactctcaaagtctgttctaataatgtcaaatgacactaatgtatgttttttagtgtcttgtatgttggctatctatacaagataacacatggattttgaaatatatgatatgagacacaagtttaatcata

SEQ ID NO: 9154 - DNA, 2401 bp, Panax ginseng
tatagagagagaaagctcaactcctctgccacctaaatctctctacccatggctgctgcttcgtcatctttatctccctcccaatccctcatctcccgctctatcccaaacaaccatggctccacacagcagcattctgatcgtctcgcccttcctgggatcaatctcagctccatttccgcaaccagaaccctctcacacgcctcacgcgccgtcgtacagtctcggagagtgggattacgcgcatccgtgagagcgtcggcggagactctagagaagacagataccgcattagtggagaaatcggtcaacacgatccggttcctagctatcgatgcggttgagaaggcaaattctggtcacccgggtctgcccatggggtgtgctccgatgggtcacgtgttgtacgatgagtttatgaggtataacccgaaaaatccatattggttcaaccgtgatcggtttgtgctctcggctggacatgggtgtatgttacagtatgcactacttcacctagctggctacgacagtgtcaaggaagaagacttgaaaagtttccggcagtggggaagcaaaacacctggtcaccctgaaaactttgagacgcctggcattgaagtccaccactggtccccttggacagggtgttgctaatgcggttggtttggcccttgctgagaagcatttagctgctcgatataacaaacctggcaatgagattgttgatcactacacgtatgtgatacttggggatggatgtcaaatggaaggaatttcaaatgaagcttgctcccttgctagtcactggggacttggaaagctgattgcattctatgatgacaaccacatttcaatcgatggtaacactggtattgcattcacagagagtgttgataagcgctttgaaggactcggttggcatgttatatgggtgaagaatggtaacactggatatgatgagatccgtgctgccattgaggaagctaaggcagttaaagataaacctactttaatcaaggtcacaactaccattggttttgggtcacctaacaaggcaaactcatatagtgtacatggtagtgcattgggtgccaaagaagtggatgccacaaggaagaaccttggatggtcacatgagccattccatgtgccagaggatgttagaaagcactggagccaccacaccactaaaggagctgctttggaagctgaatggaatgccaagtttgcagagtatgagaagaactacaaggatgaagcaaaagaattgaaatctcttattactggtgaacttcctactggttgggaaaaagcgcttccgacgtatactcctgaaagtccagcagatgccactcgtaatctgtctcagacaaatctcaatgcccttgcaaaagttcttcctggacttcttggaggaagtgcagaccttgcttcttccaatatgacactgctcaaaatgtttggtgactaccaaaaggacacccctgaggaacgtaatgtacgatttggggttagggaacatggaatgggtgccatttgtaatgggattgctctccacagccccggccttattccctactgtgctaccttctttgttttcacagactacatgcgagcagccatgaggctttctgcattgtgtgaagctggagtcatttacgtgatgactcatgattccatcgggcttggagaggatgggccgactcatcaacctattgagcatttggcaagcttccgagccatgccaaacatcataacgctccgaccagctgatggaaacgagactgctggtgcatataaggttgcagttctcaacagaaagagatcctccgttcttgccctctctcgtcaaaagcttcctaatcttacgggaacatcaattgaaggagttgagaaaggtgggtatattatttctgataactcctcaggtaacaagccagagataattttgataggaactggttccgaattggaaatagctgcaaaagcagctgatgagctcaggaagggtggaaagactgtacgagttgtgtcctttgtttcttgggagttgttcgatgaacaatctgatgcatataaggaaagtgtactgccagctggtgtatcggctagggtcagtattgaggctggatcaacatttgggtgggacaagatcgtgggatccgagggtaaggcgattgggatagatcattttggagcaagtgcaccggcagataagatatataaagaatttggattaactgtagaagctgtgataacagcagccaaagcagtgtgctaaaccttcacactgatacttttatgtgtcaaaagtgggaaaatgtgttgcgttctctctgaaaatatgaagtttttcagtgtagaagtttggtgtagtgtattgggtagtaaaagtcatttt

SEQ ID NO: 9155 - DNA, 2798 bp, Brassica rapa
aataaaaattgtggtaaggcatagaggatcactaaactcttagcctcaatcaacggccacgataacaccctttgatgcaattaaacggtcagatttgatcttcttgtctcttaccgaacacgaagagatgtcgaatattatatgattggcttaaaaaaatatcctctcactcataaagagaagtctctctttacatctctccttcaccactagcttccctttctctccaaccatggcttcaacttcctccctcgctctctctcaagccctcctcgctcgcgccatctctctccatggctccgaccaacgcatctccctaccttcatctttctcacgcgcctccgcgtcctctcgccgccgcaacgccgcgtcgatgaccaaactccgatctatccgccccctcgtccgcgccgcggctgtcgagaccctcgagacgagcaccgattcgtctattatcgacaaatcggttaactcgatcaggttcctggcgatcgatgcggtggagaaggccaagtcgggtcatcccggtcttcccatgggatgtgctcccatggctcacattctctacgatgaggtcatgaggtataaccccaagaacccttactggtttaaccgtgaccggttcgttctctctgctggtcatggttgtatgcttctctacgcgttgcttcacctcgccggatacgacagcgttttggaggaggatttgaagagtttccgacagtggggaagcaagacacctggacatcctgagaacttcgagactcctgggattgaagtcactactggtccacttggacaagggattgcgaatgctgttggtttagctcttgctgaaaagcatttagctgctaggttcaacaaacctgacgctgaagttgtcgaccactacacatatgtgatacttggagatggttgtcagatggagggtatttcaaacgaagcagcctctctagctggtcactggggacttgggaagctcattgctttctacgatgacaatcacatttccattgatggagacactgagattgcgttcactgagaatgttgaccagcgtttcgaagcgcttggatggcatgttatctgggtgaagaatggtaacactgggtatgatgagatccgtgctgctattaaggaagctaaaacggttactgacaagcctactttgattaaggttactactacaattggttatggatctccaaacaaggcgaactcgtacagtgtccatggagctgcacttggtgagaaggaagttgaggctactagaaacaacctcggatggccttatgagccattccaagtacctgaggaagttaaaagccactggagccgtcatacccctgaagggaaagctcttgaatctgactggaatgcaacgtttgcagcgtatgaaaagaagtacccagaggaagctgcagagttgaaatctatcatcactggtgaattacctgctggctgggagaaggcactaccaacatacacacccgagtctccaggcgacgccacaagaaacctgtcacagcaatgtcttaacgccatagccaaagttgtccccggtttcctcggtggaagtgctgacctcgcatcatccaacatgacactgctcaaagcctccggtgacttccaaaaggccacacccgaggaaagaaaccttagatttggcgtcagggagcacggaatgggagccatctgcaacggcatagccctccacagccccggtctcatcccttactgtgcaactttcttcgtcttcactgactacatgagaggtgccatgagaatctcagccttgtccgaagctggggtgatctacgtgatgactcatgactccattggtctcggagaagatgggccgacccatcagcccatcgagcacatcgctagcttccgcgccatgcccaacacgctcatgttccgtcccgccgacggaaacgagacggccggtgcgtacaagatcgctgtcaccaagcgtaagacgccgtctatcttggctttgtctaggcaaaagcttcctcagcttccggggacttccatcgaaggagttgccaagggtggatacacgatctctgacgactctactgggaacaaacctgatgtgatcttgattgggactggctctgagctggagatcgctgcgcaggctgcagaggtgattaggaaagaaggcaagaccgttagagttgtgtcttttgtctgctgggagctgtttgatgagcagacggatgagtacaaggagagtgttttgccgtctggtgtgtcggctagagttagtattgaagcggcttcgacttttgggtgggggaagattgttggagggaaagggaagtctattggtattaactcgtttggggctagcgcaccggcgcctttgctctacaaggagtttggtatcactgtggaagctgtcgttgatgcggccaagtcattcttctaagagacttaaaagatcatcagactatcatcctgtataagggtttgtgtcaacattgtctcattatcttaaaataaattgcaacaagacgcatagagtttctttctttcttcttttggtggtttttctttttgtaattcggacaacataggttttgggtttggaagagaaacaaagtataagacaatgtaaaactctcgtgttttgttgttatatgcttgaatttgctttccagctttctcttagaccgaccgatataaacagacacaagcattggtcagtacatctgaatttttgtgtggacaagaatagtaacagagattaaaaaggttcggttcttcttaattcttctacattaggg

SEQ ID NO: 9156 - DNA, 2512 bp, Helianthus annuus
aagccgccctcgctcgctccgccgtcccccgccacggttccaccaccaccaccacccaacaatcaacttctctttccaccctctcaatacccactttctccgggctcaaatccaccaccacgtcctcctcacgcgctgccactcgccgtcagtccttctccacgcgccgccatgtgatctccaacgccgccgttgaaactctcgctaaaacagatactgctcttgtggagaagtcagtcaacacaatcagattcttggcgattgatgctgttgagaaggcgaattccggtcatccgggtttgcccatgggttgtgcacccatgggtcatatattgtacgatgaggtcatgcggtataaccccaagaacccgtattggtttaaccgagatcgctttgttctctccgccggtcatgggtgtatgctccagtatgctctgctgcatcttgctggttacgatgctgtcaaagaagaggacttaaagcaattccgtcaatggggaagcaaaactcccggacatcccgaaaactttgaaactcctggtgttgaagtcaccactggtccgcttggtcaaggtattgccaatgccgtcggtcttgcacttgccgagaagcatttggctgctcgttacaacaaacccgacggcgaaaatgttgaccactacacatactgtattcttggagacggttgtcaaatggaagggattgcaaatgaggcgtgttcacttgctggtcattggggacttggaaagttgattgcattttacgatgacaaccacatctccattgacggtgacacagagatcgccttcactgagactgttgaccaacgttttgaagctctcgggtggcacataatttgggtgaagaacggaaacaacggttatgatgaaatccgtgccgccattaaagaagctaaagctgtgaccgataagcctactttaatcaaggtgacaacaacaatcggttttgggtcaccaaacaaggcgaattcgtacagtgttcatggagcggctttgggtgcgaaagaagtagatgcaactagacaaaacctcgggtggccttacgagccattccatgtaccagatgaagtgaagaagcactggagtcgccataccccagagggtgccgctcttgaagcagaatggaatgctaaatttgcagagtacgagaagaaataccctgaagaggctgctgaattcaagtctattgctaccggtgtattgcctgccggatgggagaaggctcttccgacgtacacaccagaaacacccggtgattccacaagaaacctctcgcaaacaatgcttaatgcattagcaccggttcttccgggacttatcggtggaagtgcggatcttgcatcttcaaacatgactttaatgaaaatgttcggtgatttccaaaaaaacacacctgaagaacgcaacgttcgtttcggtgttcgggaacacggtatgggagccatttgtaacgggatcgctctccacagccccgggttcatcccgtactgtgctacattctttgttttcaccgattacatgagaggtgccatgagaatttcagctttatcggaagccggagttatttacgtcatgacccatgactccattgggcttggagaagacgggccgacccatcaacccattgaacatttagccagtttccgggccatgccgaacatcttaatgttccgtcccgctgacggaaacgaaaccgctggagcttataaggttgcggtcgaaagcagaaaacgtccctcggttcttgctctttctcgtcaaaaactgcccaacctgcccggaacttcaatcgaaggaaccgcgaaaggtggttacacaataaccgacaattcaaccgggaacaaacccgatgttatcttgatgggtaccggttctgagctggaaattgcggctaaagcagccgatgaactcagaaaagaagggaaaacggttcgggttgtgtcattcgtgtcgtgggaactttttgatgaacaatctgatgaatacaaggaaagcgttcttccgtctggtgtaacggctcgtgttagcattgaggctgcatcaactttcggttggggaaaacttgtcggaagcaaagggaaggcgatcggaattgacaaatttggggcgagtgcgccagctggaaagatctacaaggaatacgggataactgttgaagctgtggttgctgcggctaaagaagtttgttaggttagtttgaaaccgacatcaagttctgggcttcgggaacttacataaaggacgagtgatattagttttctgtatcttgattcataatgctcgggtgaataataagatgtcggttttttagtctttttgatgcttttcatcgaacgaagatcagaagtgaggattagagattgagtgatttatgctatcttgaatttgtaccaaaattgaaacataaattttgtgatttttatgtttgattactactgaggtgttcgtttgagtcccatgtacaattctgcaagttatattacaacacttct

SEQ ID NO: 9157 - DNA, 2186 bp, Conyza canadensis
ctccgccaccaccaccgccgctgcaacccagcaaccaacttccatttcaactctatctttgcccactttctccggccttaagtcctccaccacatcatcttcacgcgccgctacacgttcacaaataccctccactcgtgggcgcgtggcacacacgcgccgccgtgtgatcacaaacgccgccgtggaaacgatagagaaaaccgagacggctttggttgacaagtcagtgaacactatcaggttcttggctattgatgctgtagaaaaagctaattcgggtcatccgggtctgcccatgggttgtgcaccaatgggtcatatcttgtatgacgaggttatgagatataacccgaaaaacccatattggtttaacagagatcgctttgttttgtccgccggacatgggtgtatgttacagtatgctctgcttcatcttgctggttatgattctgtcctagaagaggacttgaagcaatttcgtcaatggggaagcaaaactcctggtcatcctgagaacttcgaaactcctggaatcgaagtcaccactggtcctcttggtcaaggtattgccaatgctgttggtcttgctgttgctgagaagcatctagctgctcgttacaacaaacccgatgctgagattgtagaccactacacatactgtattcttggtgatggttgtcaaatggaagggattgcaaacgaagcttgttcacttgctggccattggggactcggaaagttgattgctttctatgatgacaaccacatctctattgatggtgacactgagatcgcattcaccgagaatgttgacaaacgttttgaggctcttgggtggcatatcatatgggtgaagaatggtaacaccggttatgatgagatccgtgctgccatcaaagaagctaaatctgtgactgataagcctactttgattaaggtgacaacaacaatcggttttggatcaccaaacaaggctaactcatacagtgtccatggagcagctttgggagcaaaagaagtagatgcaaccaggcaaacccttggatggccttatgagccattccatgttccagaggatgtaaagaagcactggagccgccatacccccgagggtgcagctcttgaagctgaatggaatgctaaattcgcagagtatgagaagaagtatgcggcagaagctgcggagttgaagtctattgctgatggtgtgttgcccgctggatgggagaaggctcttcctacatacaccccagaaactcctggtgatgccacaagaaatctttcacagacaatgcttaacgcattggcaccggttctccccggtcttgttggtggaagtgctgatcttgcttcatcaaacatgaccctaatgaaaatgttcggtgatttccaaaaagccacccctgaagaacgcaacatccggtttggtgttcgtgaacatggtatgggagccatatgcaacgggattgcgcttcacagccccgggttcgtcccttactgtgcaacgttctttgtcttcactgattacatgagaggtgcaatgagaatctcggctttatcggaagctggagtcatctatgtcatgacccatgactccattggtctaggagaagatgggccaacccatcaaccgattgaacatttagctagtttccgggccatgcccaacatcttaatgttccgtccagctgatggaaatgagacagccggagcttacaaggttgcagttgaaagcagaaaaagaccctcaattcttgctctttctaggcaaaaacttcccaacctggctggaacttcaatcgaaggaaccgcaaaaggtgggtacacaatatctgacaactcaacaggtaacaagcccgatgttatcttggttggtaccggttccgagcttgaaattgcagctaaagctgctgatgaactcagaaaggaagggaaaacagttcgtgtcgtgtcctttgtttcatgggagctttttgatgaacaatctgatgaatacaaggaaagtgtacttccatcagctgtaacagcccgtgttagcattgaagctggatcgacttttggatgggggaaaattgtcggaagcaaaggcaaggccatcgggattgacaaatggggttccagtgcaccagcaggaaagatttacaaagagtacggtataactgctgaagctgtgattgcggcag

SEQ ID NO: 9158 - DNA, 2443 bp, Brassica oleracea
tctcaagagagcgaaacatcaagacaatccatggcttcaacttcctccctcgctctctctcaagccctcctcgcccgcgccatctctcaccatggctccgaccaacgcatctccctaccatcatctttctcacgcgcctccgcttcctctcgccgccgcaacgccgcgtcgatgaccaaactccgatctatccgccccctcgttcgcgccgcagctgtcgagaccctcgagacgagcaccgattcgtctattattgacaaatccgttaattcgatcaggttcttggctatcgatgcggtggagaaggccaagtcaggtcaccctggtctccccatgggatgtgctcccatggctcacattctctacgatgaggtcatgaggtataaccccaagaacccttactggtttaaccgtgaccggttcgttctctctgctggacatggttgtatgctgctctacgcgttgcttcacctcgctggatacgacagcgttttggaggaggatttgaagagtttccgacagtggggaagcaagacacctggacatcctgagaacttcgagactcctgggattgaagtcactaccggtccacttggacaaggggttgctaatgctgttggtttagctcttgctgagaagcatttagctgctaggttcaacaaacctgacgctgaagttgtcgaccactacacatatgtgattcttggagatggttgtcagatggagggtatttcaaatgaagctgcctcactagctggtcactggggacttggaaagctcattgctttctatgatgacaatcacatctccattgatggagacactgagattgcattcactgagaatgttgaccagcgttttgaagcgcttggatggcatgttatttgggtgaagaatggtaacactgggtatgatgagatccgtgctgctattaaggaagctaaaacggttacagacaagcctacattgatcaaggtcactactacaattggttatggatctccaaacaaggcgaactcgtacagtgtccatggagctgcacttggtgagaaggaagttgaggctaccagaaacaacctcggatggccttatgagccattccaggtacctgatgaagttaaaagccactggagccgtcatacgcctgaaggcaaagctcttgaatctgactggaatgcaacgtttgcagcgtatgaaaagaagtacccagaggaagctgcagagttgaaatctatcatcactggtgaattacctgctggctgggagaaggcactaccaacatacacacccgagtctccaggcgacgccacaagaaacctgtcacagcaatgtcttaacgccatagccaaagttgtccccggtttcctcggtggaagtgctgacctcgcatcatccaacatgacactgctcaaagcctccggtgacttccaaaaggccacacccgaggaaagaaaccttagatttggcgtcagggagcacggaatgggagccatctgcaacggcatagccctccacagccccggtctcatcccttactgtgcaactttcttcgtcttcactgactacatgagaggtgccatgagaatctcagccttgtccgaagctggagtgatctacgtgatgactcatgactccattggtctcggagaagatgggccaacccatcagcccattgagcacatcgctagcttccgcgcgatgcccaacacgctcatgttccgtcccgccgacggaaacgagacggccggtgcgtacaagatcgctgtcaacaagcgtaagacgccgtctatcttggctttgtctaggcaaaagcttcctcagcttccggggacatcgatcgaaggagttgcgaagggtggatacacgatctctgacgactcgtcggggaacaaacctgatgttatcttgattggaactggctctgagctggagattgctgcacaggctgcggaggtgattaggaaagaaggcaagaccgttagagttgtgtcttttgtctgctgggagctgtttgatgagcagacggatgagtacaaggagagtgttttgccgtctggtgtgtcggctagagttagtattgaagcagcttcgacttttggatgggggaagattgttggagggaaagggaagtctattggtattaactcgtttggggctagtgcaccggcgcctttgctctacaaggagtttggtatcactgtggaagctgttgttgatgcggctaagtcactcttctaagagactcaaagatcagactatcctgtataagggtttgtgtcaacattgtctcattatcttaaaataaattgcaacaagacgcatagagtttcttttggtggtttttctttttgtaattcggacaacataggttttgggtttggaagagaaacaaagtataagacaatgtaaaactctcatgatcattcgtgtttttgttgttata

SEQ ID NO: 9159 - DNA, 2985 bp, Medicago truncatula
gttgaatttggtgactgtgttccaattgttaatccaaatccatgaactacccttatcaaaatccaacccttccatatcaacattcttaacctaagttgtattcatttatcttgaaaagaaataacattaataatcaacaaaataaataactttgtaaagaaataatatatttttctctctctctctctctctcacattgtacactgaaccagtcctctatgggcgacaacctcaacaaaaacaaatctccctctctctctctctacaaaaccaaccaaactgcaaaatcaaaatgatctcattcttatcgaacaaaccaactttcacattcacattttctctcactctctctctcaacaatgtcttcatcttcttccacttccctctatctcaccaacccccatctcacgcgccacacatcatccccatccaccacgcgcctctcttctctcccatccaccatcaccctcaaccgcacaccaaccccaacaacccacctctctcaatcccatcatctccgtcataccgccatccatgcatccgtctccgcaccaccgtcaaccaccacagactcatctctcgttgagaaatcagtcaacacgatccgtttcctcgcggttgattcggttgaaaaagccaattcgggtcatcctggtttacctatgggttgtgctccaatgggtcatgtgctttatgatgaggttatgagatataaccccaagaatccgttttggtttaaccgtgatcggtttgttttgtccgctggtcatggttgtatgcttcagtatgctttgcttcatcttgctggatatgacagtgttaaggtagaagatttgaagcaatttcgtcaatgggagagcagaacccctggacaccctgagaattttgagactcctggaattgaagtcaccacaggtcctcttggtcagggaattgccaatgctgttggtttagcccttgcagagaagcacttagctgccagatttaacaagcccgacaatgagatcatcgatcattacacgtattgtatattgggtgatggttgtcaaatggagggaattgcaaatgaagcttgctcacttgcaggacactggggactaggaaagctaatagcattttacgatgacaatcacatttctattgacggtgacaccgaaatcgcattcactgagagtgttgaaaaacgttttgagggacttgggtggcatgttatttgggtaaagaatggaaacactggctttgatgaaattcgtgctgccattaaggaagcaaaagctgtcaaagacagacccacattgatcaagttcacaacaaccattggttatggttctccgaataaatccaactcctacagtgtgcatggaagtgcacttggtgccaaagaagttgatgccacaagaaacaatcttggatggccatatgagcctttccacgtgcccgaggatgtcaaaaagcattggagtcgccacatccgtgagggtgctgctcttgagtccgagtggaatgccaagtttgctgattacgaaaagaaatacaaggaggaggctgcagtattgaaatctatcatcagtggtgatttacctgctggttgggagaaagcacttccgacttacactccagagatccctgccgatgccacccgaaacctatcgcagcaaaaccttaatgcccttgcgaatgttcttcccggtctgattggtggcagtgcagatcttgcttcttccaatatgaccttgctgaaaaagtttggtgatttccaaagtgattctccagcagagcgtaacgttagatttggtgttagagaacatggaatgggagcaatctgcaacggcatcgctcttcacagccgtggacttattccatactgtgcaaccttttttgttttcaccgactacatgcgtggtgccattaggctttccgccctatccgaagccggtgttatatatgtcatgactcacgattcaataggacttggagaggatggaccaacccatcagcctatagagcacctggcaagcttccgggcaatgccaaatatcttgatgctccgtcccgctgacggtaacgaaacggctggagcatacaaagttgcagtgcttaacaggaagagaccctctatccttgccctttctagacaaaaattgcctaaccttgccggaacttctattgaaggagttgaaaagggtggatacatcgtctctgacaactcaacaggaaacaaacctgatgtcattttgattggaaccggttccgaattggaaattgcatacaaagctggtgaggatctaagaaaagaaggaaaggctgttagagttgtttcctttgtttcttgggaactttttgatgaacaatcacaagcttacaaggagagtgttctccctactgctgttacggctagggttagcattgaggccggatcaacattcgggtgggagaaaattgttggaagcaaaggaaaagcaatcggcattgatcgttttggagctagtgctcctgcaggaacaatatacaaagagtttggtatcactaaagaagctgttattgctgcagcaaaagagcttatttagaactattagtttttgttcatttaagaactttctcttttatttttcttctggttttgcttttgcttttgggtttgatatatctacacagaaaagggtgtttcaatagcatcatgttgttgcttgaataagaaaaaggttagattactgttgcttatgattgtgagttgtgagttaagctaagcaacattgatcaaagtagattacactaataaatttttacgaaatagtaaacttttcaaccgattgagttgacattgttaaatccaatgatgttcatgactgttcaattgttcatctatgttagttgtattttctttcggttgttggcattgtgaaattgcaaataagcatatgtgtttggaagaatttatttaagttgttataggtttgattttatgttttatgatgatagtagttt

SEQ ID NO: 9160 - DNA, 2361 bp, Arachis hypogaea
cccgcaatctccctccgccgcatccccccaatctccgccctcaaggtctccgcttcctcctcctccgccgtcgataccgtcgaccgcacagccgccgaccccgccatcgttgagaagtcggtcaacacgatccggttcctcgcaatcgatgccgttgagaaagcgaattcgggtcacccgggtcttcccatgggttgcgccccgatgggtcacgtgctctatgacgaggttatgaggtacaacccgaagaatccgaaatggttcaaccgtgatcgctttgttctctccgctggacatggttgcatgcttcagtatgcgttgcttcaccttgctggctatgatagcgtcaaggaggaggatttgaagcaattccgtcagtgggaaagcaggactcccggacaccctgagaatttcgagacacctggaattgaagttacaacaggtcctcttggtcagggtattgccaatgctgtgggtttggccctcgcagagaagcacttggctgcgagatttaataagcctgacaatgagattgttgatcattacacgtatgctatattgggtgatggttgccagatggagggaatcgcaaatgaagcatgctcacttgctggccactggggattagggaagctaatagcattctatgatgacaatcacatttctattgacggtaacactgaaattgctttcactgagagtgttgatagacgttttgagggacttggatggcatgttatttgggtaaagaatggaaacaatggttatgatgaaattcgtgctgccatcaaggaggcaaaggctgtgaaagacagacccacactaatcaaggtcacgaccacaattggttatggttctcctaacaaggctaactcctacagtgtgcacggaagtgcattgggtgccaaagaagttgaggctacaaggcagaaccttggatgggcacatgagcctttccatgtgcctgaggatgtcaaaaagcactggagtcgccacatccctgagggtgctgcacttgaagccgagtggaataaaaagtttgccgaatatgagaagaaatacaaggaggaggctgcagaactgaagtgtattatcaatggagaatttcctgctggatgggagaaagcacttccaacatacacccctgagaccccaggtgatgccaccagaaatctctctcagcacaaccttaatgcccttgcaaaggttcttcccggtctgcttggtggtagtgcggatcttgcatcttccaacatgaccttattgaaaatgtttgggaacttccaaaaggacactcctgctgagcgtaatattagatttggcgtcagagaacatggcatgggagcaatcagcaacggcattgctctacacagccctggcctgattccttactgcgcaactttctttgttttcaccgactacatgagagctgccataaggctttctgccctgtctcaggctggtgttatttatgtgatgacccatgattcaataggacttggagaggatgggccgacccaccaacctattgagcacctggcaagcttccgggcgatgcctaatgttttgatgcttcgtcctgctgatggtaatgaaactgccggatcatacaaagttgccgtgcttaacaggaagagaccctctatcctcgccctttctaggcaaaagttgcccaatcttcctggaacttctattgaaggagttggaaagggtggatacaccatctcagacaactcaacaggcaataagcctgatgtcattttgattggaaccggttccgaattggagattgctgccaaggctgctgatgatctcagaaaggaaggtaaggccgttagagtcgtttcgttcgtttcatgggaacttttcaacgagcaatcggaggcatacaaggagagtgttctccctgctgctgtttcagctagagttagcattgaggcaggatcaacatttgggtgggagagaatcattggaagcaaaggaaaagcaataggcattgatcgattcggagctagcgctccggcaggaaaaatatacaaagagtttggcatcacaaaggaagctgttattgctgcagcaaaatcacttatctaagatgtattagtttctttatttttgtttttgccttggtttgagttgaagtttacattgagaggggaatttgcatgaggcatgtttaaagggcattccttcacttgaataaggaatagattaggttacagttgcttgtgattctcatttgagtttcttagatcaaagcaggagatggaagttttatgaacttgtaataacactttgaacagttaagttatgcatttgcgacacggtcaaaatcagtgattcttatataaaaaaaaaaaa

SEQ ID NO: 9161 - DNA, 3074 bp, Capsicum annuum
ctaaaaattaaaatggaaagaaaatatagtccgcttttagcccgagaagtgtacatcctacccacatctcttaagagccacaaggaagcaatccctaaataaatactcgaagagtcagttaaagcccattcttctcatcttcacacatttctctcctcctctctcttgccatggcttcttcctccctccctctctctcaggccatcctctctcgctcaatccctcgccatggctcctcttcctccaccaactcccaattctccccttcttccctttccctccccactttctccggcctcaaatccaccacctccaccacctcccccccccccccggtcgccggaaattagagcttcggcggctgtggagactttagagaaaacggataatgcactggttgagaaatctgtaaatacgatacgatttttggcaattgatgcagttgaaaaggccaattcaggtcatccaggtttacctatgggatgtgcacctatcggacatatattgtatgatgagatcatgagatataatcctaagaatccttattggtttaatcgtgatcgctttgttctctccgctggacatggttgtatgcttcagtatgctttgcttcatctcgctggttatgatgctgttagggaagaggacttgaagagcttccgccagtggggaagcaaaacccctggacaccctgaaaactttgagacacctggtgttgaagtcaccactgggcctcttggacaagggattgccaatgccgttggcttggccctctcagagaagcacttggctgctcgtttcaataagcctggcgctgagattgtagaccactacacatattgtattctcggtgatggttgccagatggagggtatttcacaagaagcggcttctcttgctggacactgggggctcggaaagctgattgctttctatgatgacaaccacatctcaattgatggggacacagaaatcgctttcactgaggatgttggtgcccgttttgaggctcttggttggcatgtaatctgggtgaagaacggtaacactggttatgatgagattcgtgctgccattaaggaagcaaaagcagtcacagacaaacccactatgatcaaggtaactacaaccattggttttggctcacccaacaaggcaaatagttacagtgtacatggaagcgcacttggagctaaggaagtagaggccacgaggcagaacttgggatggccttatgagcctttccatgtgcctgaagatgtcaagagccactggagccgtcatgttcccgagggtgctgctcttgaagctggatggaataccaagtttgctgaatatgagaagaagtacccagaggaagctgcagatctcaaatccatcatcactggtgaactacctgctggctgggagaaagctcttcctacctacacacctgaaagtccagcagatgccaccagaaacctgtcccaacaaaacctgaatgctcttgccaaggttcttcctggtttcctcggtggtagtgctgatcttgcctcatcaaacatgaccctcatgaaaatgtttggcgatttccaaaagaacaccccagaggagcgaaatttaaggtttggtgttcgtgaacatggtatgggagccatttgtaatggaattgctctgcacagccccggcttaattccctactgtgccactttctttgtttttactgattacatgagagcagccattagaatttcagctttgtctgaatcgcgtgttatctatgttatgacccacgattcaattgggcttggagaagatggacctacacatcagcccattgagcacttggcaagtttccgtgcaatgcccaatgttctgatgctccgtccagcagatggtaatgagacagctggtgcttataaggtggccatcctcaagagtaagacaccatcaatcctggccctttctcgacaaaagttgccccaacttgctggaacttctattgaaggaacagcaaagggtggctacgttacatcagacaactcttcaggcaacaatcctgatgtcattttgattggtaccgggtcagagctggaaattgctgtcaaggctgctgatgaactcagaaaggaaggaaaggcggtgagagttgtctccctcgtttcttgggagcttttcgatgagcaatcagcggagtacaaggaaagtgttcttccagcagctgttactgctagagttagcattgaagctggatccacatttgggtgggagaagatcgtcggatccaaagggaaggccattggaattgacagattcggtgccagtgcccctgctggaaaaatatacaaggagtatggaattacagcagaggctgtaatagctgcagctaaacaagtctcttaagctcttattacttgcccttggttactggtgtctaccaaagttgttttgttttggttctgagatcggagacaatggttgtaaccgataccaagtggactcggcagttaatcgttgcctgagtattttcaataaagataatttcttcatctgcgtttcgttttcttcagtttgaacagcggggtggccggaatgatctcaagatgaggatagaaataggcctttatggatggctcctgaccaagtacacttaaaaatgtatctttgagtttgtaatttttatttggtcgagtgataacgaggtccaattttcaattggaatttcatgtattctggtaacacatggctttctttgtcttcactatagttatccttttgcggccatctattccaaagcaattggatcttttggcagcatcgatgacaaagtctgcaactgatggaagtaaatataccgctaaactgtattttgtttctacaagcttttctgctgaagtttaaatggttgagaagttttaatcactagtgataattttaactggtcataaaactgatctgctgatcaggaattgaataactgtatttctctttcattagcttttggttctaagccatggaaatctaatcttcaaagcaaaaaagtgagtccttctaggctgaatgagttttctttatccataattaaatgttgcagg

SEQ ID NO: 9162 - DNA, 2432 bp, Vinca minor
accatttccctcccatccttctccggcctcaaatccactctcccttcaaccactatctcccgccgtcgttgttctactccctcatcccgccgccatcaaaatccccaattcttcgccgcagctacagtagaaacagtggagaaaattactactgatgagttagtcgataaatccgtcaatacgatccgattcttggctattgatgctgtcgagaaagctaattcgggtcacccgggtttaccaatgggttgtgctcctatgggtcatattctttatgatgaggtcatgaaatataatcctaaaaacccttattggtttaatagggatcgatttgttctctccgccggccatggttgtatgcttcagtatgctcttcttcatcttgctggttatgatgctgtccgggaggaagatttaaaggaattccgccaatggggaagcaaatcgcccggtcatcccgagaactttgagactcctggcgttgaagtcaccactggtcctcttggtcaaggtattgcaaatgctgttggtttggccgttgctgagaagcacttggctgctcgttacaataagcctggcgctgagattgtcgaccactacacatatgttatacttggtgatgggtgtcaaatggaagggatttcaaatgaagctgcttccctagctggccactggggacttggaaagctgattgctttctatgatgacaaccatatctcaattgacggtgacactgatattgcattcactgagagtgtggacacccgttttgagggtctcggttggcatgttatctgggtgaagaatggtaacacaggttatgatgaaattcgtgctgccatcaaggaagctaagactgtgaaggacaaacccactttgatcaaggtgactacaactattggttttggttcccccaacaaggcaaattcatacagtgtacacggaagtgccctgggtgccaaggaagtagaagctaccagaaccaatcttggatggccttatgagcccttccatgtgcctgaggatgtgaaggcgcattggagtcgtcacattcctaatggtgctgcttatgaaactgaatggaacgccaaattcgccgaatatgaaaagaaatacccacaggaggcagcagagtttaagtccattattactggtgaactccctgctggctgggaaaaggctcttccaacatatactcctgaaagcccagctgatgctaccagaaacctctcgcaagcaaaccttaatgctcttgcaaaggttctgcctggtctgcttggtggtagcgctgaccttgcctcttccaacatgacacttcttaagatgtttggtgacttccagaaggacacaccagaagagcgtaatctgaggtttggtgtccgtgaacatggtatgggagccatctgtaatggtattgctctccacagccctggcctaattccctactgtgcaactttctttgtgttcaccgactacatgagagcagccataaggatctctgccttgtctgaagctggagttatttatgtgatgacccatgactcaattggtcttggagaagatggacccactcatcagcctattgagcacttggcaagtttccgggcaatgcccaacattctgatgctacgtccagctgacggaaacgaaacagccggtgcatacaaggtggctgttctcaacaggaagagaccatcagtccttgctctctcacgtcaaaagttgcccaaccttgctggaacttctatcgaaggagtaaaaaagggtggatacattttatccgacaattcttctggcaacaaacctgatgccatcttgattggaacaggttctgagttggagattgcagtcaaggctgcagacgaactcagaaaggaagggaaggccgtcagagttgtctcctttgtttcatgggagctatttgatgaccaatcagctgaatacaaggaaagcgtcttgccagcttcagtaactgctagagttagcattgaggctgggtcaacatttggatgggcgaagattgttacatctgaagggaaagctattggaatcgaccgatttggggctagtgctcctgcaggaaaaatttacaaggagttcggcatcactgcagaggctgtcgtagcagctgctaaagaagttatgtaggctttcacaaattgctggttgcctgtttaaatcagttaggttcgcgattcaagcttgcaaattacagtcgagacaacggcaagggactcggctcagttcactgccaacaacttgagatttcataataagagaagataagttttctttgtccatctgtcttcattagtgtggagctatttgagcctgcaaaaatttaaaagatgaagcagtttaggataactcctgaatatgtacacttatgacatggcatttgtaatcttatttggttcattgcctttgaactt

SEQ ID NO: 9163 - DNA, 2176 bp, Amorphophallus konjac
cgtcaggtccctgtcctcctcctcctctcggccggcgctgaggagggccgggccgtgccggtgcgggcggcggcggtggagaccctggaagggaaggcggggacgacggcgctggtggagaagtccgtcaacacgatcaggttcctggcgatcgacgcggtggagaaggctaactcggggcacccggggctgccccatggggtgcgcccccatggggcacattctctacgacgaggtgatgcggtacaaccccaagaacccctactggttcaaccgcgaccgcttcattctgtcgcgggccacgggtgcatgcttcaatatgccctgctccacctggcgggctacgacagcgtcaaggaagaggatttgaaatctttccgccagtggggaagcagaactcctggtcaccctgagaactttgagacacctggtgtcgaagtcactactggtcctctgggtcagggtattgcaaatgctgttggattggcacttgctgagaagcacctagctgcccgtttcaataagccagacaacgagattgtagaccactacacgtatgtgatacttggggatggttgccaaatggaaggcatttctaatgaagcctgttctcttgctgggcattggggtctaggaaagttgattgctttctatgatgacaaccacatttcgattgatggagacactgaacttgcattcactgaggatgtcagtgctcgttttgaggctcttggctggcacactatctgggtgaagaatggcaacactggttatgatgatattcgtgctgcaatcaaggaagcaaaggctgtcaatgacaagcctacactgattaaggtaaccacaaccattggttatggctcaccaaacaaggcaaactcatatgctgtacatggaagtgcattgggtgctaaggaagttgaagcaaccaggaacaaccttggatggcctcatgaacctttccaggtgcctgatgatgtgaagagtcactggagtcatcatgtcccgaacggtgctgcccttgaagctgagtggaatgccaagtttgcagagtatgagaagaagtacaaggaggatgctgaagttctgaagggaataattagcggagaattgcctgcaggatgggagaaagctctcccgacctacacacccgagagtcctgctgatgctacaagaaatctctcacagcaatgcctcaatgcacttgctaatgtgcttcctgggcttcttggtggcagcgctgatcttgcgtcctccaacatgacattgctcaaaatgtacggtgacttccagaaagacacgcctgaagagcgaaatgtcaggtttggagtcagagagcatggaatgggtgccatctgcaatggcattgccctccacagcccaggactcatcccttactgtgctactttctttgtcttcacagactatatgagagctgccataaggatctctgcattgtgtgaggcaggagttatctatgtgatgactcacgattctattggactgggagaggatggaccaacccaccaaccgattgagcatttgctgagcttccgcgctatgcccaacattctcatgcttcgccctgcagatgggaatgagactgctggtgcatacaaggtcgccgtcctcaacaggaagaggccatcaatccttgccctctcccggcagaagcttgctcagcttgctggcacatccattgacggtgttgagaagggagggtacattatttcagacaattctacaggcaacaaaccagatctcattcttatcagcactggttctgagctggaaattgcagccaaggctgcagacgaattgaggaaggagggaaagaaagttcgtgtggtgtcccttgtttcttgggagttgtttgatgagcagtctgatgaatacaaagaaagtgtcttccctgctgctgtcactgctagggtaagcattgaagcaggagcaactcttgggtgggagaagtttgttggaagcaaaggcaaggccattggaattgatcggtttggagccagtgctcctgctgggagaatatacaaggaatttggtatcagtgctgagaatgttattgcaacagccaagtcgctgtaagtcttacgtggttaggaattccaattggccttttagaggaccatttccgattttgggtcacctgttcacagtttgttca

SEQ ID NO: 9164 - DNA, 2508 bp, Ambrosia trifida
ccactttctctctctaaaaaaacagagccatggcttccctcactctctcccacgccgccctttccagctccaccgtcccccgccatggctcttccaccactctctccatccccaccttctccggtcttaaacccacctcctcacgcgccctcacgcgccaccaaatttcgtccacgcgccgtactgtgacgcccacgcgccgtcgtgttatctccaacgcggctgtggagactctccagaagacggatactgctttggtggagaagtcgattaatactataaggttcttggcgattgatgctgttgagaaggcgaattcgggtcatccgggtctacccatgggttgtgcgcccatgggtcatatattgtatgatgagatcatgaggtataaccccaagaacccttattggtttaacagagatcgctttgttttatccgccggtcatggatgtatgcttcagtatgctctgcttcatcttgctggctacgatgctgttaaagaagaagacttgaagcaattccgtcaatggggaagcaaaactcccggccatcccgagaactttgagactcccggtgttgaagtcaccactggtcctcttggtcaaggtattgccaacgctgttggtcttgctcttgccgagaagcatttggctgctcgttacaacaaacctgatgccgagattgttgaccactacacatattgtattcttggagatggttgccaaatggaagggattgcaaatgaagcatgttcgcttgctggccattgggggcttggaaagttgattgctttctatgatgacaaccacatctccattgatggtgacacagagattgccttcactgagaacgttgacaaacgttttgaggctcttgggtggcacgtcatttgggtgaagaatggtaacactggttatgatgagatccgtgctgccattcaagaagctaagtctgtgactgataagcctactatgatcaaggttacgacaacaattggttttgggtcaccaaacaaggcgaactcatacagtgtccatggagcagctttgggtgcaaaagaagtagatgcaaccaggcaaaaccttggatggccttacgagccattccatgtaccagatgaagttaagaaacactggagccgccatacccctgatggtgccgctcttgaggctgagtggaatgctaaattcgcagcttacgagagtaagtaccctgaagaagctgctgaattaaaatctattgttactggtgtattgcctgctggatgggagaaggctcttcctacatacacaccagagacgcccggtgatgctacgagaaacctctcacaaacaatgcttaatgcattggcaccggttctacctggtcttgttggtggaagtgcagatcttgcatcttcaaacatgactctgatgaaaatgtttggtgatttccaaaaaaacacacccgaagaacgcaacgttcgtttcggtgtccgggaacacggtatgggagcaatttgtaacggtatcgccctccacagtcccgggttcgttccttactgtgctacattctttgtcttcactgattacatgagaggtgctatgagaatctcagctttatcagaagcaggagtcatttatgtaatgacccatgactccattggtctaggagaagatgggccgacccatcaacccattgaacatttggccagtttccgggccatgcccaacatcttaatgttccgcccggctgatggaaatgaaacagctggagcttacaaggttgcagtcgaaagccgaaaaagaccctcagttcttgctctttctaggcaaaaactacccaacctacccggaacttcaattgaaggaacctcgaaaggtgggtacacgataaccgacaactcaacaggtaacaagcctgatgttatcttgatcgggaccggttctgagctggaaattgcggttaaagccgctgacgaactcagaaaagaaggaaaatcagttcgggttgtgtctttcgtgtcatgggaactttttgaggaacaatccgatgaatacaaggaaagcgtccttccatcaggtgtaaccgctcgtgtcagcattgaggctggatcaactttcggctgggatagaattgttggaagcgcaggaaaagccattgggatcgacaaatgggggtcgagtgcaccagcaggaaagatctacaaggaatatggcattactgttgaagctgtggttgcagctgctaaacaagtgtcttaggctggtatctcgactcataatgctcggacaatcaataagaagtcggtttttagtctgtctttgatgcttttcagcgaacaccttagccgtgaatcgaacgaagatcagaagagagtattagaaagttgaatggttgatgctctcctcgtttatttgtaccaaaaattgaaacataattttcaaagttttgtgatttgtttggttactactgaggtgttcttttgagtaatgtacaattttacaagttatcataaggttattatta

SEQ ID NO: 9165 - DNA, 2613 bp, Arnica chamissonis
tctcccacgccgctctttcccgctccgccgttccccgccatggctcttccaccaccaccgcccaacagtcgacttccttggccactctctcaattccgactttctccggactcaaatctacctctacatcatcttcacgcgctcccactcgccggcaggtttcttccacgcgccgtcgtgtgatttccaacgcggctgtggagaccctccagaagacggatactgctctggtggagaagtcaatcaacaccatcagattcttggcgattgatgccgtggagaaggcgaattcgggtcatccgggtttgcccatgggctgtgcacccatgggtcatatattgtacgatgagatcatgaggtataaccccaagaacccgtattggttcaacagagatcgctttgttctctccgccggccatggatgtatgctccagtatgctctgctccaccttgctggctacgacgccgtcaaagaagaagacttgaagcaattccgtcaatggggaagcaaaactcctggccatcccgagaactttgaaactcctggtgtagaagtcaccactggtcctcttggtcaaggtattgccaacgctgttggtcttgctcttgctgagaagcatttggctgctcgttacaacaaacctgatgctgagatcgttgaccactacacatactgtattgttggagatggttgtcaaatggaaggaatttcaaatgaagcatgttcacttgctggccattggggacttggaaagttgattgctttctatgatgacaaccacatctccatcgatggtgacacggagattgccttcactgagaatgttgataaacgttttgaagctcttgggtggcatatcatttgggtgaagaatggtaacactggctatgatgagatccgagctgccattaaagaagccaaggctgtgactgataagcctactttgatcaaggtgacaacaacaatcggttttgggtcaccaaacaaggcgaactcatacagtgtccatggagcggctttgggtgcaaaagaagtagatgcaaccaggcaaaacctaggatggccttacgagccattccatgtaccagatgaagttaagaagcactggagccgccatacccctgatggtgctgctcttgaagctgaatggaatgctaaatttgcagcgtatgagaacaagtaccctgaagatgctgctgaattgaaatcaattgttactggtgtattacctgccggatgggagaaggctcttccgacatacacaccagaaacaccaggtgatgctacaagaaacctgtcacaaacaatgcttaatgcattggcacctgttctacctggtctcgttggtggaagtgcagatcttgcatcttcaaacatgaccctgatgaaaatgtttggtgatttccaaaaaagcacacccgaagaacgcaacgttcgtttcggtgtccgggaacacggtatgggagccatttgtaacgggatcgccctccacagccccgggttcattccttactgtgctacattttttgttttcactgattacatgagaggtgctatgagaatctcagctttatcagaagcaggagtcatttatgtaatgacccatgactccatcggtctaggagaagacgggccaacccatcaacccattgaacacttagccagtttccgggccatgcccaacatcttaatgttccgcccggctgatggaaatgaaacagctggagcttacaaggttgcagtcgaaagcagaaaaagaccctcagttcttgctctttctaggcaaaaactgcccaacctgcctggaacttcaattgaaggaaccgcaaagggtgggtacacaataactgacaattcaacaggtaacaagcctgatgttatcttgatcgggaccggttctgagttggaaattgcggttaaagcctctgatgaactcaagaaagaagggaaaacagttagggtcgtgtctttcgtgtcatgggaactatttgatgaacagtctgatgaatacaaggaaagtgtccttccatcgggtgtaacggctcgtgttagcatcgaggctggatcaactttcggttgggggaaaattgttggaagcaaaggaaaatccattgggattgacaaatgggggtccagcgcgccagcaggaaagatctacaaggaatacgggataacagttgaagctgtgattgcagctgctaaacaagtttgttaggctggtttgaacacgacatcaatttctgggcttccgaaacttacataaaagaagtttgatgttagtttttggtatcttgattcataatgctcagacgaacaataagaagttggtttttagtctttgatgcttttcatcgaacaccttacctgcaaatggaacgaagatcagaagagaggattagaagttgaatgatcgatgcctttgtttacttgtaccaaaatcgaaacataaatttcagagttttgtgattttatttgtttggttgctattgaggtgttgttttgagtaatgtacaaattttcactcatgctttgtagcctattggtatggcgttgcccactcccctaaaaaggtaacgatggttcaaatccttacatatacaaggttggtgtta

SEQ ID NO: 9166 - DNA, 2686 bp, Chrysanthemum coronarium
agagccatggcttctctcactctctcccaagctgccctcacacgcgccaccgtcacgcgccatggctcttccacccccacaccccacgcgccacattccctctcttccctccaaatacccactttctccggcttgaaatcctccaccgtatccacctcacgcgctcccacgcgccgtcatgtctccgccactcgcagacgcgtggtcacaaacgcggccgtagaaacccttgaaaaaaccgacacagcacttgtggacaagtccgtgaacaccatcaggttcttggcgattgacgctgttgagaaagcgaattcgggtcatcctggtttgccaatgggttgtgcacccatgggtcatattttgtatgatgaggttatgaggtataacccaaagaacccttattggtttaacagagatcggttcgttttgtctgctggtcatggttgtatgcttcagtatgctcttcttcatcttgctggttatgatgctgttacaacagaggatttgaagcaattccgtcaatggggaagtaagactcctggtcatcctgagaactttgaaactcccggagttgaagttaccactggtcctcttggtcaaggtattgccaatgctgttggtcttgctcttgctgagaagcatttggctgccagatacaacaaaccagatgccgagattgttgaccactacacatactgtattgttggagatggttgtcaaatggaaggtattgcaaatgaagcgtgttcacttgctggacattggggacttggaaagttgattgctttctacgatgacaaccacatttccattgatggtgacaccgagattgcctttactgaaagtgttgacacacgttttgaggctcttgggtggcacatcatttgggtgaagaacggtaacaccggttatgatgagatccgtgctgccattcaggaagccaaggctgtgactgataagcccactttgatcaaggtgacaacaacaatcggttttggatcaccaaacaaggccaactcatacagtgtccacggagcagctttgggtgcaaaagaagtagatgcaaccagacaaaaccttggatggccttatgagccattccatgtacctgatgatgtcaaggcacactggagccgccacactcccgagggtgctgctcttgaagcggaatggaatgctaaattcgcagagtacgagaagaagtatgctgaggatgcagcagagttgaagtctattgctgatggtgtattgcctgccggatgggagaaagctcttcccacatacacaccggaaactcctggtgacgccacaagaaacctttcacaaacaatgcttaacgcattggcaccggttctccctggtttcattggtggaagtgccgatcttgcctcatcgaacatgactttaatgaaaatgtacggtgatttccaaaaagctacacccgaagaacgcaacgtcaggtttggtgtccgtgaacacggtatgggagccatctgtaacggaattgccctccacagccctgggttcatcccatactgtgctaccttctttgttttcactgattacatgagaggtgccatgagaatctcagctttatcagaagccggtgtcatctacgtgatgacccacgactccattggtctaggagaagacggtcccacccatcagcccattgaacatttagccagtttccgtgccatgcccaacatcttaatgttccgaccagccgacggtaatgagaccgctggagcttacaaggtcgcagttgagagccgaaaacgaccctcagtccttgctctttctagacaaaagctgcccaacttgcaaggaacttcaattgaaggaaccacaaagggtggttacacaataaccgacaattctaccggaaacaaacccgatgttatcttgatcggaactggttctgagctagaaattgcagctaaagctgctgatgaactcagaaaggaagggaaaaccgttagggttgtatcttttgtctcatgggagctttttgatgaacaatctgctgactaccaggaaagtgttcttccatcaagtgtaacagcccgtgtcagtattgaagctgcaacaactttcggatgggcgaaaatcgttggaagcaaaggaaaggccatcggtattgacaaattcggagccagtgcaccagcaggaaagatttacaaggagtatggaatcactgttgaagctgtggtcgcagcagccaaagaagttatataggccgttttgaaccagagatcaagttctgagctttggaaacttgcaaaaagacgatccttgttagttttctgtaatcttgattcataatgctcagacaaacaataaaaagtcggttttttagtctttgatgctttcatggaataccttagctgtaaatcgaacgaagatcaagagagaagattagaagttgaaagattgacgatgctctcacaaatttgtatcaaaattaaaacatattttttccaagttttgtgatttttgtatgtttgattacctctgaggtgttcttttgagtactgtacaattttacaacttataacgacactatattattctgaatttttggagcatctagcttctttcttgatgaaactcaggatctgtagttctgtactaatgacactattgtatgttggctatctagatacatgatcaggcatagattcag

SEQ ID NO: 9167 - DNA, 2510 bp, Chrysanthemum coronarium
cccaagctgctctcacacgcgccgccgtcacgcgccatggctcttccaccaccacaccccaacaacccacctccctctcaactctccaaatacccactttctcaggcttgaaatccaccccacccacctcctcacgcgcgcccacgcgccgtcatgtctccgccacgcgccggcgcgttgtcacaaacgccgccgtggagacgctcgagaagaccgacaccgcccttgtggacaagtcggtgaacactatcaggttcttggctattgatgctgttgagaaagcgaattcgggtcatccgggtttgcccatgggttgtgcacccatgggtcatattttgtatgatgaagttatgaggtataacccaaagaacccttattggtttaacagagatcggtttgttttgtctgctggtcatggttgtatgcttcagtatgctcttcttcatcttgctggttatgatgctgtcacaacggaggacttgaagcaattccgtcagtggggaagcaagactcctggtcaccctgagaacttcgaaactcccggagttgaagttaccactggtcctcttggtcaaggtattgccaatgctgttggtcttgctcttgctgagaagcatttggctgcaagatacaacaaacccgatgccgagattgttgaccactacacatactgtattcttggagatggttgtcaaatggaaggtattgcaaacgaggcatgttcacttgctggacattggggacttggaaagttgattgctttctacgatgacaaccacatttcgattgatggtgacaccgagattgcctttactgaaagcgttgacacacgttttgaggctcttgggtggcacatcatttgggtgaagaacggtaacactggttatgatgagatccgtgctgccattaaggaagccaaggctgtgactgataagcccactttgatcaaggtgacaacaacaatcggttttggatcaccaaacaaggccaactcatacagtgtccacggagcagctttgggtgcaaaagaagtagacgcaaccagacaaaaccttggatggccttatgagccattccatgtaccagatgatgtcaaggcacactggagccgccacacccctgaaggtgctgctcttgaagctgaatggaatgctaaatttgcagagtacgagaagaaatacgctgaagatgcagcagaattgaaatctattgctgatggtgtattgcctgctggatgggaaaaggctcttcccacatacacacctgaaactcccggtgatgccacaagaaacctttcacaaacaatgcttaacgctttggcaccagttctccctggtctcattggtggaagtgccgatcttgcttcatcaaacatgactctaatgaaaatgtttggtgatttccaaaaagccacacccgaagaacgcaatgtcaggtttggtgtccgtgaacacggtatgggagccatctgtaacggtatcgccctccacagccccgggttcatcccttactgtgctaccttctttgttttcactgattacatgagaggtgccataagaatctcagctttatcggaagctggtgtcatctacgtgatgacccacgactccattggtctaggagaagacggtcccacccatcagcccatcgaacatttagccagtttccgtgccatgcccaacatcttaatgttccgaccagctgacggtaacgagaccgctggagcttacaaggtcgcagttgagagccgaaaacgaccctcaatccttgctctttccagacaaaagctacccaacttgcccggaacttcaattgaaggaaccgcaaagggtggttacacaataaccgacaattctaccggaaacaaacccgatgttatcttgatcgcaactggttccgagctggaaattgcagctaaagctggtgatgaactcagaaaggaggggaaaaccgttagggtcgtgtcttttgtctcatgggagctttttgatgaacaatctgccgactaccaagaaagtgtccttccatcaagtgtaacagcccgtgtcagcattgaagctgcttcaactttcggatgggggaaaatcgttggaaccaaaggaaaggccatcggcatcgacaaattcggagccagtgcaccagcaccaaagatatacaaggaatacgggatcactgttgaagctgtggtcgcagcagctaaagaagttatataggccagtttgaactcgaggtcaagttctgagctttggaaacttaacagaaaacgatcgttgttagtttcagtaatcttgattcataatgctcagacaaaacaataaaaagtcggttttttagtctttgatgctttcatggaataccttagctgtgaatcgaacgaagatcaagagagaagattaaatgcagaaagattgatgatgctctcacgaatttgtatacaaaataacattattttttcctaagttttgtgatttttatatgtttgattacctctgaggtgttcttttgagtta

SEQ ID NO: 9168 - DNA, 3472 bp, Cocos nucifera
atccagttgcttcgccttacgcccaccccaataaaacctcaaacctctcaattcccacctcacccacccaaaaacgaaggggagactaggggaggcggagaaaactagtgagagaaacagggcgagccatggccgcttcctcctccgtcaccgctgcgcaggccctcgtcggccgggccatctccggccactcctccccctccccttcccaccccgaccgcctcgccttcggaatcagctccattgccggcaacgccctcaagtcccccgccgccccccgcctccagaaccggcgcccgcaggccgcctccaggcctcgccgatacgccgtcacgagggcggcggcggtggagacgctggaggagaagcccgccacggaggccctggtggagaagtcgatcaacacaatccggttcctggccatcgacgccgtcgagaaggccaactccggccacccgggacttcctatggggtgtgcgccaatgggccacatcctctacgacgaggtcatgcgctacaatcccaagaaccccttctggttcaaccgcgaccgcttcgtgctctccgccggacacgggtgtatgctccagtacgccctgcttcaccttgctggttacgatagcgtcaagatggaggatttgaaggctttccggcagtggggaagcaaaactcctggtcatcccgagaatttcgaaactctgggaattgaagtcactactggtcctcttggtcagggtgttggaaatgctgttggattggcacttgctgagaagcacctagctgcccgcttcaataagcctgacatggagattgttgatcattacacgtattgtatacttggggatggttgccaaatggagggcatttctaatgaagtttgttctcttgctgggcactggggcttgggaaagctgattgctttttacgacgacaaccacatttccattgatggagacacagagattgcatttacggaagatgtaaatgcccgttttgaggcccttggctggcacactatatgggtgaagaatggtaacacaggctatgatgaaatccgtgctgcaataaaggaagcaaaggctgtcaaagataaacccacactgatcaaggtgaccaccaccattggttatgggtctccaaacaaggcaagcacatatagcgtacatggaagtgcattgggtgctaaggaagttgaagcaaccaggcagaaccttggttggccttatgagccttttttcgtacctgaagatgtgaagagtcattggagccgccatgtcctggaaggtcctgctcttgaagctgaatggaatgccaagtttgcacagtatgagaagaaatataaagaggatgctgcagagctgaagcagatcataacaggagaactgcctgctggatgggagaaggctcttccgacatacacacctgaaagtcctgcagatgccactagaaatctttctcagcaatgcctcaatgctcttgctaaagtactccctgggttcctaggaggtagtgccgatcttgcatcctcgaacatgacactgctgaagatgtttggtgacttccaaaaggacacacctgaggagcggaatgtccgtttcggtgttagggaacatggaatgggtgccataagcaatggcattgccctgcacagcccaggtcttatcccttactgcgctactttctttgtcttcacggactacatgagagctgccataaggatctcagccttgtctgaggcaggagtcatctatgtgatgacacatgattctattggtcttggagaagatggtcccacccatcagcccattgagcatctgattagcttccgagcgatgcccaacattttgatgctccgtccagcagatgggaatgagactgctggggcatacaaggttgcaattctcaacagcaagcggccatcaatccttgctctatcccgtcagaagcttcctcagcttgcaggaacatcagctgaaggagttgcgaagggaggatatattatttcagacaactcatctggtaacaagccagatctcattattatgagcactggctcagaattggagattgctgccaaggctgcagatgagctgaggaaggagggaaaagcagtccgagttgtgtcacttgtctcctgggagttgtttgatgagcaatctgatgaatacaaggagagtatcctccctgcttctgtaactgctagaatcagcattgaagcaggagccactcttgggtgggagaagtttgtaggtccctatggcaggtctatagggattgaccggtttggggcaagtgctcctggtgggcggatttacaaggaatttggtataacagcagagaaagttattgaagcagccaagtctctataagatcagcttgtctagggtccttcctctctcatggttacaaggagaacctagattccagggcctcgcttcagggagttagagtacactggtgtggaagaagccagctttgacagatttgagtctggcattcggcctgtaataaagcccttcatattttcttgaacttttcccattttataattgatgaagttgagtcctcttcttgttctgatttaatcaaacaattgcatctgatggttgcatctgtactctgttaatctattaaattttgaatgctttcgtaggaaaatctttaatatgtaattctgaaccgttaactttttagacctgcactatctcatctctctggtcataaagcagtcattttttctcacagaatctaagttgatgttggtgttttcaagttagtttttcttccttccctatgtgtgtggtgttgtggcatcctcgttgaaagaaaacttttgcggcagaatttatttttgtcttccaaatcaagctctcctttgcctttgtttactcccattgtaccgtttatcattctaaatgttcttgccaaatgtgcttttatgttgttgcaacctttaatgggaacctgaaagcatggctgtggatgggtgggatgggctgatttttgcgatggataaagttgcaatgcaagccaatgcaaagaggctacaatcgatctgcatccgcaacttggctttccttgggggctggcgtgaataccttttctgatgacaacatctatggttggaaattggtggactagatcttctctatctatattgtcagcttctagaggagttcagtttctcaggagttgctgtcatcatctactctcttcttctcatccttgtgtttttcttgtgtggtgacaatagcttttagagtaccatcttagaaatggtcagggatatgtcttttatgtgagagaaggattctctttccttagtgtgaattcattattggattgcacaatgatcacttcaagaactgtgcagatggatgaatggaggagtttggagtgcttaagatctatacagagtgcaatctaatggttgatatagtgaaagaagatgcatcattcttttgcgtgaaag

SEQ ID NO: 9169 - DNA, 2450 bp, Trigonella foenum-graecum
ctcaccaccccccatctcacgcgctcttctaccacgcgccctcctcttctctccccatccaccatcaccctcaaccgctcaccaaccccctccacccatctctcccctctctcaatcccacctccaccaccgcaccgccatccatgcctccgtcagcgcaccaccgtcaaccaccacagactcatctctcgttgagaaatcaatcaacacgatccgattcctcgcaattgattcagttgaaaaagctaattcgggtcaccccggtttacctatgggttgtgctccaatgggtcatgttctttatgatgaggttatgaggtataaccccaagaacccgttttggtttaaccgtgatcggtttgttttgtctgctggtcatggttgtatgcttcagtatgctttgcttcatcttgctggatatgacagtgttaaggtagaagatttgaaggaatttcgtcaatgggagagcagaacccctggacaccctgagaattttgagactcccggaattgaagtcacaacaggtcctcttggtcagggcattggcaatgctgttggtttagcccttgcggagaagcacttagctgccagatttaacaagcccgacaatgagatcatcgatcattacacgtattgtatattgggtgatggttgtcaaatggagggaattgcaaatgaagcttgctcacttgcaggacattggggactagggaagctaatagcattttacgatgacaatcacatttctattgatggtgacaccgaaattgcgttcactgagagtgttgaaaaacgttttgaaggacttgggtggcatgttatttgggtaaagaatggaaacactggctatgatgaaattcgtgctgccattaaggaagcaaaggctgtcaaagacagacccacattaatcaagttcacaacaaccattggttatggttctccgaataaatccaactcctacagtgtgcatggaagtgcacttggtgccaaagaagttgatgccacaagaaacaatcttggatggccatatgagcctttccatgttcccgaggatgtcaaaaagcattggagtcgccacacccgtgacggtgctgctcttgaatctgagtggaatgccaagtttgctgaatatgaaaagaagtacaaggaggaagctgctgtattgaaatctatcatcagtggtgatttacctgctggttgggagaaagcgcttccgacttacactccagagatccctgccgatgcgacccgaaacttgtcgcagcaaaaccttaatgcccttgcaaatgttcttcccggtctgattggtggtagtgcagatcttgcttcttccaatatgaccttgctgaaaaagtttggtgatttccaaagtggttctccagaagagcgtaacgttagatttggcgtcagagaacatggaatgggagcaatctgcaacggcatcgctcttcacagccgtggacttattccatactgtgcaaccttttttgttttcactgactacatgcgtggtgccataaggctttccgccctatcggaagctggtgttatatatgtcatgactcacgattcaataggactcggagaggatggaccaacccatcagcctatagagcacctggcaagcttccgggcaatgccaaatatcttgatgctccgtcccgctgacggtaacgaaacagctggagcatacaaagttgcggtgcttaacaggaagagaccctctatccttgccctttctagacaaaaattgcctaaccttgccggaacttctattgaaggagttgaaaagggtggatacatcgtctctgacaactcaacaagaaacaaacctgatgtcattttgatcggaaccggttccgaattggaaattgcttacaacgccgctgaggatctaagaaaagaaggaaaggctgttagagttgtttccttgtttcttgggaacttttgatgaacaatcacaagcttacaaggagagtgttctgcctactgctgtttcggctagggttagcattgaggccggatcaacatttgggtgggagaaaattgttggaagcaaaggaaaagcaatcggcattgatcgttttggagctagtgctcctgcaggaagaatatacaaagagtttggtatcactaaagaagctgttattgctgcagcaaaagagcttatttagaactttactttctgttcatttaagaactttctcttatatttttcttctggttttgcttttgggtttgatatatctacacaaaaagggtgtttcaatagcgttgtgttgttgcttgaataagaaaaaggttagattactgttgcttatgattgtgagttaaactaagcaacatagattcaaagtagtacactaataaatttttaggaacttgtaaacttttcaaccaattgagttttgtgttgccacattgttgaatttaataatattcatgtgtgt

SEQ ID NO: 9170 - DNA, 2336 bp, Brassica napus
ccatggcttcaacttcctccctcgctctctctcaagccctcctcgctcgcgccatctctcaccatggctccgaccaacgcatctccctaccatcatctttctcacgcgcctccgcttcctctcgccgccgcaacgccgcgtcgatgaccaaactccgatctatccgccccctcgttcgcgccgcagctgtcgagaccctcgagacgagcaccgattcgtctattattgacaaatccgttaattcgatcaggttcttggctatcgatgcggtggagaaggccaagtcaggtcaccctggtctccccatgggatgtgctcccatggctcacattctctacgatgaggtcatgaggtataaccccaagaacccttactggtttaaccgtgaccggttcgttctctctgctggacatggttgtatgctgctctacgcgttgcttcacctcgctggatacgacagcgttttggaggaggatttgaagagtttccgacagtggggaagcaagacacctggacatcctgagaacttcgagactcctgggattgaagtcactaccggtccacttggacaaggggttgctaatgctgttggtttagctcttgctgagaagcatttagctgctaggttcaacaaacctgacgctgaagttgtcgaccactacacatatgtgattcttggagatggttgtcagatggagggtatttcaaatgaagctgcctcactagctggtcactggggacttggaaagctcattgctttctatgatgacaatcacatctccattgatggagacactgagattgcattcactgagaatgttgaccagcgttttgaagcgcttggatggcatgttatttgggtgaagaatggtaacactgggtatgatgagatccgtgctgctattaaggaagctaaaacggttacagacaagcctacattgatcaaggtcactactacaattggttatggatctccaaacaaggcgaactcgtacagtgtccatggagctgcacttggtgagaaggaagttgaggctaccagaaacaacctcggatggccttatgagccattccaggtacctgatgaagttaaaagccactggagtcgtcatacgcctgaaggcaaagctcttgaatctgactggaatgcaacgtttgcagcgtatgaaaagaagtacccagaggaagctgcagagttgaaatctatcatcactggtgaattacctgctggctgggagaaggcactacctacatacacacccgagtctccaggcgacgccactagaaacctgtcacagcaatgtcttaacgccatagccaaagttgtccctggtttcctcggtggaagtgctgacctcgcatcatccaacatgacactcctcaaagcctctggtgacttccaaaaggccacacccgaagaaagaaaccttaggtttggtgttagggagcacggaatgggagccatctgcaacggcatagccctccacagccccggtctcatcccttactgtgcaactttcttcgtcttcactgactacatgagaggtgccatgagaatctcagctctgtccgaagctggagtgatctacgtgatgactcatgactccattggtctcggagaagatgggccaacccatcagcccattgagcacatcgctagcttccgcgcgatgcccaacacgctcatgttccgtcccgccgatggaaacgagacggccggtgcgtacaagatcgctgtcaacaagcgtaagacgccgtctatcttggctttgtctaggcaaaagcttcctcagcttccggggacatcgatggaaggagttgcgaagggtggatacacgatctctgacgactcgtcggggaacaaacctgatgttatcttgattggaactggctctgagctggagattgctgcacaggctgcggaggtgattaggaaagaaggcaagaccgttagagttgtgtcttttgtctgctgggagctgtttgatgagcagacggatgagtacaaggagagtgttttgccgtctggtgtgtcggctagagttagtattgaagcagcttcgacttttggatgggggaagattgttggagggaaagggaagtctattggtattaactcgtttggggctagtgcaccggcgcctttgctctacaaggagtttggtatcactgtggaagctgttgttgatgcggctaagtcactcttctaagagactcaaagatcagactatcctgtataagggtttgtgtcaacattgtctcattatctcaaaataaattgcaacaagacgcatagagtttctttctttctttcttcttttggtggtttttttttt

SEQ ID NO: 9171 - DNA, 2535 bp, Chrysanthemum coronarium
cccaagctgctctcacacgcgccaccgtcacgcgccatggctcttccaccaccacaccccaacaacccacttctctctcaactctccaaatacccactttctcaggcttgaaatccaccccacccacctcctcacgcgcgcccacgcgccgtcatgtctccgccacgcgccggcgcgttgtcacaaacgccgccgtggagacgctcgagaagaccgacaccgcccttgtggacaagtcggtgaacactatcaggttcttggctattgatgctgttgagaaagcgaattcgggtcatccgggtttgcccatgggttgtgcacccatgggtcatattttgtatgatgaggttatgaggtataacccaaagaacccttattggtttaacagggatcggtttgttttgtctgctggtcatggttgtatgcttcagtatgctctccttcatcttgctggttatgatgctgtcacaactgaggacttgaagcaattccgtcaatggggaagcaagactcctggtcatcccgagaactttgaaactcccggagttgaagttaccactggtcctcttggtcaaggtattgccaatgctgttggtcttgctcttgctgagaagcatttggctgcaagatacaacaaacccgatgccgagattgttgaccactacacatactgtattcttggagatggttgtcaaatggaaggtattgcaaacgaagcatgttcacttgctggacattggggacttggaaagttgattgctttctacgatgacaaccacatttcgattgatggtgacaccgagattgcctttactgaaagcgttgacacacgttttgaggctcttgggtggcacatcatttgggtgaagaacggtaacactggttatgatgagatccgtgctgccattaaggaagccaaggctgtgactgataagcccactttgatcaaggtgacaacaacaatcggttttggatcaccaaacaaggccaactcatacagtgtccacggagcagctttgggtgcaaaagaagtagatgcaaccagacaaaaccttggatggccttatgagccattccgtgtaccagatgatgtcaaggcacactggagccgccacacccctgaaggcgctgctcttgaagctgaatggaatgctaaatttgcagagtacgagaagaaatacgctgaagatgcagcagaattgaaatctattgctgatggtgtattgcctgccggatgggaaaaggctcttccaacatacacacctgaaactcccggtgatgccacaagaaacctttcacaaacaatgcttaacgctttggcaccagttctccctggtctcattggtggaagtgccgatcttgcttcatcaaacatgactctaatgaaaatgtttggtgatttccaaaaagccacacccgaagaacgcaatgtcaggtttggtgtccgtgaacacggtatgggagccatctgtaacggtatcgccctccacagccccgggttcatcccttactgtgctaccttctttgttttcactgattacatgagaggtgccataagaatctcagctttatcggaagctggtgtcatctacgtgatgacccacgactccattggtctaggagaagacggtcccacccatcagcctatcgaacatttagccagtttccgtgccatgcccaacatcttaatgttccgaccagctgacggtaacgagaccgctggagcttacaaggtcgcagttgagagccgaaaacgaccctcaatccttgctctttccagacaaaagctacccaacttgcccggaacttcaattgaaggaaccgcaaagggtggttacacaataaccgacaattctaccggaaacaaacccgatgttatcttgatcgcaactggttccgagctggaaattgcagctaaagctggtgatgaactcagaaaggaagggaaaaccgttagggtcgtgtcttttgtctcatgggagctttttgatgaacaatctgccgactaccaagaaagtgtccttccatcaagtgtaacagcccgtgtcagcattgaagctgcttcaactttcggatgggggaaaatcgttggaaccaaaggaaaggccatcggcatcgacaaattcggagccagtgcaccagcaccaaagatatacaaggaatacgggatcactgttgaagctgtggtcgcagcagctaaagaagttatataggccagtttgaactcgaggtcaagttctgagctttggaaacttaacagaaaacgatcgttgttagttttcagtaatcttgattcataatgctcagacaaaacaataaaaagtcggttttttagtctttgatgctttcatggaataccttagctgtgaatcgaacgaagatcaagagagaagattaaatgcagaaagattgatgatgctctcacgaatttgtatcaaaataacatattttttccaagttttgtgatttttatatgtttgattacctctgaggtgttcttttgagttatgtacaattttacaacttataattgac

SEQ ID NO: 9172 - DNA, 3655 bp, Ananas comosus
aaatacaacaccagcgccaccaggagcagcaacgaagtcgtcggcgactctgaacacgtaaacataaaaaagaagaaatggccgcgtcgtcgtccgtcgccgctgcgcaggccctggtgggccgcgccgtcgccgcccacggcgccccccatggctccaccccgtccgaccgcctcgccctccccgccgccttccacctcagctcactcggcggccacggccgcgccctcacctcgcccgcccgccgcctgaacgccgcctcgccgcctccgccgcgtccgaggaggcgtgttggggtgcgggcggccgcggtggagacggtggggcagaaagttggagcgacggaagaggtgctggagaagtcagtgaacacgatccggttcctggcgatcgacgcggtggagaaggccaactcggggcacccgggcctccccatgggctgcgcccccatgggccacatcctctacgacgaggtcatgcgttacaaccccaagaacccctactggttcaaccgcgaccgcttcgtcctctccgccggccacggctgtatgctccagtacgccctcctccacctcgccggctacgacagcatcaaggatgaagacttgagggcctttcgacaatggggaagcaggactcccggccaccccgagaactttgaaacacctggagttgaagttactaccggccctcttggtcagggtattgcaaatgctgttggcttggcgcttgctgagagacatcttgctgcccgtttcaataagcctgataatgagattgtcgaccattacacgtatgtcatagtaggggatggttgccaaatggagggcatctcaaatgaagcttgctctctggctggtcacttgggtcttgggaaactgattgccttctatgacgacaatcacatctccattgatggagacacagagattgcttttactgaagatgtgagtgcccgatttgaagctcttgggtggcacactatctgggtgaaggatggaaacacaggatacgatgatatccgtgcggctatcaaggaagcaaaggctgtcaaagataagcccacattgatcaaggtgaccactaccattggctatgggtctccgaacaaggcaaacacatacagtgtgcacggaagtgctttgggtgcgaaggaagttgatgcaacgaggaagaaccttggatggccgtatgaacctttccatgtgcctgaagatgtcaaaagtcactggagtcgccatgtcccagaaggcgcagctctcgaggctgagtggaatgccaaatttggcgagtatgaaaagaagtacccagaggatgcggcagatttaaagactatcatttcgggggaattgcctgctggatgggctgatgctcttcctaaatacacccctgagagctcggcagatgctacaaggaacctctcgcagcagtgcttaaatgccctggccaaagtcctccccggccttattggtggcagtgctgatcttgcttcctccaacatgacactgttgaagatgtttggtgacttccagaaggacacgcctgaagaacggaacctacggtttggagtgcgcgagcatgggatgggcgccatttgcaatggcattgccctccacagcccaggccttatcccatattgtgccaccttctttgtcttcacggactacatgcgggctgccatccgcatatctgccctctgcgaggccggcgtcatctatgtcatgacccacgactccatcgggctcggagaagatggtccaacgcatcagcccattgagcatctcattagtttccgggccatgcccaatatcctaatgctccgacccgctgatgggaatgagactgctggggcatacaaggttgcagtcctcaacaggaagaggccgtcgatcttggcgctctctcgtcagaagcttccgcagcttgcgggttcttcgattgaaggagttgagaagggaggatacatcatttcagacaactcaaccggtaacaagcccgatcttatactgattgggaccggttctgagcttgaaattgctgctaaggctgcagatgaactgaggaaggaggggaagacggtgcgtgttgtgtctttggtttgctgggagctgtttaatgagcaatcggaggagtacaaagaaagcgtgttcccagctgctgtgactgctagggttagcattgaagcgggggcaactcttgggtgggagaagtttgttgggagcaagggaaaggcaattggcatcgaccggttcggcgcaagcgctcctgctgggaggatatacaaggaattcggtttaactgcggagaaggtcatcgaagctgccaaaagcctataaggtggagtagtttataaccattcccctttctggattacatacattgctgagcctttcacgtgccctgcttgtagtaacgttgtaggggaagaagcagccagcatttcgcctgtaacaaaggctacctcttaatggatttttctcctttctatttcctctctatgatttgtgaaggtaaccctatttttattgatgaccgctactggtgcttgcaccagacattatcttccgctactctagaagagtttttaatgctttcagacaaattttagaaagaaaatgaaataactgagagtgtggtattaaatcctttttgtacctgctatattttattcagcttgcttttgtgttgatttttatgtgtgggatgatgtcactgtttatttattgtgccagactcatttttgctaaccctataagttaagagcagcgcatgggtccttgtttggtcgtactgcttctcggacaaaagtgttatttgagttgggttgtttgtttgaggaagctatttttgatatgtttttctaaatttatgattttgatgtactgtaacaacttcccagtccagttggagcttttgtattcaggagacctgattcaaattttatgcgacagctagagctccacatttcttattttctaaataaatacttgttggtgttagagtcatataagcggtattaaaagccagacaaattagacactgcgtctgcgtagcatggaaagtgtttttctgtattacatgtactttactagtaggaccctcattttctacttattcaatgggaactcagtatgcagccttttcgcattctgtattatcacataaccattggcatgagaaatattcattaggttttctgaaaattcctttatgaaggtgttaatttgtgttctgcaatgtaaggcatggcatttatatctgctcggcatttgaattggaagagtataagcgtagggacataaaaacgaggtggataggttattatttgttacgaagagatctggctcttttggccgtccaatagtgctagaataataattctcctccgcacgtgcttgatcagagggagggcaagcgtacgaggattcagatgataggatgagagaagcgcatttgtgtggtcggaaactcagaaagtagatgaagatgcgcatgtgcggtcggaaacttggaaggtagatgaagaagcgcatcatttgtggtaggaaacttggatggtagatgatgttgatggcctcctattccttatcttctaacaggagttccctacctcagattttgcatctccaaattcgtcctccagtattttgaatga

SEQ ID NO: 9173 - DNA, 2454 bp, Helianthus annuus
ccacgccgccctcgtcccccgccatggctcttccaccaccacccccaccgtctcaatcccagccttcaccggactcaaatccacctccgcacgcgcctccactcgcggacaagtctccgccacgcgccgtcaggttgcacccacgcgccgccgcgtgatcgtcaacgcggctgtggagacgttgcagaagacggatactgctttggtggagaagtcgattaatactattaggtttttggcgattgatgcggttgaaaaggcgaattcgggtcatcccggtttgcccatgggttgtgcgcccatgggtcatatattgtatgatgaggttatgaggtataacccgaagaacccgtattggtttaacagagatcggtttgttctttctgctggtcatggatgtatgcttcagtatgctctgcttcatcttgctggatatgatgctgttaaagaagaagacttgaagcaattccgtcaatggggaagcaaaactcctggccatcccgagaactttgaaactcctggtgttgaagtcaccactggtcctcttggtcaaggtattgccaacgctgttggtcttgctcttgccgagaagcatttggctgctcgttacaacaaacctgatgccgagattgtcgaccactacacatactgtattcttggagatggttgccaaatggaaggaattgcaaacgaagcatgttcgcttgccggccattggggactcggaaagttgattgctttctatgacgacaaccacatctccattgacggtgacaccgagatcgccttcaccgagaacgtcgacaaacgttttgaagctcttgggtggcacgtcatttgggtgaagaacggtaacactggttacgatgagatccgtgctgccattcaagaagccaaggccgtgaccgataagcccactatgatcaaggttacaacaacaatcggtttcgggtcaccgaacaaggcgaactcatacagtgtccatggaaccgcgttgggtgcgaaagaagtagacgcaacccgacaaaacctcggatggccttacgagccattccacgtacccgatgaagttaaaaagcactggagccgccacacccctgacggtgccgctcttgaagccgaatggaatgctaaatttgcagcttacgagagtaagtatcccgaagaagccgctgaattgaaatctattgttaccggtgtattgcctgccggatgggagaaggctcttccgacatacacaccagaaacacccggtgatgctacaagaaatctttcgcaaacaatgcttaatgcattggcaccagttctacccggtctcattggtggaagtgcggatcttgcatcttcaaacatgacgttaatgaaaatgttcggtgatttccaaaaagccacacccgaagaacgcaacgttcgtttcggtgtccgggaacacggtatgggagctatttgtaacggtatcgctcttcacagccccgggttcgttccttactgtgctacgttctttgtcttcaccgattacatgagaggtgccatgagaatctcggctttatcagaagcaggagtcatttatgtaatgacccatgactccattggtctaggagaagacgggccgacccatcagcccatcgaacatctagccagtttccgggccatgcccaacatcttgatgttccgaccagctgacggtaacgaaacagccggagcttacaaggttgcagtcgaaagccgaaaacgaccatcggttcttgctctttctaggcaaaaactacccaacctaccgggaacttcaatcgaaggaaccacgaaaggtgggtacacgataaccgacaactcaacaggcaacaagcccgatgttatcttgatcggaaccggttctgagctcgaaatcgcggttaaagccgccgatgaactgagaaaagaagggaaaacggtccgggttgtgtcgtttgtgtcatgggagcttttctatgaacaatccgatgaatacaaggaaagcgttctcccatcgagtgtgaccgctcgtgtcagcattgaggccggatcaactttcggttgggatagaattgttggaagcgcgggaaaagctatcgggattgacaaatgggggtcgagtgcaccagctggaaagatctacaaggaatatggtattaccgttgaagctgtgattgcggctgctaaacaagtgtcttaggcttgtatcttgattcgtaatggttgaacgaacaataagaagtcggttttttagtctttgatgcatttcagcgaacaccttacttgcgaatcgaacgaaaaatcagaagagaggattagaagttgaatgtttgatgctctttcctcctttatttgtaccaaaactgaaacataattttcaaagttttgtgatttgtttggttactagtgaggtgttcttttgagtaatgtacaattttacaagttatcataagattattatat

SEQ ID NO: 9174 - DNA, 2601 bp, Elaeis guineensis
cctcccctctcaccaaccccatagcgatcgaaggggcggggaaacttagagagaacgagccatggccgcttccccctccgtcaccgccgcccaggcactcgtcggccgcgccatctccggccacccctccccatcccctgctcaaccggaccgcctcgccttcggcctcagctccctcgccggccgcgccctcaagtccccccgcctccagaacctccggccgcaggccgccccccggccccgccgcgccgccgtcaccagggcggcgagggtggaaacgctggaggggaaggcggccacggaggctctggtggacaagtccgtcaacacgatccggttcctggccgtcgacgccgtcgagaaggccacttctggccacccgggccttcctatggggtgcgcccccttgggacacatcctctacgacgagatcatgcgctacaaccccaagaatccttactggttcaaccgcgatcgcttcgttctctccgccggccacgggtgtatgctccattacgccctgctccacctcgccggatatgatagtgtcaaggaggatgatttgaaggctttccggcagtgggaaagcaaaactcctggccatccagagaattttgaaactcctggaattgaagtcactactggtcctcttggtcagggtattgcaaatgctgttggattggcacttgctgagaggcacctagctgcacgtttcaataagcctgacatggagatcattgatcattacacgtatgttgtagttggtgatggctgccaaatggagggcatttctaatgaagcttgttcgcttgccgggcactggggtttaggaaagctgattgctttttacgatgacaaccacatctccattgatggagacacagagattgcatttacagaagatgtaaatgcccgtttcgaggctcttggctggcacacgatctgggtgaagaatggtaatacaggctatgatgaaatccgtgctgcaattaaggaagctaaggctgtaaaagacaaacccacactgatcaaggttaccaccaccattggttatgggtcacccaacaaggcgaacacatatagcgtgcatgggagtgcattgggtgctaaggaagttgatgcaaccaggcagaaccttggatggccttatgagcctttttttgtgcctgaagatgtgaagagtcactggagccaccatgtcccagaaggtgctgctcttgaagctgaatggaatgctaagtttgcagagtatgagaagaaatacaaagaggatgctgcagagctgaagcgtatcatatctggagaactgcctactggatgggagaaggctcttccgacatatacgcttgaaagtcctgcagatgccactagaaatctatctcagcaatgcctgaatgctcttgctaaagtacttcctggatttctaggaggcagtgctgatcttgcctcctccaacatgacattgctgaagatgtttggtaacttccaaaaggacacacctgaggagcggaatgttcgtttcggtgttagggaacatgggatgggtgccatatgcaatggcattgccctccacagcctgggccttatcccctactgtgctaccttctttgtcttcacagactacatgagagccgccataaggatctcggccctgtctgaggcaggagtcatctatgtgatgacacatgattctattggtcttggagaagatggacccacccatcagcctatcgagcatctgattagcttccgagccatgcccaacattttgatgctccgtccggctgatgggactgagactgctggggcatacaaagttgcagttctcaataggaagaggccatcaattcttgctctctcccgtcagaagcttcctcaacttgcaggaacatcggtcgaaggagttgagaagggaggatacattatttcagacaactcatctggtaacaaaccagatctcattgttatgagcactggctccgaattggagattgctgccaaggctgcagatgaattgaggaaggaggggaaaacagtcagagttgtgtcacttgtcagctgggagttgtttgatgagcaatctgatgagtacaaggagagtgtcctccctgctgctgtcactgctaggattagtattgaagcaggatccacgcttgggtgggagaagtttgtcggaaccaagggcaaggctatcggaattgaccggttcggggcaagtgctcctgctggtcggatatacaaggaatttggtataacagcagagaaagtcattgaagcagccagatctctataagattagcttgtctgtggtcctctctctctcatggctacaagaagctagattccagagcctctcttctgggagttaaaggacactggtggggacgaagccagctttggcagattaagtctggtctttggcctgcaataaagcccctcatatttcctcgaactttttctatgttataattcatgaagtgagtcttcttcgtggtctgtttgaatgaaacagtagcatctgatggttgcatcaaactgttccctgttattctattacatttttgaatatttgttagaaaaatctttgagattcattctgaa

SEQ ID NO: 9175 - DNA, 2661 bp, Spinacia oleracea
tcttttatccaaccaacacaagagtgagaagaagagagagaaacaaatcaacaatggcagcttcttcctctcttagtacactatctcatcatcaaacacttctctcacacccaaaaacccaccttccaaccacccctgcatcctcccttttagtccctacaacctcctctaaggtcaatggggtgcttcttaagtcaacctcctcctctaggaggctgcgcgtgggatcagcctccgccgtggtgagggctgcagctgttgaagccttggagagtactgatattgaccaacttgttgagaagtctgtgaacactattaggttcttggctattgatgctgttgagaaggctaattcgggtcaccccggtttgcctatgggttgtgcacccatgggtcatatattgtatgatgagatcatgcggtataacccgaagaacccgtattggtttaaccgtgaccggtttgttctctctgcgggtcatggttgtatgcttcagtatgctcttcttcaccttgctggttatgacagtgtcttggaagaagatttgaagactttccgccaatggggaagcagaattcccggtcacccagagaactttgagactcctggagtagaagttacaactgggccacttggtcagggaatagccaatgctgttggtttggcacttgctgagaagcatttagctgcacgattcaacaaacctgatgctgaaatcgttgatcattacacgtatgtcattcttggtgatggttgccagatggaagggattgctcaggaagcttgctcccttgctggtcattggggacttggaaaattgattgccttttatgatgataaccacatttctattgatggtgatactgccattgctttcactgagagtgttgatctgaggtttgaggcccttggctggcatgttatctgggttaagaatggtaacacaggctacgatgaaattcgtgctgctattaaggaagctaagacagtcacagacaaacccactttgatcaaggttaccaccaccatcggttttgggtctcctaacaagtcgaactcatacagtgtgcacggaagtgcattgggttcaaaggaagttgaggctacaaggcagaatcttggttggccttacgagccattccacgttccagaggaagttaagaagcactggagccgccatactcccgagggagcctccttggaagctgagtggaataccaagtttgccgagtatgagaagaaataccctgaagatgcaacagagttcaagtctatcactactggtgaatttcctgctggttgggagaaagctcttcctacctacactcctgaaaccccaggtgatgcaaccagaaacctgtcacaacaatgcttaaacgcccttgcaaaggttattccaggactccttggtggtagtgcagaccttgcatcatcaaacatgaccttactgaaaatgtttggagacttcagaaggacacaccggaagaaagaaacgttccgttttggtgtcagagaacacggaatgggagccatttgcaacggtatctgccttcacagcccgggttttgtcccttactgtgctaccttcttcgtgttcacagactacatgagaggagccatgaggatctcagccttgtcagaagccggagtcatctacgtcatgacccacgattctatcgggcttggagaagatggacccacccatcaacccatcgaggcacttagcaagtttccggccatgcccaacattcttatgctccgtccagctgatggaaacgagactgctggttcatacaaagttgctgttgaaaacagaaagacaccctccatccttgctctttctagaaaaaaactcccaaacttgcccggaacttccattgaaggagttgagaaaggagggtacacaatcacagacaactcttcaggtaacaaacctgatgttattcttattggaactggttcagaactggaaattgctgcaaaggctggtgatgagttaagaaaagaaggaaaagctgttagggttgtatcatttgtttcttgggaattgtttgagaaacaatctgatgaatacaaggagagtgttcttccttcagatgttactgcaagagtaagtattgaagcaggatcaacctttggatggcataagattgtggggtcaaaggggaaagccattggtattgacaagtttggagcaagtgcaccagcaggaaagatttaccaggagtatggaattacagttgaggcagttgttgaagctgcaaaatcagtttgttaggattctttttgcctcctgtttttccatttttgttgactgatcaagtagacatggctccctggtgagttactgtattacagtaaaaaaaaaaccgaaaaacttttagttactgtaaagataaactttgaaggctttcttgcagtattatgatgaatgtttgttgatttgtgtactaaaacttcaatccaatccaatgttgtagtgtggacagtatttctgaaaaggaacaacaacaatgtgaagctcccattttactggattttgtatccttttttatgggagttacagtaaaaattttctgaatctataccatgagcttgattattagcatgtaacagttgaatgatttttccttcccatttttatcagattttgtttgtat

SEQ ID NO: 9176 - DNA, 2799 bp, Aquilegia formosa
ctctcttctttcactctctctctctctttctctctatctctcgtcatctctaacaacaagtcttcttcttcttctcaatagagagaagagagattgagagaaaacccatatctctcttattaatcaagaacaacaatcatggctacttcttcatcactaacagtttcacaagctcttgtgggtagaactatttcaaataactctacccttcattctgatcgtctttctttacctggtttcaatcacagtactcgaactcttcttaaatcttcatttactcaaactattcgtatctcgagatctttgcgtaaaaacaacaacttgatttctcgatcttcttcttcttcaattaaagctcaagcagtagaaacattagagaagactgatacagctttggttgataaatctgttaatacgattcgttttcttgctattgatgctgttgaaaaagctaattctggtcatccaggtttacctatgggttgtgctccaatgggtcatattttatatgatgagatcatgagatataaccctaagaatccttattggtttaatcgtgatcgttttgttctttctgctggtcatggatgtatgcttcaatatgctcttcttcatcttgctggttacgacagtgtcaaggaagaagacttgaagtctttccgtcaatggggaagcaaaacacctggtcatcccgagaactttgagactcctggtgtagaagttactacaggtcctcttggtcagggtattgcaaatgctgttggtttggcccttgcggaaaagcacttggctgctcgtttcaacaaacctgacagtgagattgttgaccattacacatattgtattctcggggatggttgtcagatggaaggaattgcaaatgaagcatgttcccttgctgggcattggggacttggaaagctaattgctttctacgacgacaatcacatttccattgatggtgacacagagattgcattcactgaaagcgttgacaaacgttttgagggtttgggttggcatgttatttgggtcaagaatggcaacaccgggtatgatgagattcgtgctgccattgcagaagcaaaatctgtaactgacaaacccaccatgatcaaggtgactaccaccattggttttggatccccaaacaaagccaactcatacagtgtacacggggctgctttgggtgccaaggaagttgatgccacaagggagaatcttggttggccatatgagcctttccacgtcccagaagatgtcaaattgcactggagccgtcatactactgaaggtgctgcccttgaggccgaatggattggtaaattcacagagtacgagaagaagtacaaggaggatgctgcagagctcaaagccataattactggtgaacagcccaccgattgggagaaggctcttccagtatacactccggagagcccagcagacgccaccagaaacctgtctcaacaatgtcttaatgcacttgcaaaagttatccctgggcttattggtggaagtgcagatcttgcttcctccaacatgaccttgatgaaaatgtttggagatttccagaaaaacaccccagaggaacgaaatgtccgctttggtgttagggagcatgccatgggtgccatctgcaatggaattgccctacacagcccaggttttgtcccctactgtgcaactttctttgtgttcactgactacatgaggggtgctatgaggatatctgccttgagtgaggctggagttatttatgtgatgactcacgactcaattgggcttggagaagatggcccaactcatcaacctattgaacacattgcaagctttagagccatgcccaacattctgatgctccgtcccgctgatgggaatgaaactgctggggcctacaaggttgcggttgacaacagaaagagaccctcagtccttgccctttcccggcaaaagcttgcccaccttcctggaacatctattgcaggtgttgagaagggaggatatattgtatcagacaattcttcaggaaacaagccagatgtcatcctgatgggtaccggttctgaattagagattgcttccgcggctgcagatgaactcaggaaggaaggaaaggcagttcgtgttgtgtcccttatttcttgggagttgtatgatgagcagtctgacgaatacaaggagagtgtcttccctgccgcggtaaccgccagagttagtatcgaggcagcatcaacattcggatggggaaagtttgtcgggagccttgggatatctattggaattgacaagtttggagctagtgcacctgcccccaaaatttacaaggaatacggcatcacagcagaggctgtcattgcagctgccaaatcacttatttagatcttcttaagcagtgtttaaattttttcaacttcagcctgtttggcacttgggttttggatcctgttctttgaagatggaagtacagtggcgaataggcttgtcttgagagtatgagttagaacaatggtttctctgaataataaaagaaaaaaaaatgtcaattttcttttttctttttctatttcttatatccatgtaattgagtttctaattaaatcacgaccaggaatcctgtgttgatgatttttcacctattattacctgctctcgtccaaactatttaagtctgtaataatgctttcgagggaaaatgtgatgtaatgtagttcattagttcatacttcattgatgccgccatttcataatctttgccttgatgatatatacggtttttctcatattgacaatgccttt

SEQ ID NO: 9177 - DNA, 4155 bp, Cocos nucifera
caacgggttagactccatttttcccgatcgtcgcgcgaatcgtccgagagacccatcaaattgactctatatttattttagccaaaaggccaaacaacctcaatatttctcgactcccatctcaccaacccaatagcgatcgaagaggcggggaagactagagagaaagagccatggccgcttcctcctccgtcgccgcagcccaggcactcgtcggccgcgccatctccggccacccttccccatcccctgttcagccggaccgcctcgccttcggcgtcagctccctcgcgggccgcgccctcaagtccccctgcctccagaacctccggccgcaggccgccccccggccccgccgcgccgccatcgccaggtcggcgacggtggaaacgctggaggggaaggccgccacggaggccttggtggacaagtccgtcaacacgatccggttcctggcggtcgacgccgtcgagaaggccaattccggccacccgggccttcctatggggtgcgcccccctgggacacatcctctacgacgagatcatgcgctacaaccccaagaatccttactggttcaaccgcgatcgcttcgttctctctgccggccacgggtgcatgctccagtacgccctgctccacctcgccggatatgatagcgtcaaggaggatgatttgaaggctttccggcagtgggaaagcaaaactcctggccatccagagaattttgaaactcctggaattgaagtcactagtggtcctcttggtcagggtattgcaaatgctgttggattggcacttgctgagaggcacctagctgcccgtttcaataagcctgacatggagatcattgatcattacacgtatgttgtagttggtgatggttgccaaatggaaggcatttctaatgaagcttgttcgcttgctgggcactggggtttaggaaagctgattgctttttacgatgacaaccacatctccattgatggagacacagagattgcatttacagaagatgtaaatgcccgtttcgaggctcttggctggcacacgatctgggtgaagaacggtaatacaggctatgatgaaatccgtgctgcaattaaggaagctaaggctgtaaaagacaaacccacactaatcaagtttaccactaccattggttatgggtcacccaacaaagcgaacacatatagcgtacatgggagtgcattgggtgctaaggaagttgaggcaaccaggcagaaccttggatggcctcatgagcccttttttgtgcctgaagatgtgaagagtcactggagccaccatgtcccagaaggtgctgctcttgaagctgaatggaatgctaagtttgcagagtatgagaagaaatataaagaggatgctgcagagctgaagcgtatcatatctggagaactgcctgctggatgggagaaggctcttccgacatacacacttgaaagtcctgcagatgccactagaaatctatctcagcaatgcctgaatgctcttgctaaagtacttcctggatttctaggaggtagtgctgatcttgcatcctccaacatgacattgctgaagatgtttggtaacttccaaaaggatgcacctgaggagcggaatgttcgtttcggtgttagggaacatgggatgggtgccatatgcaatggcattgccctccacagtccgggcctcatcccctactgcgctaccttctttgtcttcacagactacatgagagccgccataaggatctcagcgttgtctgaggcaggagtcatctatgtgatgacacatgattcaattggtcttggagaagatggacccacccatcagcctatcgagcatctgattagtttcagagccatgcccaacattttgatgctccgtccagctgatgggaatgagactgctggggcatacagagttgcagttcttaataggaagaggccatcaattcttgctctctcgcgtcagaagcttcctcaacttgcaggaacatcggtcgaaggagtcgagaagggaggatacattatttcagacaactcatctggcaacaaaccagatctcattgttatgagcaccggctccgaattggagattgctgccaaggctgcagatgaattgaggaaggaggggaaaacagtcagagttgtgtcacttgtcagctgggagttgtttgatgagcaatctgatgggtacaaggagagtgtcctccctgctgctgtcactgcaaggattagtattgaagcaggatccacgcttgggtgggagaagttcctcggaaccaagggcaaggctatcgggatcgaccggtttggggcgagtgctcctgctggacggatatacaaggaatttggtataacagcagagaaagtcattgaagcagccagatctctataagattacagcttgtctgtggtccttctctcatggctacaagaacctagattccacagcctctcttctgggagttaaaggacactggtggggaagaagccagcactgttagatcaagtctggcctttggcctgcaataaagcccctcatttccttgaactttttcctattttatgattcatgaagtgagtcttcttcatggtctgtttgaatgagacagtagcatctgatggttgcatcaaactgttccctgttattctattaaattttgaacacttgtcaggaagatcttcgagattcattctgaaccttttactttttaaacctgcaccgtgattatttcatgcagaatggacaagttgattttggtgtttgcatgtcagtatcttctttcctctgtgtttggtgtttaacatgtggcatctgaggcatccttgttgaaagaaagcccttaaagctagatgctgtatttgtcctcaaaatcatgctggcttttttgtctttgctcccattgttgctctgtttatcactctaaagatcttgcccaacatgcgtatatgttgttgcaaccctcaatgggaaccggaagtcatggttggatgaatgagatggtctgctcctgtcaatggataaagttgagatataagcaagattttaaatttcgtggtacaagaccatcccaattttctcttggaataggatgcaccaccatcttgccccgtcctaaaacaagggacaaaggatgtcccaagacatgccgataaggatgctagaacgataatgggatggttctatcctgacatatgagatgataccccatcttggtgtcctgctgagaaattgaatctttgcatataaggacctgttttaatgtgaactgaaaaataacagtgttctctatgatttgtacaagaacattaaccaaagaccaaaaaaccatgcttgatgactgttggggataaatcccgctcctaccgaagtccagttcgatgcacagcttaacgcaattggtggccatggaagagcttcagcagccgggtcttagccgaactccctccaagctttcccttcggtcggacttcttcaaaagccgaactctcacaaccggccgaactgctcagcggccgagctccttcggactcccagcggccgggctttagccgaattcctcagcagccgagcttcagtcggactcccgcaagagccaaactcccttcaagcttccccttcggccggacttcttcaggagccggactcctcccagacatccccttcgcctggacttcttcaggagccgaactcctcccagacatccccttcggtcggtcgagctccttccgaactccccagcgaccgagccttagccgcactcctccagcctgacgcccgcgagaaccgaactccctccgcgctcttccagccagacgcctacaacagccgaactccctccgcactcttccggtcgaactccttctgagcttcccctcggtcgaactcctctggaattgatacataccgaagtccatcgattaatgcctgctttcttagagccatggctattaaatctggacgaacggtcacaattagtctgccacaggcgatgcaatcgaacgacatggccaccgctactggcgacaccactctctccgtaaccagctccatgcggcccacgatccgtcagtatggctatcactatccacctaacgatgccttcctctccatatcgaacttcatgcggccccgagcggcccac

SEQ ID NO: 9178 - DNA, 2703 bp, Vitis vinifera
ctcacttctttctgtttctctctgtacaatcgacgatggcttcttcgtcttctctctccatttctcaagccattgtcgccggagccctcaaccaccgcggctccactaattcctctgatcgcctacccctgcggtcattcactattcccaccttctccggcctcaaatccaccacctcagctgcttcatgcccttctcgcctcggctcagctcggcggaggctgtgccggagattggcggtgcaggctgcttcggtggagaccttggagaagacggaaactaccttgatcgagaaatcggtgaacaccatccggtttctggccgtcgattcggtggagaaggcgaactcgggtcacccgggtttgccaatgggttgtgctccaatgggccatgttttatacgatgagttcatgaagtttaaccccaagaacccctactggttcaatcgtgatcgctttgttctctctgccggacatggatgcatgcttcagtatgctctgcttcaccttgctggctacgacagtgtcagggaagaagacttgaaaagtttccgtcaatggggaagcacaacacctggtcacccagaaaattttgagacacctggtgttgaagtcactactggtcctcttggtcagggtattgccaatgctgttggcttggctcttgcggagaggcacttggctgctcgattcaacaaaccagacaatgagattgttgatcactacacatacgtgatactgggggatggttgtcaaatggagggtgttgcacatgaagcttgttcacttgctggacattggggtcttgggaagctgatagctttgtatgatgataaccacatctctattgatggtgacactgagattgctttcacggagaatgttgacttacgttttgaggctcttggttggcatgttatctgggtgaagaatggaaatactggctatgatgagattcgtgctgccatcaaggaagcaaagactgtcaaagacaaacccactttaatcaaggtgactacaaccattggttatggatccccaaacaagtcaaactcatacagtgtacatggaagtgcactaggtcctaaggagttggatgccacaaggaagaaccttcgatggccatatgagcctttccatgtacccgaggatgtcaagaagcattggagccgccatgtccctgaaggtgcagctctggaagctgaatggaatgcccagtttgctgaatacgaacgcaagtataaagaagaagctgcagtattgaagtctctcatcaatggtgaattacctgcaggttgggagaaggcacttccgacgtatactccagagagcccagcagaagccacgagaaattcatcacaacaatgtctaaatgcccttgcaaatgttctccctggtctgcttggtggcagtgctgatcttgcttcctccaacctgtcggtgatgaagcagtttgggaacttccaaaagggcacaccagaagagcgcaatgtcaggtttggtgttcgggagcatggaatgggagccatctgcaatgggattgtccttcactgccccggccttattccatattgtgcaactttctttgttttcactgactacttgagacctgccatgaggatttctgccttgtgtgaagctggagtcatctatgttatgacacacgattcaattgggcttggagaagatggacctacacatcagcctatagagcacttggcaagttttcgggctatgcccaacattttgatgcttcgccctgctgatgggactgagacagctgcagcttacaagattgcagtccttaacaggaagagaccctcagtccttgcccttggtcggcgagatgtctcccagcttcgtggaacatccattgagggagttgagaagggaggttacatcgtaacagacaactcttcaggcaacaaaccagatgttatattgattggaactggttcggaattggaaattgctgccaaagcagctgatgaactcagaaaggaagggaaagctgtcagggttgtttccttggtttgctgggcgctttttgatgaacaatcagatgcttacaaggaaagtgttttgccagcagctgtatcagcccgggtcagcgttgaagctgcatcaacatttgggtgggagaagtttgttgggagcaaagggaagtcaattggtattgatcggtttggggcaagtgcacctgcactaaagttgtacaaggagcttggcgtaacagcagaggctgttatagcggcagctaaatcaatttgctagaactttttactagtggctggtgccactcaaatgtttgttggccattggcatttgggttctggttttggaggttatagtgaacaatcccctcttaagagctttgggttgctgcacactgccttcttgccacgtaataaacgcagataaaatttttcatctgctgcatttatcttcttcagtggagcagctgagtctgcaacctgaatctagactgttcaatgaatttgtaccacctgctagacctttttgagtttttgtaatgtcatgtggttgtttctttagccaggttttgattatcctccatcacaatgtcttcttttagtttgagtgtagagtctatgatattccctttgtaatcctaataaattatagttctgtgattgtaaaactcgattgagcttctaagtaaaggggatgcatttgaatgtaa

SEQ ID NO: 9179 - DNA, 2321 bp, Arnica chamissonis
tggctcttccaccaccaccgccgcccaacagtcgacttccttggccactctctcaattccgactttctccggtctcaaatccaccactacatcatcctcacgcgctcccactcgccggcaggtttcttccacgcgccgtcgtgtgatttccaacgcggctgtggagaccctcgagaagacggatactgctctggtggagaagtcaatcaacaccatcagattcttggcgatcgatgccgtggagaaggcgaattcgggtcatccgggtttgcccatgggctgtgcacccatggggcatatattgtacgatgagatcatgaggtataaccccaagaacccgtattggttcaacagagatcgctttgttctctccgccggccatggatgtatgctccagtatgctctgctccaccttgctggctacgacgccgtcaaagaagaagacttgaagcaattccgtcaatggggaagcaaaactcctggccatcccgagaactttgaaactcctggtgtagaagtcaccactggtcctcttggtcaagggattgccaacgctgttggtcttgctcttgctgagaagcatttggctgctcgttacaacaaacctgatgctgagatcgttgaccactacacatactgtattgttggagatggttgtcaaatggaaggaatctcaaatgaagcatgttcacttgctggccattggggacttggaaagttgattgctttctatgatgacaaccacatctccatcgatggtgacacggagattgccttcactgagaatgttgataaacgttttgaagctcttgggtggcatatcatttgggtaaagaatggtaacactggctatgatgagatccgagctgccattaaagaagctaaggctgtgactgataagcctactttgatcaaggtgacaacaacaatcggttttgggtcaccaaacaaggcgaactcatacagtgtccatggagctgctttgggtgcaaaagaagtagatgcaaccaggcaaaacctaggatggccttacgagccattccatgtaccagatgaagttaagaagcactggagccgccatacccctgatggcgccgctcttgaagctgaatggaatgctaaatttgcagcgtatgagaacaagtaccctgaagatgctgctgaattgaaatcaattgttactggtgtattccctgccggatgggagaaggctcttccgacatacacaccagaaacacccggtgatgctacaagaaacctgtcacaaacaatgcttaatgcattggcacctgttctacctggtctcattggtggaagtgcagatcttgcatcttcaaacatgaccctaatgaaaatgtttggtgatttccaaaaaaatacacctgaagaacgcaacgttcgtttcggtgtccgggaacacggtatgggagccatttgtaacgggatcgccctccacagccccgggttcattccttactgtgccacattttttgttttcactgattacatgagaggtgctattagaatctcagctttatcagaagcaggagtcatttatgtaatgacccatgactccatcggtctaggagaagacgggccaacccatcaacccattgaacatttagccagtttccgggccatgcccaacattttaatgttccgcccggctgatggaaatgaaacagctggagcttataaggttgcagtcgaaagcagaaaaagaccctcaattcttgctctttctaggcaaaaactgcccaacctgcctggaacttcaattgaaggaaccgcaaagggtgggtacacgataactgacaattcaacaggtaacaagcctgatgttatcttgatcgggaccggttctgagttggaaattgcggttaaagcctctgatgaactcaagaaagaagggaaaacagttagggtcgtgtcattcgtgtcatgggaactatttgatgaacagtctgatgaatacaaggaaagtgtccttccatcgggtgtaacggctcgtgttagcatcgaggctggatcaactttcggttgggggaaaattgttggaagcaaaggaaaatccattgggattgacaaatgggggtccagcgcgccagcaggaaagatctacaaggaatacgggataacagttgaagctgtgattgcagctgctaaacaagtttgttaggctggtttgaacacgacatcaatttctgggcttccgaaacttgcataaaagaagattgatgttagtttttggtatcttgattcataatgctcagacgaacaataagaagttggattttagtctttgttgcttttcatcgaac

SEQ ID NO: 9180 - DNA, 2447 bp, Helianthus annuus
gccgccctcgtcccccgccatggctcttccaccaccacccccaccgtctcaatcccagccttcaccggactcaaatccacatccgcccgcgcctccacgcgcggacaagtttccgccacgcgccgtcaggttgcacccacgcgccgccgtgtgatcgtcaacgcggctgtggagacgctgcagaagacggatactgctttggtggagaagtcgattaatactattaggtttttggcgattgatgcggttgaaaaggcgaattcgggtcatccgggtttgcccatgggttgtgcgcccatgggtcatatattgtatgatgagattatgaggtataacccgaagaacccgtattggtttaacagagatcggtttgttctttctgctggtcatggatgtatgcttcagtatgctctgcttcatcttgctggatatgatgctgttaaagaagaagacttgaagcaattccgtcaatggggaagcaaaactccgggccatcctgagaactttgaaactcctggtgttgaagtcaccactggtcctcttggtcaaggtattgccaacgctgttggtcttgctcttgccgagaagcatttggccgctcgttacaacaaacccgatgccgagattgttgaccactacacgtactgtattctcggagatggttgccaaatggaaggaattgcaaacgaagcatgttcgcttgccggccattggggactcggaaagttgattgctttctatgacgataaccacatctccattgacggtgacaccgagatcgccttcaccgagagcgttgacaaacgttttgaagctcttgggtggcatgtcatttgggtgaagaacggtaacactggttacgatgagatccgtgctgccattcaagaagccaaggccgtgactgataagcccactatgatcaaggttacaacaacaatcggtttcgggtcaccgaacaaggcgaactcatacagtgtccatggagccgcgttgggtgcgaaagaagtagacgcaacccgacaaaacctcggatggccttacgagccattccacgtacccgatgaagttaaaaagcactggagccgccatacccctgacggtgccgctcttgaagccgaatggaatgctaaatttgcagcttacgagagcaagtatcccgaagaagccgctgaattgaaatctattgttaccggtgtattgcctgccggatgggagaaggctcttccgacatacacaccagaaacacccggtgatgctacaagaaacctttcacaaacaatgcttaacgcattggcaccggttctacccggtctcatcggtggaagtgcagatcttgcatcttcaaacatgacattaatgaaaatgttcggtgatttccaaaaagccacacctgaagaacgcaacgttcgtttcggtgtccgggaacacggtatgggagctatttgtaacggtatcgctcttcacagccccggtttcgttccttattgtgctacgttctttgtcttcaccgattacatgagaggtgcgatgagaatctcggctttgtcagaagcaggagtcatttacgtaatgacccatgactccattggtctaggagaagacgggccgacccatcagcccattgaacatctagccagtttccgggccatgcccaacatcttgatgttccgaccagctgacggtaacgaaacagccggagcttacaaggttgcagtcgaaagccgaaaacgaccatcggttcttgctctttctaggcaaaagctacccaacctacctggaacttcaatcgaaggaaccacgaaaggtgggtacacgataaccgacaactcaacaggcaacaagcccgatgttatcttgatcggaaccggttctgagctcgaaattgcggttaaagccgcggatgaactcagaaaagaagggaaaacggtccgggttgtgtcgtttgtgtcatgggagcttttttatgaacaatccgatgaatacaaggaaagcgttctcccatcgggtgtgaccgctcgtgtcagcattgaggctggatcaactttcggttgggatagaattgttggaagcgcgggaaaagctatcgggattgacaaatgggggtcgagtgcgccagctggaaagatctacaaggaatatggtattaccgttgaagctgtgattgcggctgctaaacaagtgtgttaggcttgtatcttgattcgtaatggttgaacgaacaataagaagtcggttttttagtctttgatgcatttcagcgaacaccttacttgcgaatcgaacgaaaaatcagaagagaggattagaagttgaatgtttgatgctctttcctcctttatttgtaccaaaactgaaacataattttcaaagttttgtgatttgtttggttactagtgaggtgttcttttgagtaatgtacaattttacaagttatcataagattatta

SEQ ID NO: 9181 - DNA, 3464 bp, Plantago ovata
aaaaagcaaccacctggaagtggctgtatattacattatcatacagtcagtacacaaaagttgcgaaactggaaattgtagtgagtagcaagagagagccgagaaaagaaacttctactctccatcaaatactttctccatatgtaacatgataaaacttgcagtgtatagagtgtagacctcaacagacacattttacatacattcaaacaatcctcagtaaggatcagatatcagcagccaaacgtttgttcaaatgcgcaggcaatctaggagtaggcactgccattaaaggtgttctcatataggtcaccaagcccggattctcacccatgtcaatctcttcagggctcattccattggcaggagtccagcggaaatggtgtaacaagtggcctatcatagaagtcaccaagttaattcccagctgtgctcctgggcacactctccgtcctgcaccaaatgggagtagcctaaaatcatgccccttcatgtcaacatcttcctcgaagaacctttcaggccggaattccagtggattcttccacacctcagggtcacgtgccacagcccaaacattgacatggatatttgaccctttagggatgtcataccctccaatttttacattggcatttgatcggtgagggagcatgagaggggttggagggtgcaaacggagagcttctttggctacagattgtaggtacgggaggttagaaaagtccagttcggttagcactcgttcatgtcctaccacacggtctagctcctcttgggctttttgctggacccttgggttcttgatcagctccgccatagcccattctacagatatagcagttgtgtccattcctgcagttatcatgtcccagaggaggccaatgatagtatcatcgctaagatcatatttatctttaagcgtgagcaaggcatcaaagaagtgttgcttggatcctccactctcttggcgagcccgggtgtgctcttccattatttctctcgttagattgtccctacgtgcaccatgtttagagaactgcatcttcatcactcctctctctcgccgccgtacaacaaccccaatcgccacccgcctccctatccgcgcttccgccgcagtagaaacaatcgaggctgccgccaccgagctcgtcgacttatccgtcaacaccatccgattcttggcaattgacgccgttgagaaggccaattcgggccatccaggtcttcccatgggttgtgctccgatgggtcatatattgtacgatgagatcatgaggtacaaccccaagaacccttactggttcaaccgggaccggtttgttctctctgctggtcatgggtgtatgctccagtatgctcttcttcatttggccggatatgacgccgttaaggaagaggacttgaagcagttccgtcaatggggaagtagcaccccaggacaccccgagaatttcgagacacctggtgttgaagtcaccactggtccacttggtcaaggtatcgcgaatgccgttggattggctcttgcggagaagcacttggctgctcgtttcaacaagcctgacagtgagattgtcgatcactacacgtattgtattcttggagatgggtgtcaaatggagggtatttcgaacgaagcttgctctcttgctggacattggggacttggaaagctgattgctttctatgatgacaaccacatctccattgatggtgatacggagattgctttcaccgagagtgtggacacacgttttgaggctcttggatggcatgtgatctgggtgaagaatggtaacactggctatgatgaaattcgtgctgccatcaaggaagcaaaggctgtcacagataagccaactctgatcaaggttactaccaccattggttttgggtcacccaacaaggccaactcatacagtgttcacggagctgcattgggtgccaaggaagttgaagccaccagacagaaccttggatggccttatgagccattccacgtgcctgatgaagtgaagaagcactggagccgacatgttcctgtgggtgcttctctcgaggctgaatggaatgccaagtttgctgagtatgagaagaagtatcctgaggaagctgctgagctgaaatccgttgttaccggtgaacttcccagtggttgggagaaagctcttcctacatacactcccgagaccccaggtgatgccaccagaaatctctctcaggcaaatctcaatgctctcgctaaagttctccccggacttcttggtggcagtgcggatcttgcctcgtccaacatgactcttctcaaaatgtttggtgacttccagaagaacacaccagaagaacgtaatgtaaggttcggtgtccgtgaacacggtatgggagccatctgtaatgggatcgcgctccacagccctggcctaatcccctactgtgcaacatttttcgtgttcacagactacatgagaggcgctatgaggatctctgcattgtctgaggctggcgttatctatgtcatgacccacgactcgattgggctcggagaagatggtccgactcaccagcctatcgagcatttggcaagtttccgggcaatgcccaatatcttgatgctccgcccagctgacggtaacgagacagccggtgcatacaaagcagccgtcttgaaaagaaagacaccatcgatcctcgccctttctcgtcaaaagctgcccaacttgcccggaacatcaattgacggtgtattaaagggaggatacacaattactgacaattctactggtaacaagcccgatttgatattgatggcaacaggttctgagttggaaatcgcagctaaggctgcagatgagcttagaaaggagggaaagacagtaagagtggtgtccttagtttcatgggatctttacgaggagcaatctgctgagtacaaggagagcgtacttccagcttctgtaacagctagggtcagcatcgaggctggatcaacctttggttggcataagtatgttggagacaaaggaaagtctattggtattgaccggtttggagccagtgcacctgcaggtaaaatatacaaggagtttggcatcacagtcgaaggtgtcattgctgcagctaagtcagtttgttaaattgatgcgcgttgaacttcatgcttgtttttctgcttcctgcattactcagcatttggattctggggctggtaaagtttacaggggaagttccaaagaagaagatgataagactcggcttctagagtatgtaaaattttcaataaagaagataagttgtcctctttgtttatcttttgttcttgaaattgagcagagcgcgtagtcgtaatgcgatcaggagatgatgtagtcagatttggtactcctgaaatttgtacacttgaacaatcaacctgattttgtaacctaaatgtatttttgattcattatcaagttcttgtt

SEQ ID NO: 9182 - DNA, 2288 bp, Beta vulgaris
tctcctctccttcaccaaaacccctctttctctctctaacccaccaaaaatggcaacttctctttctctctcccaagcaatctcagctcgcacttcctcctctcaccaccaatcatctctctcccaccaccttccttcatcactttctctctcttctctctctctgctcaaatcatcttctgtctctctcaaaacctctcaacgtgttgtagcaccatgcgcaacaatacgcgcatcatcagcggtggattccctcgacaaatccgcctcaactgaagtaaccctaattgagaaatcagttaacacgatcagatttcttgcgatcgatgcagttgaaaaagcgaattcgggtcacccgggtttacccatgggttgtgctccaatgggtcatgttttgtatgatgaagttatgcggtataacccgaagaacccgtattggtttaaccgtgatcgctttgttttgtccgcgggtcatggatgcatgcttcaatatgctctgcttcatttggctggatatgatagtgtcactgaagaagatttgaagaatttccgtcagtgggaaagcaggactcctggtcatcctgagaattttgagactcctggggttgaagtcaccactggtccccttggtcagggtattgccaatgctgttggactggctcttgcagaaaagcacttggctgctcgatttaacaaacctggtgcagagatcgttgatcactacacgtatgctatagttggtgatggttgtcaaatggagggtgtttctcaagaagcctgttctcttgctgggcattggggtcttggaaagcttattgcattttatgatgataatcatatctctattgatggtaacaccgatatcgcattcaccgaggatgttgacaagcggtttgaggctcttggatggcacgtgatctgggtcaagaatggtaatactggctatgatgaaattcgtgcagcaattagagaagctaaagctgttacggacaaaccgactttaattaaggtgactacaacaattggttatggttccccaaacaaggcaaattcgtacagtgttcatgggagtgcattgggagctaaggaggtggaagcaactaggagcaatctcgggtggccgcatgagccattccatgtatctgaagatgtcaagaaacattggagtcgccacacccctgaaggagcagcccttgaagctgaatggaatgctaagtttgccgagtatgaaagaaaatacaaggatgaagctgcagagttgaagtctattatcactggggaattaccttctggctgggagaatgcacttccgacatacaccacagagagccctgccgatgctacaagaaatctgtctcaacaatgcctcaacgctcttgccaaagttcttccaggttttctgggtggaagtgccgaccttgcttcctcaaacatgactttactgaagatgtttggaaatttccagaaggaaactcctgaggagaggaacctgcgatttggtgttcgtgagcatgcaatgggatccatttgtaatgggattgcccaccacagcccgggattcatcccctactgtgcaactttctttgtttttacagactacatgagagcttccataaagatggctgccttgtcacaagctggggtcatctttgttatgacccacgactctattgggctcggtgaagacgggcccactcatcagcctattgagcatttggccagtttccgggctatgccaaatgttcttatgctccgtcctgcagatggtaccgagactgctggggcctacaaggttgcagcaataaagagaaagacacccgcgattctggctctttctcggcaaaaacttccccaacttgctggtacttcagtcgaaagggttgaaaagggtggttatgtaatttctgacaactcaaaggcaaacaaaccagatgttattctgatgggaactggttctgaattagagattgctgctaaagctgcagatgagcttagaaaggaaggaaaagctgttagagttgtgtcatttgtttcatgggagctcttcgatgctcaacccgattcatataaagaaagcgttttgccatctgatgtgacagccagggtgagcattgaagctggatcaacatttgggtggttgaagtatgttggcagcaagggcaaagcaattggtattgatcggtttggtgccagtgcccctgctgggaagatatacaaggagttcggaatcacgaaagaagctgtcgtcgaagcagctaaatcacttttctaagctcatctgcagcttt

SEQ ID NO: 9183 - DNA, 2455 bp, Helianthus annuus
ccatgccgccctcgtcccccgccatggctcttccacccccacccccaccgtctcaatcccagccttcaccggactcaaatccacatccgcccgcgcctccacgcgcggacaagtttccgccacgcgccgtcaggttgcacccacgcgccgccgtgtgatcgtcaacgcggctgtggagacgttgcagaagacggatactgctttggtggagaagtcgattaatactattaggtttttggcgattgatgcggttgagaaagcgaattcgggtcatccgggtttgcccatgggttgtgcgcccatgggtcatatattgtatgatgagattatgaggtataacccgaagaacccgtattggtttaacagagatcggtttgttctttctgctggtcatggatgtatgcttcagtatgctctgcttcatcttgctggatatgatgctgttaaagaagaagacttgaagcaattccgtcaatggggaagcaaaactcctggccatcccgagaactttgaaactcctggtgttgaagtcaccactggtcctcttggtcaaggtattgccaacgctgttggtcttgctcttgccgagaagcatttggctgctcgttacaacaaacccgatgccgagattgttgaccactacacatactgtattctcggagatggttgccaaatggaaggaattgcaaacgaagcatgttcgcttgccggccattggggactcggaaagttgattgctttctatgacgataaccacatctccattgacggtgacaccgagatcgccttcaccgagagcgttgacaaacgttttgaagctcttgggtggcatgtcatttgggtgaagaacggtaacactggttacgatgagatccgtgctgccattcaagaagccaaggccgtgaccgataagcccactatgatcaaggttacaacaacaatcggtttcgggtcaccgaacaaggcgaactcatacagtgtccacggagccgcgttgggtgcgaaagaagtagacgcaacccgacaaaaccttggatggccttacgagccattccatgtacctgatgaagttaaaaagcactggagccgccacacccctgatggtgccgctcttgaagccgaatggaatgctaaatttgcagcttacgagagtaagtatcccgaagaagccgctgaattgaaatctattgttaccggtgtattgcctgccggatgggagaaggctcttccgacatacacaccagaaacacccggtgatgctacaagaaatctttcgcaaacaatgcttaatgcattggcacctgttcttcccggtctcattggtggaagtgcggatcttgcatcttcaaacatgacgttaatgaaaatgttcggtgatttccaaaaagccacacccgaagaacgcaacgttcgtttcggtgtccgggaacacggtatgggagctatttgtaatggtatcgctcttcacagccccgggttcgttccttactgtgctacgttctttgtcttcaccgattacatgagaggtgccatgagaatctcggctttatcagaagcaggagtcatttatgtaatgacccatgactccattggtctaggagaagacgggccgacccatcagcccatcgaacatctagccagtttccgggccatgcccaacatcttgatgttccgaccagctgacggtaacgaaacagccggagcttacaagggtgcagtcgaaagccgaaaacgaccatcggttcttgctctttctaggcaaaagctacccaacctacccggaacttcaatcgaaggaaccacgaaaggtgggtacacgataaccgacaactcaacaggcaacaagcccgatgttatcttgatcggaaccggttctgagcttgaaatcgcggttaaagccgcggatgaactcagaaaagaagggaaaacggtccgggtcgtgtcgtttgtgtcatgggagcttttctatgaacaatccgatgaatacaaggaaagcgtcctcccatcgggtgtgaccgctcgtgtcagcattgaggccggatcaactttcggttgggatagaattgttggaagcgcgggaaaagctatcgggattgacaaatgggggtcgagtgcgccagctggaaagatctacaaggaatatggtattaccgttgaagctgtgattgcggctgctaaacaagtgtgttaggcttgtatcttgattcgtaatggttgaacgaacaataagaagtcggttttttagtctttgatgcatttcagcgaacaccttacttgcgaatcgaacgaaaaatcagaagagaggattagaagttgaaatggttttagatgctctttcctcctttatttgtaccaaaactgaaacacaattttcaaagttttgtgatttgtttggttactagtgaggtgttcttttgagtaatgtacaattttacaagttatcataagattatta

SEQ ID NO: 9184 - DNA, 2614 bp, Oryza sativa
tctcctcgccaccacaccactcctctcgccatggccgcgcactccgtcgccgccgcgcacgccaccatcgccgcgcgcgcgggtgccgccgcgccagcgcccgcgccgccggagcgcctcgggttccgcctcagcgcgctcgccggccgcggcctccgctccccgctcccgcctcgccgcggcgcgccatcggcgtccgcgtcgcgccgccgccacaacaaccgcgtgcgcgcggcggcggtcgagacgctcgaggggcaggcggcgacgggggcgctgctcgagaagtcggtgaacacgatccggttcctcgccatcgacgccgtcgagaaggccaactcggggcaccccggcctgcccatggggtgcgcgcccatggggcacatcctctacgacgaggtcatgcggtacaaccccaagaacccctactggttcaaccgcgaccgcttcatcctctccgccggccacggctgcatgctccagtacgccctgctccacctcgccggctacgacgccgtcttggaggaggacttgaagcaattcaggcaatggggaagcaagactccaggccatcccgagaacttcgagacgcccggagttgaagttaccactggacctcttggtcagggtattgcaaatgcagttgggctggcccttgctgagaagcacctggctgctcgtttcaacaagcccgacagcgagattgttgatcactacacctactgtattttgggagatgggtgccagatggagggtatctccaatgaagcttgctcgttggctggccattggggtcttggcaagctgattgcattctatgatgacaaccacatttccattgacggagacacagagattgcattcactgaggatgtgagtgctcgctttgaggctcttgggtggcatacaatctgggttaagaatggaaacgatggctatgatgagattcgtgccgccattaaggaagcaaaggcggtaactgacaagccaacactaatcaaggtgaccaccacaatcggttttggatcacccaacaaggccaactcatacagcgtccacggaagtgctttgggtaccaaagaggttgaagcaaccagagagaaccttggatggccctatgagccattctttgtgcctgaggatgtgaagagccactggagccgccatgtgcctcaaggtgctgcttttgaggctgactggaatgctaagttcgccgagtatgagaagaagtacccagaagatgcagcgaccttgaagagcattgtctcaggggagttgcctgctggctgggctgacgctcttcctaaatacactccagagagccctgcagatgccaccaggaatctgtcacagcagtgcttaaacgcacttgctaaagttgttcctggtcttcttggaggaagtgctgatcttgcatcctccaacatgacattgcttaagatgttcggtgacttccagaaggatacgcctgaggagcgcaatgtccgatttggagtcagggagcatggaatgggcgccatttgcaacggcattgctctgcacagcccaggactcattccatactgtgctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaagattcaaaccgcgcgttttgagtttttgtcatcgttgatgccaaggaacagtatacatgaagccatgaaggtcttgtgcccaaagcttggaataatgaagggagagggatgcctgcattggagcgtgagtggtattttaggcctgtaataagcactgcttttccatttacgtttgttttgttggatcactccttagatgattcatcaagttgagcctgattcaattggggactggttttggtaatatttacatttgactatagtccagctacaatattccgttctccctaaagtcatctcctctcagtgtgttagtttgctattcactatagtcttgcacaaatgttgctag

SEQ ID NO: 9185 - DNA, 2579 bp, Elaeis guineensis
cggagaaaactagagagagaaacagggcgagccatggccgcttcctcctccgtcaccgccgcgcaggccctcgtcggccgcaccatctccggccactcctccccctccccttgccaccccgactgcctcgccttcggcctcagctccgtcgctggccgcgccctcaagactccccccgcccctcgcctccagaaccggcgcccacaggccgcctcgaggcctcgccgatccgccgtcacgagggcggcggcggtggagacgctggaggagaaggccgccacggaggccctgctggagaagtcgatcaacacgatccggttcctggccgtcgacgccgtcgagaaggccaactccggccacccgggactccctatggggtgtgccccgatcggccacatcctctacgacgaggtcatgcgctacaatcccaagaaccccttctggttcaaccgcgaccgcttcgtgctctccgccggacacggctgtatgctccagtacgccctgcttcaccttgcgggttacgatagcgtcaaggaggaggatttgaaggctttccggcagtgggggagcaaaactcctggtcatcctgagaattttgaaactctgggagttgaagtcactactggtcctcttggtcagggtattgcaaatgctgttggattggcacttgttgagaagcacctagcttcccgcttcaataagcctgacatggagatcgttgatcattacacgtatgttatacttggggatggttgccaaatggagggcatttctaatgaagtttgttctcttgctgggcactggggtttgggaaagctgattgctttttacgatgacaaccacatttccattgatggagacacagagattgcatttacggaagatgtaaatgcccgttttgatgcccttggctggcacactatctgggtgaagaatggtaacacaggctatgatgaaatccgtgctgcaataaaggaagcaaaggccgtcaaagacaaacccacattgatcaaggtgaccaccaccattggttttgggtctccaaacaaggcaaacacatatagcgtacatggaagtgcattgggtgctaaggaagttgaagcaaccaggcagaaccttggatggccttatgagccttttttcgtacctgaagatgtgaagagccattggagccgccatgtcctggaaggtcctgttcttgaagctgaatggaatgccaagtttgtgcagtacgagaagaaatataaagaggaagctgcagagctgaagcagatcataacaggagaactgcctgccggatggcaggaggcttttccgacatacacgcctgaaagtcctgcagatgccacaagaaatctatctcagcaatgcctcaatgcccttgctaaagtactccctgggttccttggaggtagtgccgatcttgcatcctcgaacatgacactgctgaagatgtttggcgacttccaaaaggacacacctgaggagcggaatctccgtttcggtgttagggaacatggaatgggtgccatatgcaatggcattgccctgcacagcccgggtatgatcccttactgtgctactttctttgtcttcacggactacatgagagctgccataaggatctcagccttgagtgaggcgggagtcatctatgtgatgacacatgattctattggtcttggagaagatggtcccacccatcagcccattgagcatctgattagcttccgagccatgcccaacattttgatgctccgtccagctgatgggaatgagactgctggggcatacaaggttgcaattctcaacaggaagcggccatcaatccttgctctctcccgtcagaagcttcctcagcttgcaggaacatcagctgaacgagttgcaaagggaggatatactatttcagacaactcatctggtaacaagccagatctcattattatgagcactggctcagaattggagattgctgccaaggctgcagatgagctgaggaaggagggaaaaacagtccgagttgtgtcacttgtctcctgggagttgtttgatgagcaatctgatgaatacaaggagagtatcctcccagcttctgtaactgctagaatcagcattgaagcaggagccactcttgggtgggagaagttcgtcggggccggcggcaagtccatagggattgaccggtttggggcaagtgctcctggtgggcggatttacaaagaatttggtataacagcggagaaagttattgaagcagccaagtctctataagatcagcttgtctagggtccttcctctccaatggttacaaggagaacctagattccagagccgtgcttctgggagttaagagtacactggtgtggaagaagccagctttggcagattgagtctggcgtttggcctgtaataaagcccttcatattttcttgaacattttccactttataattcatgaagttgagccctcttctggttctgatttaatcaaacaactgcatctgatggttgcatcaagctgtactctgttgatctattaaattttgaatgctttcgtggaaagatctttaagatgt

SEQ ID NO: 9186 - DNA, 2693 bp, Oryza sativa
atctccgcctctcctcgccaccacaccactcctctcgccatggccgcgcactccgtcgccgccgcgcacgccaccatcgccgcgcgcgcgggtgccgccgcgccagcgcccgcgccgccggagcgcctcgggttccgcctcagcgcgctcgccggccgcggcctccgctccccgctcccgcctcgccgcggcgcgccatcggcgtccgcgtcgcgccgccgccacaacaaccgcgtgcgcgcggcggcggtcgagacgctcgaggggcaggcggcgacgggggcgctgctcgagaagtcggtgaacacgatccggttcctcgccatcgacgccgtcgagaaggccaactcggggcaccccggcctgcccatggggtgcgcgcccatggggcacatcctctacgacgaggtcatgcggtacaaccccaagaacccctactggttcaaccgcgaccgcttcatcctctccgccggccacggctgcatgctccagtacgccctgctccacctcgccggctacgacgccgtcttggaggaggacttgaagcaattcaggcaatggggaagcaagactccaggccatcccgagaacttcgagacgcccggagttgaagttaccactggacctcttggtcagggtattgcaaatgcagttgggctggcccttgctgagaagcacctggctgctcgtttcaacaagcccgacagcgagattgttgatcactacacctactgtattttgggagatgggtgccagatggagggtatctccaatgaagcttgctcgttggctggccattggggtcttggcaagctgattgcattctatgatgacaaccacatttccattgacggagacacagagattgcattcactgaggatgtgagtgctcgctttgaggctcttgggtggcatacaatctgggttaagaatggaaacgatggctatgatgagattcgtgccgccattaaggaagcaaaggcggtaactgacaagccaacactaatcaaggtgaccaccacaatcggttttggatcacccaacaaggccaactcatacagcgtccacggaagtgctttgggtaccaaagaggttgaagcaaccagagagaaccttggatggccctatgagccattctttgtgcctgaggatgtgaagagccactggagccgccatgtgcctcaaggtgctgcttttgaggctgactggaatgctaagttcgccgagtatgagaagaagtacccagaagatgcagcgaccttgaagagcattgtctcaggggagttgcctgctggctgggctgacgctcttcctaaatacactccagagagccctgcagatgccaccaggaatctgtcacagcagtgcttaaacgcacttgctaaagttgttcctggtcttcttggaggaagtgctgatcttgcatcctccaacatgacattgcttaagatgttcggtgacttccagaaggatacgcctgaggagcgcaatgtccgatttggagtcagggagcatggaatgggcgccatttgcaacggcattgctctgcacagcccaggactcattccatactgtgctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaagattcaaaccgcgcgttttgagtttttgtcatcgttgatgccaaggaacagtatacatgaagccatgaaggtcttgtgcccaaagcttggaataatgaagggagagggatgcctgcattggagcgtgagtggtattttaggcctgtaataagcactgcttttccatttacgtttgttttgttggatcactccttagatgattcatcaagttgagcctgattcaattggggactggttttggtaatatttacatttgactatagtccagctacaatattccgttctccctaaagtcatctcctctcagtgtgttagtttgctattcactatagtcttgcacaaatgttgctagaaaaaaaaattcgtgcatacaatttctgatccataggtgcttttggttgagcatcaagatacatgaagct

SEQ ID NO: 9187 - DNA, 2837 bp, Amborella trichopoda
tctctctctctctctcgctccgagtcgtcaaggttgaaaagtgctgcagcagcctcaccaaccctaaatctaaattcttttcggcctttctgcctcgattaaaagcttcaaatttcgggcaaaagctgcgttgttcagagcccttattttcccctctctacattgtgctacgtctgccattgttggtcgagatagggtttcgagagatcgagggtcaatcctccttgtatctagttcgaaaattgaaacagttggagagagaaaggaagatacagaggaaaaatggcgtcgtcgtctctgggcatgtatcaggccccattggcaggggcaccagcagcagcagagcgcagatcctcatcatctgcaacgctgcctttgcccctgccttctaagcccaacacacccgccatactcctaaataacaactttctgagggggactaaggtggtgttgagtcgcaggagcagagcaaggaagccatcgacatcaatgcaggcagtagtgagggcgtcagcagctgtcgagacactggaccagacgagcacgactgaattgatagagaagtcgatcaacaccatcagatttcttgcaattgatgcggttgagaaggccaactctgggcaccctggcctccccatggggtgtgccccaatgggccacatcctctacgacgaggtgatgcgctacaacccaaagaacccatactggtttaaccgtgatcgcttcgtgctctctgctggccatggatgcatgttgcagtacgctctcctccaccttgccggctacgacagcgtcaaggaagaagatttgaaatcctttaggcagtggggaagcaagacccctggccatcctgaaaacttcgagactcctggcatcgaagtcacaactggtcctttgggccaaggagttgcaaatgctgtcgggttagctcttgctgagaaacatttagctgccagatacaacaagcccggttttgagattgtcgatcactacacattctgtattcttggagatggatgtcaaatggagggtatctccaatgaggcttgctccttggctgggcactggggtcttgggaagctcattgctttctatgatgacaaccacatctccattgatggtgacaccgaaattgccttcactgagactgttgatacacgtttcgagggcctgggttggcatgtcatctgggttaagaatggtaacaccgggtacgatgagattcgtgctgccattgaagaggctaaggctgttaaggacaaacccactctcattaaggttaccaccaccattggttatgggtccccaaacaaggccaattcgtacagtgttcatggaagtgccttgggagccaaggaggtggatgccacccgccagaaccttggatggccatatgagcctttccatgtcccagatgatgtcaagagtcattggagccggcatgtttccgaaggtgcttccctggaagcagaatggcaagccaaattggcagagtatgaaaagaagtacaaggaggaagctgtagaattcaaggaactcatctctggtcaactgccagatgggtgggagaaggctctcccagtgtacaccgctgagagccctgctgacgccacccgaaacctatcccagcaatgcctcaatgcgctcgctaaggtccttccaggactcctcggtggcagtgcagatcttgcctcctcgaacatgacattgctgaagatgtttggggacttccagaaagatacccccgagcagcggaatgtgcggtttggtgtgagggagcacagcatgggtgctatttgcaatgggattgccctccacagtggcctcataccctactgtgccaccttctttgttttcacagattacatgagggctgccatgaggatatcagctctatgtgaagccggtgtcatatacgtgatgacccatgattccattgggcttggggaggatgggcccacccatcagcccattgagcatattgcgagcttcagggccatgcccaacatcctgatgctccgcccaggggacgggaacgagacggccggtgcttataaggtcgcggtcctcaacaggaagaggccctcggtgctcgccctctctcgccaaaagctcccccagctagcaggcacgacgattgagggagttgagaaaggagggtacattgtgagcgacaactcaatgcgcaacaagcctgatctcatccttatcggcaccggttctgagctggagatcgctgtaaaggcagcagatgagatcaggaaggaagggaaggcagttagggttgtgtcccttgtgtcatgggagctgtttgacgagcagtcggatgattacaaggagagtgtcctccctgctgaggtgacggcaagagtgagtgtggaggcagggtcaacatttgggtgggagaagattgtcggaagcaaaggtaagagcattgggatcgaccggtttggtgccagtgctcctgccggaaccttgtacaaggagtttggcattactgtggacaatgtcattgcagcggccaagtcccttttgtaatttcttgatgcattcattcctcgaagctgttgctggtactcttgagcttgggttctctacagtttgtattggttacatacagtagagtagaatagagctatgataccattaagagatttgaggtggaggcctcttaatgtaataaggaacccttattctcctttttatttcttgtgttttggtctatggagcagagcttattctaaagcttctgaacattttctttgaattcacgagttctgattgaatgattatctaccccttttttgaaggcatgatgctaatgtcccgctttctgt

SEQ ID NO: 9188 - DNA, 2512 bp, Arnica chamissonis
cgttccccgccatgcctcttccaccaccgccactcaacaatcgacttccctctctaccctctcaatacccgctttctctgggctcaaatccaccaccacatcctcctcacgcgcacctactcgccgtcaggtgtctaccacgcgccgccatgtgatctccaacgcggctgtggagactctcgacaagacggatactgctttggtggagaagtctgtcaacaccatcagattcttggctattgatgctgtagagaaggcgaattcgggtcatccgggtttgccaatgggttgtgcacccatgggtcatatattgtacgatgaggtcatgaggtataatcccaagaacccgtattggttcaatagggatcgctttgttctctccgccggacatggatgtatgctccagtatgctctgctccaccttgctggctacgatgctgtcaaagaagaggacttaaagcaattccgtcaatggggaagcaaaactcccggtcatcctgagaactttgagactcctggtattgaagtcaccactggtcctcttggtcaaggtattgccaatgctgttggtcttgctcttgctgagaagcatttggctgctcgttacaacaaacccgatgctgagattgttgaccactacacatactgtattcttggagatggttgtcaaatggaagggattgcaaatgaagcatgttcacttgctggccactggggacttggaaagttgattgctttttatgatgacaaccacatctccattgatggtgacacagagattgccttcactgagaatgttgatcaacgttttgaagctcttggatggcacataatttgggtgaagaatggaaacactggttatgatgaaatccgtgctgccattaaagaagcgaaaactgtgaccgataaacctactttgatcaaggtgacgacaacaatcggttttgggtcaccgaacaaggcgaattcatacagtgtccatggagcggctttgggtgcaaaagaagtagatgcaaccagacaaaaccttggatggcctcatgagccattccatgtaccagatgaagtgaagaagcactggagtcgccacaccccagacggtgctgctcttgaagctgaatggaactctaaatttgcagagtatgagaagaaataccctgaagatgctgccgaactgaagtctattgctactggtgcattgcctgccggatgggagaaggctcttccgacatacacaccagaaacacccggtgacgccacaagaaacctctcacaaacaatgcttaatgcattagcacctgttctccctggtcttattggtggaagtgcagatctcgcatcttcaaacatgactttaatgaaaatgtttggtgatttccaaaaaaacactcctgaagaacgcaatgttcgatttggtgttcgggaacatggtatgggagccatttgtaacggaattgccctccacagccccgggttcatcccttactgcgctacattctttgttttcactgattacatgagaggtgccatgagaatttcggctttatcagaagctggagttatttatgtcatgacccatgactccattgggctgggagaagacgggccgacccatcaacccattgaacatttagccagtttccgtgccatgcccaacatcttaatgttccgtccggctgatggaaacgaaacagctggagcttataaggttgcagtcgaaagcagaaaacgtccctctgttcttgctctttctaggcaaaaacttcccaacctgcccggaacttcaattgaaggaactgcgaaaggtggttacacaattaccgataattcaagtgggaacaaacccgatgttatcttgatggggacaggttctgagctggaaattgcagttaaagctgctgatgaactcagaaaagaagggaaatcggttcgggttgtgtctttcgtgtcatgggaactttttgatgaacaatctgatgaatacaaggaaagcgttcttccgtctggtgtaacggctcgtgttagcatcgaggctggagcaactttcggttggacaaaacttgtcggaagcgaagggaaggcgattgggatcgacaaatttggggccagcgctccagctggaaagacctacaaggaatacgggataactgttgaagctgtggttactgcggccaaagaagtttcttaggtcggttcgaaaccaacatcatgttctgggcttcgggaacttttataaaggacgattgatattagttttcggtatcttgattcataaatgctcagatgaataataagaggttggtttttagtctttgatgcatttcatcgaacatcgaacgaagatcggaagagaggattagaagtctcgtgaatttgtaccaaaattgaaacatatttttgtgatttttatatgttcgattactacggaggtgttcttttgagtcccatgtagaagttatcataacatatgatacacatattttagctcagtattctgaaatatatgatacac

SEQ ID NO: 9189 - DNA, 2605 bp, Musa acuminata
ctcaccaaggaagtccgcagaattcgaagtcgaccgaccgatggccgcctcctcctctgtcgtcgccgcctccgcctccgcctccgcccaggccctcgcggtctccactcactgctccccctcctccagccattcccaccgccttgccctccccggtggcgatgcccttagatcgctcgtcggccgatctctcacgtcgtccccctccgccctccgcttcctacgcatgaggcagccggtgttccgatcccgtagggctggcccggccagggcggcggctgtggagaccctcgaggcggccgccacggacgcccttgtcgagaagtcggtcaacacgatccggttcctcgccattgacgccgtcgagaaggccaactccggccacccggggctccccatggggtgcgctccaatgggccacatcttgtacgacgagtttatgaagtacaaccccaagaacccgtactggttcaatcgtgatcggttcgttctttccgcaggccatggatgcatgcttcattacgcgctgctccacctcgctggctacgatagcgtcaagattgaagacataaaggaattccggcagtggggcagcagaactcctggtcaccctgagaactttgaaacccctggaattgaagtcacaactggtcctcttggtcagggtgttgcaaatgcagttgggttggctcttgctgagaagcacctagctgcccgtttcaataagcctgacaatgagattgtggaccattacacgtatgtcatactcggggatggttgtcaaatggagggcatttcaaatgaagcttgttctcttgctgggcattggggcctagggaaacttatcgcgttttatgatgacaaccacatttccattgatggagacactgagatcgcttttacggaagatgtaatggctcgttttgaggctcttgggtggcacaccatctgggttaagaatggtaataatggctatgatgatatccgtgcagccattaaggaagcaaaggctgtcaaagacaaacccacactgattaaggtcactactaccattggttatggatcaccaaacaaggcaaacacatatagtgtgcatggaagtgcattgggtgctaaggaggtcgatgcaactagacagaaccttggatggccgtatgagccattccatgtgcctgaggaagtgaagagtcactggagccgccatgttcctgaaggtgcttcttttgaagctgaatggaatgccaagttcgcagagtatgagaagaagtataaagaagatgctgcacagctgaaaggtatcatatcgggagaattgcctgctggatgggagacggctcttccgacgtatacttctgaaagtcctgctgatgctactagaaatctgtcacagcagtgcttgaatgcacttgccaaagtactcccaggttttcttggtggcagtgctgaccttgcatcctccaatatgactttattgaaaacgtttggtgacttccaaaagggcactcctgaggaacgaaatgtccgttttggtgttagagaacatggaatgggtgccatctgtaatggtattgccctccacagccctggtcttctcccctattgtgccactttctttgtcttcactgactacatgagagctgccatgaggatctcagccttgagtgaggcaagagttatctatgtgatgacacatgattctatcggacttggtgaagatggacccacccatcaacctatcgaacatttgataagcttccgagccatgccaaatattttaatgctccgtccagctgatggaaatgagactgctggagcatacaaggttgctgtgctcaacaagaaaaggccatcagtccttgctctttcccggcagaagcttcctcagcttgcaggaacatctgttgaaggagttgagaagggaggatacattatttcggacaactcatccggcaacagaccagatctcatttttatgggcactggttcagaactggaaatagctgccaaggctgctgatgagctaaggaaggaggggaagacggtccgtgtagtatctcttgtttcatgggagctgttcgacgagcaatcagatgaatataaggagagtgtcttccctgcttctgtcactgccaggattagtatcgaagcaggcaccactcttgggtgggagaagtttgtcggaagcaagggcaaggcgatcgggattgatcggtttggtgcaagtgccccagctgggagaatatacaaggaattcggtataacagcagagaacatcattgcaacagccagatctctgtgatatttgacatatcagttttatgttctggcaattcctggctaatagggctcagaaagatgagtgcctaaagaaattgaatgttggcattcggcctataataaaatgtcattgagatcttttctgtaatttcggatttagccgatttcgtctgatttatttgatttgctgcagttgacattccatcaaactctattgtcatatgaaacaaagtgctattgaggagagtaattactcttttttgaagtcctgttacatccagattttgttttaggtttcatggttggaatattgtaagagtctggtcac

SEQ ID NO: 9190 - DNA, 2567 bp, Setaria italica
acccacacctacccccggagccgacaaaccatggccgcgcactccgtcgccgccgcgcacgccaccatcgccgcgcgcgcgggccccgcgcccggcgccgcggcgtcggccccggccgagcgcctcggcttccgccgcctcagctcgctcgccggccgcggcctgcggtccccggcgccggcccgccgcgcgccctccgcggccgcctcccgccgccagcgcgtcgtgcgcgccgccgccgtcgaggcgctcgagggcaaggctgccaccggcgagctgctcgagaagtcggtcaacacgatccggttcctggccatcgacgccgtcgagaaggccaactccggccacccggggctccccatgggatgcgcgcccatgggacacatcctctacgacgaggtcatgcgctacaaccccaagaacccctactggttcaaccgcgaccgcttcgtcctctccgccggccacggctgcatgctccagtacgccctgctccacctcgccggatacgacagcgtcaaggaggaggacttgaagcaattcaggcaatggggaagcaggacacccggccaccctgagaactttgagactccaggagttgaagttaccactggacctcttggtcagggtattgccaatgctgttgggttggcacttgccgagaagcacctggctgctcgcttcaacaagcctgacagtgagatcgtcgaccactacacgtatgctattttgggagatggttgccaaatggagggtattgccaatgaagcttgctccttggctggacactggggtcttggcaagttgattgctttctacgatgacaaccacatttctattgatggagatacagagatcgcgttcacagaggatgtgagcacccgttttgaggctcttgggtggcacacaatctgggttaagaatggaaacactggctatgatgacatccgtgcggccattaaggaagcaaaggcagttactgacaagcctaccttaatcaaggtgactaccacgatcggttttggatctccgaacaagtccaactcatacagcgttcacggaagtgcattgggcaccaaagaggtcgaagcaaccaggcagaaccttggatggccctatgaggcattctttgtgccggaggatgtcaagagccactggagccgccacacgcccgaaggtgctgcacttgaggctgattggaatgctaagtttgcagagtacgagaagaagtacccagaggatgcagcaaccttgaaaagtatcatcacaggggagttacccactggctgggctgatgctctccctaaatacactccagagatcccaggagatgccaccaggaacctctcccagcagtgcttgaacgcacttgctaaagttgtgcctggtcttattggaggtagtgctgatcttgcgtcctccaacatgacattgcttaagatgtttggtgacttccagaaggatacacctgaggagcgcaatgtccgctttggagtcagggagcacggaatgggtgccatttgcaatggcattgctctgcacagcccagggtttgttccatactgtgctactttctttgtcttcaccgattacatgagaggtgccatgaggatctcagctttgtctgaagctggagttatctatgttatgacccacgactctattggtctcggagaagatggtccgacccatcagcccattgagcacttggtgagtttccgcgcaatgcccaacatattgatgctccgtcctgctgatggtaatgagaccgctggagcatacaaagttgcagttctcaacaggaagaggccatctattctcgctctctccaggcaaaagcttcctaatctgcctggtacctcaattgagggtgttgagaagggtggatataccatctctgacaactcaaccggcaacaagcctgacctcattgtgatgggtaccggttctgaactggagattgctgccaaggctgctgatgagttgaggaaggaggggaagaccgtccgtgttgtgtcatttgtttcctgggagcttttcgaggagcagtcagatgaatacaaggagagcgttctccctgcgtctgtttctgcgagaatcagtattgaggcagggtctactctcggatggcagaagtacgtcggagcccagggcaaggccattggcatcgacaaattcggtgcaagtgctcctgctggaaagatctaccaggagtacggcatcactgtggagagcatcctcgcggcagccaagagcttttaagagtccacagtcttgagtttttgccatcattggtgccaaaggatcactatacctcgaggtcttgtgcccaaagcttggaataacggagggagcggtaggatgcctgcatttggagcgtgagtggtattctaggcctgtaataaacaatgccttttccatttacgttggttttatttggcgacccttatacgattcctgaaggtgtgcctgattaaattgggtgctggttttgttaacattggcaatgaactgatgattagtcttgcaacgacgtttcattctttgcgagatcgtcttagaagggc

SEQ ID NO: 9191 - DNA, 2625 bp, Sorghum bicolor
cgccatctccgcctctcctcctccacccggcacgcgcacgcacacagcgccatcacagacaccatggctacgcactcggtcgccgccgcgcacgccaccatcgccgcgcgcgcggcgccggctgccggggcgtcggccccggccgagcgccttggcttccgcctcagctcgctcgccggccgcggcctgcgttccccgctcccggcccgccgcgcgccgtccgcggccgcgtcccgccgccagcgcgtcgtgcgcgccgccgccgtcgagacgctcgaggggaaggccgccacgggcgagctgctcgagaagtcggtcaacacgatccggttcctggccatcgacgccgtcgagaaggccaactccggtcacccgggcctccccatgggctgcgcgcccatgggccacatcctctacgacgaggtcatgcgctacaaccccaagaacccctactggttcaaccgtgaccgcttcgttctctccgccggccacggctgcatgctccagtacgccctgctccacctcgccggatacgacagtgttaaggaggaggatttgaagcagttcaggcaatggggaagcaagacaccgggccaccctgagaactttgagactccaggagttgaagttaccactggaccccttggtcagggtatcgccaatgctgttgggttggcgcttgctgagaagcacctggctgctcgcttcaacaagcctgacagtgagattgtcgaccactacacgtatgttattttgggagatggttgccaaatggagggtattgccaatgaagcttgctccttggctggacactggggtcttggcaagctgattgctttctacgatgacaaccacatttccatcgatggagatacagagattgcattcacagaggacgtgagcacccgctttgaggctcttgggtggcacacgatctgggttaagaatgggaacaacggctatgatgacatccgtgcagccattaaggaggcgaaggcagttactgacaagcccaccttaatcaaggtgactaccacaatcggttttggatcgcccaacaaggccaactcatacagtgtgcatggaagtgcattgggtgccaaagaggttgaagcaaccaggcagaaccttggatggccctatgagccgttctttgttccagaggacgtcaagagccactggagccgccacacacctgaaggtgctgcacttgaggctgattggaatgctaagtttgcagagtacgagaagaagtatgcagacgatgcagcaaccttgaaaagtatcatcacaggagagttccctactggctgggctgatgcgcttcctaaatacactccagagagcccaggagatgccaccaggaacctctcccagcagtgcttgaatgcacttgctaatgttgtgcctggtcttattggaggtagtgctgatcttgcgtcctccaacatgactctgcttaagatgtttggtgacttccagaaggatacggctgaagagcgcaatgtccggtttggagtcagagaacacggaatgggcgccatttgcaatggcattgctctgcacagtccagggtttgttccatactgtgctacattctttgtcttcactgattacatgagaggtgccatgaggatctcagctctgtctgaggctggagttatctatgttatgacccacgactctattggtcttggagaagatggtccgacccatcagcccattgagcacttggtgagtttccgtgcaatgccgaacatattgatgctccgccctgctgatggcaatgagaccgccggagcatacaaagttgcagttctcaacaggaagaggccatctattctcgctctttccaggcaaaagcttcctcacctgcctggtacctcaattgagggagtcgagaagggtggatataccatctctgacaactcaactggcaacaagcctgacctcattgtgttgggtactggctctgaactggagattgcggaaaaggctgccgatgagttgaggaaggaggggaagacagtccgtgtcgtctcatttgtttcttgggaacttttcgatgaacagtcagatgaatacaaggagagtgtcctgcctgcagccgtcaccgcaagaatcagcattgaggccgggtctactctcggctggcagaagtatgtcggagcccagggcaaggccattggcatcgacaaattcggtgcgagtgctcctgccggaacgatctacaaggagtatggcatcactgtggagagcgtcattgcggcggccaagagcttttaagagttaacaacaacagtcttgagttttttgtcatcattgatgccaaaggaacactgtacctcgaggtcttgtgccccaaagcttggaataaacaatggagggagcggaaggatgcctgcatttggagcgcgtgagtggtattttaggcctgtaataaacaatgccttttccatttatgttggttttattcggtgaccctcacacgaacacgattcatgaaggtgagcctggttattaattaaatcgggtgctggtttttggtaacatgcattggcaatgaccttactgtcttgcagagcgatgtttcattctttgctggatcgtgggtttaagtcgcac

SEQ ID NO: 9192 - DNA, 2350 bp, Trifolium pratense
ttctcaatcccaagctcatctccgccacatcaccatcccacatgcctcagccgctgtaacaccaaccactgaaacaacccttgttgagaaatcagtcaacacgatccgttttctagcgattgattcagttgaaaaagctaattcgggtcacccgggtttacccatgggttgtgctccaatgggtcatgttctttatgatgaagttatgagatataatcctaaaaaccctttttggtttaaccgtgatcgttttgttttgtctgctggtcatggttgtatgcttcagtatgctttgcttcatcttgctggctatgacagtgtcaaggaagaagatttgaaggaatttcgtcaatgggggagtaggactcctggacatcccgagaattttgagactcctggaattgaagttacaacaggtcctcttggtcagggtattgccaatgctgttggtttagcccttgcagagaagcacttggctgcaagatttaacaaacccgacaatgagatcattgatcattatacgtattgtatattgggcgatggttgtcaaatggagggaattgcaaatgaagcttgctcacttgcaggacactggggactagggaaactaatagcgttttatgatgacaaccacatttctattgacggtgacacggaaattgctttcactgagagtgttgaaaaacgtttcgagggtctcgggtggcatgttatttgggtaaagaatggaaacactggctttgatgagattcgtgctgccattaaggaagcaaaagctgtcaaagacagacctacattgatcaagttcacaacaaccataggttatggttctccaaataaatcaaactcctacagtgtgcatggaagtgcacttggtgccaaagaagttgatgccacaagaaacaatcttggatggccatatgaacctttccacgtgcccgaggatgtcaaaaagcattggagtcgccatattcccgagggtgctgcacttgaatctgagtggaatgctaagttttctgcatacgaaaagaagtacaaggaggaagctgccgtattgaaatctattatcagtggtgaattaccctctggttgggagaaagcacttccgacttacactccagaggtcccagctgatgccacgagaaatctgtcccagacaaaccttaatgcccttgcgaaggttcttcccggtcttctcggtggcagtgcagatcttgcttcttccaatatgaccttgctgaaagcgtttgggaacttccaaagtgaaactccagcagagcgtaatgttagattcggtgttagagaacatggaatgggagcaatctgcaacggcattgctcttcacagcccaggactgattccatattgtgcaaccttctttgttttcaccgactacatgcgcggtgccataaggctttctgccctatccgaatctggtgttatatatgtcatgactcacgattcaataggacttggagaggatgggccaacccaccagcctatagagcacttggcaagcttccgggcaatgccaaatatcttgatgctccgtcccgccgacggtaatgaaaccgctggagcatacaaagttgccgttctcaacagaaagagaccctctatcctcgccctttctagacaaaaattgccaaaccttcccggaacttctattgaaggagttggaaagggtggatacatcgtctctgacaactcaacaggaaacaaacctgatgtcattttgatcggaaccggttccgaattggaaattgcttactatgctgccgaagatctaagaaaagaaggaaaggctgttagagttgtttcctttgtttcttgggaacttttcgatgaacaatcagacgcttacaaggagagtgttctccctggtgctgtttcggctagagtcagcattgaggccggatcaacattcgggtgggagaaaattgttggaagcaaaggtaaagcaatcggtatcgatcgtttcggagccagtgctcctgcaggaagaatatacaaagagtttggcataactaaagaagctgttattgctgcagcaaaagagcttatttagaactattagtttctgttcatttaagaactttctttctttcttttctttcttctttttttagttttgatatatctacacaaagaagaatgtttcaatagcattgtgttgttgcttgaataagaaaaaggttagaagattattgttgcttgggattgttgtgagtgaagctaagcaacatagatcaaagaatgagtacactaataaatttttatgaacttgtaaacttttcaaccaattgaattttgtattgccacattgttaaattcaattatgttcatgagt

SEQ ID NO: 9193 - DNA, 2498 bp, Panax ginseng
cgcccttcctgggatcaatctcagctccatttccgcaaccagaaccctctcacacgcctcacgcgccgtcatacagtctcggagagtgaggcgtgtgagggcttcggcggtggcggagactctagagaagacagataccgcattagtggagaaatcggtcaacacgatccggttcctagctatcgatgcggtcgagaaggcaaattctggtcacccgggtctgccaatggggtgtgctccgatgggtcacgtgttgtacgatgaggttatgaggtataacccgaaaatccatattggttcaaccgtgatcggtttgtgctctcggctggacatgggtgtatgttacagtatgcactacttcacctggctggctacgacagtgtcaaggaagaagacttgaaaagttaccgacagtggggaagcgaaaacacctggtcaccctgaaaactttgagacacctggcattgaagtcaccactggtccccttggtcagggtgttgctaatgcggttggtttggcccttgctgagaagcatttagctgctcgatataacaaacctggaaatgagattgttgatcactacacgtatgtgatacttggggatggatgtcaaatggaaggaatttcaaatgaagcttgctcccttgctagtcactggggacttggaaagctgattgcattctatgatgacaaccacatttcaatcgatggtaacactggtattgcattcacagagagtgttgataagcgctttgaaggactcggttggcatgttatatgggtgaagaatggtaacactggatatgatgagatccgtgctgccattgaggaagctaaggcagttaaagataaacctactttaatcaaggtcacaactaccattggttttgggtcacctaacaaggcaaactcatatagtgtacatggtagtgcattgggtgccaaagaagtggatgccacaagaagaaccttggatggtcacatgagccattccatgtgccagaggatgttagaaagcactggagccaccacaccactaaaggagctgctttggaagctgaatggaatgccaagtttgcagagtatgagaagaactacaagggtgaagcaaaagaattgaaatctcttattactggtgaacttcctactggttgggaaaaagcgcttccgacgtatactcctgaaagtccagcagatgccactcgtaatctgtctcagacaaatctcaatgcccttgcaaaagttcttcctggacttcttggaggaagtgcagaccttgcttcttccaatatgacactgctcaaaatgtttggtgactaccaaaaggacacccctgaggaacgtaatgtacgatttgggttagggaacatggaatgggtgccatttgtaacgggattgctctccacagccccggccttattccctactgtgctaccttcttgttttcacagactacatgcgagcagccatgaggctttctgcattgtgtgaagctggagtcatttacgtgatgactcatgattccatcgggcttggagaggatgggccgactcatcaacctattgagcatttggcaagcttccgagccatgccaaacatcctaatgctccgaccagctgatggaaacgagactgctggtgcatacaaggttgcagttctcaacagaaagagaccctccgttcttgccctctctcgtcaaaagcttcctaatcttacgggaacatcaattgaaggagttgagaaaggtgggtatattatttctgataactcctcaggtaacaagccagagataatttttgataggaactggttccgaattggaaatagctgcaaaagcagctgatgagctcaggaagggtggaaagactgtacgagttgtgtcctttgtttcttgggagttgttcgatgaacaatctgatgcatataaggaaagtgtactgccagctggtgtatcggctagggtcagtattgaggctggatcaacatttgggtgggacaagatcgtgggatccaagggtaaggcgattgggatagatcattttggagcaagtgcaccagcagataagatatataaagaatttggattaactgtagaagctgtgataacagcaggcaaagcagtgtgctaaaccttcatactgatacttttatgtgtcaaagtgggaaaatgtattgcgttctctctgaaaatatgaagtttttcagtgtagaagtttggtgtagtgtattgggtagtaaaagtcattttgattctggtaagaaaaaaataaagggaacttcaaatcctcctctgcattcttgatggagtttctgcgtcagttcaagatggatggtctcttgggttcttgacttgtgcttaaagcttcatcctgatgtaattttgaaagctatttttagtagcagtagttgttgcagtctaattttctgttttgtgatgatgcacttctagttttacctttagctctgcgatttgatattattgatgctttctgttttct

SEQ ID NO: 9194 - DNA, 2610 bp, Papaver somniferum
gaagtaacgaattagtaatacttctattgtatattcatacgattagtcatcatcagatctaatcggttaatacaccatcgttatcgagatctttcgtggttcgtgctgcagctgttgagactttggaaaagacagatacagcattagttgataaatcagtgaatactattagatttctagcaattgatgctgtttagaaagctaattcaggtcatcctggtttacctatggttgtgcacccatgggtcatattttgtacgatgaactatgagatataaccctaagaacccttactggtttaacagagatagatttgttctttctgctggtcacggttgtatgttgcagtatgctttgcttcatcttgctggttatgacagtgttacgacagaagatttgaagactttccgtcagtggggaagcaaaatccctggtcaccctgagaactttgagactcccggtgttgaagttactacaggtccccttggacaaggtattgctaatgctgttggattggcacttgcggagaagcacttggctgcccgtttcaacaagcctgacagcgagattgttgatcattacacgtactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatacccgttttgaaggtctaggatggcacggtaatttgggtgaagaatggcaacaatggttacgatgaaattcgtgctgccatcaaggaagcaaaggctgtcacagacaagcccactttgatcaaggtgactaccaccattggttttggttctccaaacaaggcaaactcatacgccgtacacggtgctgcattgggttccaaagaggttgatgccacaaggaagaaccttgactggccatttgagcctttccacgtgccagaggatgttaagagccactggagccgccatactgctgaaggcgctgccctggaagctgaatggacagctaaatttgcagagtacgaaaagaagtactcagaggatgctgcagaatttaagtccatcattactggtgaattccctgctggttgggagaaggctcttcctacttacactccagagatcccagctgatgccaccagaaacctatcccagacgtgccttaatgcacttgctccagtcctccctggtcttattggtggtagtgcagatctcgcttcctccaacatgaccttgatgaaaatgttcggagacttccaaaaggccactccagaagagagaaacgttcgatttggtgtcagagagcatgctatgggggccatatgtaacggaattgctcttcacagtcctggttttgtcccctactgtgcaaccttctttgttttcacagattacatgagaggtgccatcagaatttcagctttatctgaagctggagtcatttatgtcatgacccacgactctattggtcttggagaggatggtccaactcatcagcccatcgagcatttggcaagctttagagccatgcctaacattcttatgctccgtcctgctgatggaaacgagactgccgggtcatacaaggttgcagttgaaaacagaaagagaccctcgattcttgccctttcacgtcaaaagcttgcaaaccttccaggaacctccattgaaggagtcgccaagggaggttacacaatatcagacaactctacaggtaacaaaccagatgtcatcttgtgtgctactggttcagaattagaaattgctgaaaaggccgctggtgagctcaggaaggaaggaaagacagttagggttgtttcttttgtttcctgggaattatatgatgagcagaccgacgaatacaaggagtctgttcttccagctgccatcactgctagggttagtattgaggcaggttcaacattcggatggcacaagattatcggaagcaaaggaaaggctattggtgtcgacggtttcggagcgagtgcccctgcaccaattatatacaaagagttcggcatcacatcagaagccgttattgcagcagctaaatcagttatgtagattgttttctttgtccttttttcagctggagcttatttgtcattttggttttttggatttctgctcttccaaatctagaagtgacaccgccggaggagagaggcctgtctttaagagtaatttgaattcagaaaaacagcctcgtgaacgaattatgataataattaaaaaaagaacacaacaagcgaccttgtttcatctacagtagtttgtatcttcacattaactgatgaatcagagttgtcttattgaaattcatgagaaacaaataatgtaccgtctttcacagtttctcttacaggatccatttgttttatatcaattttatgcacaatttctactgggtcttttctttcatcttctatgtttccattttcttcatttagcaaatactgtaaaaggctgtcgcctctgaaccaggacatggttggtgtcagcgcatactgttaaaggctgtcgcctctgaaccaatccaattc

SEQ ID NO: 9195 - DNA, 5128 bp, Brassica oleracea
aaaacaaaaacctgaaacttgtctgccctcctcctagcctttgcacagacaatggagtaatggtggcttggactggtctggagcattttcgtgtaggaagattcgatccacctccacctgcaattgaacctgatgattatgtggtacgttctttaaacaaagaacaatactttaagttgaaaaaacgaaagattgtaactttgtgattgatgtgtgtttgaacttagtatgatcttcgaccaaggtggcctcgtggagaggagcggcgaaaatcgccggcgactgaagaaagctttcactcgcgacgacgttcatggagacgtcgaggctaccgttgtcgtcttcgattagaggaaagctgatatccgccggctacacttccctgtcgtcgatttcatccgtctcctccaccgatctcgctcgagatgttaaaatcacagagagtgaagcatttgagattttgaagatggcaaatcaaatcagcggatcaagctcttgcaatggaagaagctcttctctcgtaaatggagcaaggaatgcttgggatatgcttaacgaggaggaagctttgccgcggattactacgtcttgttctgatcttgataagatcttgggtggtggaatcagctgcagggatgttacagagattggtggagtacctggtattggcaagactcagattgggatccagctctctgtgaatgttcagattcctcgtgagtttggtggtcttggaggaaaagcgatatacatcgatacagaaggtagcttcatggtggagcgtgctctacagatcgcagaagcttgtgtggaggacatggaggaatacactggatacatgcacaaacattttaaagcgagtcaagtgcagatgaaacctagagatatcttggagaacatattctacttccgtgtctgcagttataccgagcagatcgctttggttaatcatcttgacaagttcatctccgaaaataaagatgtaaaagtggtaatcgtagacagtatcacgtttcattttcgtcaggactttgatgatttagctcataggacacgagtgcttagtgaaatggctttgaagtttatgaagcttgccaaaaagttctctcttgctgttgtgttattaaaccaggtgaccacaaagtacaccgaaggctcgtttcagttagctcttgcgttaggtgatagctggtctcattcgtgtaccaacagagtgattctgtattggaacggtgatgagcgttacgcgtatatcgacaagtccccttcacttccttcggcttccgcttcgtacactgtaactggtagaggtctaagaaactcctcatcaagtagcaagcgtgtcaagatgatgtaaagacacaacacaagcacatggagtacgctttctacggtctaatttactgcgtgtcacgatgatgtaaagacacaacacaagcacttgaaagacgtagaggatcaacgaacaagactgtgttatttctgaatccaacggtcatactttctttaggttgatttgtcctttaaagaacacgaggagttggcgggatctgtttggttctctctctgtcactctcaatataaaagtgcagagaagcattagtcttgttctcattctctctcagttcaccagcagagagcatccatggcttctttagcgttctctcaagctctcctttctcgtgccatctctcacaatggctctaacaagaacgtctccgttccagcttcctctgttctcaaatccacttccccacgcaccacgttcttccacagtcaacgcagcgcctccacgagcagtcactccctccgtcctctcgtccgtgcagccgccgtagagacgacagacgcaaccactgattcaaccctggttgataaatcagttaatacgatcaggttcctggccatagatgcagttgagaaggctaaatctggtcatcctggtcttccaatgggctgtgctcctatgtcccacatcttgtacgatgaggtcatgaggtataaccccaagaacccttactggttcaaccgtgatcgattcgttctctctgctggacatggatgcatgttgcagtacgctttgcttcacctcgctggctacgacagtgtcagggaggaagacttgaagagcttccgtcaatggggaagtaagacgcctggacaccctgagaactttgagactcctggtgttgaagtcactactggtcctctaggacaaggcattgcaaatgctgttggtttagctcttgctgagaaacatctagctgctagattcaacaaacctgacaatgaaatcgtcgaccactacacttactcgattattggagatggttgtcagatggaagggattacaaatgaagtttgctctctagctgcccactggggacttggaaagctcatcgctttctatgacgacaatcacatttctatcgatggagacacagagatcgcctttacggagaacgtggacaagcgctttgaagctctaggatggcatgttatttgggttaagaatggaaacaatggatatgatgagatccgtgctgctattaaagaagctaaggctgtaacagacaagcccactttgattaaggtgactactacaattggttatggatctcccaacaaggcaaactcatacagtgtccatggagctgcgcttggtgagaaggaagttgaagctaccagaaataaccttggatggccatatgagccgtttcaggtacctgaggatgttaagagccattggagccgtcacacccctgagggagccgctcttgaagctgattggaatgctaagttttcagcttatgagaagaagtatccagaggaagcagaagagttgaaatctatcatctcaggtgacttgcctgccggttgggagaaggcacttcctacatatacaccagagtctccaggtgacgccaccagaaacctctctcagcaatgtctcaacgccctcgccaaaaccctccccggtttcctcggcggtagcgccgacctcgcatcttccaacatgacactcctcaaagccttcggagacttccaaaacgctacacccgaaggaagaaacctcaggttcggtgtcagggagcacggcatgggagctatctgcaacggcgtcgcactccacagccctggcttcatcccttactgcgcgacgttctttgtcttcaccgactacatgagagccgcgatgagaatcgcggctctctctgaagccggtgttatctacgttatgacgcatgactccatcggtctaggagaagatggaccgactcaccagcctgtggaacacttgtccagcttccgcgccatgccgaatatcatgatgttccgtcccgctgacgggaacgaaacagccggcgcgtacaaaatcgctgtcgctagacggaacacgccttctgttttggccttgtctagacaaaagctgcctcagcttccgggaacgtctattgagaacgttgagagaggtggatacattctttctgataactctaacggtaacaaaccggatgtgatcttggttggaactggctcggagctggagattgctgctaaagctggagaggagttgaggaaagaagggaagagtgtgagagtcgtttcgtttgtgtgttgggaactgtttgatgagcaaccggatgcgtacaaggaaagtgtgttgccatctgatgtatcagctagagttagtattgaagctggatcgacgtttggatgggggaaggttgttggtgggaaagggaaatcgattggaattgactcgtttggggcaagtgcaccagcggggaagctttataaagagtttgggatcaccattgaagctgtggttgcagcagctaagtcacttatctaaagaagtataagggtttggttttgaagtaagagaggttcttccatataagcattgtcttctttgtccaagtagaaaaatgtaagagagaaaataaaaatttgtttcttgcatgtgacgtttgtaactgaaaccatgaacacaatacttatagccaatgttcaaggcgctttatattggattattgattaggcggtcgagcttttaaaaaatggttatagaaaaatcgttttgagatccgatatgccgagtaagatgtttaaaacactgctaatttaattattcaaacagttttcttttgtaaagtttcgtaatttgagtttggttaggtgagttgaaagatcaaaaactaaaactttgatctttcacattttcgtcgattgctttcaatcggatggcacaagctagcagaatctgccacggcgtgcagaagccatgtgttgtgcttcaacccatccgagaaatctcgggtctcatcaagctacccggatccaagtctctctccaatcggatcctacttcttgccgctctatctgagttgtatgacacaggtcggcttcttcgtcttccaactttgagcatcttccccaaattttcacctctttcttctctcatggatgcttcgaatctcggttcttccagcaaaccggccttctcttccttctcacaatccagcagaagaggaagaggaaacgagagagataatgatcgtcggaggcctcagggtcgtggcggcggtggtggtggcagaggaggaggaggaggagatagaatcgatgctcttggaagactcttacggttgagtccgagaagttacttaaaccaatattgtcacctgaagaagctccagtttgtgtgcatggaacatatcggaagaatttggaatccatcttagcatctggcttaaagcgtatgaatagactccatgttcacttttcttgtggcttgccaacagatggtgaagtgataagtggcatgagaagagatgttaatctcttgatctttctcgacatcaagaaagctcttgaagatgggattgcattctacatttcagacaacaaggtgattttgactgaaggtgttgatggtgtagtgcctgttgattacttccaaaagattgagtcttggcctagtcggcaaccaattcctttctgattccttgtttatacaatacgttcattgaatttttttattggaccacatttgtgacttatcagatatacaaatgttaccaccttagtatttaataacctatgttgtccatgtggtctggaa

SEQ ID NO: 9196 - DNA, 2393 bp, Flaveria ramosissima
ttctccggcctcaaatccgtcgctacatcctcctcacgcgccaccacgcgccggcaggtgattcccacgcgccgccgtgtgatttccaacgcggcggtggagactctcgacaagacggacactgctttggtggagaagtcgatcaacaccatcagattcttggcgattgatgctgtggagaaggcgaattcgggtcatccgggtttgcccatgggttgtgcgcccatgggtcatatattgtacgatgaggtcatgaggtataaccccaagaacccttattggttcaatagggatcgctttgttctctccgccggacatgggtgtatgctccagtatgctctgcttcaccttgctggctacgattctgtcaaagaagaggacttgaagcaattccgtcaatggggaagcaaaactcctggccatcccgagaactttgaaactcctggagttgaagtcaccactggtcctcttggtcagggtattgccaatgctgttggtcttgctcttgctgagaagcatttggctgctcgttacaacaaacctgatgctgagattgttgaccactacacatactgtattcttggagatggttgtcaaatggaaggaattgcaaatgaagcgtgttcacttgctggccattggggacttggaaagttgattgctttatacgatgacaaccacatctccattgacggtgacacagagattgccttcactgagaacgttgaccaacgttttgaggctcttgggtggcacatcatttgggtgaagaatggtaacactggttatgatgagatccgagctgccatcaaagaagctaaggctgtgactgataagcccactttgatcaaggtgacaacaacaatcggttttggatcaccaaacaaggcgaactcatacagtgtccatggagcggctttgggtgctaaagaagtagacgcaaccagacaaaaccttggatggccttacgagccattccatgtaccagatgaagttaagaagcactggagccgccatacccctgatggtgctgctcttgaagctgactggaatgctaaatttgcagcctatgagagtaagtatcctgaagaagctgctgaattgaaatctattattaccggtgtatttcctgccggatgggagaaagctcttccaacatacacaccagaatcacccggtgatgctacaagaaacctctcacaaacaatgcttaatgcattggcaccggttctacctggtctcattggtggaagtgcagatcttgcatcttcaaacatgaccctaatgaaaatgtttggcgacttccaaaaaaacaccccggaagaacgcaacgttcgtttcggtgtccgggaacacggtatgggagccatatgtaatgggatcgccctccacagccctgggtttgtcccttactgtgccacattctttgtcttcactgattacatgagaggtgctatgagaatctcagctttatctgaagctggagtcatatatgtcatgacccatgactccattggtctaggagaagatgggccgacccatcaacccattgaacatttagccagtttccgtgccatgcccaacatcttaatgttccgcccagctgatggaaacgaaacagctggagcttacaaggttgcagtcgaaagcagaaaaagaccctcgattcttgctctttctaggcaaaaactgccccaactacccggaacttcaattgaaggagccgccaaaggtggttacacaataaccgacaactcgacaggtaacaagcccgatgttatcttgatcgggacaggttctgagctggaaatcgtggttaaagcagctgatgaactcagaaaagaaggaaaatcagttcgggtcgtgtcttttgtgtcatgggaactcttcgaggaacaatctgatgaatacaaggaaagtgtccttccttcgggtgtaacagctcgtgtcagcatcgaggctgggtcaactttcggttgggagaagatcgttggaagcaaaggaaaagcaatcgggatcgacaaatgggggtccagtgcaccagcaggaaagatctacaaagaatatgggattactgttgaagctgtgattgcagctgctaaacaagttgcttaatctggtcttataaaagaagactgatgttagtttttggtatctcgattcataatgctcagacgaacaataagaagtcggtttttagtctttgatgcttttcatcgaacaccttacctgcaaatcgaacgaagatcagaagaggattagaagttgaaggattgatgctctggtttatttgtaccaaaaatgaaacataatttaccaagttttgtgacctttatatgtttggttaatgatgaggtgttcttttgagtaatgtacaattttacaagtatatt

SEQ ID NO: 9197 - DNA, 2663 bp, Lactuca sativa
cgatctttctcgttcatctcaacgacccctctccaaatctctgatcataaatcacaatcagacaacaacttatattaacaagaatcacattgctgattactctctcacttcccgcaattttctctctctaaaacgagccatggctgcgtcttctttcgctctctcccaagctgccaccaccctctctccctccgccgctctccgccatgaatcttccactaatatcacgcaaccaccttcttctatatccaccctctccatccccactttctccggcctcaaatccacctcaactccctcctcacgcgctgtcactccccggcgtgtatccgcttctcgccgacgtatcatatcttcggccgcagtggagtcgcttcagaagaccgatacgtcccttgttgataagtctgtaaacacgatcagattcttggcgattgatgctgttgagaaggctaattccggtcaccctggtttgcccatgggttgtgctccgatggggcatattctatacgatgaagtaatgaggtataaccccaagaatccatattggttcaatagagatcgctttgttctctccgccggacacgggtgcatgcttcattatgccctcctccaccttgccggctacgacagtgttaaagaagaagacttgaagcagttccgtcaatggggaagcaaaactcctggccaccctgagaactttgaaacccctggtatcgaagtcactacaggtccacttggtcaaggaattgccaatgcagttggtcttgcagttgcagaaaagcacttggctgctcgattcaacaagccagatgccaagattgttgaccactacacatattgtatccttggtgatggttgtcaaatggaggggattgcaaatgaagcttgttcactcgcgggtcactggggacttgggaaattaatcgctttttatgatgataatcacatttccattgatggtgacactgagattgcttttactgagagtgttgaaaaacgttttgaagcccttggatggcatattgtttgggtcaagaatgggaacaatggttatgatgatattcgtgctgcgattaaagaggcaaaggctgttactgataaaccaactttgatcaaggtgacaacaacaattgggtttgggtcaccaaacaaggcgaattcatacagtgttcatggagctgcattgggtgcaaaagaagtagatgcaacaagacaaaaccttggatggccttatgagcctttccatgttcctgaggatgtgaagaagcattggagtcgccatacagctgagggggcagctctagaagccgaatggaatgtgaaatttggtgaatatgagaagaagtatgcagaagatgcagccgagttgaagtctattgctgatggtgtattcccaactggatgggagaaagctcttcctaaatacacgcccgatattcccggcgatgcaacccgaaacctctcccaatcatgcctaaacgcattagcacccgttctcccagggctcctcggtggaagtgccgatctcgcctcttccaacatgaccctaatgaaaatgttcggtgacttccaaaagaacgcgccggaagaacgaaacgtccgcttcggtgtccgtgaacacggaatggccgccatctgtaacggcatcgccctccacagtccgggattcatcccgtactgtgctactttcttcgttttcaccgattacatgagaggcgctatgcgcctctcagctttatctgaaaccggggtcatctacgtgatgacccacgattccatcgggttgggtgaggatggccccacccatcaacccattgaacacatcgccagtttccgggcgatgccaaatattttaatgctccggccggccgacggaaacgaaacggccggagcatacaaggtcgcagtagaaaaccgtaagcgaccgtccgtccttgccctttcgagacaaaagctgcccaacctgcccggaacgtcaatcgaaggtgtagcgaaaggtggttatattgtatccgatgattcttcgggcaacaaacccgatgttatcttgatcgggaccgggtccgagcttgagatcgcggttaaagctgcggatgagcttagaaaggatgggaaatcggttagggttgtgtcgtttgtgtcatgggagctttttgatgaacaatctaatgagtataaagagagtgtacttccggatagtgtcacgggtcgggtcagtattgaagccgggtcaacttttgggtgggaaagaatagttggaagcaaagggaaggcgattgggattgataaatttggggcaagtgcacctgcgggaaagatatataaggagtatgggataacagttgaagctgttatagcagccgctaaggaagtttgctaagtttctaataggtaaacaataaaacgaagaacggagagtttagataaagttcatgtattgtttgagttttggtgaattttgtaatttgatacttaaagatctttctagattttgtattttatgtgtttgatcgttgatgagtcatgagatgtttttgtccaattacctttcaagtagattttcctatctaaacgtaacccaaatctactaattaagaagttaattggtcaaaatcgttaccaatagttatgattttgtgcgatctaaactagtatatcgt

SEQ ID NO: 9198 - DNA, 2287 bp, Allium cepa
tttctctccttcactcctctcacttctcacatacttaatcaaccatcatgtcttcttcgatcaccgcctctcaggccctcctaaacctatctctgacccgcaagccgcgggccacatctagaatgaccatgcgggtcccgcttcgccgggggttgatccgtgcagctgccgtcgaggcggtggaggtgtcaacggagacggtggtggagaagtcggtgaacactatcaggtttttggccattgatgcagttgaaaaggcaaattcgggccacccgggtttacccatgggttgtgctcccatggggcatattttgtatgatgaggttatgaggtacaacccgaaaaatccattttggtttaatagggataggtttgtgctttctgctggccatggatgcatgttgcagtatgctcttttgcatttggctggatatgacagtgtcaaggaagaagatctgaaacaattcagacagtggggaagtaagacaccaggtcaccctgagaactttgagacaactggtgtagaagtcacaaccggtcctttaggtcaaggtattgcaaatgctgttgggctagcacttgcggagaaacacttagctgctcgtttcaataaacctgatgctgagatcgttgatcactatacatatgtgatcgttggtgatggttgcaacatggagggaatttcaaatgaagcagcatctcttgctggtcattgggggcttggaaagctaattgccttctatgatgataaccatatttcaattgatggagacacagagattgcatttactgaagatgttagtgcccgttttgagtctcttggatggcacactctttgggtgaagaatggaaacactggctatgatgaaatccgagcagcgattaaggaagcaaaggcagttactgataaaccaactatgattaaggttaccacaaccattggttatggatcaccaaacaaagcaaactcatacagtgtacatggggctgcattgggtgcaaaagaggttgatgctacccgacaaaaccttggatggccatatgaacccttccatgtacctgaagatgtaaagagccactggagtcgtcatatatctgatggggctgctcttgaagctgaatggaatgccaagtttgcagagtatgagaagaaatacgcagaggaagcagcagaattgaaatctattataaccggagaattacccgcgggttgggaaaaggctcttccgacatataccccagaaagcccagcggacgcgacaagaaacctgtcccaacaatgcctaaacgctctcgcttccgtcctcccaggcttcctggggggcagtgccgacctcgcctcgtccaacatgaccctcctcaaatccttcggcgacttccaaaaatccaccccccatgaacgcaacctccgattcggggtccgggaacacggcatgggcgccatctgcaacggcattgccctccacagcccaggactcatcccgtactgcgccaccttcttcgtcttcaccgactacatgcgcggggccatgcgcatctctgccctgagcgaggcccgcgtgatctatgtcatgacccatgactctatcgggttgggcgaggatggccccacccatcagcccatcgagcacctcgtcagcttccgcgctatgcccaacatcctcatgttccgccccgccgatggaaacgagaccgccggcgcctaccggatcgccgtcctcaagcccaagacaccctccatccttgccctctcccgccaaaagctccctcacctccccggtacatccatcgagggtgtcgccaagggtgggtacatcatatccgacaactccacgggtaacaaacctgattacattctaatgggtacgggttcggaattagagatcgctgccaaggcggcggaggagttgaggaaggaagggaagacggttagggtcgtgtccttcgtgtcgtgggagttgttcgacgagcaggatgatgagtacaaggagagcgtgcttccggaagctgtgaccgccagggttagtatcgaggccgggtcgaccctcgggtggcagaagtatcttggaggtaaagggaaggccattgggattgataagttcggagctagcgctcctgctgggattatttacaaggagtatgggattacggtggagaatgtagttgcggcagctaaatctttgtaattttaccgtttgtagtttgtgaggggatttgttttgtgtaattgtagcatcaagagttgttctctgtatgttttatttttgaatgctttaaactggggaaa

SEQ ID NO: 9199 - DNA, 2410 bp, Arabidopsis lyrata
attcgcctcgtcggcaggcaacagcaatctctctcaaaaatggcgtctctgacttcatcatcacaggcttctatcctcgctcgaccttcatcgaatcgttcttctcctcctctccctcctacggatctccatgtttccctttctctcccttctttttccgctctcagagcctccttcactcgctcttcttcccctacgctccgccgccgccgccgcctccttcttccgatatccgccgccgcgacggacgtgtctctggtagacaaatcggtcaatacgatcaggttcctggcgatcgatgcggtggagaaagccaaatcgggtcacccgggactgcctatgggatgtgccccgatgggccatatattgttcgacgaagtgatgcaatacaacccaaagaacccttactggttcaacagagatcgtttcattttgtctgccggtcatggttgcatgctccagtacgccttgcttcacctcgctggctacgacagtgtcagggaagatgatttgaagaatttccgtcagtggggaagtaggactccaggacatcccgagaattttgagactcctggtgttgaagtcaccactggtccacttgggcaaggaattgcaaatgctgttggtttggcacttgcggagaagcatttggctgccagattcaacaaacctggcaatcagattgtcgaccattacacgtatgctattctcggagatggatgtcagatggaaggaattgcaaatgaagcttgttctcttgcagggcactggggtctggggaagctcattgccttttatgatgacaaccacatttctattgacggtgacacggagattgcctttaccgagaatgtggaaacacgtttccagggtcttggttggcatgttatatgggtcaagaatggaaacaccgcttatgatgaaattcgtgctgccattaaggaagctaaggctgttaaagacaaacccactttgatcaagataactacaacaattggttacggatcaccaaacaaggcaaattcttacagtgttcacggaagtgcactgggtgaaaaagaagttgatgctaccagaaagaatcttggatggccatatgggcctttccatgttcctgaagatgtcaagagccactggagtcgtcatatccctaaaggagctgctcttgaaacagaatggaatgctaagtttgctgactatgagaacaagtacccacaagaagctgcagaactgaaatccatagttactgttaacttacctactggctgggaaaaatcattgccgacttacacgcccgagagtcctgcagatgcaacaagaaacctctctcaacagtgtcttaatgcccttgcaaaggttcttcctgggttcctcggtgggagtgctgaccttgcttcatccaacatgacattgctcaaaatgtttggggacttccaaaagaacgcacctgaagagagaaaccttaggtttggtgtcagggaacacagcatgggagctatctgcaatggcataacctgtcacagcccggggctcatcccttactgtgctacattctttgtcttcacagattacatgagagctgccatcaggctctctgccctgtctcaagcaggggttatctacgtaatgacccatgattcaatcggtcttggagaagatggaccgacccaccagcctatagaacatgtggcgagcttccgtgccatgcccaacatcttgatgctgaggccagcggatggaactgaaactgcaggggcatacaaagttgctgtagagaacagaaagaggccttcgatcctggctctgtccagacaaaagctgcttcatctacctggaacttcggttgagggagtggagaaggggggatatgtaatctcagacaactccacaggtaacaaaccagacgtaatcctgatggggacaggttcggagctagagattgctgcaaaggctggagagaagctaagagaagaaggaagagcagtgagagtagtgtcactggtgagttgggagctgtttgatgaacaaagcgaagaatacaaagaaagtgtgttaccttcagaggtttcagcaagagtgagcattgaagcagggtcgacctttgggtgggagaagatggttggctccaaaggaaaagccatcggtgtagacagttttggagcaagtgcaccagcggatgtgctctacaagaaatttggactcacggttgatgcggttgttgcagccgctaaagacctttgctaagctaagctctcttttgcacaacatcatcataaaagacattttctacgtagtgtttgtgcctttccacatgcatttacccggactcactcactagtcgctataaatcaatatcgttatgtgtttttttatcttacaataagtgataatggaaatttgaagaatgaaa

SEQ ID NO: 9200 - DNA, 2383 bp, Brassica napus
ctcgcccgcgccatctctctccatggctccgaccaacgcatctccctaccttcatctttctcacgcgcctccgcgtcctctcgccgccgcaacgccgcgtcgatgaccaaactccgatctatccgcccccttgtccgcgccgcggctgtcgagaccctcgagaccagcaccgattcgtcgattatcgacaaatcggttaactcgattcggttcttggcgatcgatgcggtggagaaggccaagtcgggtcaccccggtcttcccatgggatgtgctcccatggctcacattctctacgatgaggtcatgaggtataaccccaagaacccttactggtttaaccgtgaccggttcgttctctctgctggtcatggttgtatgctcctctacgcgttgcttcacctcgccggatacgacagcgttttggaggaggatttgaagagtttccgacagtggggaagcaagacacctggacatcctgagaacttcgagactcctgggattgaagtcactactggtccacttggacaagggattgcgaatgctgttggtttagctcttgctgagaagcatttagctgctaggttcaacaaacctgatgctgaagttgtcgaccactacacatatgtgatccttggagatggttgtcagatggagggtatttcaaacgaagctgcctctctagctggtcactggggacttgggaagctcattgcgttctacgatgacaatcacatttccattgatggagacactgagattgcgttcactgagaatgttgaccagcgtttcgaagcgcttggatggcatgttatctgggtgaagaatggtaacactgggtatgatgagatccgtgctgctattaaggaagctaaaacggttactgacaagcctactttgattaaggttactactacaattggttatggatctccaaacaaggcgaactcgtacagtgtccatggagctgcacttggtgagaaggaagttgaggctactagaaacaacctcggatggccttatgagccattccaagtacctgaggaagttaaaagccactggagccgtcacacgcctgaaggcaaagctcttgaatctgactggaatgcaacgtttgcagcttatgaaaagaagtatccagaggaagctgcagagttgaaatctatcatcactggtgaattacctgctggctgggagaaggcactaccaacatacacacccgagtctccaggcgacgccacaagaaacctgtcacagcaatgtcttaacgccatagccaaagttgtccccggtttcctcggtggaagtgctgacctcgcatcatccaacatgacactgctcaaagcctccggtgacttccaaaaggccacacccgaggaaagaaaccttagatttggcgtcagggagcacggaatgggagccatctgcaacggcatagccctccacagccccggtctcatcccttactgcgcaactttcttcgtcttcactgactacatgagaggtgccatgagaatctcagccttgtccgaagctggagtgatctacgtgatgactcatgactccattggtcttggagaagatgggccgacccatcagcccatcgagcacatcgccagcttccgcgccatgcccaacacgctcatgttccgtcccgccgacggaaacgagacggccggtgcgtacaagatcgctgtcaccaagcgtaagacgccgtctatcttggctttgtctaggcaaaagcttcctcagcttccggggacttccatcgaaggagttgccaagggtggatacacgatctctgacgactctactgggaacaaacctgatgtgatcttgattgggactggctctgagctggagatcgctgcgcaggctgcagaggtgattaggaaagaaggcaagaccgttagagttgtgtcttttgtctgctgggagctgtttgatgagcagacggatgagtacaaggagagtgttttgccgtctggtgtgtcggctagagttagtattgaagcggcttcgacttttgggtgggggaagattgttggagggaaagggaagtctattggtattaactcgtttggggctagcgcaccggcgcctttgctctacaaggagtttggtatcactgtggaagctgtcgttgatgcggccaagtcattcttctaagagacttaaaagatcatcagactatcatcctgtataagggtttgtgtcaacattgtctcattatcttaaaataaattgcaacaagacgcatagagtttctttctttcttcttttggtggtttttctttttgtaattcggacaacataggttttgggtttggaagagaaacaaagtataagacaatgtaaaactctcgtgttttgttgttatatg

SEQ ID NO: 9201 - DNA, 2542 bp, Zostera marina
agagagagcacacatagacacacacggacagaacaatggcagcgtcgtcttctctgacggtccaaactttcgccgctaattttatctccggcaacggatccgcttcttcgcagtgtccttcgaaccgtcttctctccacctcccgtaccagctccttctccggcaaacccctccgcttctcgtcttcttcctcatcatgtcgtaccaaaaaggtatatttgcagaggaggggacttggagtcacgagagcgtcggcggtggagacactgaagaaaaagacagcgacagatgaacttgtggagaagtcggtgaataccatccggttcttgtcaatagacgctgtcgagaaggcgaattcaggtcatccagggttgccgatgggatgtgctcccatgggacatattctgtacgatgaagtcatgagatataaccctaagaacccttactggttcaatcgtgatagattcgtcctctctgctggtcatgggtgtatgctccattactccctacttcacctcgccgggtacgactccgtaaaggaggaggatttgaaagtttttcgtcagtggggaagctgcactcctggtcatcctgagaattttgagacccctggaatagaagttaccacaggtcctttgggacagggtattgcaaatgctgttggattagcacttgcagagaagcatttggccgcaagatttaataaacccgactgtgagattgtagaccactacacgtatgttatacttggtgatggttgccagatggaaggtatatctaacgaagcatgctcccttgctgggcattggggtcttgggaagcttatcgctttctatgatgacaaccatatttccattgatggagacacagaaattgcatttactgaggatgttagcagtcgttttgatgctcttggatggcacacaatctgggtgaaaaatggtaacaatggttatgatgaaatacgtgctgcgatcgaggaggcaaaaactgtcaaggataagcccactatgatcaaggtgactacgactattggttatggttcacctaacaaagcaaactcgtacgctgtacatggaagtgcactaggtggaaaggaagtggatgcaaccagagagaatcttggatggtcctacgatccattttttgttccagaagatgtaaaaagccattggagtcaacatacacctgatggtgctgctcttgaggctgaatggaatgcgaagttttcaaagtatgagaagaagtacagtgaggatgctgcagaattgaagcaaattgcatctggagagtttcctgcaggatgggagaatgctctgcctacatacaccccagacagccctgctgatgctactaggaatctatctcaacagtgtcttaatgcactggccaatgtgcttcccggatttttaggtggcagtgctgatcttgcctcatccaacatgactttgatgaaaacgtttggtgactttcaaaaggatacaccagaggaaaggaatctcagatttggtgtgagggagcatggaatgggtggcatatccaatggcatatgccttcacagccctggcttcattccatactgtgctacattttttgtcttcacagattacatgagaggtgccatgcggatttctgctttgtctgaagctggagttatctatgttatgacacacgattccattgggcttggagaagatggtcctacccatcagccaattgagcatttaatcagtttccgtgctatgccaaacatcgtaatgttccgtcctgctgatggtaatgaaactgctggttgctacaagattggagttatcaataggaagagaccttctatattggccctctctcgtcagaagcttccccagcttccaggaacatcgattgaaggtgttgagaagggaggatatgccatttctgacaattccacaggtaacaaaccagacatcattcttataggtaccgggtctgaactggagatagcagccaaagctggagatgagctgaggaaggaagggaagacagtccgtgttgtatcccttgtttcatgggagctttttgaagagcaatctgatgaatacaaggaaagtgttttccctgctgcatcaactgcaagagttagcatcgaagcaggatcaacatttggatgggaaaggtacaccggaagcaaaggaaaggctattggaattgatcgatttggagctagtgctcctgccgggaagatttacaaggagtttggtctgactgtggagaatgtcatagctacagccaagtctctataataagtttggacatgtcagtccagagacacttgtggtaggataaatttgatttttatttgcctgtgagctaataagtacattgataaggtaccccctcttatatttccctctttctgtcttttgacttaagattgttctatacgttataattgagtatgtcgagttctcgaccattcgagattaaaaattctttgttgtattgaagaatgagagttattgtttggattgcgtaatacttaagttctgtaattactttaaaacgt

SEQ ID NO: 9202 - DNA, 2417 bp, Brassica napus
cgctcgcgccatctcccaccatggctcagaccagcgcatctccttaccttcacctttctcacgcgcccccgcctcctcctctcgccgccgcaacaacgccgccgcgtccacgaccaaactccgctctctccgccctctcgctgttcgcgccgcggctgtagatacgctagagccgaccaccgacgcgtctatcgtggacaaatctgtgaacacgatcaggttcctggctatcgacgcggtggagaaggcgaagtcgggtcatccgggtcttcccatgggatgtgctcccatggctcacattctctacgatgaggtcatgaggtataaccccaagaacccttactggttcaaccgtgaccggttcgttctctctgctggtcatggttgtatgttgctttacgcgttgcttcacctcgctggatacgacagcgtattggaggaggatttgaagagctttcgacagtggggaagcaagacaccagggcatcctgagaatttcgagactcctgggattgaagtcactactggtcctcttggacaagggattgctaatgctgttggtttagcacttgttgagaagcatttggctgctaggttcaacaaacctgatgctgaagttgtcgaccactacacgtatgtgatccttggagatggttgtcagatggagggtatttcaaatgaagctgcctctctagctggtcactggggacttggaaagctcattgctttctacgatgacaaccacatctctattgatggagataccgagattgcattcactgagaatgttgaccagcgttttgaagctcttggatggcatgttatctgggtgaagaatggtaatactgggtatgacgagatccgtgctgctattaaagaagctaaagctgttacagacaagcctacattgattaaggtcactactacaattggttatggatctcccaacaaggcgaactcatacagtgtccatggagctgctcttggtgagaaggaagtcgaggctaccagaaacaaccttggatggccgtatgagccattcaaggtacctgatgaagttaaaagccactggagccgtcacacgccagatggcaaagctcttgaatctgactggaatgcatcatttgcagcgtatgaaaagaagtacccagaggaagctgcagagttgaaatctatcatcactggtgaattacctgctggctgggagaaggcactaccaacatacacaccagagtctccaggtgacgccacaagaaacttgtcacagcaatgtctcaacgccctagctaaagtcgttcccggtttcctcggtggaagtgctgaccttgcatcttccaacatgacactgctaaaagcctttggtgacttccaaaaggcaacgcccgaagagagaaaccttaggtttggtgttagggagcacggaatgggaggcatctgcaacggcattgcccttcacagccctggtctcatcccttactgtgcaactttcttcgtcttcactgactacatgagaggcgcgatgagaatctcagctttgtctgaagctggagtcatctacgtgatgactcatgactccattggtctcggagaagatggaccaacccatcagcccgttgagcacttggctagcttccgcgcgatgcccaacactctcatgttccgtcccgctgatggaaacgaaacagccggtgcgtacaagatcgctgtcaccaagcgcaagacaccgtctatcttggctctgtctagacaaaagcttcctcagcttccggggacatccatcgaaggagttgagaagggtggatacacgatctctgacaactcgtctggaaacaaacctgatgtgatcttggttggaactggttcagagcttgagattgctgctcaggctgcggaggtgctgaggaaagaaggcaaaaccgtgagagttgtgtctttcgtctgctgggagctgtttgacgagcagacggatgagtacaaggagagtgtgttgccgtctggtgtgtctgctagagttagtattgaagcggcttcgacttttggatgggggaagattgttggaggtgaagggaagtccattggtattaattcgtttggggctagtgcaccagctccattactctacaaggagtttggtatcactgttgaagctgttgttgatgcggctaagtcattcttctaagtgactttaccatttcacaacattgtctcactacctcaaaataaagtgcaacaagacgcaaagagactcttcgttcttttttttgtttcttgtaatgcgggtcaagataggttttgggtttgggaagaggagaaagtagaagacaatgtaaaactctctatgatcagttgtgtattgttgttatatgctttgagtttcagctaaatttcacctacttaaataacattggtcactacta

SEQ ID NO: 9203 - DNA, 2127 bp, Spinacia oleracea
ctcgtcttcttcttctcttctcaaaccctcttctttttcgttaaaaactacacagcgtgtagccccacgcgccaccgtgcgtgcatcggctgtagaatcactcgacaagtccgtcacctctgaagataccttggtcgataagtctgtgaatacgatccgatttctggcgatcgatgcagtcgaaaaggcgaattcgggtcacccgggtttgcccatgggttgtgctccaatggggcacattttgtacgatgaagttatgcggtataatccaaagaacccctattggttcaaccgtgatcgctttgttttgtccgccggtcatgggtgtatgctccagtatgcgctccttcacttggctggctacgacagtgtcactgtagaagatttgaagagcttccgtcagtgggaaagcaggactcctggtcatcctgagaatttcgagactcctggaattgaagtcaccactggtccccttggtcaaggtattgccaatgctgttgggctggcacttgcagagaagcatttggctgctcggtttaacaagcctgatatggagattgttgatcactatacgtatgctatactcggagatggttgtcaaatggagggtgtttctcaggaagcctgttcccttgcaggacattggggtcttggaaagcttattgcattctatgatgacaatcatatatctattgatggtagcactgatattgcattcactgaggatgttgacaaacggtttgaggctcttggatggcatgtgatttgggtcaagaatggtaatactggctacgatgaaattcgcgctgcaatcagagaggctaaggctgttaaggacaagccaaccttgatcaaggtgactacaactatcggttatggttccccaaacaagtcaaattcatacagtgttcatgggagtgccttaggtgctaaggaagtggaagcaaccaggagcaaccttgtgtggccacatgagccattccatgtacctgaagatgttaagaaacattggagccgccatactcccgagggagcatcccttgaaactgaatggaacgctaaatttgctgagtatgaaaagaagtacacagatgaagctgcagagttgaagtgtatcattactggagaattaccttctggctgggagaaagcacttccaacgtacaccccagagagccctgctgatgctaccagaaacctgtctcaacaatgcctcaacgctcttgctccagttcttccaggttttcttggtggaagtgctgaccttgcttcctcaaacatgactttgttgaaaatgttcggaaacttccagaaggatactcctgaagaaaggaaccttcgatttggtgttcgggagcatggaatgggatccatctgcaatgggattgccctccactgcccaggcttcatcccctactgtgcaactttctttgtcttcacggattacatgagagcctccataaggatggctgccttgtcccaggctggggtcatctttgtcatgacccacgactccattggacttggggaagacgggccaactcatcagcccattgagcatttggcgagtttccgggccatgccaaatgtgttcatgttccgtcctgcagacggtaccgagaccgcaggagcttaccgagtggctgtattaaacaaaaagacaccatcaattctcgctctttctcggcaaaaacttcctcagcttcccggaacttctattgaaggagttgaaaaaggtggttacataatttctgacaactcaaagggtaacaccccagatgttattttgatgggtacgggttccgaactagagattgctgctaaagctgctgacgatcttagaaaggaaggaaaggctgttagagttgtctcattcgtttcatgggagctctttgatgctcaacctgattcatataaagagagtgtgttgccagccgatgttacagctagagtgagcattgaagctggaaccacatttgggtggttgaagtacgttggctgcaagggcaaagctatcggtattgatcggtttggagcgagtgcccctgctgataagatatacaaggagttgggaatcacaaaagaggctgtcattgaagccgctaaatcactttgctagacaatggt

SEQ ID NO: 9204 - DNA, 2395 bp, Petroselinum crispum
tctctctccgcctcctctctcaaatgctgtcggcgcgtaggctcacgcgccgccgccgtgaaggcgtcatcatcagcggtggatgtggtggacaaaacagaaactgggttggtggagaaatcggtgaacacgatcaggttcttggctattgatgcggtggagaaagcgaattcgggtcatccgggtctacccatgggttgtgcacccatgggtcatatattgtacgatgagatcatgaagtataatcctaagaacccgttttggtttaatagagatcggtttgttttgtctgctggacatgggtgtatgttgcagtatgctcttcttcacttagctggttacgacagtgttaaggaagaagacttgaaaagtttccgtcagtggggaagcaaaacacctggtcaccctgaaaactttgagactcctggcattgaagtcactactggcccccttggccagggtgttgcaaatgcagttggtttagctcttgcggagaagcatttagctgctcgatttaacaaacctggcagtgaaattgttgatcactacacgtatgtgatactcggagatggttgtcaaatggaaggaatttctaatgaagcctgctccctcgctagtcactggggacttgggaagctaattgcattctatgatgacaaccacatttcaattgacggtgacacggctattgcattcactgaatctgttgatcagcgcttcgaaggacttggttggcatgtcatatgggtaaagaatggtaacactggatatgatgagatccgtgctgctatagaggaagctaaagctgttacagacaagcctaccttaattaaggtcactactacaattggttttggctcacctaataaggccaactcatacagtgtacatggaagtgcattgggtgccaaagaagttgatgccacaaggaagaaccttgggtggccacatgagccattttatgtgccagaggatgttaaaaagcactggagtcgccatacccctgaaggtgctgctttggaagctgaatggaataccaaatttgcagagtatgagaagaaatacaaagaagaagcacaggaactgaaatctcttattagtggtgaacttccagttggttgggaaaaggctcttccaaattatactccagaaaccccaggggattctactcgtaatctttctcagacaaacctgaatgcccttgcaaaagttcttcctggacttctagggggaagcgcggaccttgcttcttccaatatgacactgctgaaaatgtttggtgattttcaaaaggacacccccgaggaacgtaatgtacggtttggcgttagggaacatggaatgggtgctatatgtaatggaattgctctccacagtcctggcctcatcccatactgtgctaccttctttgttttcacggattacatgcgagcagccatgaggctttctgcattgtgtgaagctggagtcatctacgtgatgactcatgattccatcgggctaggagaggatgggccaactcatcaacctattgagcatatagcaagcttccgggccatgccaaacattctgatgctccgaccagctgacgggaatgagactgctggtgcatacaaggttgcagttctcaacagaaagagaccttcagttctagccctctcacgtcaaaagcttcctaatcttcctggaacatcaattgaaggagtcgagaaaggtgggtatattattactgataactcttcaggtaacaagcctgatattatcttgattggaactggttccgaacttgaaatcgctgcaaaagcagctgatgagctgaggaagagcggaaagacagttcgggttgtgtcatttgtatcttgggagttgtttgacgagcaatctgctgcatacaaagaaagtgttctgccagatgatgtatcagctagggtgagcatagaggctggaacaacatttgggtgggagaagatcgtgggatccaagggaaaggcgattggaatagatcattttggagcaagtgcaccagcagataagatatataaagaatttggattaacagtggaagctgtgattgcagcagccaaggcattgtgttaaagcaactgatagttgtagtgctgctactactttttattcttcagtttgttttgatctgtgattcttcatggaatttctacctcactatcgggttcaagacggtttattttgagattgagaatgtagcttttgtgtatctttgacaatcagaattcaattagaccttagacctgcagttttaccatctgtagttgtgtcatactgcccagtaaccttcgaaaccatgttttgaaatgtgacacattcttgttgatttactttacaataataaaaattgcttatgcctgagatcggaaga

SEQ ID NO: 9205 - DNA, 2573 bp, Silene vulgaris
gatttagaaacaatggagcacacagaattgatgttcgcagatttggaacagaggtctgggatccccatagtttacgtagaaaaatctttcacactgtctcaccagtctctcctcccccacgccaaactccccaccacctccgccgccgccaccgccaccccgtcgctgttacttccactcaccgcggccaagcatggtggcgcgttgcgaggtggtggcgcgtggaggaggcgcgtggggtcacgcgctgcggtgttggtgaaggcgacggcggtggagagtgtggagacggctgagacgacggatgaggtggtggcgaagtcggtgaatacgatacggtttttggcgattgatgcggttgagaaggcgaattcgggtcacccgggtttgcctatggggtgtgcgcccatgggtcatattttgtatgatgaggttatgaggtataacccgaaaaatccgtattggtttaatagggataggtttgtgttgtctgctggtcatgggtgtatgcttcagtatgctcttcttcatcttgctggttatgacagtgtgttggaagatgatctgaagtcattccgacaatggggaagtagatcacccggtcatcccgagaactttgagactcctggaattgaagttactaccggacctctcggtcagggtattgcaaatgctgtaggtttggctcttgctgagaagcacttggctgcaagattcaacaagcctgatgctgaaattgtcgaccattacacatattgcatcctcggagatggttgccaaatggaaggaatttcgcaagaagcatgctcccttgctggtcactggggtcttggaaaattgattgccctttatgatgacaaccacatctctattgatggagacactgctattgcattcactgagagtgttgatcagcggtttgaggcccttggatggcatgttatctgggttaagaatggtaacacaggatacgatgagatccgtgctgcaatcaaggaggctaagtcagtcacagacaaacctactttgatcaaggtcaccaccacaattggttttggttctcccaacaaggcaaactcttacagtgttcacggagctgcattgggcgccaaggaagttgacgcgacaaggcagaatcttggttggccatatgagcctttccatgttccggaggatgtaaagaagcactggagccgccacactcctgagggggcttcccttgaagctgattggaacgccaagtatgcagagtaccaaaagaagtactctgaagaagcagcagagttgaattccatcattactggtgaatttcctgctggttgggagaaggcactacccacttacacacctgaggacgcaggtgatgctaccagaaacctatcccaggcgaacttgaatgctcttgcgaaggttattccaggacttatcggaggaagtgcagatcttgcatcttcaaacatgaccttattgaaaatgtttggagacttccagaaggacacacccgaagaaagaaatgtccgttttggtgtcagagaacacggaatgggagcaatctgtaatggcattgctcttcacagcccagggttcgtcccatactgtgctaccttctttgtcttcacagattacatgagaggagcaatgagaatttcggccttgtctgaggccggagtcatctacgttatgacccacgattccattgggcttggagaggatgggcctacccaccagcctattgaacacctagccagtttccgggccatgcccaatatcctaatgttccgcccagcagatggaaacgagacagctggttgttacaaggtggcagttgagaagagaaagaccccatcaatcctggctctttcccggcaaaagcttcctcaacttcccggcacatccattgaaggagttgcaaaaggagggtacacaatctccgacaactcttcaggtaacaaacccgatgttattctcgtcggtactggttccgagctagaaattgcagctaaagccggcgatgagctcagaaaagaaggaaagacagtcagagttgtgtcctttgtttcctgggagttgttcgacttacagtccgatgagtacaaggagagtgttctcccctcggctgtaacagctagggttagcattgaggctgcctcaacattcggatggggtaagatcgttgggtcaaagggtaaggccattggtatcgacaagtttggagccagtgcaccagcaggaaagatataccaggagtacggaattacagttgaggcggttattgaggcggctaaatcagttatctagttcacactctttttgagaggtgttctattcttctttttgcctcccatttttcgttttgttataacttgatgtgaaacttgagttaaaaatgctcaaaggtgggatggacaaggctgttgtttagtttattgtaaagaaagtataatttctttgcttgttcattttcccattttaggcctacttacagtttagtgcttgtcgatttttgtatttgaaatatcccaccgatgtattatggatataccattgataaaggtggaataaaaagacagtga

SEQ ID NO: 9206 - DNA, 2446 bp, Phalaenopsis aphrodite
catcaacgctgcacaaaccatcgtagggcggcgccccatctcccgtcacggttcggccgccacgcctcaccaggaccggctctcccttccgaccagcttcggccttagctcgctttctggccttgctgtcagatccggcccacgcaggcgagccgccgctgcacccttccgccggtcatcgaatcctcgtgcggcggcgatcgagacgctagatgtgcaaaccgctacggtggagctgattgagaaatccataaatacgatccgattccttgcaatcgacgccgtcgaaaaggcgaactccggtcacccggggcttcccatgggttgtgccccaatgggccacattctttacgacgaggtcatgaggtataaaccctaaaaacccttactggtttaatcgcgatcgcttcgtcctctcagccggccacggatgcatgctccagtacgcgctgctccacctcgctggctatgatagcgtccgggaagaggacttgaagcaattccggcagtggggaagcagaacaccaggccatcccgagaactttgaaactcctggtgttgaagtaacaactggtccttttggggcagggaattgcgaatgctgttggattagcacttgctgaaagacatctagcggctcgtttcaacaaaccagacaatgagattatagaccattatacatatgttattcttggtgatggttgccaaatggagggcatttccaatgaagcatgttctcttgccgggcactggggccttggaaaactcatagctttctatgacgataaccacatatccattgatggggacactgagattgccttcactgaagatgtgagcgcccgctttgaggctcttggttggcacaccatttgggtgaagaacggaaacaccggctatgacgagattcgagctgcaataaaggaagcaaaggctgtcaaggacaaacccacattgatcaaggttacaacaaccattggttatggctcaccaaacaaagcaaactcatatagtgttcatggaagtgctttaggtgcaaaggagttgacgcaaccaggcagaaccttggctggcctatgaacctttctatgtgcctgaggatgtcagaaaccattggagccgccatgactcagaaggtgcttctcttgaagcagaatggaatgctaaatttgcagaatacgagcagaagtacaaggaggaagcgtcggaactaaaaggcatcatctatggagaacttcctttaggatgggagaaagcactcccgagttacacccctgagagcagcgccgacgctactcggaatctctctcagcagtgccttaacgcacttgcgaaggtcctccctggtttcctcggaggcagtgctgatctcgcaagctccaacatgactttgttaaaaagcttcggggactttcagaaagccaccccggaagagagaaatctgcgttttggtgtcagagaacacggaatgggtgccatttgcaacggcattaaactccacagccctggcctgttcccttactgcgcaacgttcttcgtcttcaccgactacatgagagctgcgataaggatatcagccctatctgaagctggagtaatctacgtcatgactcatgattccatcggtcttggtgaagacggtccgacgcatcagcccatcgaacatttaatgagcttccgagcaatgccaacatttaatgttcaggccagccgatgggaacgagactgctggagcttataggattgcggttcttaacaagaagagaccatcaatcctcgccctatccaggcagaagcttcctcagctcgcagggacttccattgaaaaagttagagaagggagggtacatcgtctctgacaactcgtcggacaacaagccaaatatcattcttacaggaactggttctgagttggaaatcgcagccaaagctgcagatgagctgaggaaggaggggaagacggttcgagttgtgtcgcttgtttcatgggagttatttgatgaacagtccgatgagtacaaggagagtgtcttccctgaagaagtcactgctagaattagcatcgaggctggagcaacgcttgttgggagaaatttgtcggcaggaagggaaggcaatcggcatcaaccggtttggtgctagtgctccggcgggagactatacaaggagttcggtttgacacggaagctgtcattgcggcggcgaggagtttataaactatgcattgtttgaagcttcttctctgcaaggtggttctgatcactctgagctctaatggagattttagatacagatgggagagcagttcaagttgagatgattcggatatgtttctgtctataataataaagctttgtaatttttattgcactttttctcttgtacgtcattgaatctgattgttgtatcaaagtgaactttctctctgaatctcacttgggtttac

SEQ ID NO: 9207 - DNA, 2492 bp, Panax ginseng
atcgtctcgccctccctgggatcaatctcagctccatttccgcaaccagaaccctctcacacgcctcacgcgccgtcgtacagtctcggggagtgggattacgcgcatccgtgagagcgtcggcggagactctagagaagacagataccgcattagtggagaaatcggtcaacacgatccggttcctagctatcgatgcggttgagaaggcaaattctggtcacccgggtctgcccatggggtgtgctccgatgggtcacgtgttgtacgatgagtttatgaggtataacccgaaaaatccatattggttcaaccgtgatcggtttgtgctctcggctggacatgggtgtatgttacagtatgcactacttcacctagctggctacgacagtgtcaaggaagaagacttgaaaagtttccggcagtggggaagcaaaacacctggtcaccctgaaaactttgagacacctggcattgaagtcaccactggtccccttggacagggtgttgctaatgcggttggtttggcccttgctgagaagcatttagctgctcgatataacaaacctggcaatgagattgttgatcactacacgtatgtgatacttggggatggatgtcaaatggaaggaatttcaaatgaagcttgctcccttgctagtcactggggacttggaaagctgattgcattctatgatgacaaccacatttcaatcgatggtaacactggtattgcattcacagagagtgttgataagcgctttgaaggactcggttggcatgttatatgggtgaagaatggtaacactggatatgatgagatccgtgctgccattgaggaagctaaggcagttaaagataaacctactttaatcaaggtcacaactaccattggttttgggtcacctaacaaggcaaactcatatagtgtacatggaagtgcattgggtgccaaagaagtggatgccacaaggaagaaccttggatggtcacatgagccattccatgtgccagaggatgttagaaagcactggagccaccacaccactaaaggagctgctttggaagctgaatggaatgccaagtttgcagagtatgagaagaactacaaggatgaagcagaagaattgaaatgtcttattactggtgaacttcctaccggttgggaaaaagtgcttccgacgtatactcctgaaagttcagcagatgccactcgtaatctgtctcagacaaatctcaatgctcttgcaaaagttcttcctggacttcttggaggaagtgcagaccttgcttcttccaatatgacactgctcaaaatgtttggtgactaccaaaaggacacccctgaggaacgtaatgtacgatttggggttagggaacatggaatgggtgccatttgtaatgggattgctctccacagccccggccttattccctactgtgctaccttctttgttttcacagactacatgcgagcagccatgaggctttctgcattgtgtgaagctggagtcatttacgtgatgactcatgattccatcgggcttggagaggatgggccgactcatcaacctattgagcatttggcaagcttccgagccatgccaaacatcataacgctccgaccagctgatggaaacgagactgctggtgcatataaggttgcagttctcaacagaaagagaccctccgttcttgccctctctcgtcaaaagcttcctaatcttacgggaacatcaattgaaggagttgagaaaggtgggtatattatttctgataactcctcaggtaacaagccagagataattttgataggaactggttccgaattggaaatagctgcaaaagcagctgatgagctcaggaagggtggaaagactgtacgagttgtgtcctttgtttcttgggagttgttcgatgaacaatctgatgcatataaggaaagtgtactgccagctggtgtatcggctagggtcagtattgaggctggatcaacatttgggtgggacaagatcgtgggatccaagggtaaggcgattgggatagatcattttggagcaagtgcaccagcagataagatatataaagaatttggattaactgtagaagctgtgataacagcaggcaaagcagtgtgctaaaccttcatactgatacttttatgtgtcaaagtgggaaaatgtattgcgttctctctgaaaatatgaagtttttcagtgtagaagtttggtgtagtgtattgggtagtaaaagtcattttgattctggtaagaaaaaaataaagggaacttcaaatcctcctctgcattcttgatggagtttctgcgtcagttcaagatggatggtctcttgggttcttgacttgtgcttaaagcttcatcctgatgtaattttgaaagctatttttagtagcagtagttgttgcagtctaattttctgttttgtgatgatgcactcagttttacctttagctctgcgatttgatattattg

SEQ ID NO: 9208 - DNA, 2367 bp, Helianthus annuus
gccttcaccggactcaaatccacctccgcacgcgcctccactcgcggacaagtctccgccacgcgccgtcaggttgcacccacgcgccgccgcgtgatcgtcaacgcggctgtggagacgttgcagaagacggatactgctttggtggagaagtcgattaatactattaggtttttggcgattgatgcggttgaaaaggcgaattcgggtcatcccggtttgcccatgggttgtgcgcccatgggtcatatattgtatgatgaggttatgaggtataacccgaagaacccgtattggtttaacagagatcggtttgttctttctgctggtcatggatgtatgcttcagtatgctctgcttcatcttgctggatatgatgctgttaaagaagaagacttgaagcaattccgtcaatggggaagcaaaactccgggccatcctgagaactttgaaactcctggtgttgaagtcaccactggtcctcttggtcaaggtattgccaacgctgttggtcttgctcttgccgagaagcatttggctgctcgttacaacaaacctgatgccgagattgtcgaccactacacatactgtattcttggagatggttgccaaatggaaggaattgcaaatgaagcatgttcgcttgccggccattggggactcggaaagttgattgctttctatgacgacaaccacatctccattgacggtgacaccgagatcgccttcaccgaaagcgttgacaaacgttttgaagctcttgggtggcatgtcatttgggtgaagaacggtaacactggttacgatgagatccgtgctgccattcaagaagccaaggccgtgaccgataagcccactatgatcaaggttacaacaacaatcggtttcgggtcaccgaacaaggcgaactcatacagtgtccatggagccgcgttgggtgcgaaagaagtagacgcaacccgacaaaacctcggatggccttacgagccattccacgtacccgatgaagttaaaaagcactggagccgccacacccccgacggtgccgctcttgaagccgaatggaatgctaaatttgcagcttacgagagcaagtatcccgaagaagccgctgaattgaaatctattgttaccggtgtattgcctgccggatgggagaaggctcttccgacatacacaccagaaacacccggtgatgctacaagaaacctttcacaaacaatgcttaacgcattggcaccggttctacccggtctcatcggtggaagtgcagatcttgcatcttcaaacatgacgttaatgaaaatgttcggtgatttccaaaaagccacacctgaagaacgcaacgttcgtttcggtgtccgggaacacggtatgggagctatttgtaacggtatcgctcttcacagccccgggttcgttccttactgtgctacgttctttgtcttcaccgattacatgagaggtgcgatgagaatctcggctttatcagaagcaggagtcatttatgtaatgacccatgactccattggtctaggagaagacgggccgacccatcagcccattgaacatctagccagtttccgggccatgcccaacatcttgatgttccgaccagctgacggtaacgaaacagccggagcttacaaggttgcagtcgaaagccgaaaacgaccatcggttcttgctctttctaggcaaaaactacccaacctacccggaacttcaatcgaaggaaccacgaaaggtgggtacacgataaccgacaactcaacaggcaacaagcccgatgttatcttgatcggaaccggttctgagctcgaaatcgcggttaaagccgccgatgaactcagaaaagaagggaaaacggtccgggtcgtgtcgtttgtgtcatgggagcttttctatgaacaatccgatgaatacaaggaaagcgttctcccatcgggtgtgaccgctcgtgtcagcattgaggccggatcaactttcggttgggatagaattgttggaagcgcgggaaaagctatcgggattgacaaatgggggtcgagtgcgccagctggaaagatctacaaggaatatggtattaccgttgaagccgtgattgcggctgctaaacaagtgtgttaggcttgtatcttgattcgtaatggttgaacgaacaataagaagtcggttttttagtctttgatgcatttcagcgaacaccttacttgcgaatcgaacgaaaaatcagaagagaggattagaagttgaatgtttgatgctctttcctcctttatttgtaccaaaactgaaacataattttcaaagttttgtgatttgtttggttactagtgaggtgttcttttgagtaatgtacaattt

SEQ ID NO: 9209 - DNA, 4190 bp, Brassica rapa
atggtgacttggactggtctggagcattttcgtgtaggaagattcaatccacctccacctgcaattgaagctgatgattttgtgtatgatcttcgaccaaggtggcctcgtggagaggagcggggaaaatcgccggcgattgaagaaagctttcactcgcgacgaaccttcatggagacgtggaggctaccgttgtcgtcttcgatcagaggaaagctgatatccgccggctacacttccctgtcgtcgatttcatccgtctcctccaccgatctcgctcgagatgttaaaatcacagagagtgaagcatttgagattttgaagatggcgaatcaagtcactggatcaagctcttgcaatggaagaagctcttctctcgtaaatggagcaaggaatgcttgggatatgcttcacgaggaggaagctttgcctcgcattactacatcttgttctgatcttgataagatcttgggaggtggaataagctgcagggatgttacagagattggtggagtaccaggtattggcaagactcagattgggatccagctctctgtgaatgttcagattcctcgtgagtttggtggtcttggaggaaaagctatatatatagatacagaaggtagcttcatggtggagcgtgctctacagatcgcagaagcttgtgtggaggacatggaggaatacactggatacatgcacaaacattttaaagcgagtcaagtgcagatgaaacctagagatatcttggagaacatattctacttccgtgtctgcagttataccgagcagatcgctttggttaatcatcttgacaagttcatctctgaaaataaagatgttaaagtggtaatcgtagacagtatcacgtttcattttcgtcaggactttgatgatttagctcagaggacacgagtgcttagtgaaatggctttgaagtttatgaagcttgccaaaaagttctctcttgctgttgtgttattaaaccaggtgaccacaaagtacaccgaaggctcgtttcagttagctcttgcgttaggtgatagctggtctcattcgtgcaccaaccgagtgattctgtattggaacggtgatgagcgttacgcttatatcgacaagtccccttcacttccttcggcttccgcttcgtacactgtaactggtagaggtctaagaaactcctcatcaagtagcaagcgtgtcaagatgatgtaaagacacaacacaagcacacgagtaagctttctacggtttcctttgctgcgtgtcaaaatgatgtaaagacacaacacaagcacatgagtaagctttctcccgtttagttttgattttgattgaagagactggtttgtccggttaatatcagaaccggtacaagagttggtggattagtgactaataataatattatttcttaaatctaaagcaattaggttcttcaccaacccctgtcatgaacatggcttttgctttacacaccaactcatgtcgcacctattctcttattttgacttttaaaaacaaaacaaaaaaagttgaaagacgtagaggatcaacgaacaagcctgtgttctttttgaatccaacggtcatactttctttagcttgttttgtcctttaacgaacacgaggagttggcgtgatctgattggttctctctctttcactctcaatataaaagtgcagagaagcattagtcttgttctcattctctctcagttcaccagcagagagcatccatggcttctttagcgttctctcaagctctcctttctcgagccacctctcacaatggctctaacaagcacgtctctgttccagcttcctctgttctcaaaaccacttctccacgcaccaacttcttccacagtcaacgcagcgcatccacgagcaatcacactctccgtcctctcgtccgtgcatccgccatagagacgactgacacaacaactgattcaaccctggttgataaatcagttaatacgatcaggttcctggccatagatgcagttgagaaggcgaagtctggtcatcctggtctaccaatgggctgtgctcctatgtcccacatcttgtacgatgaggtcatgaggtataaccccaagaacccttactggttcaaccgtgatcgcttcgttctctctgctggacatggatgcatgttgcaatacgctttgcttcacctcgctggctacgacagtgtcagggaggaagacttgaagagcttccgtcaatggggaagtaagacgcctggacaccctgagaactttgagacccctggtgttgaagtcactactggtcctcttggacaaggtattgcaaatgctgttggtttagctctggctgagaaacatctagctgctagattcaacaaacctgacaatgaaatcgtcgaccactacacttactcgattattggagatggttgtcagatggaagggattacaaatgaagtttgctctctagctgcccactggggacttgggaagctcatcgctttctatgacgacaatcacatttctatcgatggagacacagagatcgcctttacggagaacgtggacaagcgctttgaagctctaggatggcatgttatttgggtgaagaatggtaacaatggatatgatgagatccgtgctgccattaaggaagctaaggctgtaaaagacaagcccactttgattaaggtgactactacaattggttatggatctcccaacaaggcaaactcgtacagtgtccacggagccgcgcttggtgagaaggaagttgaggctaccagaaataaccttggatgggcatatgagccgttccaggtacctgaggatgttaaaagccattggagccgtcacacccccgagggagccgctcttgaagctgattggaatgctaagttttcagcttatgagaagaagtatccagaggaagcagaagagttgaaatctatcatctcaggtgacttgcctgccggttgggagaaggcacttcctacatatacaccagagtcaccaggtgacgccaccagaaacctctctcagcaatgtctcaacgctctcgccaaatccctccccggtttcctcggcggtagcgccgacctcgcatcttccaacatgacactcctcaaagccttcggagacttccaaaacgctacacccgaaggaagaaacctcaggttcggtgtcagggaacacggcatgggagctatctgcaacggcgtcgccctccacagccctggcttcatcccttactgcgcgacgttctttgtgttcaccgactacatgagagccgcgatgagaatcgcagctctctctgaagccggtgttatctacgttatgacgcatgactccatcggtctaggagaagatggaccgactcaccagcctgttgaacacttgtccagcttccgcgccatgccgaatatcatgatgttccgtcccgctgacgggaacgaaacagccggtgcgtacaaaatcgctgtcgctagacggaacacgccttctgttttggccttgtctagacaaaagctgcctcagcttcggggaacgtctattgagaacgttgagagagggggatacattattactgataactctaacggtaacaaaccggatgtgatcttggttggaactggctcggagctggagattgctgctaaagctggagaggagttgaggaaagaagggaagagtgtgagagtcgtttcgtttgtgtgttgggaactgtttgatgagcaaacggatgcgtacaaggaaagtgtgttgccatcggaggggtcggctagagttagtatcgaagctggatcgacgtttggatgggggaaggttgttggagggaaagggaaatcgattggaattgattcgtttggggcaagtgcaccggcggggaagctttataaagagtttggtatcaccgttgaagctgtggttgcagcagctaagtcacttatctaaagaagtataagggtttggttttgaagtaaagagaggttcttccatataagcattgtcttctttgtccaagtagaaaaatgtaagacagaaaataaaaatttgtttcttgcaagtgacgtttgtaactgtaagtctgaaaccatgaacacaatacttatacccaatgttggaggcgctttatattggattattgattaggcggtcgagcttttaaaaaatggttatagaaaaatggttttg

SEQ ID NO: 9210 - DNA, 2415 bp, Panax ginseng
agcattctgatcgtctcgccctccctgggatcaatctcagctccatttccgcaaccagaaccctctcacacgcctcacgcgccgtcgtacagtctcggggagtgggattacgcgcatccgtgagagcgtcggcggagactctagagaagacagataccgcattagtggagaaatcggtcaacacgatccggttcctagctatcgatgcggttgagaaggcaaattctggtcacccgggtctgcccatggggtgtgctccgatgggtcacgtgttgtacgatgagtttatgaggtataacccgaaaatccatattggttcaaccgtgatcggtttgtgctctcggctggacatgggtgtatgttacagtatgcactacttcacctagctggctacgacagtgtcaaggaagaagacttgaaaagtttccggcagtgggaagcaaaacacctggtcaccctgaaaactttgagacacctggcattgaagtcaccactggtccccttggacagggtgttgctaatgcggttggttggccttgctgagaagcatttagctgctcgatataacaaacctggcaatgagattgttgatcactacacgtatgtgatacttggggatggatgtcaaatggaaggaatttcaaatgaagcttgctcccttgctagtcactggggacttggaaagctgattgcattctatgatgacaaccacatttcaatcgatggtaacactggtattgcattcacagagagtgttgataagcgctttgaaggactcggttggcatgttatatgggtgaagaatggtaacactggatatgatgagatccgtgctgccattgaggaagctaaggcagttaaagataaacctactttaatcaaggtcacaactccattggtttgggtcacctaacaaggcaactcatatagtgtacatggtagtgcattgggtgccaaagaagtggatgccacaaggaagaaccttggatggtcacatgagccattccatgtgccagaggatgttagaaaccttggatttgacaggcactggagccaccacaccactaaaggagctgctttggaagctgaatggaatgccaagtttgcagagtatgagaagaactacaagggtgaagcaaaagaattgaaatctcttattactggtgaacttcctactggttgggaaaaagcgcttccgacgtatactcctgaaagtccagcagatgccactcgtaatctgtctcagacaaatctcaatgcccttgcaaaagttcttcctggacttcttggaggaagtgcagaccttgcttcttccaatatgacactgctcaaaatgtttggtgactaccaaaaggacacccctgaggaacgtaatgtacgatttggggttagggaacatggaatgggtgccatttgtaacgggattgctctccacagccccggccttattccctactgtgctaccttctttgttttcacagactacatgcgagcagccatgaggctttctgcattgtgtgaagctggagtcatttacgtgatgactcatgattccatcgggcttggagaggatgggccgactcatcaacctattgagcatttggcaagcttccgagccatgccaaacatcctaatgctccgaccagctgatggaaacgagactgctggtgcatacaaggttgcagttctcaacagaaagagaccctccgttcttgccctctctcgtcaaaagcttcctaatcttacgggaacatcaattgaaggagttgagaaaggtgggtatattatttctgataactcctcaggtaaaaagccagagataattttgataggaactggttccgaattggaaattgctgcaaaagcagctgatgagctcaggaagggtggaaagactgtacgagttgtgtcctttgtttcttgggagttgttcgatgaacaatctgatgcatataaggaaagtgtactgccagctggtgtatcggctagggtcagtattgaggctggatcaacatttgggtgggacaagatcgtgggatccgagggtaaggcgattgggatagatcattttggagcaagtgcaccggcagataagatatataaagaatttggattaactgtagaagctgtgataacagcagccaaagcagtgtgctaaaccttcacactgatacttttatgtgtcaaaagtgggaaaatgtgttgctttctctctgaaaatatgaagtttttcagtgtagaagtttgttgtagtgtattgggtagtaaaagtcattttgattctgttaagaaaaaaaataaagggaacttcaaatcctcctcaaaattcttgatggagtttctgcgtcagttcaagatggatggtctcttgggttcttgacttgtgcttaaagcttcatcctgatgtaattttga

SEQ ID NO: 9211 - DNA, 3794 bp, Sorghum bicolor
cttgattttaagttgtttacatgcacactgttcttgatccttatgaaggactccttgaccatccgagcaatgatccttcgctgcagatcgtggtaagtttttccaggtgataaatagctaagatagtgaaaaatagagagagagagagagagaaaacaaaattatataagcatatccacgaagccacgcccaactgttatatgaacactgaactaaagcaattacagtcagagtcggctcgcatggatgaggccatgacaccatcacaatttcctataaagaaacataatcctagcactgcacattcagaaaatcaaaactgaaattttaaattttaaatgtgcacatccttctaaaacttattccttaataatatgacacgccagcacattcagaagatcttgcatttctctatagctattttcatattccaatcacattctttgcggcccttctcatgaataatagtgcaagagcctttcttttggtacgaatagtctaaattttagtagatgtacataaaggtagttggtttgagctttggatcaacttcttcattgtgctaatctgcaagtacattgggaatcagacattgtgctctgtagctggacggtgcacaacaggtttgtaaacttggtgcgcaacaggatgagatggaaaccttcaccaccctaagtgtcaacaagacgaaggacgctaacacatcataagatattttttaggtgcagaagaagagacaaatggagagagcagccatggtccgcgccgccgggagctccgccgtggaacgccgtaggcccgtagctgctgttgccaacgagtccatacataacccctcccctcccctcccctcgtcgccccgaaccgcagcctcgacatctccgcctccgcctccgcctccgcctccgcctcagacgcacacgcacgcacgcacacgcccataccatggccgcgcactccgtcgccgccgcgcacgccaccatatccgcgcgcgcggtcgccgcgcacggcgccggagtgtcggccccgggcgagcgcctcggcttcctccgcctgagctcaccggtcgccggccgcggccagctgcgctccccgctcccggcccgccgccagcgcgtcgtgcgcgccgccgccgccgccgagacggtcgaggggaacaaggccgccaccggcgagctgctggagaagtcggtcaacacgatccggttcctggccatcgacgccgtcgagaaggccaactccgggcacccgggcctccccatgggctgcgcgcccgtgggccacgtcctctacgacgaggtcatgcgctacaaccccaagaacccttactggttcaaccgcgaccgcttcgtcctctctgccggccacggctgcatgctccagtacgccctgctccacttagccggctacgacagcgtcaaggaggaggacttgaagcagttcaggcaatggggaagcagcacacctggccaccctgagaactttgagactccaggagttgaagttaccactggacctcttggtcagggtgtcgccaatgctgttgggttggcacttgctgagaagcacctggctgcccgcttcaacaagcctgacagtgagattgtcgaccactacacgtacgttattttgggagatggttgccaaatggagggtgttgccaatgaagcttgctccttggctgggcactggggtcttggcaagctgattgctttctacgatgacaaccacatttccattgatggagatacagagattgcattcacagaggacgtgagcacccgctttgaggctcttgggtggcacacaatctgggttaagagtgggaacactggctatgatgacatccgtgcagctattaaggaagcaaaggcggttaccgacaagcccaccttaatcaaggtgacaaccacaatcggttttggatcacccaataaggccaactcatacagtgtgcatggaagtgcattgggtgccaaagaggtcgaagcaaccaggcagaaccttggatggccctatgagccattctttgtaccagaggatgtcaagagccattggagccgccacacgccacaaggtgctgcacttgaggctgattggaatgccaaatttgcagagtacgagaagaagtatgcagaggatgcagcaactttgaaaagtctcatcacaggggagttccccactggctgggctgatgctcttccgaaatacactccagagagcccagccgatgccaccaggaacctctcccagcagtgcttgaatgcacttgctaatgttgtgcctggtcttattggaggtagtgctgatcttgcgtcctccaacatgaccctgcttaagatgtttggtgacttccagaaggatacgcctgaagagcgcaatgtccgttttggagtcagagagcacggaatgggcgccattgcgaatggcattgctctgcacagcccagggtttgttccatactgtgctactttctttgtcttcactgattacatgagaggtgccatgagaatctcagctttgtctgaagccggagttatctatgttatgacccacgactctattggtctcggagaggatggcccgacccatcagcccattgagcacttggtgagtttccgcgcaatgccgaacatattgatgcttcgccctgctgatggtaatgagactgctggagcatacaaagttgcagttctcaacaggaagaggccatctattcttgctctctcaaggcaaaagcttcctcatctgcctggcacctcaattgagggtgttgagaagggtggatataccatctctgacaattcaacaggcaacaagcctgatctcatcgtgttgagtaccggctctgaactagagattgctgccaaggctgctgatgagttgaggaaggaggggaagactatccgtgttgtatcatttgtttcctgggaactttttgaggaacagtcagacgaatacaaggagagtgttcttcctgaggccgttactgcaagaatcagcattgaggctggttctactctcggatggcaaaagtacattggagcccagggcaaggccattggcatcgacaaattcggtgcaagtgctcctgctggaaagatctacaaggagtatggcatcactgtggagggtgttattgcggcagccaaaagcttctaagactcataactgagttttgttgtcaccgatgccaaaggaatgtcatacctggaggtcttgtgcccaaaacatgcaataattgagggagcataagatgcctgtgcttggagggtgagtgatactttaggactggaataaacaatgtattttccttgtacattggtttttattcagtgactccttagacgattcatgaagttgagtttgattaaattgggtgctgggttttttggtaacactggcaatcaacttatagtcttgctcttgcaacaatgtttcattcttttctttgcgagatcctgggtttaaatcatgctgtgcctagttggattttttgtcttctatacagtttgtagtgcttttatgattgcaatataagcagagcatctattcaacttcatgtggtctatcttttttctgttttttttcttgaattcaaaccaatcatggttagaagtagaacatcggcaacctttatccacttcaaatgccttgatgtgctgaacattctgttgctgcacttgcaatagcatatgaatctgaatgtaccattgtcaagaaagaagtgaacaaaataccagcgctgttgcttcaggaaggctgtctgtctctgagtgcagttgaagctccga

SEQ ID NO: 9212 - DNA, 2286 bp, Trifolium pratense
aacaacccttgttgagaaatcagtcaacacgatccgttttctagcgattgattcagttgaaaaagctaattcgggtcatccgggtttacctatgggttgtgctccaatgggtcatgttctttatgatgaagttatgagatataatcctaaaaaccctttttggtttaatcgtgatcgctttgttttgtctgctggtcatggttgcatgcttcagtatgctttgcttcatcttgctggttatgatagtgttaaggaacaagatttgaaggaatttcgtcaatggggaagtagaactcctggacaccccgagaatttcgagactcctggaattgaagttacaacaggtcctcttggtcagggtattgccaatgctgttggtttagcccttgcagagaagcacttggctgcaagatttaacaagcccgacaatgagatcattgatcattacacgtattgtatattgggcgatggttgtcaaatggagggaattgcaaatgaagctgcctcacttgcaggacactggggactagggaagctaattgcgttttatgatgacaaccacatttctattgatggtgacacggaaattgcgttcactgagagtgttgaaaaacgttttgagggactcgggtggcatgttatttgggtacagaatggaaacactggctttgatgagattcgtgctgccattaaggaagcaaaagctgtcaaagacagacctacattgatcaagttcacaacaaccataggttatggttctccaaataaatcaaactcctacagtgtgcatggaagtgcacttggtgccaaagaagttgatgccacaagaaacaatcttggatggccatatgagcctttccacgtgcccgaggatgttaaaaagcattggagtcgccacattcccgagggtgctgcacttgaatctgagtggaatgctaagtttgctgcatacgaaaagaagtacatggaggaagctgcagtattgaaatctattatcagtggtgaattaccctctggctgggagaaagcacttccgacttacactccagagatcccagctgatgccacgagaaatctgtcccagacaaaccttaatgcccttgcgaaggttcttcccggtcttctcggtggcagtgcagatcttgcttcttccaatatgaccttgctgaaagcgtttggaaacttccaaagtggaactccagaagagcgtaatgttagattcggtgttagagaacatggaatgggagcaatctgcaacggcattgctcttcacagcccaggactgattccatattgtgcaaccttctttgttttcaccgactacatgcgcggtgccataaggctttctgccctatccgaagctggtgttatatatgtcatgactcacgattcaataggactcggagaggatgggccaacccaccagcctatagagcacctggcaagcttccgggcaatgccaaatatcttgatgctccgtcccgccgacggtaacgaaactgctggagcatacaaagttgccgtgctcaacagaaagagaccctctatcctcgccctttctagacaaaaattgccaaaccttcccggaacttctattgaaggagttggaaagggtggatatatcgtctctgacaactcaaccggaaacaaacctgatgtcattttgatcggaaccggttctgaattggaaattgcttactatgctgccgaagatctaagaaaagaaggaaaggctgttagagttgtttcctttgtttcttgggaacttttcgatgaacaatcagacgcttacaaggagagtgttctccctggtgctgtttcggctagagtcagcattgaggccggatcaacattcggatgggagaaaattgttggaagcaaaggtaaagcaatcggaatcgaccgtttcggagctagtgctcctgcaggaagaatatacaaagagtttggcatcactaaagaagctgttattgctgcagcaaaagagcttatttagaactattagtttctgtttatttaagaattttctctctttcttttcttcttgttttagtttcgatatatccacacaaagaaggatgttttagtagcattgtgttgttgcttgaataagaaaaaggttagaagattattgttgcttgggattgtgagtgaagttaagcaacacagatcaaagagtacactaataaatttttatgaacttgtaaacttttcaaccaattgaattttgtattgccacattgttaaattcaattattttcatgagttttcatctatataaatgaa

SEQ ID NO: 9213 - DNA, 2390 bp, Amborella trichopoda
atgaaagcagtattgcagaccaccatctctaatagccgggggaggaggccatggtcctcgcgggtggtggtgagagcggctgcggttgagacgctggacgtgacgagcacgatcgcattgatagagaagtcgatcaacaccatcagattcctcgcgatagatgcggtggagaaggcgaactccgggcaccctggtctccccatggggtgtgcccccatgggccacatcctctacgacgaggtgatgcgctacaacccgaagaacccctactggttcaaccgtgaccggttcgtgctctcggcaggccatggatgcatgctccagtatgctctcctccaccttgctggctatgacagcgtcaaggaagaagatttgaaatcttttaggcagtggggtagcaaaacccctgggcatcctgagaactttgagacccgtggtattgaagtcacaactggtcctttgggccaaggaattgcaaatgctgtcggtttggctcttgctgagaaacacttagctgccagatacaacaagcctggttttgaggttgtcgatcactacacgtactgcattctcggggatggatgtcaaatggagggtatctctaatgaggcttgctccctagctgggcactggggtctcggtaagctcattgctttttatgatgataaccacatctcaattgatggtgatactgaaattgccttcactgagagtgttgatacccgttttgagggccttggttggcacgttatctgggttaagaatggtaacactggctacgatgagatccgtgctgccattgaagaggctaaggctgtcaaagacaagcccactctcatcaaggtgaccaccaccatcggctatgggtccccgaacaaggccaattcatacagtgttcatggaagcgccttgggagccaaggaggtggatgccacccgacagaaccttggatggccatatgagcccttccatgtcccggatgatgtcaagagtcattggagccggcatgttcccgaaggtgcttccctggaagcagaatggcaagccaaattggccgattatgaaaagaagtacaaggaggaagctgcagaattcaaggaactcatctctggtaaatggcctgatgggtgggagaaggctcttccggcgtacacccctgagagccctgctgatgccaccagaaacctatcccaacaatgcctcaatgcgctcgcaaaggttctcccaggactccttggtggcagtgcggatcttgcctcttcaaacatgacattgttgaagatgtttggggacttccaaaaagacacccctgagcagcggaatgtgcggttcggtgtgagggagcatgccatgggttccatttgcaatgggatcgcccttcacggcagtggcctcatcccttactgtgctaccttctttgttttcacagattacatgagggctgccatgaggatatctgctctgtgtgaagccggtgtcatttacgtgatgacccacgattccattgggctcggagaggatggccccacccatcagcccattgagcatcttgcaagcttcagggccatgcccaacatcctgatgctccgcccgggcgacggcaacgagactgccggtgcttacaaggtcgcgatcctcaacaggaagagaccctcagtgctcgctctctctcgccaaaagctccctcagctggcaggcacaacaatagagggagttgagaagggagggtacatagtcagcgacaactcaatgagaaacaagcccgacctcatccttatcggcactggttccgagctggagatcgctgtaaaggcagcaaatgtgatcaggaaggaagggaaggcagttagggtcgtgtccttagtgtcatgggaactgtttgatgagcagtccgacgagtacaaggagagtgtcctccctgctggggtgtcagcgagagtcagtgtggaggcagggtcaacatttgggtgggagaagattgtggggagcaaggggaagagtatcgggattgaccgatttggtgccagtgctcctgccggaaccctgtacaaggagttcggcattaccgtggacaatgtcattgcagctgccaaaacacttttgtaatctctccatttctatccctcgaagcttatgctgctatcatcgagtatgcattatccacagactattttggttacatatgtggagagacagacgatgccaccaagagatttgaggcagacatctccaagtgtgataagaaacattctttccttctttttgctcttttgtggtgtggactctatatcagctctcattataaagcttgtggttctgggtattttctgttaaacctctttttccttcaaagtaatccatgatcgaaatgcgggtctgctcttttctaa

SEQ ID NO: 9214 - DNA, 2551 bp, Flaveria ramosissima
caataccaacaacactcactcccccgttctctctcgtccacaccaacacccatggcgtacctccgcctctctcaccctctctcagcccaccatctctcagcccaccatctctcgctccgccgtcccccgccatggttccaccaccgccactgccacccagcaatcgacttccctctcaatacccactttctccggcctcaaatccgtcgctacatcctcctcacgcgccacaacgcgccggcaggtgattcccacgcgccgccgtgtgatctccaacgcggcggtggagactctcgacaagacggacactgctttggtggagaagtcgatcaacaccatcagattcttggcgattgatgctgtggagaaggcgaattcgggtcatccgggtttgcccatgggttgtgcgcccatgggtcacatattgtacgatgaggtcatgaggtataaccccaagaacccttattggttcaatagggatcgctttgttctctccgccggacatggttgcatgctccagtatgctctgcttcaccttgctggctacgattctgtcaaagaagaggacttgaagcaattccgtcaatggggaagcaaaactcctggtcatcccgagaacttcgaaactcctggtgttgaagttaccactggtcctcttggccaaggtattgccaatgctgtcggtcttgctcttgctgagaagcatttggctgctcgttacaacaagcctgatgctgagattgttgaccactacacttattgtattcttggagatggttgtcaaatggaagggattgcaaatgaagcgtgttcgcttgcaggccattggggacttggaaagttgattgcgctttatgatgacaaccacatttccattgacggtgacaccgagattgcattcactgagaatgttgatcaacgttttgaagctcttgggtggcacataatttgggtgaagaatggaaacactggttatgatgaaatccgtgctgccattaaagaagctaaagctgtgactgataaaccaactttgatcaaggtgacaacaacaatcggctttgggtcaccaaataaggcgaactcatacagcgtccatggagcagctttgggtgcaaaagaagtagatgcaaccagacaaaaccttggatggccttatgagccattccatgtaccagatgaagtgaagaagcactggagtcgccacaccccagatggtgccgctcttgaagctgaatggaatgctaaatttgcagagtatgagaagaaataccctgaagatgctgctgaattgaagtctattgctactggtgtattgcctgccggatgggagaaggctcttccgacctacacaccagaaacacccggtgatgccacaagaaacctctcacaaacaatgcttaatgcattagcaccggttctccctggtcttgttggtggaagtgcagatcttgcatcttcaaacatgactttaatgaaaatgtttggtgatttccaaaagaacacacctgaagaacgcaatgttcgattcggtgttcgggaacatggtatgggagccatttgtaacgggatcgccctccacagccctgggttcgtcccttactgtgctacattcttcgttttcactgattacatgagaggtgccatgagaatttcagcattatcagaagctggagttatttatgtcatgacccatgactccattggtcttggagaagacgggccgacccatcagcccgttgaacatttagccagtttccgtgccatgcccaacatgttaatgttccgcccagcagatggaaatgaaacagctggagcttataaggttgcagtcgaaagcagaaaaagaccctcaattcttgctctttcaaggcaaaaactgcccaacctgcccggaacttcaattgaaggaaccgggaaaggtggttacacaataactgataactcaacagggaacaaacccgatgttatcttgatggcgacaggttctgagctggaaattgcagttaaagctgctgatgaactcagaaaagaagggaaaacagttcgcgttgtgtctttcgtgtcatgggaactttttgatgaacaatctgatgaatacaaagaaagtgttcttccatctggtgtaactgctcgtgtcagcattgaggctgcatcaactttcggttggggaaaacatgttggaagcaaagggaaggcgatcggcattgacaaatttggcgccagtgcgccagctggaaagatctacaaggaatatgggataactgttgaagctgtggttgccgcggctaaagaagtttgttaggttggttcttaactgacatcaacttccgagctttggtggcttttacacaaaagacgattgatgttagttttcggtatcttgatctataatgctcagatgaataataagaggtcggcttttagtctttgatgcgtttcatcgtacaccttacatgcaaattgaacgaagatcagaagagtggattagaagtagcgtgattgatgctctcgtgaatttgtaccaaaattgaaacatatctttttctaaatt

SEQ ID NO: 9215 - DNA, 2150 bp, Panicum virgatum
caccggcgagctagcagagtccaagttctctcacctcacctacccggagtccctgctgcgaaaccatggcgagtcctctcctgctgctcgtcttcctgtttctcacccacgcctcggcggcagagtacggggaggagctgctgcggcgcgcgtggggggagcgggagtggatggtgagcgcgcggcgccgcatccacgcgcacccggagctcgcgttccgggagcaccgcaccagcgccctcgtccgcgaggagctcgagcgcctcggaatccgcaaccgcgccgtcgcggggacgggcgtggtcgctgatgttggctcgggcgcgccccccttcgtcgcgctccgcgccgacatggacgcgctcccgctccaggaattagtggagtgggagcacaagagcaaagtggacggggtgatgcacgcctgcgggcatgatgtgcacaccgcgatgctcctgggggcagcaaagttgctcagtcagcgtaaggatcagctcaagggaacagtgagactcctttttcagcctgctgaagaaggtggtgctggtgcatctcatatgataaaagaaggcgctcttgatggcgtcggagccatttttgccatgcatgtcgattatcggataccaactggagtaatagcagctcatccaggacctacgcaagccgctgtgtgtttctttgaagccaaaatagaaggtaaaactgggttggctgaaaccccacacttaaatgtggaccctatcgttgctgcatcattcaccatcctgtccctacagcagctcatttccagagaagatgatcctcttcacagccaagtggtctcggttacttatgtcaaagctggaaatgcccttgatgctacccctgcaattgttaattttggaggtactttgaggagcatcactactgaaggcctttaccgtctgcagaaaagggttaaagaggtggtagaagggcaggctgcggtgcatagatgcaagggcgctgtcgagataaagagtgaggactacccgatgtaccctgctgttgtgaacgacgaggagctgcatcgccacgtagaggatgtcggcaggcgcctgcttggcccggacaaggtgaagcccggagagaagatcatggcgggcgaagacttcgctttctaccagcagctagctcctggtgttatgtttggcatcggaattagaaacgaggaagctggctccatccacccagctcacaactctcatttcttcgttgatgaggatgtcattccaattggggcagctctgcatactgccatagcggaactgtatctctctgaggcatctactctgaacggaggggacttgcagtcgcattgatgatatctagtcgaacagatgggttgaaaatatacaagtacccaaagatagcattgaccacacctggtgcattttctctgcagttggattcaaacaacgtttgcccccatacgcttctgccgaagaatcgtgcaacaatgtgattcagatttcagactgtaaccggccgtcaccactttctgcaggtagtagaagggcaggccgccgtgcatagatgccagggagctgtgaagatggaggttgacggctacccgatgtaccctgctgtcgtgaacgacgagaagctgcatcgccacgtggaggacgtcggcaggcgcctgctcggcccggacagggtgaggccgggtgagaggatcatggcgggcgaagacttcgcgttctaccagcagctggctcccggggtgctgttcggcatcggcatctggagcgaggaagctggctccgtccacccacttcacaacccgcatttcttcgtggacgaggatgtcgtgcccgtcggggctgcgttgcatactgcgcttgcagaacagtacctcgccgagggctccgctgtcaaccaaggagacctgcatccgcgtggctgatcctgagttgagtaaattgaaccgtcgaacatgttattcagaaaactgaaacagagttgagttggggttcagttcagggttcatcgcccgaccccgtgccattgaatttgatcttcctgcgattcttttgtactcgtgccattatgttcctagtgatttcttcacaatccaacttactcttagttcaaaattatataaaattagagctcaatttttagattatcta

SEQ ID NO: 9216 - DNA, 1618 bp, Sorghum bicolor
agacgtttcgttcatcatcttctgatttctgaattctgaattcgagtggatatctgattcgaggtttggcaaatgctccactggtgcaatatattttcactagcatcccttggatgacggatgatatgtatacgtcagcgtccgtttcctcgaggcccgggcagtcgagcttttgacaaagtcaaagctcccacctaccgcgagacctcggccgcgaccatggcgatccctctcctcttgctcctcctcgttctctcctcagcttctgcggatgagtatggggacgagctgctgcagcgcgcgtggggggagcgggagtggatggtgagtgtgcggcggcgcatccacgcgcaccccgagctcgcgttccgggagcaccgcaccgcagccctcgtccgcgaggagctcgagcgcctcggcctctccacccgcgccgtcgccggaacgggcgtcgtcgctgatgtaggctccggggcgctccccttcgtggcgctccgcgccgacatggacgcgctcccgctccaggaattagtggagtgggagcataagagcaaggtggacggagtgatgcacgcctgcgggcatgatgtccacacagcgatgcttctgggggcagcaaagttactcagtcagcgtaaggatcagctcaagggaacagtgagactcctttttcaacctgccgaggaaggtggtgcaggtgcatctcatatgataagagaaggggttctggatggtgttaaagccatatttgcaatgcatgttgactaccagataccaactggtgtaatagcagctcacccaggaccaacacaagccgctgtatgtttctttgcagcaaaaatagaaggtaacactgggccgtctgaaaccccacacttaaatgtggatcctattgtcgctgcatctttggccatcctgtccctgcagcagcttatttccagagaagatgatcctcttcacagccaagtggtctcggttacctatgtgaaagctggaaaagcccttgatgctacccctgatgttgttgaatttggaggtactttgaggagcctcaccactgaaggcctttaccgtctgcagagaagggttaaagaggtagtagaaggccaggctgcagtacatagatgcaagggagctgtcgacatgaaggctgaggactacccaatgtaccctgctgttgtgaacgacgagaggctgcatcggcacgtagaggatgtcggcagaggcttgcttggcccgggcaacgtgagaccaggggaaaagatcatggccggcgaagacttcgctttctaccagcagctggttcccggtgttatgtttggcatcggcattagaaacgagaaagctggttctgtttactcggttcacaacccctatttcttcgttgatgaggacgtcattcctgttggtgctgctttgcatgctgcgattgcagaactgtacttcactgagggctcctctctcaacaaagactcgtagcttctcactcgtgcggttgatcttgggttgaacaaatataattgacatgtacagatgcattgtaaaagtgttttttttttggcaaaattgtgactcacaaaacaatgcgacgtcattttgaagcagagctctactgtac

SEQ ID NO: 9217 - DNA, 1488 bp, Oryza sativa
gcttccaattccaactaccaccgcttcaccatggccgctcctctcttcctcctcctcctcctcctcctcgtctcctccgcctccgcgggttacgaggaggaggcgctgctgcggcgcgcggaggaggagcgggactggatggtgggcgtgcggcgccgcatccacgcccatccggagctcgcgttccgggagcaccacaccagcgccctcgtccgcgacgagctggagcggctcggcctcaccgcccgcgcggtcgccggcaccggcgtcgtcgccgacgtcggctccggcctcccccccgtcgtcgccctccgcgccgacatggacgccctccccgtccaggaattagtggagtgggaacacaagagcaaagtggatggtgtgatgcatgcctgcggtcatgatgtgcacaccgcgatgctcctgggagctgcaaagttgcttagtgagcgcaaggagcagatcaagggcacagtgagacttcttttccaacctgccgaggaaggtggtgcgggtgcatcttacatgataaaagatggtgttcttgatggcgttgaagctatattcgggatgcatgttgactatcggatgccaacaggtgtaatagcagctcatgcagggcctacacaagctgctgtatgtttttatgaagcaaaaatagaaggtaaaactggaaaggctgaaactccacacttaaatgtggatcctattgttgctgcatcatttgtcatcctatccctgcagcagctcatttcaagagaagatgatcctcttcacagccaggtgctctcagttacctatgtcaagggtgggaacactattgatgccacacctccagttattgaattcggaggtactttgaggagcctcactactgaaggtctatatcgtctacagaaaagggtcaaggaggtggtagaagggcaggcagctgtgcacagatgcaagggagttgtccagataaaaagggacgactacccaatgtatccagctgtctttaatgatgagaaactgcatcaccatgtagaaactgtgggcagacgattacttggtccagacaaggtgaagccgggagagaagattatggctggcgaagacttcgctttctaccaacagttagttcctggagttatgtttggcattggtattagaaacggggaagttggttcagttcacactgttcataaccctaagttcttcgttgatgaggatgttatcccaattggagctgcactgcatactgcccttgcagaaatgtaccttactgagcgctccacagaaggtgaagacggaagccagcattcgcattgacattcgtgcgttgaacagttcgagtgtacaagtatccaagagaataatcatgcttcaagaatccagatgatcattttagtagcgtgcaaggcgttcttgtactcaggtatgctcgagtaatgacaagaaatatatacactgtattactcaatgatcactgtacaacatccaacatac

SEQ ID NO: 9218 - DNA, 1590 bp, Oryza sativa
caatctacactgcgcaaccggcaaccaaaccccaagtcaggcttccaattccaactaccaccgcttcaccatggccgctcctctcttcctcctcctcctcctcctcctcgtctcctccgcctccgcgggttacgaggaggaggcgctgctgcggcgcgcggaggaggagcgggactggatggtgggcgtgcggcgccgcatccacgcccatccggagctcgcgttccgggagcaccacaccagcgccctcgtccgcgacgagctggagcggctcggcctcaccgcccgcgcggtcgccggcaccggcgtcgtcgccgacgtcggctccggcctcccccccgtcgtcgccctccgcgccgacatggacgccctccccgtccaggaattagtggagtgggaacacaagagcaaagtggatggtgtgatgcatgcctgcggtcatgatgtgcacaccgcgatgctcctgggagctgcaaagttgcttagtgagcgcaaggagcagatcaagggcacagtgagacttcttttccaacctgccgaggaaggtggtgcgggtgcatcttacatgataaaagatggtgttcttgatggcgttgaagctatattcgggatgcatgttgactatcggatgccaacaggtgtaatagcagctcatgcagggcctacacaagctgctgtatgtttttatgaagcaaaaatagaaggtaaaactggaaaggctgaaactccacacttaaatgtggatcctattgttgctgcatcatttgtcatcctatccctgcagcagctcatttcaagagaagatgatcctcttcacagccaggtgctctcagttacctatgtcaagggtgggaacactattgatgccacacctccagttattgaattcggaggtactttgaggagcctcactactgaaggtctatatcgtctacagaaaagggtcaaggaggtggtagaagggcaggcagctgtgcacagatgcaagggagttgtccagataaaaagggacgactacccaatgtatccagctgtctttaatgatgagaaactgcatcaccatgtagaaactgtgggcagacgattacttggtccagacaaggtgaagccgggagagaagattatggctggcgaagacttcgctttctaccaacagttagttcctggagttatgtttggcattggtattagaaacggggaagttggttcagttcacactgttcataaccctaagttcttcgttgatgaggatgttatcccaattggagctgcactgcatactgcccttgcagaaatgtaccttactgagcgctccacagaaggtgaagacggaagccagcattcgcattgacattcgtgcgttgaacagttcgagtgtacaagtatccaagagaataatcatgcttcaagaatccagatgatcattttagtagcgtgcaaggcgttcttgtactcaggtatgctcgagtaatgacaagaaatatatacactgtattactcaatgatcactgtacaacatccaacatacaaaaaccgaactggaactgacaatctcaacagaggcatcaatacatacacaaattacgactg

SEQ ID NO: 9219 - DNA, 1437 bp, Secale cereale
ctcactttgctcttgactcttgaacatggccactcctcgtctcccctgcctcttccttctccttctccttctctccaccgcgtcggcggagtacgcgcaggagctacttcggcgcgccgagggcgagcgagagtggattatcggcgtgcgccggcgcatccacgcccatccggagcttgcgttccaggagcaccgcaccagcgccctcgtccgcgaggagctcgagcggctaggggttaccgcccgcgccgttgccggcaccggcgtcgtcgctgatgtcggctcgggcatgcccccgatcgtcgccctccgcgctgacatggacgccctacccatccaggaattggtggagtgggagcacaagagcagagttgatggcgtaatgcacgcctgtggtcatgatgtgcacacagcgatgctcctgggagcggcaaagttgcttcatgagcgcaaggatcagcttaaaggaacggtgagactcctttttcaacctgccgaggagggtggtgctggtgcatctcatatgataaaagaaggtgttcttgatggtgttgaagctatattcgccatgcatgtcgattatcggatgccaacaggcgtaatagctgctcacgcaggaccaacacaagcagctgtatgtttctttgtagtgaaaatagaaggtaaaaccgggaaggctgaaaccccacacttaaatgtggatcctattgttgctgcagcatttaccatcctgtccctgcaacaactcatttcaagagaaggcgatcctcttcacagccatgtgctctctgtgacctatattaaaggtgggaaatctattgatgccacacctccagttgttgagttcggaggtactttgaggagcctcactactgaaggactttatcgactacagaaaaggcttaaggaggtagtagaagggcaggcagctgtgcatagatgcacgggagttgcggagatattgggggctccctcccacccaatgtatcccgccgtcgtcaatgatgagagactccaccagcatgtggagaatgtgggcagaagtttgcttggtccagacaaggtgaagcccggagagaagatcatggcaggggaagactttgcattctaccaacagttagttcctggcgtcatgtttggtatcggtattggaaatgagaaagtcggctcggtccactctgctcacaacccgcatttcttcgtcgacgaggatgtccttccaattggagctgcattgcatactgccaccgcagaaatgtatctttctgtgcgttcctctcaaaatgaagatggaagcgtgcattcacggtaacgctctttggatggacgatttgaatgtataaatgtatgttaaagatgttccaagtataggtgtgtacttatgttcaactgttgatggctcaaatgtatatttgtcagaaagcagatttgttggag

SEQ ID NO: 9220 - DNA, 1667 bp, Zea mays
ggtgcacggtatgttatcattccgtgagctatgatgtacgtcagcgtccgtttcctcgaggctcgaccagtcgagcttgagaaaaatcaaagctcccacctacctcgagacccaggacgcgtggagagcggtgccaaaccaccatggcgatcctgctcctcttgctcttcgttttgtcctcagcttcagctgatgagtacggggaagagctgctgcagcgcgcgtggggggagcgggagtggatggtgagcgtgcggcggcgcatccacgcgcatccggagctcgcgttccgggagcaccgcaccgcagccctcgtccgcgaggagctcgagcacctcggccttcccgcccgcgccgtcgccggaacgggcgtcgtcgctgatgtaggttccggggcgccccccttcgtggcgctccgcgccgacatggacgcgctcccgctccaggaattagtggagtgggagcataagagcaaggtggacggagtgatgcacgcctgcgggcacgatgtccacacagcgatgcttctgggagcagcaaagttactcagccagcgtaaggatcagctcaagggaacagtgagactcctttttcaacctgccgaggaaagtggtgcaggtgcatctcatatgataagagaaggggttctggacggtgttgaagccatatttgcaatgcatgttgactatcgtataccaactggtgtaatagcagctcacccaggacctacacaagcggctgtatgtttcttcgaagcaaaaattgaaggtaaaactgggatggctgaaaccccacacttaaatgtggaccctgttgtcgtcacatcattggccatcctgtccctgcagcagcttatttccagagaagatgatcctcttcacagccaagtggtctcggttacctatgtgaaagctggaaaagcccttgatgctacccctaaccttgttgaatttggaggtactttgaggagcctcaccactgaaggcctttactgtctgcaaagaagggttaaagaggtggtagaagggcaggcggctgtgcataggtgcaagggagctgtcgaaataaaggttgaggactacccggtgtaccctgccgttgtgaacgacgagaagctgcatcgacatgtagaggatgtcggcagaggcttgcttggcccgggcaaggtgagaccaggggaaaagatcatggccggcgaagacttcgctttctaccagcagcttgttcccggcgttatgtttggcatcggcattagaaacgaggaagctggttctgttcactcggctcacaacccctatttcttcgtcgatgaggacgtcattcctgttggggctgctttgcatgctgccattgcagaactgtacttcactgacggccccctctttcgacaaagaagactagtggtttctcgttcgtgcgtattttgtctggatcagtccgaacagatggcttcagctggccaatcagatctgaacatctggtccaccatgctgatcagccgcgctccgcggccagtatcaacctccaactatttttccctctgtaaccagaaacactacacatgtttctcaaccctacagtggtctagctattttattctctctttaaacagaaacactgcaaggttcctaaccttatagtgggatttagagcaacttcaccggatc

SEQ ID NO: 9221 - DNA, 1367 bp, Leymus cinereus x Leymus triticoides
tccactcctcgcccctgcctgttcgtcctcctgctcctctccaccgcctcggcggagtacgcgcaggagctacttcggcgcgccgagggcgagcgagagtggattatcggcgtgcgccggcgcatccacgcccacccggagctcgcgttccatgagcaccgcaccagtgccctcgtccgcgaggagctcgagcggctaggggttacggcccgcgccgttgccggcaccggtgtcgtcgctgatgtcggctcgggcatgcccccgatcgtcgccctccgcgccgacatggacgccctacccatccaggaattggtggagtgggagcataagagcagagttgatggtgtaatgcacgcctgtggtcatgatgtgcacacagcgatgctactgggagcggcaaagttgcttcatgagcgcaaggatcagcttaagggaacggtgagactcctttttcaacctgctgaggagggtggtgctggtgcatctcatatgataaaagaaggtgttcttgatggtgttgaggctatatttgccatgcatatcgattatcggatgccgacaggggtaatagctgctcacgcaggaccaacacaagcagctgtatgtttatatgtagtgaaaatagaaggtaaaaccgggaaggcggaaaccccacacttaaatgtggatcctattgttgctgcagcatttaccatcctgtccctgcaacagctcacttcaagagaagacgatcctcttcacagccaagtgctctctgtcacctatatcgaaggtgggaaatctatggatgccacacctccagttgttgaatttggaggtactttgaggagcctcactactgaaggactttatcggctacagaaaaggcttaaggaggtagtagaagggcaggcagctgtacatagatgcatgggagttacggagatattgggggctccctcccacccaatgtatcctgccgtcgtcaatgatgagagactgcaccagcatgtagagaatgtgggcagaggtttgcttggcccagacaaggtgaagcccggagagaagatcatggcaggggaagactttgcattctaccaacagttagttcctggtgttatgtttggtatcggtattagaaatgagaaagtcggctcggtccactctgctcacaatccgcatttcttcgttgacgaggacgtccttccaattggagctgcattgcatactgccaccgcagaaatgtatctttctgggcgttccactcaaaatgaagagggaagcgtgcattcgcggtaacgctctttggatggacgatttgaatgtataaatgtatgttgaagatgttcagtctagttatgtacttgtattcaactgttgatggctca

SEQ ID NO: 9222 - DNA, 1735 bp, Triticum aestivum
agcttcccccaccttccacttgaccatggccactcctcgtctcccctgcctcttcgttctcctcctcctctccaccgtctcggcggagtacgcgcaggagctacttcggcgcgccgagggcgagcgagagtggattatcggcgtgcgccggcgcatccacgcccacccggagctcgctttccaggagcaccgcaccagcgccctcgtccgcgaggagctcgagcggctaggggttaccgcccgcgccgttgccggcaccggcgtcgtcgctgatgtcggcttgggcatgcccccaatcgtcgccctccgcgccgacatggacgcactacccatccaggaattggtggagtgggagcataagagcagagttgatggtgtaatgcacgcctgtggtcatgatgtgcacacagcgatgctactgggagcggcaaagttgcttcatgagcgcaaggatcagcttaagggaacggtgagactcctttttcaacctgctgaggagggtggtgctggtgcatctcatatgataaaagaaggtgttcttgatggtgttgaagctatatttgcaatgcatatcgattatcggatgccaacaggggtaatagctgctcacgcaggaccaacacaagcagctgtatgtttctatgtagtgaaaatagaaggtaaaaccgggaaggctgaaaccccacacttaaatgtggatcctatcgttgctgcagcatttaccgtcctgtccctgcaacagctcacttcaagagaagatgatcctcttcacagccaagtgctctctgtcacctatattaaaggtgggaactctgttgatgccacacctccagttgttgaatttggaggtactttgaggagcctcactactgaaggactttatcggctacagaaaaggcttaaggaggtagtagaagggcaggcagctgtacataggtgcacgggagttacggagatattgggggctccctcccacccaatgtatcctgccgtcgtcaatgatgagagactccacgagcatgtagagaatgtgggcagaagtttgcttggtccagacaaggtgaagcccggagagaagatcatggcaggggaagactttgcattctaccaacagttagttcctggcgttatgtttggtatcggcattagaaatgagaaagtcggttcggtccactctgctcacaacccgcatttcttcgtcgacgaggatgtccttccaattggagctgcattgcatactgccaccgcagaaatgtatctttctgggcgttctgcttaaagtgaagttggatccgtgcatttgcggtaatgctctttggatggacgatttgaatgtataaatgtactcccaacgttccgaattacttgtcgcacgtatggatgtatctagatgtattttagttctagatacatccatttcagcgacgagtaatttggaacggaggtagtatgtcaaagatgtccagtctagctatgtactcctttgttcacaaataagattttctagtaacttttttctgagttggatgtatatagacacgttttagtgtgtttggtcactcatttcagcctgtctgtagtccatattgaaatctcaaaaacatcttatgtttatgaacggagggagtacattgataaggggcaagaatgtgtttatagcttgtataaacatgatatacatctgttcgcagaaagcgaccaaggagtttttctgccaagcagggacctaacattt

SEQ ID NO: 9223 - DNA, 2750 bp, Panicum virgatum
ccaacctcgtctcccaggtaaggtagcgcatggccacccgtaaagattaggcctaataattggcagagagccgggccgggcaatccatcgccattgccgcccctcgcgcagtcgcatatcctccgtctcgccgactgggcctgcacaattcatcttcccgcacatatataaagcttctcaccctcctgagctcccacgccgagttctctcttccagagacggacagagagagaaagtgagttccagcgaagcagccagcagcccgccacgccttcctccttcctctcgcggattcagagctccagacctcctccgtgtccgtgggtgcgaagcggcgcaacggcggcggcggcgacagcgaaagcgtgatcgccttcccgggagcgggaagctcgagttgagcggcggcgcaacggccgccgatgggaccaatggagccgcgctaccgtcccgccggcgcccctgaggatacaactaagagaaggacctctaaaagcaaaagcttcaaagatgtcgaaaattttgaagttcttgtcattgaaaagaactgtggttgcaagttcaaatctttgaagatcatgatcatagctatcatttctgcaacagttcttacccttataaccccaaccttgtatgagcaccaattgcagtcagcctcccggtttgtggacgtcggttggatgtgggacaaaacaagttctgacccgcgatatgcttcatctgttgatgttcagtgggatgatgtacatagagcactcagaaatctaaaaagtggtaatcaagatctcaaagttggactcttgaattttaacagcaccgagtatggctcctggacacagttgttgccggacagccatgtttccataataagacttgagtatgccaaggacagcattacttggcagacactgtatcctgaatggatcgatgaggaggaagaaactgagataccctcttgtccatctctcccagagcccaatgttcgaaaaggtgtacgctttgatgtcattgcagtgaaacttccttgtacccgtgttgcgggttggtcaagagacgttgcacggctccatttgcagctctcagcagcaaaattggctgtggcctcttcgaagctcaatcacaaggtccatgtgctttttgtaagtgactgcttcccaattcctaatctcttcccgtgcaagaaccttgtgagacatgaaggcaatgcttggttatatagtcctgactcgaaagcattaagggaaaagctcaggcttccagtcggatcttgtgagcttgctgttcctctcaaagcaaaatcaagacttttctcagtagatcgacgaagagaagcatatgcaacaatactgcattcagcaagtgagtatgtctgcggtgctatctcagcagcacaaagcattcgccaatcaggatcaactagggatctggtcatccttgttgacgagaccataagtgatcaccaccggagaggattggagtctgcagggtggaaggtcagaataatccaaagaatcaggaatccgaaagctgtgcgtgatgcttacaacgagtggaactacagcaagttcaggttgtggcagctgactgactacgacaagatcatcttcatcgacgctgacctcctcatcctacggaatgttgacttcctgttcgcaatgccagagatcaccgcgactggcaacaatgcaacgctcttcaactccggtgtcatgatcatagagccttccaactgcacgttccagctgctgatggaccacatcaacgagatcacgtcgtacaatggcggcgaccaaggttacctgaacgagattttcacatggtggcaccgcatccccaagcacatgaacttcctgaagcacttctgggagggcgacagcgaggagatgaaggcgaagaagacacagctgttcggcgccgatcccccggtcctctatgttctccactacctgggcctgaagccgtggctgtgcttcagggactatgactgcaactggaacaaccccccgatgcgcgaattcgctagtgacgtcgcgcacgcccggtggtggaaggtgcacgacaggatgccccggaagctccagtcctactgcctcctgaggtcacggcagaaggccgggctggagtgggaccggaggcaggctgagaaggccaactctgaagatggccattggcgccgcaacatcactgaccccaggctgaagacctgctttgagaagttctgcttctgggagagcatgctctggcattggggcgagaacaataacaggacgaagggcagccccgcgacggtgacgacggcgagcttggcaagctcatgatctgtacatataaaaacaagcaacttcccataaggcaaccatacatgcatagcaatagtttgtataggtacctgtgcttcttaggtctttgctatacaaaatacacccctccctgttgctgtcatggctgcagctctatgtcagctgccggcctgcctcgatggctaacgattcttttgggttggctgagataataagttacttttacatgtaaatttccctgctgaaattctgtgagcgtgagtgagaaatgcatttgtacagggcgccagttataagcggttactgcatggaaaaatatggctagttgtatagtgtacaccgacagactttgtatattacaacgccttaccgacagtacagaaacagagcactgcaaggtaatactagacatgcaaagtttgccaattcaatcgaaagggggagcttttt

SEQ ID NO: 9224 - DNA, 2301 bp, Echinochloa colona
tcctctcaggactcaggagagggaagcgtgagcggcggcggcggcgcaacgagcaccgatgggcccaatggagccgcgctaccgtcccaccggcgtccccagtgaggacacaactaagagaagggcctcgaaaagcaaaagcttcaaagatgtcgagaattttgaagttcttgtccttgagaagaactgtggttgcaagttcaaatctttgaagatattgatcatagctatcatttctgcaacagttcttaccctcataaccccaaccttatatgagcaccaattgcagacagcctccaggtacgtggatgtcggttggatgtgggacaaaacaagttctgacccacgatatgtatcatctgtcgatgttcagtgggaggatgtatatagagcattgagaaatctaaaaagtggcaatcaaaatctgaaagttggactcttgaattttaatagcactgagtatggctcttggacacagttgctcccagacagccatgtttccattataagacttgagcatgccaaggatagcattacttggcagacactgtatcctgaatggatcgacgaggaggaagaaactgagataccctcttgtccatctcttccagagcctaatgttcgcagaggtatacgcttcgatgtcattgctgtgaagcttcttgtaccgtgtagcggttggtcaagagatgttgcacggctccatttgcagctctcagcagcaaaattggctgtggctgcttctaagcgcaaccacaatgtccatgtgctttttgtaagcgaatgcttcccaattccaaatctcttcccttgcaagaaccttgtgaggcatgaaggcaatgcttggttatatagtcctgactcgaaagcattaagggaaaagctcaggcttccagtcggatcctgcgagcttgctgttccgctcaaagcaaaatcaagacttttctcagtagatagacgaagggaagcatatgcaacaatacttcattcagcaagtgaatatgtctgtggtgctatcacagcagctcaaagcattcgccaagcaggatcaactagggatctggtcatccttgttgatgagaccataagtgatcatcaccggagaggcttggaagctgcagggtggaaggtcagaataatccaaagaatcaggaacccaaaagctacgcgtgatgcttacaatgagtggaactacagcaagttcaggctgtggcagctgaccgactacgacaagatcatcttcattgacgctgacctcctcatcctgaggaatgttgacttcctgttcacaatgccagagatctctgcaactggcaacaatgcaacgcttttcaactctggtgtgatggtcatagagccttccaactgcacgttccagctgctgatggaccacatcaacgagattacttcgtacaatggtggagaccaaggttacctgaatgagattttcacatggtggcaccgcatccccaagcacatgaacttcctgaagcacttctgggagggcgacagcgaggaaatgaaggcgaagaaaactcagctgttcggtgcagatccccccatcctttacattctccactacctgggcctgaagccatggctgtgcttcaaggactatgactgcaactggaacaacgccggaatgcgtgaatttgctagcgatgttgcccatgcccggtggtggaaggtgcatgacaagatgccccggaagctccagtcctactgccacctgaggacacggcagaaggccgggctggagtgggaccggaggcaggccgagaaggccaagtctgaagacggccattggcgccgcaacatcactgaccccaggctgaagacctgctctgagaagttctgcttctgggagagcatgctcttgcattggggcgagaacaataacaggacaaagagcagccctgcgacggtgaagacggcgagcttggcaagctcatgatctgtacatatacaaacaactttcaatatggcaaccatacatgcatagcgatagcttgtataggtagctatgcttaggtctttgctatacaaaatacacccctccctgttgctgtcatggctgcagctctatttcggctgccggcctgccttgatggctaacgattcttttgggttggcttttgctgagataataagttgctggtacttgtaaatttccctgcagaaattctgtgagcgtgtgtgagaaatggatttgtacagggcgccagttaatgattggtcactgcttggaagtatcaaactaatactgtactagacaagcagattttgccaattaaaatgaaa

SEQ ID NO: 9225 - DNA, 2922 bp, Sorghum bicolor
ctaataattggcagaaggccgagaaaacccatcaccgttgccgcgcctcgcggggcttccgtctcccccgcgtcggcgcggcgtacctgtggtgtggtgtggtgtttcacgatgagtcgatgattcatctcactcttgcttgtatctacacacatagtatataaagcttcctcccccctcctgagctcggcctcgcacgccgagttcttcgtctagtagatagagaaactgagtgctagggaaaagcagcaaccacgccttcctcctcccgccctccctctcgtggattcttcacaaggcttcccttgggttccggggtgcgaagcggcgcggcggcggcggtggccgaggcggcggcgatagcgtcaccttcccaggagaggttgagaagagaagcgtgagcggcggcgccgacgagcaccgatgggcccactggagccgcgctaccgtccagccggcgcccctgaggacacaactaagagaagggcctccaaaagcaaaagtttcaaagatgttgaaaattttgaagttattgtccttgaaaagagctgtggttgcaagttcaaatctttgaggatcttgctcatagctatcatttctggaacagttcttacgcttgtgactccaaccttatacgagcaccaattgcagtcagcctcccggtatgtagatgtcggttggatgtgggacaaaacaagttctgatccaagatatgtatcatctgttgatgttcggtgggaggatgtatataaagcacttggaaatctaagaagtggtaatcaaaatctcaaagttggactattgaattttaatagcactgagtatggctcttggacacaattgctctcagacagccatgtttccattataagacttgagcatgccaaggacagcattacttggcaaacactgtatcctgaatggatcgatgaggaggaagaaacagagataccctcttgcccatcacttccagagcctgatgtacgaagagatgtacgctttgatgttattgctgtaaagcttccttgtacccatgtggcaggttggtcaagagatgttgcacggctccatttgcagctctcagcagcaaaattggctgtgacatcttcgaagcgcaaccacaaggtccatgttctttttgtaactgagtgctttccaatcccgaatctcttcccttgcaagaaccttgtgagacatgaaggcaatgcttggctatatagccctgactcaaaagcattaagggaaaagctcaggcttccagtcggatcctgtgagcttgctgttccactcaaagcaaaatcgagacttttctcagtagatcgacgaagagaagcatatgcaacaatactgcattcagcgagtgaatatgtctgtggtgctatcacagcagctcaaagcattcgtcaagcaggatcaaccagggacctagtcatccttgttgatgagaccataagcgatcaccaccggagaggcttggaagctgcagggtggaaggtcagaataatccaaagaatcaggaatccgaaagcagagcgtgatgcatacaacgagtggaactacagcaagttcaggctgtggcagctgactgactacgacaagatcatcttcatagatgcagacctcctcatcctgaggaatgttgacttcctgtttgcaatgccagagatcacagcaactggcaacaatgcaacactcttcaactccggtgtcatggtcatagagccttccaactgcacattccagctgctgatggaccatatcaacgagataacttcatacaatggcggggaccagggatacctgaatgagatattcacctggtggcaccgcatccccaagcacatgaactttctgaagcacttctgggagggcgacagccaggccatgaaggcgaagaagactcagctgtttggcgcagacccaccaatcctctatgttctccactaccttggcctgaagccatggttgtgcttcaaagactatgactgcaactggaacaacgccggaatgcgtgaatttgcaagcgacgtcgcacatgcccgatggtggaaggtgcacgacaagatgccccggaagctccagtcctactgcctgctgaggtcacggcagaaggccagcctggagtgggaccggaggcaggctgagaaggccaactctgaagatggccattggcgccgcaacatcacggacaccaggctgaagacatgctttgagaagttctgcttctgggagagcatgctctggcattggggcgagaacaataacaggacgaagagcatccccatggcagtgaagacggcgagcttggcaaggtcatgatctgtagaatacaaacacccgatattgcaaccatacatgcatagcaatagcttgtataggtagctatgcttaggtcttcgctatacaaaatacaccactccctgttgctgtcatggctgcagctctatgtcgctgccagcctgcctcgacggctaacaattcttttgggttgactcttggctgctgaaataagtttcaggtaaatgtaaagttccctgctgaaattatgtgagcgtgtgagaaatgatttgtgtacagggcgccaaataataattggttagtgcatggaacatatgactagtcttactcttacagtgtatgacgacagacttgtatagcacagcgcatacggagaatgcaatgtggaggcagtgctagacattcaaaacatgccaatccaattgagagagggcactttctgacaatgtatcaagtaaatgtatgtacatacaggttacaatacaaactcgatttttacagcatataaaatgaaccgttagtaaataaagatgacagaatgactgtcaaggcattctaatcctagccaaccagaagaattaaagaagtgatgtaaaatctacaactcgtgatgcatgcttcacc

SEQ ID NO: 9226 - DNA, 3314 bp, Zea mays
caattctaaaatcgaaaccgacaagcatgccatcagctatagcgtgtatgtatgccgaacatttttattttttaccgcgaggcaagttttctcacggaacggaagcgctaacgcatgccatgcgtgtatgtatgtattttccctagcttccccggcctcggcctcgcagtagaagattagttaggccttgacccgtagtccacacccgtacgcccgcctaataattggcagagacggccggaaacagcccccctcctcatcaccgttgccgcgcatcccccgcctccgtctcccccgcgtcggcgtactcaccagtcacatatatagagcttcgtcccctcccgagctcgcacaccgagttcttcttcttaatcttcctcttcgtctccttctagtagtgggcagagagagatcgagtgctaggggagaagcaagcaagccaggcagcagcaaccgcgcctggtttcctcctcctcctcctcgtgggctcacacaaggcttccttcggttcgggggtgtgcgaagcggcgcaacggcggaggcggctctagcatcaccggccgacggtcctcctccttctcacgaaaggcactagaggagcggcggcggcggcggcgcatcaagcaccgcaccgatgggcccactggagccgcgctaccgtccaggcggcgcccccgaggacacgactaagagaagggcctccaagagcaagagtttcaaagacgccgagaacttcgaagtcctcgtccttgagaagagctgcggttgcaagttcaagtctttgaggatcttgctcatagccatcatctccgcgacagtccttacccttgtaaccccgaccttatacgagcgccagttgcagtcagcctcccggtacgtggatgtcgggtggatgtgggacagagcgagttccgatccgcggtacgcatcttctgccgatgttgggtgggaggatgtgtacaaagcactgggaaacctaagaagcggtaaccgccagagtcatctcagagttgggctcttgaatttcaacagcaccgagtatggctcctggacgcagttgctcccagctgacagccacgttatctccactgtaaggctcgagcacgccaaggacagcgtcacctggcagacgctgtaccctgagtggatcgacgaggaggaagagacggagataccctcttgcccgtcgctgccggagccaaacgtgccaagaggtgcgcgctttgacgtcgtcgccgtgaagctcccatgcacccgtgtggcgggctggtcgagagacgtcgcgcggctccatctgcagctctcggcagccaaactggctgtggcgtcctcgaagcgcaaccacgacgtccatgttctcttcgtcactgactgcttcccgatcccgaacctcttcccttgcaagaaccttgtcacacgtgaaggcagcgcctggttgtacagtcctgactccaaggcgttgagggaaaagctcaggcttccagtcgggtcctgtgagcttgccgttccactcaaagccaaatcgaggcttttctcggtagatcgacgaagagaagcgtacgcgacgatactgcattcagcgagcgaatacgtctgcggcgcaatctcggcagcgcaaagcatccgccaggcaggatccaccagggacctggtcatccttgtggacgagaccataagcgaccaccaccggagaggcttggaggcggcggggtggaaggtcagagtgatccagaggatcaggaaccccaaggcggagcgcgacgcgtacaacgagtggaactacagcaagttcaggctgtggcagctcaccgactacgacaaggtcatcttcatagacgccgacctcctcatcctgaggaacgtcgacttcctgttcgccatgccggagatcgccgcgacgggcaacaacgccacgctcttcaactccggcgtcatggtcgtcgagccctccaactgcacgttccgcctgctcatggaccacatcgacgagatcacctcgtacaacggcggggaccaggggtacctcaacgagatattcacgtggtggcaccgcgtccccaggcacatgaacttcctcaagcacttctgggagggcgacagcgaggccatgaaggcgaagaagacccagctgttcggtgcggacccgccggtcctctacgtcctccactaccttggcctcaagccgtggctgtgcttcagagactacgactgcaactggaacaacgccgggatgcgcgagttcgccagcgacgtcgcgcatgcccggtggtggaaggtgcacgacaggatgccccggaagctccagtcctactgcctgctgaggtcgcggcagaaggccaggctggagtgggaccggaggcaggccgagaaggccaactctcaagatggccactggcgcctcaacgtcacggacaccaggctcaagacgtgctttgagaagttctgcttctgggagagcatgctctggcattggggcgagaacagtaacaggaccaagagcgtccccatggcagccacgacggcaaggtcgtgatctgtagatatacgaacaccccatccccatatggcaaccatacatgcatagcaatagcttgtataggtagctatgctttagttcttcgctatatatacagaatacaccactcgatccctgttgttgtcaaggctgcagctctatgtcgctgccggcctgccaccatggctaacgattcttttgggttggctgctgtaataagtttcaggtacatgtaaatttccctgctgaaattacgtgaccgcgtgtgagaaatgaatttgtacagggcgccaaataataattggttggtgcatacaacatatgaccagtcttttgcagtatatgccgacagacttcagacttgtatagcacaacgcataccgacagtgcagaaacaaaacaatgcaatatgaaggcggtgttagacattcgaaacttatcaatccaattgagagagggcactttctcacaatgtatcaagtaaatgtttgtacatacaggttacaatacaaactcgatttttaacaacataataaaatgaaccgttagtaaattgagcaaatagaacgaatgccaaggccttctaatcccttaccaactacatacaactctagttgcatgtagcatgcttcaccgtgtatacgagtcaaaaatcaaaaagaagaaaagaatgtagaagtccagtgaaccacctagcagctgcagctgccttgtcccggacgtatgttaattctctagtatacctggtaatgtcaaatatcacaatgcaataggtgcgggtagattgtgctgccaaaaa

SEQ ID NO: 9227 - DNA, 2953 bp, Hordeum vulgare
gactgatcgtttccatttgctcttctcattctggaggcttctttgcgcccgccgttaatggcgccaccatttgcttcgcttcactggtcccctcgctgttctttggtttactggcgattactatactacgtttacatgctgatcagcggcagtctgatcctcctcctcctcctctcgaaaagaaaagagaaccaaaaaacagacaccggattgttaaaatatagtataatttcgctgattttctatgccgggtcgggtggtgtcagagccatgtcttttttgcatcgggcctccaactccaaccctctgtctgctctgcctgttattttatttttctacttacttctgcttccgtgcaccctcgtaaacacaacactcggccctgtgtgttccctctccccactgccactcgggcctcacgtttcgggcccggtggcccgcgcgtcttaccacacgacaagattgcttacccctgtgctgtcgtgattgcagatgagaagcagcgcaccggcggcggcgtgaacctctccgctccccggggaagagaggaggaggaggagaagaggaagagaggagggcccaagcccaagcccaagcccaggaccaatggagcagcgctaccgaccgggcggggccgctgatgacacaactaagagaaggaccaccaaaaccaaaagtttcaaagatgttgaaagctatgaagttcttgtccttgagaagaactgcggttgcaagttcaaatctttgcgctacttgcttatagctattgtttctgcgacatttcttaccctcctgactccgacgttgtatgagcgccaactacaatcaagttcacggtatgtggatgttgactggatatgggacaaaaccagtgctgatccgcgatatgtatcatctgctgatgttcagtgggctgatgtatatacagctatagaagatcttagtgctggtaaccaaaagctcaaaattggactcctgaattttaacagcaccgagtatggctcctggtcgcagatactccctgaaagccatgtttcaattataagacttgagcatgccaaggacagcattacttggcctacactatacccagaatggatagatgaggaggaagaatctgagataccttcctgtccatcatttccagagcctaatgtccgaagaggcgcatggttcgatgttattgctgtgaaacttccctgtacaagggtggcgggttggtcgagagatgttgcaaggcttcatttgcagctctcagcggcaaaactggccgtgtcctcttcaagaggcaaccggatggtccatgtgctttttgtgacggactgcttccccatccctaacctcttcccctgcaagaaccttgtgaaacatgaaggcaatgcttggttgtatagacctgatttgaaagcagtaagggaaaagcttaggcttcctgttggatcatgcgagcttgctattccacttaaagcaaaagcaagacttttctcagtagatcgaagaagagaagcctatgccacgatactgcattcagcaagtgaatatgtgtgtggtgctatcacagcagctcagagcatcaggcaagcaggatcaactagggacttggtcatccttgttgataacaccataagtgatcaccaccggaggggcttggaagccgctggctggaaggtcaggataatcgaaaggatcaggaacccaaaagctgagcgtgatgcctacaatgagtggaactacagcaagttcaggttatggcagctgaccgactacgacaagatcatattcatagacgctgacctcctcatcctgaggaatgtggacttcctgtttgcaatgccagagatcactgcaactggcaacaacgcgaccctcttcaactcgggtgtcatggtcatcgagccctcaaactgcacgttccagctgctgatggagcacatcaacgagataacatcgtacaacggcggtgaccaggggtacctgaatgagatattcacatggtggcaccgcatccccaagcacatgaacttcctgaagcacttctgggagggcgacagcgaggcagccaaggcgaagaagacccagctgtttggcgccgacccgccaaacctctatgtgcttcactacctgggcctgaagccatggctgtgcttcagggactacgactgcaactggaacaacttcatcatgcgtgagtttgcaagcgatgtcgcgcacaaccgttggtggaaggtgcacgacaagatgccccggaagctccagtcctactgccttctgagaacaaggcagaaggctgggctggagtgggaccggaggcaggccgagaaggcgaacctggaggacgggcattggcggcggaacatcaccgatccgaggctcaagacctgcttcgagaagttctgcttctgggagagcatgctgtggcactggggcgaggccaagaaccagaccaagagcatccccgcgcctaccacgacgagcttgtcatcaacctcgtgagctgtgtagataacccgagatatttatacagaagaaagctttatatgtatagcaccgtacctgcatagcggcagcttgtataggtagctactatgcttaggccttccccacacaaatacaaaccctcctctgttggctgttgccgccctcctggctgcagccttggtggccaacaattcttttgggtttgtttagctaataagttatctgtgcatgtaaattctcttactaagaacacggaatgttttttcacgacaaggaaagctaatggcagtagtaccctctcagttccaagttattgaagctctagttttgtcctaactaaaacttctttaagcttgcccaagtccccacaaaaatatcaacatgtttgacatgttcctgggcatcaactgaattccatacccagaaaatttaacttaggcttagtagcggcttcgagcaaatcatatcccttggc

SEQ ID NO: 9228 - DNA, 2439 bp, Hordeum vulgare
ccctcccgagagctccgatacaccacctgactcgagctcttcttttgcgtgagcaaagcgcacagagagagagaagaaggagaggggagcggcccgtttctcgccgcccaccttccccttcgccggttcgcctgcgccgcggatgagaagcagcgcaccggcggcggcgtgaacctctccgctccccggggaagaaaggaggaggaggagaagaggaagagaggagggcccaagcccaagcccaagcccaggaccaatggagcagcgctaccgaccgggcggggccgctgatgacacaactaagagaaggaccaccaaaaccaaaagtttcaaagatgttgaaagctatgaagttcttgtccttgagaagaactgcggttgcaagttcaaatctttgcgctacttgcttatagctattgtttctgcgacatttcttaccctcctgactccgacgttgtatgagcgccaactacaatcaagttcacggtatgtggatgttgactggatatgggacaaaaccagtgctgatccgcgatatgtatcatctgctgatgttcagtgggctgatgtatatacagctatagaagatcttagtgctggtaaccaaaagctcaaaattggactcctgaattttaacagcaccgagtatggctcctggtcgcagatactccctgaaagccatgtttcaattataagacttgagcatgccaaggacagcattacttggcctacactatacccagaatggatagatgaggaggaagaatctgagataccttcctgtccatcatttccagagcctaatgtccgaagaggcgcatggttcgatgttattgctgtgaaacttccctgtacaagggtggcgggttggtcgagagatgttgcaaggcttcatttgcagctctcagcggcaaaactggccgtgtcctcttcaagaggcaaccggatggtccatgtgctttttgtgacggactgcttccccatccctaacctcttcccctgcaagaaccttgtgaaacatgaaggcaatgcttggttgtatagacctgatttgaaagcagtaagggaaaagcttaggcttcctgttggatcatgcgagcttgctattccacttaaagcaaaagcaagacttttctcagtagatcgaagaagagaagcctatgccacgatactgcattcagcaagtgaatatgtgtgtggtgctatcacagcagctcagagcatcaggcaagcaggatcaactagggacttggtcatccttgttgataacaccataagtgatcaccaccggaggggcttggaagccgctggctggaaggtcaggataatcgaaaggatcaggaacccaaaagctgagcgtgatgcctacaatgagtggaactacagcaagttcaggttatggcagctgaccgactacgacaagatcatattcatagacgctgacctcctcatcctgaggaatgtggacttcctgtttgcaatgccagagatcactgcaactggcaacaacgcgaccctcttcaactcgggtgtcatggtcatcgagccctcaaactgcacgttccagctgctgatggagcacatcaacgagataacatcgtacaacggcggtgaccaggggtacctgaatgagatattcacatggtggcaccgcatccccaagcacatgaacttcctgaagcacttctgggagggcgacagcgaggcagccaaggcgaagaagacccagctgtttggcgccgacccgccaaacctctatgtgcttcactacctgggcctgaagccatggctgtgcttcagggactacgactgcaactggaacaacttcatcatgcgtgagtttgcaagcgatgtcgcgcacaaccgttggtggaaggtgcacgacaagatgccccggaagctccagtcctactgccttctgagaacaaggcagaaggctgggctggagtgggaccggaggcaggccgagaaggcgaacctggaggacgggcattggcggcggaacatcaccgatccgaggctcaagacctgcttcgagaagttctgcttctgggagagcatgctgtggcactggggcgaggccaagaaccagaccaagagcatccccgcgcctaccacgacgagcttgtcatcaacctcgtgagctgtgtagataacccgagatatttatacagaagaaagctttatatgtatagcaccgtacctgcatagcggcagcttgtataggtagctactatgcttaggccttccccacacaaatacaaaccctcctctgttggctgttgccgccctcctggctgcagccttggtggccaacaattcttttgggtttgtttagctaataagttatctgtgcatgtaaattctcttactaagaacacggaatgttttttcacgacaaggaaagctaatggcagtagtaccctctcagttccaagt

SEQ ID NO: 9229 - DNA, 2373 bp, Secale cereale
cactcgagctcttcttttgcctgagtgcgtggagagagagagaagaggagagggcgagcagcccgttccttgccgcccaccttcccttctccgcctcacctgcgtcgcggatgagaaggagcgcaccggcggcggcggcgtgatcctcctcctcactcggagcagaggagagaggcgggacaagagcaagaaccgagggggcccaggcccaatggagcagcgccaccgaccggccgcggccgctgatgacacaactaagagaagggccaccaaaagcaaaagtttcaaagatgttgagaactatgaagttcttgtcctggagaagaactgcggttgcaagttcaaatccttgcggtacttgcttattgctattgtttctgcgacatttcttaccctcctgactccgacgctgtacgagcgccaactacaatcaagttctcggtatgttgatgttgattggatatgggacaaaacaagtgttgatccgcgatacgtatcatctgctgatgttcagtgggccgatgtatatacagctatagaagatcttagtgctggtaaccgggagctcaaaattggactcctgaattttaacagcaccgagtatggctcttggtcgcgcatactccctgaaagccatgtttcgattataaggcttgagcatgccaaggacagcattacttggcctaaactatatcccgaatggatagacgaggaggaagattctgagataccttcctgcccatcatttccagagcctaatgtccggagaggcgcatggtttgatgttattgctgtgaaacttccctgtacaagggtggcgggttggtcgagagatgttgcaaggcttcatttgcagctctcggcggcaaaactggccgtggcctcttcaagaggcaaccggaaggtccatgtgctctttgtgacggactgcttccccatccccaacctcttcccctgcaagaaccttgtgaaacatgaaggcaatgcttggctgtataggcctgatttgaaagcagtaagggaaaagcttaggcttcctgttggatcatgcgagcttgctattccacttaaagcaaaagcaagacttttctcagtagaccgaagaagggaagcatatgccacgatactgcattcagcaagtgaatatgtatgtggtgctatcacagcagctcagagcatcaggcaagcaggatcaactagggacttggtcatccttgttgataacaccataagtgatcaccaccggagaggcttggaagccgcaggctggaaggtgagaataatcgaaaggatcaggaatccaaaagccgagcgtgatgcctacaatgagtggaactacagcaagttcaggttgtggcagctgacggactacgacaagatcatattcatagatgctgacctgctcatcctgaggaatgtggacttcctgttcgcgatgccagagatcaccgcgacgggcaacaacgcgaccctcttcaactccggcgtcatggtgatcgagccctccaactgcacgttccagctgctgatggagcacatcaacgagatcacgtcgtacaacggcggcgaccaggggtacctgaacgagatattcacatggtggcaccgcatccccaagcacatgaacttcctgaagcacttctgggagggcgacagcgaggcggccaaggccaagaagacccagctgtttggcgccgacccgccgagcctctacgtgcttcactacctcggcctgaagccatggctgtgcttcagggactacgactgcaactggaacaacttcatgatgcgtgagttcgcgagcgacgtcgcgcaccgccggtggtggaagacgcacgacaagatgccccggaagctccagtcctactgccttctgaggacaaggcagaaggctgggctggagtgggaccggaggcaggcggagaaggcgaacctggaggacgggcactggcggcggaacatcaccgatcccaggctcaagacctgcttcgagaagttctgcttctgggagagcatgctgtggcactggggcgaggcgaagaaccagaccaagagcatccccgcgccggcgacgcctgcgacgatgagcttgtcaagctcgtgagctgtgtagatagcccgagatatttatacagaagaaagcttcatgatatgtaatagcaccgtacctgcatagcagcagcttgtataggtagctatgcttagggccttccccacacaaatacaaaccctcctctgtttgccgtcctcctggctgcagctctgagccttggcggtggccaacaattcttttgggttgctttagttaataagttatctgtgtatgtaaattctcttactaagaacacggaatgttttttcacgacaaggaaa

SEQ ID NO: 9230 - DNA, 2369 bp, Secale cereale
caccactcgagctcttcttttgcgtgagtgcgtggagagagagagagagaagaggaggggcgagcagcccattccttgccgcccaccttcccttcgccgcctcacctgcgtcgcggatgagaaggagcgcaccggcggcggcggcggcggcgtgatcctcctcctcgctcggagcagaggagaggcgggagaagagcaagaaccgaggggggccaggcccaatggagcagcgccaccgaccggccgcggccgctgatgacacaactaagagaagggccacgaaaagcaaaagtttcaaagatgttgagaactatgaagttcttgtcctggagaagaactgcggttgcaagttcaaatccttgcggtacttgcttatagctattgtttctgcaacatttcttaccctcctgactccgacgctgtacgagcgccaactacaatcaagttctcggtatgttgatgttgactggatatgggacaaaacaagtgctaatccgcgatatgtatcatctgctgatgttcagtgggccgatgtatatacagctatagaagatcttagtgctggtaaccaagagctcaaaattgggctcctgaattttaacagcaccgagtatggctcttggtcgcggatactccctgaaagccatgtttcgattataaggcttgagcatgccaaggacagcattacttggcctaaactatatcccgaatggatagatgaggaggaagattctgagataccttcctgcccatcatttccagagcctaatgtccgaagaggcgcatggtttgatgttattgctgtgaaacttccctgtacaagggtggcgggttggtcgagagatgttgcaaggcttcatttgcagctgtcagcggcgaaactggccgtgacctcttcaagaggcaaccgcaaggtccatgtgctctttgtgacggactgcttccccatccccaacctcttcccctgcaagaaccttgtgaaacatgaaggcaatgcttggttgtataggcctgatttgaaagcagtaagggagaagcttaggcttcctgttggatcatgcgagcttgctattccacttaaagcaaaagcaagacttttctcagtagaccgaagaagagaagcatatgccacgatactgcattcagcaagtgaatacgtatgcggtgctatcacagcagctcagagcatcaggcaagcagggtcgaccagggacttggtcatccttgttgataacaccataagcgatcaccaccgaagaggcttggaagccgcaggctggaaggtgagaataatcgaaaggatcaggaatccaaaagccgagcgtgatgcctacaatgagtggaactacagcaagttcaggttatggcagctgacggactacgacaagatcatattcatagatgctgacctgctcatcctgaggaatgtggacttcctgttcgcgatgccagagatcaccgcgacgggcaacaacgcgaccctcttcaactccggcgtcatggtgatcgagccctcgaactgcacgttccagctgctgatggagcacatcaacgagatcacgtcgtacaacggcggcgaccaggggtacctgaacgagatattcacatggtggcaccgcatccccaagcacatgaacttcctgaagcacttctgggagggcgacagcgaggcggccaaggccaagaagacccagctgtttggcgccgacccgccgagcctctacgtgcttcactacctgggcctgaagccatggctgtgcttcagggactacgactgcaactggaacaacttcatgatgcgtgagttcgcgagcgacgtcgcgcaccgccggtggtggaagacgcacgacaagatgccccggaagctccagtcctactgccttctgaggacaaggcagaaggctgggctggagtgggaccggaggcaggcggagaaggcgaacctggaggacgggcactggcggcggaacatcaccgatcccaggctcaagacctgcttcgagaagttctgcttctgggagagcatgctgtggcactggggcgaggcgaagaaccagaccaagagcatccccgcgccggcgacgcctgcgacgatgagcttgtcaagctcgtgagctgtgtagatagcccgagatatttatacagaagaaagcttcatgatatgtaatagcaccgtacctgcatagcagcagcttgtataggtagctatgcttagggccttccccacacaaatacaaaccctcctctgtttgccgtcctcctggctgcagctccgagccttggcggtggccaacaattcttttgggttggtttagctaataagttatctgtgtatgtaaattctcttactaagaacacggaatgttttt

SEQ ID NO: 9231 - DNA, 2250 bp, Avena sativa
ccagttcgaggctcaccggcgtcgcgtccctgcggatgagaagcgaagcggcggcggcggcgtgatcttcctcgctcctcgaagaagagaggggagaacaggaacccacccaggcggagtccaatggagcagcgctaccggccggccggagcccctgatgacacaaccaagagaagggccaccaaaagcaaaagtttcaaagatgttgaaaactacgaagttcttgtcctcgagaagaactgtggttgcaagttcaaatctctgcggtacttgcttatagctattgtttctgcaacatttgtcaccctcctaactcccacgttgtacgagcgccaactacaatccaattctgtgtatgtggatgttgactggatatgggacaaaacaagtgctgacccacgatatgcatcatctgttgatgttcagtgggatgatgtatattcagcagtggaagatcttaatgatggtaaccaaaagctgaaagttgggctcctgaattttaacagcactgagttaggctcttggtcacggatactccctgaaagccatgtctcgattataagacttgagcatgccaaggaaagcgttacttggcctgcactatatcctgaatggatagatgaggaggaagattctgagataccgtcctgcccatcgtttccagagcctaatgtccgaaaaggtgtattttttgatgttattgctgtgaaacttccttgtacaagggtggcaggttggtcaagagatgttgcaaggctccatttgcagctctcagcggcaaaactggctgtgacctcttcaagagccaaccggaaggtccatgtgctttttgtgacggactgcttcccgattcctaatctcttcccgtgcaagaaccttgtgaaacatgaaggcaatacttggttgtataggcctgatttgaaggcaataagggagaagcttaggcttcctgttggatcgtgtgagctcgctgttccactcaaagcgaaagcaagactctactcagtagatcgaagaagagaagcatatgcaaccatactgcattcagcaagtgaatatgtatgtggtgctatcacagcagctcagagcatcaggcaagcaggatctaccagggacttggttatccttgttgatgacaccataagtgatcaccaccggagaggcttggaagctgcaggctggaaggtgagaataatcgagagaatcaggaacccaaaagctgagcgtgatgcctacaacgagtggaactacagcaagttcaggttatggcagctgaccgactacgacaagataatattcatagatgctgacctcctcatcctgaggaatgtggacttcctgtttgcgatgccagagatcaccgcaaccggcaacaatgcgaccctcttcaactccggtgtcatggtcatcgagccctcaaactgcacgttccagctgctgatggagcacatcaacgagataacatcgtacaacggcggtgaccaagggtacctgaatgagatattcacgtggtggcaccgcattccgaagcacatgaacttcctgaagcacttctgggagggcgacaacgaagctgccaaggcaaagaagacccagctgtttggcgctgacccgccgagtctctatgtgcttcactacttgggtgtgaagccatggctgtgcttcagggactatgactgcaactggaacaacctgatgatgcgcggtttcgcgagcgatgtcgcgcacaaccgatggtggaaggtgcacgacaagatgtctccgaagcttcagtcgtattgccttctgcgaacaaggcagaaggctgggctggaatgggaccggaggcaggcagagaaggcgaacatggaggacgggcattggcggcggaacatcactgatccgaggctcaagacctgtttcgagaagttctgcttctgggagagcatgctttggcactggggcgagacgaaccggacaaagagcgcccccgtgctggcgacacctactgtgagcttgtcaagctcgtgagctctgtagataaccggagatatatttatacagaagggggggggggggggggggggggggggggggggggggggggggggtttcccatacaaatacaaaccctatgttgctgtcctgactgcagctcttaatcaggcagcggtgatggacaacaattcttttgggttgctttagctaataagttatttgtgcatgtaaattctcttactgggaacacggaatgttttttcaagacaggaa

SEQ ID NO: 9232 - DNA, 2161 bp, Triticum aestivum
tgatgacacaactaagagaaggaccaccaaaagcaaaagtttcaaagatgttgagaactatgaagttcttgtccttgagaagaactgcggttgcaagttcaaatccttgcgctacttgcttatagctattgtttctgcgacatttcttaccctcctgactccgacgctgtacgagcgccaactacaatcaagttctcggtatgttgatgttgactggatatgggacaaaacaagtgctgatccgcgatacgtatcatctgctgatgttcagtgggccgatgtatatacagctatagaagatcttagtgctggtaaccaagagctcaaaattggactcctgaattttaacagcaccgagtatggctcttggtcgcgcatactccccgaaagccatgtttcgattataagacttgagcatgccaaggacagcattacttggcctaaactatatcctgaatggatagatgaggaggaagaatctgagataccttcctgcccatcatttccagagcctaatgtccgaagaggcgcatggtttgatgttattgctgtgaaacttccctgtacaagggtggctggttggtcaagagatgttgcaaggcttcatttgcagctctctgcggcaaaactggccgtgacctcttcaagaggcaaccggaaggtccatgtgctctttgtgacggactgcttccccatccccaacctcttcccctgcaagaaccttgtgaaacatgaaggcaatgcctggttgtataggcctgatttgaaagcagtaagggaaaagcttaggcttcctgttggatcatgcgagcttgctattccacttaaagcaaaagcaagacttttctcagtagaccgaagaagagaagcatatgcgacgatactgcattcagcaagtgaatatgtatgtggtgctatcacagcagctcagagcatcaggcaagcaggatcaactagggacttggtcatccttgttgataacaccataagtgaccaccaccggagaggcttggaagctgcaggctggaaggtcagaataattgaaaggatcaggaacccaaaagccgagcgtgatgcctacaatgaatggaactacagcaagttcaggttatggcagctgaccgactacgacaagatcatattcatagatgctgacctcctcatcctgaggaatgtggacttcctgttcgcaatgccagagatcaccgcgaccggcaacaacgcgaccctcttcaactccggcgtcatggtgatcgagccctcaaactgcacgttccagctgctgatggagcacatcaacgagatcacgtcgtacaacggcggtgaccaggggtacctgaacgagatattcacatggtggcaccgcatccccaagcacatgaacttcctgaagcacttctgggagggcgacagcgaggaggccaaggcgaagaagacccagctgtttggcgccgacccgccgaacctctacgtgcttcactacctgggcctgaagccatggctgtgcttcagggactacgactgcaactggaacaacttcatgatgcgcgagttcgcaagcgacgtcgcgcacagccggtggtggaagacgcacgacaagatgccccggaagctccagtcctactgccttctgaggacgaggcagaaggctgggctggagtgggaccggaggcaggcggagaaggcgaacctggaggacgggcattggcggcggaacatcaccgatccgaggctcaagacctgcttcgagaagttctgcttctgggagagcatgctgtggcactggggcgaggcgaagaaccagacgaagagcaaccccgcgccggcgacgcctgcgacgatgagcttgtcaagctcgtgagctgtgtagatagcccgagatatttatacagaagaaaagcttcatcatatgtatagcaccgtacctgcatagcagcagcttgtataggtagctatgcttagggccttccccacacaaatacaaaccctcctctgttgccgtcctcctggctgcagctctgagccttggcggtggccaacaattcttttgggttggtttagctaataagttatctgtgtatgtaaattctcttactaagaacacggaatgttttttcacgacaaggaaagctaatggcagtggtactctctcccgttccaa

SEQ ID NO: 9233 - DNA, 2181 bp, Avena sativa
cgtactccaccactcggacgaagttttttcgcgtgagtgtgccgatagaaagagacgaggaggcgcacccgtttctcgccttccaccttcccttggcggccagttcgaggctcaccggcgtcgcgtcctagcggatgagaagcgaagcggcggcggcggcgtgatcctctgcgctcctcggagaagaagaagggaggggagaacaggaacccaggcggagtccaatggagcagcgctaccggccggctggagcccctgatgacacaaccaagagaagggccaccaaaagcaaaagtttcaaagatgttgaaaactacgaagttcttgtcctcgagaagaactgtggttgcaagttcaaatctctgcggtacttgcttatagctattgtttctgcaacatttgtcaccctcctaactcccacgttgtacgagcgccaactacagtccagttctgtatatgtggatgttgactggatatgggcaaaacaagtgctgatccacgatatgcatcatctgttgatgttcagtgggatgatgtatattcagcaatggaagatcttaatgatggcaaccaaaagctgaaagttgggctcctgaattttaacagcactgagttaggctcttggtcacggatactccctgagagccatgtctcgattataagacttgagcatgccaaggaaagcgttacttggcctgcactatatcctgaatggatagatgaggaggaagactctgagataccgtcctgcccatcgtttccagagcctaatgtccgaaaaggtgtattttttgatgttgttgctgtgaaacttccctgtacaagggtggcaggttggtcaagagatgttgcaaggctccatttgcagctctcagcggcaaaactggccgtgacctcttcaagggccaatcggaaggtccatgtgctttttgtgacggactgcttcccgattcctaatctcttcccgtgcaagaaccttgtgaaacatgaaggcaatacttggttgtataggcctgatctgaaggcaataagggagaagcttaggcttcctgttggatcgtgtgagctcgctgttccactgaaagccaaagcaagactctactcagtcgatcgaagaagagaagcatatgcaacgatactgcattcagcaagtgaatatgtatgtggtgctatcacagcagctcagagcatcaggcaagcaggatcgaccagggacttggttatccctgtggatgacaccataagtgatcaccaccggagaggcttggaagctgcaggctggaaggtgagaataatcgaaagaatcaggaacccaaaagctgagcgtgatgcctacaacgagtggaactacagcaagttcaggttatggcagctgaccgactacgacaagataatattcatagatgctgacctcctcatcctgaggaatgtggacttcctgtttgcgatgccagagatcaccgcaaccggcaacaatgcgaccctcttcaactccggtgtcatggtcatcgagccctcaaactgcacgttccagctactgatggagcacatcaacgagataacatcatacaatggcggtgaccaggggtacctgaatgagatattcacgtggtggcaccgcattccgaagcacatgaacttcctgaagcacttctgggagggcgacaacgaagctgccaaggcaaagaagacccagctgtttggcgctgacccgccgagtctctatgtgctacactacttgggtgtgaagccatggctgtgcttcagggactatgactgcaactggaacaacctggtgatgcgcggcttcgcgagcgacatcgcacacaagcggtggtggaaggtgcacgacaagatgtctccgaagcttcagtcatattgccttctgcgaacgaggcagaaggctgggctggaatgggaccggaggcaggcggagaaggcaaacatggaggatggccattggcggcggaacatcactgatccgaggctcaagacatgtttcgagaagttctgcttctgggagagcatgctctggcactggggcgagacgaaccggacgaagagcgcccccgtgctggcgacacctactgggagcttgtcaagctcgtgagttgtgtagataacccgagatatatttatacagaaagctttatgtatagcactatgcatgcatagcagcag

SEQ ID NO: 9234 - DNA, 2777 bp, Brachypodium distachyon
cgccattgctgcgcttgccactgcgcatccgcgtcactaccccggcccctcgctgcccgcgtgggcgtcgtccctgtgtcgccaattccaatctcattgcatatataaaggagcttttcctcctcctcctcctcctcttgagctctcatacattactcgagttctttttgcgtgcgtgcgtgcgtgcgtagagagtgaagaggaggagagcaggggaggcgcacccttttcttgccgtcctccttcccttggccaatccagggctcgccggcgttgcggatgagaagcggcgaaacggcggcggcagctatcgcgtgattctctcttcgttcttaacagaggaaagagaagagaaggagaagaagaaccggcggggggggggggggggggggggggttcaattcaatggagcagcgctaccgtccatctggagtcgctgacgacacaaccaagagaaggaccaccaaaagcaaaagtttcaaagatgttgaaaattttgaagttcttgttctcgagaagaactgtggttgcaagtttaaatctctgcgctacttgcttatagctattgtctctgcgacatttgttaccctcctaactccgacgttatacgagcaccaactacagtccagctctttgtatgtggatgttgactggatatgggacaaaacaagtaccgatccacgatatgtatcatctgttaatgttcagtggatggatgtatataaagcaatagaagatcttaacggtggtgaccaaaagctcaaagtcggactcttgaattttaacagcactgagtatggctcttggtcacaattactcccagaaagccatgtttccattataagacttgagcatgccaaggacagcattacttggccagtactatatcctgagtggatcgatgaggaggaagaaactgagataccatcttgtccatcacttccggagcctaatgttcggaaaggtgtatggtttgatgttattgctgtgaaacttccctgtacaagggtggggggttggtcaagagatgttgcaaggctccatttgcagctctcagcggcaaaattggctgtgatctcttcaagaggcaacaggaatgtccatgtgctttttgtgacggactgcttcccgattcctaatctcttcccatgcaagaaccttgtgaagcatgaaggcaatgcttggttgtatagacctgatttgaaggcactaaaggaaaagctcaagctccctgtcggatcctgtgagctagctgtgccacttaaagcaaaagcaagactttactcggtagatcgaagaagagaagcatatgccacgatattgcattcagcgagtgagtatgtgtgtggtgctatcacggcagctcagagcattaggcaagcaggatcaactagggacttggttatccttgttgatgactccataagtgatcaccaccggaaaggcttggaagctgcaggctggaaggtaagaataatccaaagaatcaggaacccaaaagctgagcgtgatgcctacaatgagtggaattacagtaagttcaggttatggcagctgactgactacgacaagataatattcatagatgctgacctcctcatcctgaggaatgtagacttcctgtttgcaatgccagagatcactgcaactggcaacaatgcaaccctcttcaactctggtgtcatggtcatcgagccttcaaactgcacattccagctactgatggaacacatcaatgagataacatcgtacaacggtggtgaccaagggtacctgaatgagatattcacatggtggcaccgcattccaaggcacatgaacttcctgaagcacttttgggagggcgacagtgaggcggcgaaggcaaagaagacccagctgtttggtgctgacccaccgaatctctatgtgcttcacttcttaggcctgaaaccatggctgtgcttcagggactacgattgcaactggaacagcctcgtgatgcgtgattttgcaagtgatgtcgcgcacaaccggtggtggaaggtgcacgacaagatgcctcggaagcttcagtcctactgccttctaagatcaaggcagaaggctggactggaatgggaccggaggcgggccgagaaggcaaactttgaagatggacattggcagcggaaaatcactgatccaaggctcaagatctgcattgataagttctgcttctgggagagcatgttgtggcactggggcgagacaaaccagacgaagagcctccccgtgccagtgacacctgcggtgagcttgtcgagctcatgatctgtgtagataaaccattatattatgacagaaaactttctgtatagcaccatacatgcatagcagcagcttgtataggtagctatgcttaggccctttcccatacaaacacaaaccctctgttgctgtccttgttgcagctcttgtcttgctgcgggttgatggctaacaattcttttgggttggtttagctaataagttttcagcacatgtaaattgtcctatattgagaactcgaaatgttcttttgcgagaagaaaagacagagggaacggtacatcttgtgtacaagagattgtgctggtcactagaggtagaagcttcgaccaaatcatatccctcggccctcgttgagcgcggtctgccggaatacatgtgtgacatccatgtagactcaatatgcacataacttggagttctttgctcagcataatcctgtgatgccgtttgacagtgcttcgctactgggcatgggcgcatggcag

SEQ ID NO: 9235 - DNA, 2638 bp, Oryza sativa
gagaaaaatccatcccagtaatcgccattgccgccgcggctcagtgcgccgcgcattcgctcgcgcttgctcttctgcctcctccttcctccccgcgtgagatgcaatcacgcaattctataaatatataaacgagcttctcctcctcatgagctctcgtagtatataggagtagcctttgtggagagatacagagagaggcagaggagcacaagccgtcactcacctcacctgccttcttcttcatcatcatcttcttcttcttcctcccgcttcgccgattcaggttctccttcgctgcagatgagaagcggcgcctcggcggcggcggcggcggtgtgattctcctctccagagagagaaagaagagagagagagagagagagagagagagagagagagagaggagaggagaagaagcgtgaccaccgatgggatcgctggagacgcggtaccggccggccggagcgccgtctgatgacacaactaagaggaggacccccaaaagtaggatttacaaagatgtcgaaaattttggagttcttgtccttgaaaagaactctggttgcaagttcaaaactttgagatatttgctcctagctatcacttctgcgacgttccttaccctcctaactccaaccttttacgagcatcagttacaaagttctcggtatgtggatgttggttggatatgggacaaaccaagttatgacccacgatatgtatcatctgttgatgttcagtgggaggatgtatataaggcactggaaaatctcaatgatggtagccaaaagctcaaagttggactcttgaattttaacagcactgagtatggatcttgggcacagttgctcccaggaagtgctgtttccattgtaagacttgagcatgccaaagacagtattacttgggacaccctgtatcctgaatggattgatgaggaggaagaaactgatataccggcttgtccatcacttccagatcctaatgttcgaaaaggctcacactttgatgttattgctgtgaaacttccctgcacccgggtgggcggttggtcaagagatgttgcacgactccatttgcagctctcagcagcaaaactggctgtagcctcttcgaaaggcaaccagaaggtccatgtgctatttgttactgactgcttccctattcctaatctcttcccgtgcaagaaccttgtgaaacatgaaggcaatgcttggttgtatagccctgacttaaaggctttaagagaaaagctcaggcttccagttggatcctgcgagcttgctgttccgctcaaagcaaaagcaagactctactcagtggatcgaagaagagaagcatatgctactatcctgcactcagcaagtgaatatgtctgtggtgctatctcagcagctcaaagcattcgccaagcagggtcaactagggatctggttatccttgtcgatgacacgataagtgatcaccaccgaaaaggattggaggctgcaggctggaaggtgagggttatccaaagaatcaggaatccaaaagctgagcgcgatgcttacaatgagtggaactacagcaagttcaggttgtggcagctgaccgactatgacaagatcatattcatagatgctgatctccttatcctgaggaacgtcgacttcctgttcgcgatgccagagatcaccgcaactggcaacaatgcgacactcttcaactccggtgtgatggtcatcgagccgtcaaactgcacattccagctactgatggatcacatcaatgagataacatcgtacaacggcggtgaccaaggatatctgaatgagatattcacatggtggcaccgcatccccaagcacatgaacttcttgaagcatttctgggagggggacgacgattctgcaaaggcgaagaagactgagctgtttggcgcagacccgcctatcctctatgtcctccactacctgggcatgaagccatggctgtgcttcagagactatgactgcaactggaacatccccctgatgcgcgaattcgcaagcgatgtcgcgcacgcccggtggtggaaggtgcatgacaatatgcccgagaagcttcagtcctattgcttgctgagatcaaagctgaaggctgggctggaatgggaacggaggcaggctgagaaggcaaacctggaagatggacattggcggcgaaatatcaccgatccaagactgactatctgctacgagaagttctgctactgggagagcatgctgctgcattggggtgagaagaacccaacgaacaacaaccctgtgccagcgacaatatcaagctcatgatctgtagatagctcaagatattattagtacacaaaaatccatcctatatagcactatacatgcatagaaacagcttgtgtaggttgccatgcttaggcctttccaacacacaaaagaaaaaaaaaacaccctccattgctgtcatggctgcagctgtgtctcgctgcgttgttgacagctaacaattctttcgggttggtttagctaattagttatggcaaatgtaaattccttgatgaaaaacctgagtactgcgggaaagagatgctgcacagagaggctgtcctttgttggttataatggaagtaaagcttttcttgtac

SEQ ID NO: 9236 - DNA, 2626 bp, Oryza sativa
ccagtaatcgccattgccgccgcggctcagtgcgccgcgcattcgctcgcgcttgctcttctgcctcctccttcctccccgcgtgagatgcaatcacgcaattctataaatatataaacgagcttctcctcctcatgagctctcgtagtatataggagtagcctttgtggagagatacagagagaggcagaggagcacaagccgtcactcacctcacctgccttcttcttcatcatcatcttcttcttcttcctcccgcttcgccgattcaggttctccttcgctgcagatgagaagcggcgcctcggcggcggcggcggcggtgtgattctcctctccagagagagaaagaagagagagagagagagagagagagagagagagagagagaggagaggagaagaagcgtgaccaccgatgggatcgctggagacgcggtaccggccggccggagcgccgtctgatgacacaactaagaggaggacccccaaaagtaggatttacaaagatgtcgaaaattttggagttcttgtccttgaaaagaactctggttgcaagttcaaaactttgagatatttgctcctagctatcacttctgcgacgttccttaccctcctaactccaaccttttacgagcatcagttacaaagttctcggtatgtggatgttggttggatatgggacaaaccaagttatgacccacgatatgtatcatctgttgatgttcagtgggaggatgtatataaggcactggaaaatctcaatgatggtagccaaaagctcaaagttggactcttgaattttaacagcactgagtatggatcttgggcacagttgctcccaggaagtgctgtttccattgtaagacttgagcatgccaaagacagtattagttgggacaccctgtatcctgaatggattgatgaggaggaagaaactgatataccggcttgtccatcacttccagatcctaatgttcgaaaaggctcacactttgatgttattgctgtgaaacttccctgcacccgggtgggcggttggtcaagagatgttgcacgactccatttgcagctctcagcagcaaaactggctgtagcctcttcgaaaggcaaccagaaggtccatgtgctatttgttactgactgcttccctattcctaatctcttcccgtgcaagaaccttgtgaaacatgaaggcaatgcttggttgtatagccctgacttaaaggctttaagagaaaagctcaggcttccagttggatcctgcgagcttgctgttccgctcaaagcaaaagcaagactctactcagtggatcgaagaagagaagcatatgctactatcctgcactcagcaagtgaatatgtctgtggtgctatctcagcagctcaaagcattcgccaagcagggtcaactagggatctggttatccttgtcgatgacacgataagtgatcaccaccgaaaaggattggaggctgcaggctggaaggtgagggttatccaaagaatcaggaatccaaaagctgagcgcgatgcttacaatgagtggaactacagcaagttcaggttgtggcagctgaccgactatgacaagatcatattcatagatgctgatctccttatcctgaggaacgtcgacttcctgttcgcgatgccagagatcaccgcaactggcaacaatgcgacactcttcaactccggtgtgatggtcatcgagccgtcaaactgcacattccagctactgatggatcacatcaatgagataacatcgtacaacggcggtgaccaaggatatctgaatgagatattcacatggtggcaccgcatccccaagcacatgaacttcttgaagcatttctgggagggggacgacgattctgcaaaggcgaagaagactgagctgtttggcgcagacccgcctatcctctatgtcctccactacctgggcatgaagccatggctgtgcttcagagactatgactgcaactggaacatccccctgatgcgcgaattcgcaagcgatgtcgcgcacgcccggtggtggaaggtgcatgacaatatgcccgagaagcttcagtcctattgcttgctgagatcaaagctgaaggctgggctggaatgggaacggaggcaggctgagaaggcaaacctggaagatggacattggcggcgaaatatcaccgatccaagactgactatctgctacgagaagttctgctactgggagagcatgctgctgcattggggtgagaagaacccgacgaacaacaaccctgtgccagcgacaatatcaagctcatgatctgtagatagctcaagatattattagtacacaaaaatccatcctatatagcactatacatgcatagaaacagcttgtgtaggttgccatgcttaggcctttccaacacacaaaagaaaaaaaaaacaccctccattgctgtcatggctgcagctgtgtctcgctgcgttgttgacagctaacaattctttcgggttggtttagctaataagttatggcaaatgtaaattccttgatgaaaaacctgagtactgcgggaaagagatgctgcacagagaggctgtcctttgttggttataatggaagtaaagcttttcttgtacta

SEQ ID NO: 9237 - DNA, 2574 bp, Oryza sativa
ggccgcgagctctgcacagcgagagagagagagagagagtagagagagaggagtgagagagccggtggcacccagctaacccactcggccgccaccaactgcggccatttccgacgacgccgacgccggggcgcgcccgtcggtgctcccaagtccgccttctctgcggatgagaagctgctccaccgcggcggcgacagtgtggtcggccaccgcctgagaccggagagccatagctgacggctcgggggaagattcaggtgggctcgcagagaacgaaagagagtccccatgggttctttggagacgacgaacacgcggtaccggccggccggagcagcggatgacacagctaagagaaggacccagaaaagcaaaagtttcaaagaggtcgaaaaatttgatgtctttgtcctagagaaaagctctggttgcaagttccggtccttacaacttctgctcttcgcgatcatgtctgctgcatttctgacactattgtacactccatctgtgtacgaccatcaaatgcagtctagttctcggtttgtcagtgggtggatatgggacaagaccattcctgatccacgatatgtatcttcgcttggtgttcagtgggaggatgtatataaaaccgtcgaaaatctgaatgatggtgaacggaagctcaaagttggactattaaattttaacagcactgaaattggctcatggacacaattgctcccggatagtgatttttcgatcattaggctagagcatgccaaggaaagcatcacctggcagactctttaccctgaatggattgatgaggaggaagaaacagagataccatcgtgtccatcgcttccagatcctatttttccaagagggacacactttgatgttgttgctgtgaaacttccctgtacccgagctggtggatggtcaagagacgttgcacgtctgcatttgcaactatctgctgcaaaagtggcagtgactgcttcaagaggcaatcgtggtatccatgtgctgtttgtgacggattgcttccctattccaaatctcttctcttgcaagaaccttgtgaaacatgaaggcaatgcttggatgtacaagcctgacttgaaggcactaagggagaagctcagacttccagttggatcctgtgaacttgctgttccactcaaagcaaaagcacgactttactcggtagacagacggagggaagcatatgctactattctgcattcagcaagtgaatatgtctgtggtgcaatcacagctgcccaaagcattcgccaagccggatcaactagggattttgttattcttgttgacgagaccataagtaaccaccaccggaagggcttggaagctgctgggtggaaggttagaataatccaaaggatccggaatccgaaagctgagcgtgatgcatataatgagtggaactacagcaaattccgtctatggcagctcacagattacgacaagattatatttattgatgctgatctcctcattctgagaaatgtcgattttctgttcgcaatgccagaaatcactgcaaccggcaacaatgcgacactgttcaactctggagtaatggttattgagccttcaaactgcacattccagttgttgatggaccacatcaatgagataacatcctacaatggtggtgaccaaggatacctgaatgagatattcacatggtggcatcgaattccgaagcacatgaacttcttaaaacatttctgggagggggatgaagaggaagtgaaagtgaagaagactcggttgtttggtgctgacccaccaatcctctatgtccttcactatttgggtctcaaaccatggctgtgcttccgggattacgactgtaactggaataacccgatactgcgggagtttgccagtgatgttgcacatgcccgttggtggaaggtacatgacaagatgccaaagaaacttcagcactattgtcttttgagatcaaggcaaaaggctgggttggagtgggatcggaggcaggctgagaaagcaaacttcaccgatggacattggcggaggaacataactgatcctaggctgaaaacttgctttgagaagttctgcttctgggagagcatgttatggcactggggtgaatccaagaactcaacgaaggaaaaccctgtgccggccacacctaccgcgagcctcacaagttcatgagatgtgtagatagccctataccagatacaaacttctaagctccatacatacatagcaacagcttgtaaaggtagctatgcttaggtttctcgacaaaactataccttgtgtttgctatcatggcttcggctccactctggctgctttgatagctcacaatttttttggttttttggccaataattcatcagtataggtaaattttctgttcatgaattgtttggtcagtctggggttggttgttgctcggctgcaatagcctagttcgatgtatggtggttgaactgtttcggtgataaaatctggagtgacgcaacatgagattgctgaccagcaaacactgcctcattttgacatgaaatacagtattgtttt

SEQ ID NO: 9238 - DNA, 2651 bp, Oryza sativa
ggccgcgagctctgcacagcgagagagagagagagagagtagagagagaggagtgagagagccggtggcacccagctaacccactcggccgccaccaactgcggccatttccgacgacgccgacgccggggcgcgcccgtcggtgctcccaagtccgccttctctgcggatgagaagctgctccaccgcggcggcgacagtgtggtcggccaccgcctgagaccggagagccatagctgacggctcgggggaagattcaggtgggctcgcagagaacgaaagagagtccccatgggttctttggagacgacgaacacgcggtaccggccggccggagcagcggatgacacagctaagagaaggacccagaaaagcaaaagtttcaaagaggtcgaaaaatttgatgtctttgtcctagagaaaagctctggttgcaagttccggtccttacaacttctgctcttcgcgatcatgtctgctgcatttctgacactattgtacactccatctgtgtacgaccatcaaatgcagtctagttctcggtttgtcagtgggtggatatgggacaagaccattcctgatccacgatatgtatctttgcttggtgttcagtgggaggatgtatataaaaccgtcgaaaatctgaatgatggtgaacggaagctcaaagttggactattaaattttaacagcactgaaattggctcatggacacaattgctcccggatagtgatttttcgatcattaggctagagcatgccaaggaaagcaccacctggcagactctttatcctgaatggattgatgaggaggaagaaacagagataccatcgtgtccatcgcttccagatcctatttttccaagagggacacactttgatgttgttgctgtgaaacttccctgtacccgagctggtggatggtcaagagacgttgcacgtctgcatttgcaactatctgctgcaaaagtggcagtgactgcttcaagaggcaatcgtggtatccatgtgctgtttgtgacggattgcttccctattccaaatctcttctcttgcaagaaccttgtgaaacatgaaggcaatgcttggatgtacaagcctgacttgaaggcactaagggagaagctcagacttccagttggatcctgtgaacttgctgttccactcaaagcaaaagcacgactttactcggtagacagacggagggaagcatatgctacgattctgcattcagcaagtgaatatgtctgtggtgcaatcacagctgcccaaagcattcgccaagccggatcaactagggattttgttattcttgttgacgagaccataagtaaccaccaccggaagggcttggaagctgctgggtggaaggttagaataatccaaaggatccggaatccgaaagctgagcgtgatgcatataatgagtggaactacagcaaattccgtctatggcagctcacagattacgacaagattatatttattgatgctgatctcctcattctgagaaatgtcgattttctgttcgcaatgccagaaatcactgcaaccggcaacaatgcgacactgttcaactctggagtaatggttattgagccttcaaactgcacattccagttgttgatggaccacatcaatgagataacatcctacaatggtggtgaccaaggatacctgaatgagatattcacatggtggcatcgaattccgaagcatatgaacttcttaaaacatttctgggagggggatgaagaggaagtgaaagtgaagaagacgcggttgtttggtgctgacccaccaatcctctatgtccttcactatttgggtctcaaaccatggctgtgcttccgggattacgactgtaactggaataacccgatactgcgggagtttgccagtgatgttgcacatgcccgttggtggaaggtacatgacaagatgccaaagaaacttcagcactattgtcttttgagatcaaggcaaaaggctgggttggagtgggatcggaggcaggctgagaaagcaaacttcaccgatggacattggcggaggaacataactgatcctaggctgaaaacttgctttgagaagttctgcttctgggagagcatgttatggcactggggtgaatccaagaactcaacgaaggaaaaccctgtgccggccacacctaccgcgagcctcacaagttcatgagatgtgtagatagccctataccagatacaaacttctaagctccatacatacatagcaacagcttgtaaaggtagctatgcttaggtttctcgacaaaactataccttgtgtttgctatcatggcttcggctccactctggctgctttgatagctcacaatttttttggttttttggccaataattcatcagtataggtaaattttctgttcatgaattgtttggtcagtctggggttggttgttgctcggctgcaatagcctagttcgatgtatggtggttgaactgtttcggtgataaaatctggagtgacgcaacatgagattgctgaccagcaaacactgcctcattttgacatgaaatacagtattgttttaaaattgagttggattaatacggtcacggctgacatccacagatggttggacgttggagcagctggggccattttgc

SEQ ID NO: 9239 - DNA, 1993 bp, Panicum virgatum
ttatacgctttgcaggtatgtggatgtcggttggatgtgggacaaaacaagttctgacccgcgatatgcatcctctgttgatgttcagtgggatgatgtatatagagcattgagaaatctaaaaagtggtaatccagatctcaaagttggactcttgaattttaatagcactgagtatggctcttggacacagttgttgccggacagccatgtttccattataatacttgagaatgcccaggacagcattacttggcagacactgtatcctgaatggatcgatgaggaggaagaaacggagataccctcctgtccatctctcccagagcccaatgttcgaaaaggtgtacgctttgatgtcattgccgtgaagcttccttgtacccgtgttgcgggttggtcaagagacgttgcacggctccatttgcagctctcagcagcaaaattggctgtggcctcttcgaagcgcaatcacaaggtccatgtgctttttgtaagtgactgcttcccaattccgaatctcttcccgtgcaagaaccttgtgagacatgaaggcaatgcttggttatatagtcctgactcgaaagcattaagggaaaagctccggcttccagtcggatcttgtgagcttgctgttcctctcaaagcaaaatcgagacttttctcagtagatcgacgaagagaagcatatgcaacaatactgcattcagcaagtgagtatgtctgcggtgctatctcagcagctcaaagcattcgccaagcaggatcgactagggatctggtcatccttgttgacgagaccataagtgatcaccaccggagaggattggaatctgcagggtggaaggtcagaataatccaaagaatcaggaacccgaaagctgcgcgtgatgcttacaacgagtggaactacagcaagttcaggttgtggcagctgaccgactacgacaagatcatcttcatcgacgctgacctcctcatcctaaggaatgttgacttcctgttcgccatgccagagatcactgcgactagcaacaacgcaacgctcttcaactccggcgtcatgatcatagagccttccaactgcacgttccagctgctgatggaccacatcaacgagatcacgtcgtacaacggcggggaccaaggttacctgaacgagattttcacatggtggcaccgcatccccaagcacatgaacttcctgaagcacttctgggagggcgacagcgaggagatgaaggcgaagaagactcagctgttcggcgccgatcccccggtcctctacgttctccactacctcggcctgaagccatggctgtgcttcagggactatgactgcaactggaacaacccctcgatgcgcgaattcgctagtgatgtcgcgcacgcccggtggtggaaggtgcacgacaagatgccccgggagctccagtcccactgcctcctgaggtcacggcagaaggccgggctggagtgggaccggaggcaggctgagaaggccaactctgaagacggccattggcgccgcaacatcaccgactccaggctgaagacctgctttgagaagttctgcttctgggagagcatgctgtggcactggggcgagaacagtaacaggacgaagagcagccccgcgacggtgacgacgacggcgagcttggcgagctcatgatctgtagatatacaaacaacttcccatatggcaaccatatatacctgcatagctttagtttgtatagtaccaatgcttcttaggtctctgctatacaaaacatacccctccctgttgctgtcatggctgcagctcgatgtcagctgccggcctgcctcgatggctaacgattcttttgggttggctgagataataagttacttttacatgtaaatttccctgctgaaattctgtgagcgtgagcgagaagtgcatttgtacagggcgccagttaataagcggttaccgcatggaaaatatggctagttgtacagtgta

SEQ ID NO: 9240 - DNA, 2776 bp, Brachypodium distachyon
ttccccttttctgggcttaagcttcccatacgtttttcctcccccccccctctctctctctctctctctataaaactctcttggttctcctccctctgtcttgaggagagctttgtaagtttgcagagcagggagccggagccacacaggcaccacccaccatcgacttcttgttcgtttccgtcttcttcctgctcttctcgccattgccgcagccgccttcctcctccttgcttgcctgcgctccggatgagaagctacgcaaccggagaggcgatagtgcggtcggcctgaggctggaggggcaaccagctccagctcagaggaggcttcaggcagagagagtgaaagcgagtcctcatgggttccttggaggctcggtaccggccggccggagcagctgatgacacagctaagagaaggacccagaaaagcaaaagtttcaaagaggttgagaaatttgatgtctttgtcttagagaaaagctctggctgcaagttccgatccttgcaacttttgctcttcgctatcatgtctgctgcatttctgacactcctatacactccatctgtgtatgagcatcaattgcaatccaattctaggttcgtcaatgttggttggatatgggataagactactcctgatccacgatatgtatcttctctcggtgttcagtgggaggatgtgtatagatctatcgagaatctgaatggtggtgaacataagctgaaggtgggactcttaaattttaacagcactgagtttgggtcttggacacagttgctcccagaaagtgagttctcaatcataaggctggagcatgccaaggaaagcattacctggcagactctgtatcctgaatggattgatgaggaggaagaaacagaaataccatcttgcccatcacttccagaccctaattttccaaggggggcacacttcgatgttattgccgtgaagcttccctgtacccgagttgggggctggtcaagagatgtcgcacgtttgcatttgcagctgtcagcggcaaaattggctgtgacagctgcaagaggtaatcgtggggttcatgtgatgttcgtgactgattgcttccctcttccgaatctgttctcttgcaagaacctaaagaaacatcaaggaaatgcttggctgtacaaacctgacttgaaggcattaaaggagaagcttagacttcctgttggttcctgtgagcttgcagttccactcaaagcaaaatcaagactttactcagtagacaggcgaagagaggcatatgctaccatactgcattcagcaagtgagtatgtctgcggtgcaatcacagcagcacaaagcattcgtcaagctggatcaacaagggactttgttattcttgtcgatgataccataagcgagcaccacaggaagggcctggaagctgcagggtggaaggtcagaataattgagaggatccgaaacccaaaggctgagcgtgatgcttacaatgagtggaactacagcaaattccggttatggcagcttacagattatgacaagatcatattcatagatgccgatctcctcatcctgaggaatatcgattttctgtttgcaatgccagaaatcacagcaactggaaacaatgcaacactcttcaactccggtgttatggttattgagccttcaaactgcacattccagttgttaatggaacatatcaatgagataacatcttacaatggtggtgatcagggatacttgaatgagatattcacatggtggcatcggattccaaagcacatgaatttcttgaagcatttctgggagggtgatgaagaggaagtgaaggtgaagaagactcggctgtttggttctgacccgcccatcctctatgtccttcactatttaggccggaaaccatggctgtgcttccgggactatgactgcaactggaatgtcccaatacttcgggagtttgccagtgacattgcgcatacccgttggtggaaggtgcatgacaagatgcccaagaaacttcagagctactgccttttgagatcaaggctaaaggctgggctggagtgggagcggaggcaggctgagaaggcgaacttcaccgacgggcattggcgacgcaacataaccgaccggaggctgaaaacatgctttgagaaattctgcttctgggagagcatgttatggcattggggcgagaccaccaactcgacgaagaaaaccctgccggcggtgcaggcgttgcccgctgagagcttgtgaagatcaagagatgtgtagatatcctgagaaattagcaaataccagatacatcttcccaagctcccatacatacatagcaacagcttgtaaaggtagctatgcacttaggccttccccttatatacgttcccttctgctgccacacctgcagcagcgctcccgctgctgatccgatggccaacgattttttggtttctggctaataattcgtcagtataggtaaaaattttgtgggcaaggaacttgtttgtgttggctaccgctgctattccacgatagcttagcttttgatgtatggtggttgttgaactgctgcagttggtcttctggcgtgatgcaacattagattgctgaccagtaggcactgctccgtttcatcaatacgaatgtgatgaattgatggtgatgcttctttttggtggctgtaatgggatggaattgggttagttgtaaccgctcgctgtccgaatggctggacagttgagccatgcgtacaaagcagttatagcttaatcat

SEQ ID NO: 9241 - DNA, 1981 bp, Secale cereale
ctccgacacaccaccactcgagctcttcttttgcgtgagtgcgtggagagagagagagagaagaggaggggcgagcagcccattccttgccgcccaccttcccttcgccgcctcacctgcgtcgcggatgagaaggagcgcaccggcggcggcggcggcggcgtgatcctcctcctcactcggagcagaggagaggcgggagaagagcaagaaccgagggggcccaggcccaatggagcagcgccaccgaccggccgcggccgctgatgacacaactaagagaagggccacgaaaagcaaaagtttcaaagatgttgagaactatgaagttcttgtcctggagaagaactgcggttgcaagttcaaatccttgcggtacttgcttatagctattgtttctgcgacatttcttaccctcctgactccgacgctgtacgagcgccaactacaatcaagttctcggtatgttgatgttgactggatatgggacaaaacaagtgctgatccgcgatacgtatcatctgctgatgttcagtgggccgatgtatatacagctatagaagatcttagtgctggtaaccaagagctcaaaattgggctcctgaattttaacagcaccgagtatggctcttggtcgcgcatactccctgaaagccatgtttcgattataaggcttgagcatgccaaggacagcattacttggcctaaactatatcccgaatggatagatgaggaggaagattctgagataccttcctgtccatcatttccagagcctaatgtccgaagaggtgcatggtttgatgttattgctgtgaaacttccctgtacaagggttgcgggttggtcgagagatgttgcaaggctccatttgcagctctcagcggcaaaactggccgtggcctcttcaagaggcaaccggaaggtccatgtgctctttgtgacggactgcttccccatccccaacctcttcccctgcaagaaccttgtgaaacatgaaggcaatgcttggttgtataggcctgatttgaaagcagtaagggaaaagctcaggcttcctgttggatcatgcgagcttgctattccacttaaagcaaaagcaagacttttctcagtcgaccgaagaagagaagcatatgccacgatactgcattcagcaagtgaatatgtatgtggtgctatcacagcagctcagagcatcaggcaagcagggtcgaccagggacttggtcatccttgtcgataacaccataagtgatcaccaccggagaggcttggaagccgcaggctggaaggtgagaataatcgaaaggatcaggaatccaaaagccgagcgtgatgcctacaatgagtggaactacagcaagttcaggttatggcagctgacggactacgacaagatcatattcatagatgctgacctgctcatcctgaggaatgtggacttcctgttcgcgatgccagagatcaccgcgacgggcaacaacgcgaccctcttcaactccggcgtcatggtgatcgagccctccaactgcacgttccagctgctgatggagcacatcaacgagatcacgtcgtacaacggcggcgaccaggggtacctgaacgagatattcacatggtggcaccgcatccccaagcacatgaacttcctgaagcacttctgggagggcgacagcgaggcggccaaggccaagaagacccagctgtttggcgccgacccgccgagcctctacgtgcttcactacctgggcctgaagccatggctgtgcttcagggactacgactgcaactggaacaacttcatgatgcgtgagttcgcgagcgacgtcgcgcaccgccggtggtggaagacgcacgacaagatgccccggaagctccagtcctactgccttctgaggacaaggcagaaggctgggctggagtgggaccggaggcaggcggagaaggcgaacctggaggacgggcactggcggcggaac

SEQ ID NO: 9242 - DNA, 2990 bp, Hordeum vulgare
ctggtccctccacccctccgctgcaagatttggcccttgccgtgcacgccggggacccgacggcaaagactacgtttttcccccaggggtgaaatccattgcccgtttcggtccgctttgcttaacccgctcctgcttccccccttttgtgcgctaagcttcctccccttctctctctctctctctataaaactctctcctcctgcttccaccccctctccctgtgtagagagagggagccggagccacacaccagcgcacagccaccaccaccaccgactgcgtccgtccatccgtctcttcttcctcatcctgccatcgccattgccgccgccgcagcttcctcctccgcagctgcgatacggatgagaagcagcgcgaccggggcagcgactgcgcggtcggcctgaggaccggagaggcaggccggcgggctgcagagctcagctcagctcagaggaggcttcaaccaggcagactgaaaccgagcccccatgggctccctggaggcgcggtaccggccggccggagcagctgatgacacagctaaaagaaggacccagaaaagtaaaagtttcaaagaggttgaaaagtttgatgtatttgttctagagaaaagctctggctgcaagttccggtccttgcaacttttgctcttcgctatcatgtctgctgcatttctgacacttctatacacgccatctgtgtatgagcatcagttgcagtccaattctcggtttgttaatgtcggatggatatgggataagactatccctgatccgagatatgtatcttctatggccgtccagtgggatgatgtgtataaaactatcgaaagtctgaatggtggtgagcagaagctcaaagtcggactcttaaattttaacagcactgagttcgggtcttggacacaattgctcccagaaagtgagttttcgatcataaggttggagcatgctaatgaaagcattacctggcagacgctgtatcctgaatggattgatgaggaggaagaaacagagataccatcttgtccatcgctttcagagcctaatttcccaagaggcacgcattttgatgttattgctgtgaagcttccctgtacccgagttggggggtggtcaagagatgttgcacggttgcatctgcagttgtcagcagcaaaattggccgtgagtgccgctagaggcaaccgtggggtacatgtgatgtttgtgacggagtgcttccctcttccgaatctcttctcttgcaagaatcttaagaaacatgaaggcaatgcttggctatacaagcctgatccgaaggctttaaaggagaagcttagacttccaattggatcttgtgagcttgctgttccactcaaagcaaaatcaagacttttctcggtagaccgacgcagagaagcatatgctaccatactgcattcagcaagtgagtatgtctgtggtgcaatcgcagcagctcaaagcattcgtcaagcaggatcaacaagggactttgttattcttgtcgatgacaccataagtgaccatcaccgaaagggccttgaatctgcgggttggaaggtcagaataattgagaggatccggaacccgaaggccgagcgtgatgcttacaatgagtggaactacagcaagttccggttgtggcagctcacggactatgacaagatcatattcatagatgctgatctgctcatcttgaggaacattgatttcctgtttacaatgccagaaatcagtgcaaccggcaacaatgcaacactcttcaactctggtgtcatggtcatcgaaccctcaaactgcacattccagctgttaatggagcacatcaatgagataacatcttacaatggtggtgatcagggctacttgaatgagatattcacatggtggcatcggattcccaagcacatgaacttcctgaagcatttctgggagggtgatgaagaggaggtgaaggcgaagaagacccagctgtttggcgccaacccaccgatcctctacgtcctccactacctgggccgcaaaccatggctatgcttccgggactatgactgcaactggaacgttccgatactgcgggagtttgccagcgacattgcgcacacccggtggtggaaggtgcatgacaagatgcccaagaagctccagagctactgcctgctgaggtcaaggctgaaggccgggctggagtgggagcggaggcaggcagagaaggccaacttcaccgacgggcactggaagcggaacatcacggacaagaggctcaagatttgcttcgagaagttctgcttctgggagagcatgctgtggcactggggtgaggcccccaactcgacgaagaaggcctcgacgccggcactgcccaccgcgaccctctcaagctcatgatgggatgttgtgtagatattatcctccccgagaaattttagcataccagaagatacagcagactcccagtctctccttgatacatacacaatagcaacagcttgtaaaggtagccatgctgctcctagggctttcctcaacagctatacattttgtttgctgccaatgccttggggtcgcgctctcgttgctgctgctgctgccgctccaaccgcgacggctaacgattttttggttgatggatggatggataataattcgtcgcgtgtaggtaaattttcttgggcaagacttgtctatggctctgcgttggtgcagcagtagttagcttttgtaatgtaatgtaatgtatggtggttgtcgaactgttggttccggcggcgttggtctggggtgatgcaaggttcatattttgctgaccggcggacgccgccgtttctcctttttggcaccatggatgatggacatgaacatgatgatgatgtaatggaattcgggttggttcaactgctcggcgattcggttcgcggcgtacggggagttgttgttccctgtgtgtgcgtcatctgaaatcgtttgcttgtgttgttgttt

SEQ ID NO: 9243 - DNA, 2519 bp, Triticum aestivum
ggcagcgactgcgcggtcggcctgaggccggagaggcaggcaggcaggctgcaaagctcagctcagaccagaggaggcttcatccagacagagtgaaagcgagcccccatgggctccctggaggcgcggtaccggccggccggagcagctgatgacacagctaaaagaaggacccagaaaagtaaaagtttcaaagaggttgaaaagtttgatgtatttgttctagagaaaagctccggctgcaagttccgatccttgcaacttttgctcttcgctatcatgtctgctgcatttctgacacttctatacactccgtctgtgtacgagcatcagttgcagtccaattctcggtttgttaatgttggatggatatgggataagactatccctgatccgcgatatgtatctactatgcccgttcagtgggatgatgtgtataaaactatcgaaagtctgaatggtggtgagcagaagctcaaggtcggactcttgaattttaacagcactgagtttgggtcttggacacaattgctcccagaaagtgagttttcgatcataaggttggagcatgctaatgaaagcattacctggcagacactgtaccctgaatggattgatgaggaggaagaaacagagataccatcttgtccatcgcttccagagcctaatttcccaagagggacacactttgatgttattgctgtgaagcttccctgtacccgagttggcgggtggtccagagatgttgcgcggttgcatctgcagttgtcagcagcaaaattggccgtgactgccgcaagaggcaaccggggggtacatgtgatgtttgtgacggagtgcttccctcttccgaatctcttctcttgcaagaatcttaagaaacatgaaggcaatgcttggctatacaagcctgactcgaaggcattaaaggagaagcttagacttccgattggatcttgtgagcttgctgttccactcaaagcaaaatcaagacttttctcggtagaccgacgcagagaagcatatgctaccatactgcattcagcaagcgagtatgtctgtggtgcaattgcagcagctcaaagcattcgtcaagcaggatcaacaagggactttgttattcttgtcgacgacaccataagtgaccatcaccggaagggccttgaatctgcgggttggaaggtgagaataatcgagaggatacggaacccaaaggctgagcgtgatgcttacaatgagtggaactacagcaaattccggttgtggcagctgacggattatgacaagatcatattcatagatgctgatctgctcatcctgaggaacattgatttcctgtttacaatgccggaaatcagtgcaactggcaacaatgcaacactcttcaactctggtgtcatggttatcgaaccttcaaactgcacattccagctgttaatgaatcacatcaacgagatcacatcttacaatggtggtgatcagggatacttgaacgagatattcacatggtggcatcggattccaaagcacatgaatttcctgaagcatttctgggagggtgacgaagaggaggtgaaggcgaagaagacccagctgttcggcgccaacccgccgatcctctacgtcctccactacctgggccgcaagccatggctatgcttccgggactatgactgcaactggaacgttccgatactgcgggagtttgccagcgacatcgcgcacacgcggtggtggaaggtgcatgacaagatgcccaagaagctccagagctactgcctcctgaggtcgaggctgaaggcggggctggagtgggagcggaggcaggcggagaaggccaacttcaccgacgggcactggaagcggaacatcaccgacaagaggctcaagatttgcttcgagaagttctgcttctgggagagcatgctgtggcactggggcgaggcccccaacaacgcgacgaagaaggcctcgacgccggcgctgcccgccgcgaccctgtcgagctcgtgagatgctgtgtagatatcctcccccgcgaaattttagtataccagatgatgatacagcagacctccccccagtctcctccattccatacaatacacaatagcaacagctttgtaaaggtagccatgcatgctgctcctaggcctttccttcccaacagctatacattttgtttgctgccgatgcctcgggcgcgctctcgctgtcgctgctgctgctccaaccgcgacggctaacgattttttggtttcatcatggatgggtaataattcgtcgcttgtaggtaaacttttccgggcaggacttgtctatggctggctgtgttggcgcagtggtagttagcttttgtaatgtaacgtgtgtatggtggttgttgaactgttggctccggtggcgttggtctggggtgatgcaaggtttagattgctgaccggcggacgccgccgctcctttttggcaccatgggtgatggacatgatatatgatgttgtaatggaatttgggttggt

SEQ ID NO: 9244 - DNA, 2670 bp, Avena sativa
gcgctttgcttaacccgctctcgcttaccacttttctgcgctaagcttcctgtaacattttcccccattctctctctctataaaactctgccgctgcttctcccccctccgtgagagctttgcagagagagggagccggagccacacaaacaccgccaccgactgcgctcatccctgttcttccccgttgttcttgccattgccgcagccgcgtcctccttccccgctgcgctccggatgagaagcagcgcaaccaggaaggcgactgtgcggtgggcctgaggctggagaggcaggcagcaacctcacaggaagagtcttcaggcagaactcaaagcggaagggggagccctcatgggttctttggaggcgcggtaccggccggcgccggccggagcagcagcagctgatgacacggctaaaagaaggacccagaaaagcaaaagtttcaaagaggttgagaagtttgatgtatttgtcctagagaaaagctctggctgcaagttccgttccttgcaacttctgctcttcgctatcatgtctgctgcatttctgacactcctatacactccatctgtgtatgagcatcagttgcagtccaattctgggtttgtcaatgttggatggatatgggataagaccatccctgatccgcgatacgtgtcttctatgggtgttcagtgggaggatgtgtataaaactatcgaaaatctgaatggtggtgagcagaagctcaaggtcggactcttaaattttaacagcaccgagttcgggtcttggacacaattgctcccagaaagtgaattctcgatcataaggctggagcatgcaaaggaaagcattacttggcagactctgtatcctgaatggattgatgaggaggaagaaacagacattccatcttgtccgtctcttccagagcctaattttcccagagggacacactttgatgttattgccgtgaagcttccctgtacccgagttggggggtggtcaagagatgttgcacggttgcatttgcagttgtcagcggcaaaattggctgtgactgctgcaagaggcaatcgtggggtacatgtgatgtttgtgactgattgcttccctcttccgaatctcttctcgtgcaagaatctgaagaaacatgaaggcaatgcttggctatacaagccggacttgaaggcattaagggagaagcttagacttccgattggctcctgcgagcttgctgttccactcaaagcaaaatcaagactttactcggtagacagacgcagagaagcatacgctaccatactgcattcagcaagcgagtatgtctgcggtgcaatcgcagcagctcagagcattcgtcaagctggatcaacaagagactttgtcattcttgtggacgataccataagtgaccatcacaggaagggcctggaagctgcagggtggaaggtcaggataatcgagaggatccggaacccaaaggccgagcgtgatgcctacaacgagtggaactacagcaagttccggctctggcagctcactgattatgacaagatcatattcatagatgcggatctcctcatcctgagaaacattgattttctgtttgcaatgccagagatcagtgcaaccggcaacaacgcaacgctcttcaactctggtgtcatggtgatcgagccttcaaactgcacgttccagctgctgatgaaccacatcaatgagatcacatcctacaacggcggtgaccaggggtacctgaacgagatattcacgtggtggcacaggattccaaagcacatgaacttcctgaagcatttctgggagggtgatgaggactcggtgaaggcgaagaagacgcagctgtttggcgccgacccgccgatcctctacgtgcttcactacctggggcggaagccgtggctgtgcttccgggactacgactgcaactggaacgtcccgatcctgcgggagtttgccagcgacatcgcgcacacccgttggtggaaggtgcacgacaagatgcccaagaagctgcagagctactgcctgctgaggtcgaggctgaaggcggggctggagtgggagcggcggcaggcggagaaggccaacttcgtggacgggcactggaagcggaacatcacggacaagcggctgaagatctgcttcgagaagttctgcttctgggagagcatgctgtggcactggggcgaggcccccaactcgacgaagaagaccgcgacgcaggcgctgcctaccgcgaagctgtcgagctcgtgagagatgtgtatgtagatatcctcctcctccccaccccgagaaattagtataccagatacagactccccaagctccatacatacatagcagcagcagcttgtaaaggtagctatgctctctctctttcctaggcccttcttccccaacagctcctgctatctacaccttgtgcttgccgtcatgcctcattacagcggctgctgctcgtcgacggctaacgagattttttggtttgtgggtaataattctgtcagtatagggtaaatttcctgggcaagagaactgttacttggaccggctatttgtatgtatgcgtatgtatgtatggtggtggttgaactgaactgttccggtggcggtctcctggggtgatgcaaccgactttagattgctgaccagcag

SEQ ID NO: 9245 - DNA, 2478 bp, Secale cereale
cggagccacacacaagcgcacagccaccaccaccgactgctaccgccattgctgccgctgccgcttcctcctcccccgctgcgcttcggatgagaagcagcgcaaccggggcagcgactgcgcggtcggcctgaggccggagaggcaggcaggcaggctgcaagctcagctcagaggaggcttgaagcacacagactgaaagaaagcccccatgggctccctggaggcgcggtaccggccggccggagcagctgatgacacagctaaaagaaggacccagaaaagtaaaagtttcaaagaggttgaaaagtttgatgtatttgttctagagaaaagctctggctgcaagttccgatccttgcaacttttgctcttcgccatcatgtccgctgcatttctgacacttctatacactccatctgtgtatgagcatcagttgcagtccaattctcggtttgttaatgttggatggatatgggataagactatccctgatccgcgatatgtatcttctatgcccgttcagtgggatgatgtgtataaaactatcgaaagtctgaatggtggtgagcagaagctcaaggtcggactcttgaattttaacagcactgagtttgggtcttggacacaattgctcccagaaagtgaattttcgatcataaggttggagcatgctaatgaaagcattacctggcagacactgtaccctgaatggattgatgaggaggaagaaacagagataccaacttgtccatcgcttccagagcccaatttcccaagagggacacactttgatgttattgctgtgaagcttccctgtacccgtgttggtgggtggtccagagatgttgcgcggttgcatctgcagttgtcagcagcaaaattggccgtgacggccccaagaggcagccgtggggtacatgtgatgtttgtgacggagtgcttccctcttccgaatctcttctcttgcaagaatcttaagaaacatgaaggcaatgcttggttgtacaagcctgactcgaaggcattaaaggagaagcttagacttccgattggatcttgtgagcttgctgttccactcaaagcaaaatcaagactttactcagtagaccgtcgcagagaagcatatgctaccatactgcattcagcaagcgagtatgtctgtggtgcaatcgcagcagctcaaagcattcgtcaagcaggatcaacaagggactttgttattcttgtcgatgacaccataagtgaccatcaccggaagggccttgaatctgcgggttggaaggtgagaataatcgagaggatccggaacccaaaggccgagcgtgatgcttacaatgagtggaactacagcaaattccggttgtggcagctgacggattatgacaagatcatattcatagatgctgatctgctcatcctgaggaacatcgatttcctgtttacaatgccagaaatcagtgcaactggcaacaatgcaacactcttcaactctggtgtcatggttatcgagccttcaaactgcacattccagcttttaatggagcacatcaacgagataacatcgtacaatggtggtgatcagggatacttgaacgagatattcacatggtggcatcggattccgaagcacatgaatttcctgaagcatttctgggagggtgacgaagaggaggtgaaggcgaagaagacccagctgtttggcgccaacccgccgatcctctacgtcctgcactatctaggccgcaagccgtggctatgcttccgagactacgactgcaactggaatgttccgatactgcgggagtttgccagcgacatcgcgcacacgcggtggtggaaggtgcatgacaagatgcccaagaagctccagagctactgcctcctgagatcgaggctgaaggcggggctggagtgggagcggaggcaggcggagaaggccaacttcacggacgggcactggaagcggaacatcaccgacaagaggctcaagatttgcttcgagaagttctgcttctgggagagcatgctgtggcactggggcgaggcccccaacaacgcgacgaagaaggcctcgacgccggcgctgcccgccgccgcgaccctgtcgagctcatgagatgtgtggtgtagataccctccccccgagaaattttagtataccagatgatgatacagcagtctcctccatacatacacaatagcaacagcttgtaaaggtatccatgctgctcctaggcctttccttcccaacagctatacattttgtttgctgccaatgcctcgagcccgcgctctcgctgctgctgctccaaccgcggcgctcttgctgccgctgctgctgctccaaccgcgacggctaacgttttttttggttatggatggataatattcgtcgcgtgtaggtacattttcttgggcaagcttgtctatggctgtgttggtgcagtagttagcctttgtaatgtaatgtatgta

SEQ ID NO: 9246 - DNA, 2632 bp, Secale cereale
gactagagagagagagggagccggagccacacaccagcgcacagccaccgactgcgtccgtccgtctcttccccctcctgatatcgccgccattgttgccgccgcttcctcctccgccgctgcgctccggatgagaagcagcgcaaccggggcagcgactgcgcggtcggcctgaggccggagaggcaggcaggcaggctgcaagctcagctcagaggaggcttcaagcacacagactgaaagcgagcccccatgggctccctggaggcgcggtaccggccggccggagcagctgatgacacagctaaaagaaggacccagaaaagtaaaagtttcaaagaggttgaaaagtttgatgtatttgttctagagaaaagctctggctgcaagttccgatccttgcaacttttgctcttcgccatcatgtccgctgcatttctgacacttctatacactccatctgtgtatgagcatcagttgcagtccaattctcggtttgttaatgttggatggatatgggataagagtatccctgatccgcgatatgtatcttctatgcctgttcagtgggatgatgtgtataaaactatcgaaagtctgaatggtggtgagcagaagctcaaggtcggactcttgaattttaacagcactgagtttgggtcttggacacaattgctcccagaaagtgaattttcgatcataaggttggagcatgcgaatgaaagcattacctggcagacactgtaccctgaatggattgatgaggaggaagaaacagagataccaacttgtccatcgcttccagagcccaatttcccaagagggacacactttgatgttattgctgtgaagcttccctgtacccgagttggcgggtggtccagagatgttgcgcggttgcatctgcagttgtcagcagcaaaattggccgtgactgccccaagaggcagccgtggggtacatgtgatgtttgtgacggagtgcttccctcttccgaatcttttctcttgcaagaatcttaagaaacatgaaggcaatgcttggttgtacaagcctgactcgaaggcattaaaggagaagcttagacttccgattggatcttgtgagcttgctgttccactcaaagcaaaatcaagactttactcggtagaccgacgcagagaagcatatgctaccatactgcattcagcaagtgagtatgtctgtggtgcaatcgcagcagctcaaagcattcgtcaagcaggatcaacaagggactttgttattcttgtcgatgacaccataagtgaccatcaccggaagggccttgaatctgcgggttggaaggtgagaataatcgagaggatccggaacccaaaggccgagcgtgatgcttacaatgagtggaactacagcaaattccggttgtggcagctgacggattatgacaagatcatattcatagatgctgatctgctcatcctgaggaacatcgatttcctgtttacaatgccagaaatcagtgcaactggcaacaatgcaacactcttcaactctggtgtcatggttatcgagccttcaaactgcacattccagctgttgatggagcacatcaacgagataacatcgtacaatggtggtgatcagggatacttgaacgagatattcacatggtggcatcggattccaaagcacatgaatttcctgaagcatttctgggagggtgacgaagaggaggtgaaggcgaagaagacccagctgtttggcgccaacccgccgatcctctacgtcctgcactatctaggccgcaagccgtggctatgcttccgggactacgactgcaactggaacgttccgatactgcgggagtttgccagcgatattgcgcacacgcgctggtggaaggtgcatgacaagatgcccaagaagctacagagctactgcctcctgagatcgaggctgaaggcggggctggagtgggagcggaggcaggcggagaaggccaacttcacggacgggcactggaagcggaacatcaccgacaagaggctcaagatttgcttcgagaagttctgcttctgggagagcatgctgtggcactggggcgaggcccccaacaacgcgacgaagaaggcctcgacgccggcgctgcccgccgtgaccctgtcgagctcatgagatgtggtgtagataccctcccccgagaaattttagtataccagatgatgatacagcagacccccccagtctcctccatacatacacaatagcaacagcttgtaaaggtatccatgctgctcctaggcctttccttcccaacagctatacattttgtttgctgccaatgcctcgagcccgcgctctcgctgctgctccaaccatggcgctctcgccgctgctgctccaaccgcgacggctaacgatttttttggtttatggatggataataattcgtcgcgtgtaggtacattttcttgggcgagacttgtctatggctgtgttggtgcagtagttagccttttgtaatgtaatgtatgtatggtgggtgttgaactgttcgttcggcggcgttggtccgggtgatgcaaggttcagattgctgaccggcgggcgccgccgctcctttttggcacgacggatgatggacatgata

SEQ ID NO: 9247 - DNA, 2234 bp, Setaria italica
ctccatttctcccagcgagcccagagctctgtagaagaggagggggacgaaccggagccactcagccgccacctcaccgcaccgactgcctgcctctcctgcttgctgccgcccgctgctctcgccattccagctctatctgctgcagcgcctctcctcctactcgagtctccgccgcctggcctgcctgcctgcctgcctgccggctgccttccggatgagaagcggcgcaaccggggaggcggaagtgtggacggcctgaaccttcgtcggagtcagtgaaagcgccgggaaggaccctggagatcaagcgcatgggttccttggaggcccggtaccggccggccggggcagctgaggacacagctaagagaaggactcagaaaagcaaaagtttcaaagaggtggaaaaatttgatgtttttgtactggagaaaagctctggatgcaaattccgatccttgcaacttctgctctttgctatcatgtctgctgcatttctgacgctcctatacacaccgtctgtgtatgaacatcagctgcaatcaagctctcgacttgtcaatgggtggatatgggacaagagaagttctgatccccgatatgtatcttctgccagcattcaatgggaggatgtatataaaagtatccaaaatctgaatggtggcgaacagaagctcaaagttggactcctgaattttaacagaactgagtttggcgcttggacaaatatgctcccagatagtgatttttcagtcataagactagagcatgccaatgaaagcattacctggcagactctctaccctgaatggatagatgaggaggaagaaacagagataccatcttgcccttcgcttccagatccaaattttccaagagcgactcattttgatgttgttgctgttaagcttccctgtactcgtgtggcgggttggtcaagggatgttgcacggctgcatttgcagttatcagcagcaaaaatagcagcgaccacggcgagaggcaatggtggagtccatgtcctgtttgtgactgattgcttcccgatcccaaatctcttctcttgcaagaacctagtgaaacgtgaaggcaatgcttggctgtacaaacctgacgtgaaggctctaaaggagaagctcaggctgcctgttggttcctgtgagcttgccgttccactgaacgcaaaagcacgactttatacggtggacagacgcagagaagcatatgctactatactgcattcagcaagtgaatacgtttgcggtgcaatcacagcagctcaaagcattcgccaagcaggatcaacaagagaccttgttattcttgttgatgacaccataagtgaccaccaccgcaaggggctggaatctgcggggtggaaggtcagaataatacagaggatccggaatcctaaggctgaacgtgatgcctacaatgaatggaactacagcaaattccggctttggcagcttacagattatgacaaggttatattcattgatgccgatctcctcatcctgaggaatattgatttcctgtttgccatgccagaaatcactgcaacaggcaacaatgcaacactcttcaactctggagtgatggtcattgagccctcgaactgcacgttctctttgctgatggagcacatcaatgagataacatcatacaatggtggtgaccaggggtacctgaatgaaatattcacatggtggcatcgcattccgaaacacatgaacttcttgaagcatttctgggagggtgatgaagaggaagtgaaggcgaagaagactcggttgtttggcgctaacccgccaatcctctatgtccttcactacttggggcggaagccatggttgtgcttccgggactacgactgcaactggaatgttgaaattctgcgggagtttgcgagtgatgttgcgcatgctcgctggtggaaggtgcacaacaagatgccgaagaagcttcagagctattgccttctgaggtcaaggctgaaggccggattggagtgggagcggcggcaggctgagaaagcaaacttcactgatgggcactggaagcggaacataactgatcctaggctgaaaacctgctttgagaagttctgcttctgggagagcatgctgtggcattggggtgagaacaagaccaactcgacaaagaacaacgcggtgcctgtgccgcctaccgcgagcctgtagagctcatgagatctgtagatagctttg

SEQ ID NO: 9248 - DNA, 2568 bp, Pennisetum glaucum
ccgctgctgctctcgccgttcctgctctcgccgctgcagcgcctctcctccctcctcctccagtctccgccgcctggcctgcctctgcgcctgccggctgccttccggatgagaagcggcgcaaccggggaggcggaagtgtggtcggcctgaaccttcgtcggagtcagtgagcgcgcccgggaaggaccctggagatcaagcgcatgggttccttggaggcccggtaccggccggccggggcagctgaggacacggctaagagaaggactcagaagagcaaaagtttcaaagaggttgaaaaatttgatgttttcgtgctggagaaaagctccggatgcaaattccgatccttgcaacttctgctcttcgctatcatgtctgctgcatttctgacgctcctgtacacaccgtctgtgtatgagcatcagctgcaatctagttctcggcttgtcaatgggtggatatgggacaagagaagttctgacccccgatatgtatcttctgccagcattcaatgggagaatgtatataaaagtatccaaaatctgaatggtggcgaacagaagctcaaagttggtctcctgaattttaacaggactgagtttggcacttggacaaatatgctcccagatagtgacttttcagtcataagactagagcatgccaatgaaagcattacttggcagactctctaccctgaatggatagatgaggaggaagaaacagagataccatcttgcccttcgcttccagatcctaattttcctagagcaactcattttgatgttgttgctgttaagcttccctgtactcgtgtggcgggttggtcaagagatgttgcacggctgcatttgcagttatcagcggcaaaaatagcagcgaccacggcaagaggcaatggtggagtccacgtgctgttcgtgactgattgcttcccaattccgaatctcttctcttgtaagaacctagtgaaacgtgaaggcaatgcttggctgtacaaacctgatgtgaaggctctaaaggagaagctcaggttaccggttggttcctgtgaacttgccgttccactgaatgcaaaagcacgactttatacggtggacagacgcagagaagcatatgctactatactgcattctgcaagtgaatatgtttgcggtgcaattacagcagctcaaagcattcggcaagcaggatcaacgagagaccttgtcattcttgttgatgataccataagtgaccaccaccgcaaggggctggaatctgcggggtggaaggtcagaataatagagaggatccggaatcctaaagctgaacgtgatgcctacaatgaatggaactacagcaaattccggctttggcagcttacagattatgacaaggttatattcattgatgctgatctcctcatcctcaggaatatcgatttcttgtttgccatgccagaaatcaccgcaactggcaacaatgcaacactcttcaactctggagtgatggtcattgagccctcgaactgcacattctctttgctgatggagcacatcaatgagataacatcatacaatggtggtgaccaggggtacctgaatgagatattcacctggtggcatcgcattccgaaacacatgaacttcttgaagcatttctgggagggtgatgaagaggaagtgaaggcgaagaagactcggttgtttggcgctaacccgccaatcctctacgtccttcactacttggggcggaagccgtggttgtgcttccgggactacgactgcaactggaatgttgaaattctgcgggagtttgcgagtgatgttgcgcatgctcgctggtggaaggtgcacaacaagatgccgaagaagcttcagagctattgccttctgaggtcaaggctgaaggccgggctggagtgggagcggcggcaggctgagaaagcaaacttcacggatgggcactggaaacggaacataactgatcctaggctgaaaacctgctttgagaagttctgcttctgggagagcatgctgtggcactggggtgagaacaagaccaactcgacgaagaacaacgcggtgccagcgccacctaccgtgagcctgtcgagctcatgagatctgtagatagctttgttgagagagtagtatacccagatacaaaacttctgaagctccatacaatacatagcaacagctttgtaaaggtagctatgtaggccctcttcccgaatgactctatacctcttgttcgccatcactgctccagcggcccctcacgctgcttgccttctgatggctggcaaaattttttggtttctgctaataattcatcagtataggctattttcctttctctgccttttgagtcctggccgccgggtctgtctgttgcttcaaatcccaccggggctctactgctgcgctgtgctgcaacaagtaggtctggtaatttgtttgatgtatggtggttgaacagtttcagtgatggatctggagtgatgcaacatgaagattgctgaccagcaaacacactgcatcgttttggcatgaatgaatacatatgatggtgtcactt

SEQ ID NO: 9249 - DNA, 2744 bp, Secale cereale
gagccggagccacacaccagcgcacagccaccgactgcgtccgtacgtctcttcctcctcctgctgtcgccgccattgctgccgccgcttcctcctccgccgctgcgctccggatgagaagcagcgcaaccggggcagcgactgcgcggtcggcctgaggccggagaggcaggcagccaggctgcaagctcagctcagaggaggcttcaagcacacagagtgaaagcgagcccccatgggctccctggaggcgcggtaccggccggccggagcagctgatgacacagctaaaagaaggacccagaaaagtaaaagtttcaaagaggttgaaaagtttgatgtatttgttctagagaaaagctctggctgcaagttccgatccttgcaacttttgctcttcgccatcatgtccgctgcatttctgacacttctatacactccatctgtgtatgagcatcagttgcagtccaattctcggtttgttaatgttggatggatatgggataagagtatccctgatccacgatatgtatcttctatgcctgttcagtgggatgatgtgtataaaactatcgaaagtctgaatggtggtgagcagaagctcaaggtcggactcttgaattttaacagcactgagtttgggtcttggacacaattgctcccagaaggtgaattttcgatcataaggttggagcatgctaatgaaagcattacctggcagacactgtaccctgaatggattgatgaggaggaagaaacagagataccaacttgtccatcgcttccagagcccaatttcccaagagggacacactttgatgttattgctgtgaagcttccctgtacccgagttggcgggtggtccagagatgttgcgcggttgcatctgcagttgtcagcagcaaaattggccgtgactgccccaagaggcagccgtggggtacatgtgatgtttgtgacggagtgcttccctcttccgaatctcttttcttgcaagaatcttaagaaacatgaaggcaatgcttggttgtacaagcctgactcaaaggcattaaaggagaagcttagacttccgattggatcttgtgagcttgctgttccactcaaagcaaaatcaagactttactcagtagaccgtcgcagagaagcatatgctaccatactgcattcagcaagcgagtatgtctgtggtgcaatcgcagcagctcaaagcattcgtcaagcaggatcaacaagggactttgttattcttgtcgatgacaccataagtgaccatcaccggaagggccttgaatctgcgggttggaaggtgagaataatcgagaggatccggaacccaaaggccgagcgtgatgcttacaatgagtggaactacagcaaattccggttgtggcagctgacggattatgacaagatcatattcatagatgctgatctgctcatcctgaggaacatcgatttcctgtttacaatgccagaaatcagtgcaactggcaacaatgcaacactcttcaactctggtgtcatggttatcgagccttcaaactgcacattccagctgttgatggagcacatcaacgagataacatcgtacaatggtggtgatcagggatacttgaacgagatattcacatggtggcatcggattccaaagcacatgaatttcctgaagcatttctgggagggtgacgaagaggaggtgaaggcgaagaagacccagctgtttggcgccaacccgccgatcctctacgtcctgcactatctaggccgcaagccgtggctatgcttccgggactatgactgcaactggaacgttccgatactgcgggagtttgccagcgacatcgcgcacacgcgctggtggaaggtgcatgacaagatgcccaagaagctccagagctactgcctcctgaggtcgaggctgaaggcggggctggagtgggagcggaggcaggcggagaaggccaacttcacggacgggcactggaagcggaacatcaccgacaagaggctcaagatttgcttcgagaagttctgcttctgggagagcatgctgtggcactggggcgaggcccccaacaacgcgacgaagaaggcctcgacgccggcgctgcccgccgtgaccctgtcgagctcatgagatgtggtgtagataccctcccccgagaaattttagtataccagatgatgatacagcagacccccccagtctcctccatacatacacaatagcaacagcttgtaaaggtatccatgctgctcctaggcctttccttcccaacagctatacattttgtttgctgccaatgcctcgagcccgcgctctcgctgctgctgctccaaccgcggcgctctcgctgctgctgctccaaccgcgacggctaacgatttttttggtttatggatggataataattcgtcgcgtgtaggtaaattttcttgggcaagacttgtctatggctgtgttggtgcagtagttagccttttgtaatgtaatgtatgtatggtgggtgttgaactgttcgttccggcggcgttggtccggggtgatgcaaggttcagattgctgaccggcgggcgccgccgctcctttttggcacgacggatgatggacatgatatgatgttgtaatggaatttgggttggttaaacaaaaaaaaaaaaaaaaaaaaagaaaaaaaaaaaaaaaagaaaaaaaaaaaaaactaaaagagaactagacaagacgacacagggaagtagag

SEQ ID NO: 9250 - DNA, 2777 bp, Sorghum bicolor
cttaaaccagctccccccctttgcttttgcagtggggttatatatctttgctatatatacaactcctcctgctccactcttcaagcccacccagagctctgtagaagaggaggagaggagagagaggaagaggacgaaccggagccactcagccgccacctcaccccgcatcggccgcctgaggtccgtccaaccgctcctgccgccgcccgttgctctcgccattgaagccgtcgccgcctcctccagcccgctcgcttgcctgccttcctgccggctgccttccggatgagaagcggcgcaacctgggcggtgcaagcgtggtcggcctgattcttcgtcggggttaacgccgagaagaggatcctggagtttaagcgcatgggttccttggaggcccggtatcggccggccggggcagctgaggacacagctaagagaaggacccagaaaagcaaaagtttcaaagaggttgaaaaatttgatgtttttgtgctggagaaaagttcaggttgcaaattccgatcgttgcaacttttgctcttcgctatcatgtctgctgcatttctaacactcctatacacaccatctgtgtatgaacatcagttgcagtcaagctctcggcttgtcaatgggtggatatgggataagagaagttctgatccccgatatgtatcttctgccagcattcaatgggaggatgtgtataaaagtatccaaaatctgaatgttggtgaacaaaagctcagtgttggactcctgaattttaatagaactgagtttggcgcttggacacatatgctcccagaaagtgatttttcaatcataaggctagagcatgccaatgaaagcattacctggcagactctgtatcctgaatggatagatgaggaggaagaaacagagataccatcttgcccttcgcttccagatccaagttttccaagagcgacacattttgatgttgttgctgttaagcttccctgttctcgtgtggcgggttggtcaagagatgttgcaaggctgcatttgcagttgtcagcagcaaaattagcggcagccacaacaagaggcaatagtggaatccatgtgctgtttgtgactgattgcttcccaattccaaatctcttctcttgcaaggacctagtgaaacgtgaaggcaatgcatggctgtacaaacctgacgtgaaggctctgaaggagaagctcaggctgcctgttggttcatgtgagcttgctgttcctctcaacgcaaaagcacgactctacacagtagacagacgcagagaagcatatgctacaatactgcattcagcaagtgaatatgtttgcggtgcaatcacagcagctcaaagcattcgtcaagcaggatcaacaagagaccttgttattcttgttgatgacaccataagtgaccaccaccgcaaggggctggaatctgcggggtggaaggtcaggataatagagaggatccggaatcccaaagctgaacgtgatgcctacaatgaatggaactacagcaaattcaggctatggcagcttacagattatgacaaggttatttttattgatgctgatctcctcatactgaggaacattgacttcttgtttgcaatgcctgaaatcactgcaactgggaacaatgcgacactcttcaactccggagtgatggtcattgagccttcaaactgcacattccagttactgatggagcacatcaatgagataacatcttacaatggtggtgaccaaggatacctcaatgagatattcacatggtggcatcggattccaaaacacatgaatttcttgaagcatttctgggagggtgatgaagaggaggtgaaagccaagaagactcgtttgtttggtgctaacccaccgatcctctatgtccttcactacttgggccgaaagccgtggttgtgttttcgggactatgattgtaactggaatgttgaaatcctgcgggagtttgcgagtgatgtagcgcatgctcgctggtggaaggtgcacaacaagatgcccaagaagcttcagagctattgccttctgaggtcaaggttgaaggctgggttggagtgggagcggcggcaggctgagaaagcaaacttcactgatgggcattggaaacggaacataactgatccgaggctgaaaacttgctttgagaagttctgcttctgggagagcatgctatggcattggggtgagaacaagaacaactcgacgcagaacagtgcagtgccggcaacacctactgcgagcctgtcgagctcatgagatttgttgtagatagcttcgttgagagtagtataccggatacaaaacttcccaagctccatacatacatagcaacagctctgtaaaggtagctatgtaggcctttcccccgaatgactatacttttgttcgccgtcacagctgcgccctcccgctgctttctgatggttaacaattcttttggtttttgccaataattcgtcagtataggctgttttttttccctctctggcttgagtcctgtccgggtctgttgcttcaagtcccatgggctattgctttgcagtacgcctggtttgttgtatggtggttgaacagtttcagtgataaatctggagtgatgcaatatcagattgctgaccagcgaacagtgcatcatgttggcatgaatatgatggcgtcgttttttatgccgtagtgaagttggattagcttgattgctagggaccaaaaggatattatttgagtgctgtttgagatgaatgaaccaccct

SEQ ID NO: 9251 - DNA, 2081 bp, Echinochloa colona
ctcctcctcaacgagctccctccgcctggcctgccgcctggcttccggatgagaagcggcgcaaccggggcggcggaagtgtggtcggcctgagcgttcgtcggagtcggtgaaagctccaagaaggatcctggagatcaagcggatgggttccttggaggcccggtaccggccggccggggcagctgaggatactgctaagaggaggactcagaaaagcaagagtttcaaagaggttgaaaaatttgatgtttttgtactggagaaaagttctggatgcaaattccggtccttgcaacttttgctcttcgctatcatgtctgctgcttttctgacgctcctatacactccgtctgtgtatgaacaccagctgcagtcaagctcccgacttgtcaatgggtggatatgggataagagaagttctgatccccgatatgtatcttctgccagcgttcagtgggaggatgtatataaaagtatccaaaatctgaatggtggtgaacaaaagctcaaagttggacttctgaattttaacagaactgaatttggcgcttggacaaatatgctcccagaaagcgatttttcaatcataagactagagcatgctaatgaaagcattacctggcagactctgtaccctgaatggatagatgaggaggaagaaacggagataccatcttgcccttcacttccagatccaaattttccaagagagacacattttgatgttattgctgttaaacttccctgtactcgtgtggcgggttggtcaagagatgttgcacggctgcatttgcagttatcagcggcaaaattggcagcggccactgcaagaggcaatggtggagcccatgtgctgtttgtgaccgattgcttcccgattccaaatcttttctcttgcaaggacctagtgaaacgtgaaggtaatgcctggctgtacaaacctgatgtgaaggctctaaaggacaaggtcaggctaccggttggttcctgtgagcttgctgttccactaaacgcaaaagcacgactctacacagtagacagacgcagagaagcatatgctacgatactgcattcagcaagtgaatatgtttgcggtgcaattacagcagctcaaagcattcgccaagcaggatcaacaagagaccttgttattcttgttgatgatacaataagtgaccaccatcgcaaggggctggaatctgcggggtggaaggtcagaataatacagaggatccggaatcctaaggctgaacgggatgcctacaatgaatggaactacagcaaattccggctatggcagcttacagattacgacaaggttatattcattgatgccgatctcctcatcctcaggaatatcgatttcttgtttgcaatgccagaaatcactgcaactggcaataatgcaacactcttcaactctggagtgatggtcattgaaccctcaaactgcacgttccagttgctgatggagcacatcaacgagataacatcttacaatggtggtgaccaggggtacctgaatgagatattcacatggtggcatcgtatcccaaaacacatgaacttcttgaagcatttctgggagggtgatgaagatgcagtgaaggcgaagaagactcggttgtttggtgctaacccgccaatcctctatgtccttcactacttgggccggaagccgtggttgtgcttccgggactacgactgcaactggaatgttgaaattctgcgggagtttgcaagtgatgttgcgcatgctcggtggtggaaggtgcacaacaagatgccgaagaaactccagagctattgccttctgaggtcaaggcttaaggctgggttggagtgggagcggcggcaggctgagaaagcaaacttcactgatgggcactggaagcggaacataactgatccaaggctaaagatctgctttgagaagttctgcttctgggagagcatgctatggcattggggtgagaacaagaccaactcgactaagaacaacgcggtacctgcgccgcctactgcgagcctgtcgagctcatgagacctgtagatagctttgttgagagagtagtaaa

SEQ ID NO: 9252 - DNA, 3254 bp, Zea mays
gcgccgagaaggatcctggagattaagcgcatgggttccttggaggcccggtacaggccgaccggggcagctgaggacacagctaagcgaaggacccagaaaagcaaaagtttcaaagaggttgagaaatttgatgtttttgtgctggagaaaagttctggttgcaaattccggtcgttgcaacttttgctcttcgctatcatgtctgctgcgtttctaacactcctatacacaccatctgtgtatgaacatcagttgcagtcaagctctcggcttgtcaatgggtggatatgggataagaggagttctgatccccgatatatatcttctgccagcattcaatgggaggatgtatataaaagcatgcaaaatctgaatgttggtgaacaaaagctcagtgttggactcctgaattttaacaggactgagttcagtgcttggacacatatgctcccagaaagtgatttttcagtcataaggctagagcatgccaatgaaagcatcacctggcaaactctgtatcctgaatggatagatgaggaggaagaaacagagataccatcttgtccttcgcttccagatcctagtttttcaagagcgacacactttgatgttgttgctgttaagcttccctgtactcgtgtggcgggttggtcaagagatgttgcaaggctgcatctgcagttgtcagcagcaaaattagcagcagccacagcaagaggcaatagaggaatccatgtgctgtttgtgactgattgcttcccaattccaaacctcttctcttgcaaggacctagtgaaacgtgaaggcaatgcttggatgtacaaacctgacgtgaaggctctaaaggagaagctcaggctgcctgttggttcctgtgagcttgctgttccactcaacgcaaaagcacgactctacacggtagacagacgcagagaagcatatgctacaatactgcattcagcaagtgaatatgtttgcggtgcgataacagcagctcaaagcattcgtcaagcaggatcaacaagggaccttgttattcttgttgatgacaccataagtgaccaccaccgcaaggggctggaatctgctgggtggaaggttagaataatacagaggatccggaatcccaaagccgaacgtgatgcctacaacgaatggaactacagcaaattccggctgtggcagcttacagattacgacaaggtcattttcattgatgctgatctgctcatcctgaggaacattgatttcttgtttgcaatgccggaaatcaccgcaactgggaacaatgcaacactcttcaactctggagtgatggtcattgagccttcaaactgcacgttccagttactgatggagcacatcaacgagataacatcttacaacggtggtgaccaagggtacctgaatgagatattcacatggtggcaccggattccaaagcacatgaatttcttgaagcatttctgggagggtgacgaggacgaagtgaaggccaagaagactcggctgttcggcgccaacccaccgatcctctacgttctccactacttggggcggaagccatggctgtgcttccgggactacgattgcaactggaacgttgagatcttgcgggagtttgcgactgatgttgcgcacgcccgctggtggaaggtgcacaacaagatgccgaagaagcttcagagctattgcctcctgaggtcaaggctgaaggctgggttggagtgggagcggcggcaggccgagaaggcgaacttcaccgacgggcattggaaacggaacataaccgatccgaggctgaagacttgcttcgagaagttctgcttctgggagagcatgctatggcactggggcgagaacaagaacaactcgacgcagagcagcgcggtgccggcaacacctgccgcgacgagcctgtcgagctcgtgaggcctgttgtgtagatacagctttgttgagagtagtataccagatacgaaacttctgaagctcctccatacatacatagcaacagctctgtaaaggtagctatgtaggcctttctcccccccccccccgaatgactatactctttgttcgccgtcacggctgcagcgccccctcctgctgcttcctgatggttgacaattcttttggtttttgccaataattcatcagtataggctgtttttcactctgggcggcttgagtccggtctgggcctgttgttgcttcaaatcctaccggggctactgcttttgctgcggtacgcctggttttgatgtatggtggttgaacagtttcagtgataaatctggagtgatgcaatatgggattgctgaccagcaaacactgcatcatctaaggcatgaatatttatttgatcggttattgtctgagtgctgctgttcgggatgaacgaaaccaccctgactttttgagttgtttgcatgcagcactcgtgtttgtttctggtcgtgtgccaccaagccatggacgcaatgcaagcgttcaaatgccgtgcctccctgcgtcgtactggcacagagcaagcatcatcattgcgtccatcgagagctttggttccgtgcactgctgctgttgcgccaaagaacgagacgcatcattgcccggatccatgatctcgtggtgctgtcgagttccttggaggtgcggtcttttgcagctcatcagcctgctcgcttttccagcagcggcacacctaaaaagcacagggataggctgtatctgcgtgcgacctcgctccggcggtgccgtcgcttcgcctgagacagagacactgtacgtacacctggttgggtccttcccttgtcgctcacgattggagtagttggatgtttgcgttgcaagtgactgagattaggttttctccacgtttgccactacaaaatccgcgagatgcgcgtccagatctgacgcgcagtctagtagtgctacagtaatataatgtatagaaaaaactattgcgcgattaagttttttcgtgcgatcatcgtgtagttaaatgactgaaaattttaaaaatttcttaaatacgagaaattagagtttaaattttaatatagtgatagatcatctgataagttaattgcacaactgttttatggcaatgtatcaggtgcaagccaatactaaaatacgttgccatgttttatataccacaacacacatactccacggagaagatcagaaggctagcactgttactgcatctggaaccactattcttgcctctcccaccgtcacgc

SEQ ID NO: 9253 - DNA, 1228 bp, Glycine max
tgcgtgtgtgtgtgtgcgagagagagagacaacgaccccagacgcttccactctttctttggcggcggcgtcgttttctctacgctttacccattcattcattcattctcaggttcggggcatttcattctgattcactatggccaatggtccagcaccgttttctgagattgggaaaagggcaaaagaccttttatacaaggattacaacttcgatcacaagtttagcctctcaattccaaactccactggattggggcttatagcaacaggattgaagaaggataaactttttgttggtgacataagtacactctacaagagtggaaatactacagtggatgtgaaagttgatacatactctaatatatatacaaaggtgactgtgaatgatatcttgcatggtacaaaagctgctttgagcttcaacatacctgatcacaagtcaggaaagctggatgtgcagtaccttcatcctcatgcagctgttgattctagtattggtttgaatccatcccctctattggagctttcagctgcaattggcagcaaagatctttgtctgggtgctgaagttggatttaatacaacttctgcttcgttcacaaaatataatgctggagttgccttcaataaaccagatttctctgtggcacttatgctggctgataaaggacagaccctgaaggcatcttacattcattatgttgatcgccctgatggatttacggttgctgctgaaatctcccacaggttttcttccttagagaacagatttactattgggagctcgcagtcaatagatccaaagacagttttaaagactcggttcagtgacgatggcaaagctgccttccaatgccaacgagcatggaggccaaattcacttataaccctgtctgctgaatatgactccacgaagatctttggttcatccaccaagttcggtcttgctctagctctcaagccttaacttggcctgcctattaaatcttatttggcgacttcaacttttaccatcatatcattttacattgtttccaaagcccatggtgggttgtgttaagccctatcatatcataaggtaaaccaaagaaactagtaatatttgtgaaatcttctaaagcggcaccgggaaggaggacccagttttgaaatacttgcataatggctagagggttttgtagctggtttattataccatccaggatctagcatatgattttgg

SEQ ID NO: 9254 - DNA, 1676 bp, Glycine max
tcatgtgtaggtctaggtgtgaataggccacgtcaccgttttgagtccggttgtgagtcagttgagagttgagaccgggcctttgcattttcttgcgcagcccatacagactctgcgccctgtgctgcgtgtgtgtgtgtgcgagagagagagacaacgaccccagacgcttccactctttctttggcggcggcgtcgttttctctacgctttacccattcattcattcattctcaggttcggggcatttcattctgattcactatggccaatggtccagcaccgttttctgagattgggaaaagggcaaaagaccttttatacaaggattacaacttcgatcacaagtttagcctctcaattccaaactccactggattggggcttatagcaacaggattgaagaaggataaactttttgttggtgacataagtacactctacaagagtggaaatactacagtggatgtgaaagttgatacatactctaatatatatacaaaggtgactgtgaatgatatcttgcatggtacaaaagctgctttgagcttcaacatacctgatcacaagtcaggaaagctggatgtgcagtaccttcatcctcatgcagctgttgattctagtattggtttgaatccatcccctctattggagctttcagctgcaattggcagcaaagatctttgtctgggtgctgaagttggatttaatacaacttctgcttcgttcacaaaatataatgctggagttgccttcaataaaccagatttctctgtggcacttatgctggctgataaaggacagaccctgaaggcatcttacattcattatgttgatcgccctgatggatttacggttgctgctgaaatctcccacaggttttcttccttagagaacagatttactattgggagctcgcagtcaatagatccaaagacagttttaaagactcggttcagtgacgatggcaaagctgccttccaatgccaacgagcatggaggccaaattcacttataaccctgtctgctgaatatgactccacgaagatctttggttcatccaccaagttcggtcttgctctagctctcaagccttaacttggcctgcctattaaatcttatttggcgacttcaacttttaccatcatatcattttacattgtttccaaagcccatggtgggttgtgttaagccctatcatatcataaggtaaaccaaagaaactagtaatatttgtgaaatcttctaaagcggcaccgggaaggaggacccagttttgaaatacttgcataatggctagagggttttgtagctggtttattataccatccaggatctagcatatgattttgggccaaattttattatttgatacagtgactcatgatcaggtggatttgtcgatgcctgatgtctcatttcatatttattttctccctaatatcttctcatatggctccaattttatcgttctatttctccagctccctcgtctccactggggaataatacaccatgacagtgttcggagaactttcctatgattatcctgagcagttgaataattgcaaattagattatatgttttatatttcggcacctggtttgaattgagcaagagtaagtgatatttttttgaggggttaaataaaatgttacctgtttatttattctgt

SEQ ID NO: 9255 - DNA, 1503 bp, Phaseolus vulgaris
gatgcttgtgagtaggtaggtctaaggaggccacgtcagcactgtttgtgagttgagacccagaccattgcgttttcttccgcagcccaccgagggtttgcaccagtggtgctgcgtgagagagagagagacaacgactcttacgcttccactctttctttggcggcggcgcgtcgttttctctccgcttcactcatcattctttctctggtttggtgcatttcattctgagtcattatggccaatggtccggcaccattttctgatattggaaaaagggcgaaagaacttttatacaaggattacaactttgatcacaagtttagcctgtcaattccaaactccactggattggggcttatagcaacaggattgaagaaggatcaagtttttgttggtgacataagtactctctacaagagtggaaatactacagtggatgtgaaagttgatacatactctaatgtatctacaaaagtgactgtgaatgatgtcttgcatggtacaaaagctgctttgagcttcagcatacctgatcataagtcagggaagctggatgtgcagtaccttcatcctcatgcagccattgattctagtattggtttgaatccatcccctctattggagctttcagctgcaattggcagcaaagatctttgtctgggtgctgaagttggatttaatacaacttctgcttcgttcacaaaatataatgctggagttgccttcaataaaccagatttctcggcagcacttatgctggctgataaaggacagaccttgaagacatcttacattcattatgttgatcgcccagatggatttacagttgctgctgaaatgacacacaggttttccagctttgagaacagatttactattgggagctcacagttcatagatcccaagacagttttgaagactcggttcagtgatgatggcaaagctgcctttcaatgtcaacgagcatggagaccaaattcacttataacactgtctgctgaatacgactccacgaagatctttagttcatccaccaagttcggtcttgctctttctctcaagccttaacttggccattctattaaatctgatttgttgacttcaaattttaccgttatcattttgcattgtttccaaaacgcatggctggttgttttaagccccctatcataaggtaaaccagagaaactagtaatatttgtgaaatctaaagcggcaccgggaaggaggacccagttttgaaattcttcttacataatggctagagggtttgtagcttatttatgatactaccatccaggatctagcatataattttgggaccaaattctataatttgatatagtgactcatggtcaggtagatttgtaagtgcctgatgtctcatttcatatcattttcgtagtaacaacttctcaaacggcaccaattttatcgttctatttcaccaggtccctcatctacacttgagaataaaacttagtcttcggagaacttgtt

SEQ ID NO: 9256 - DNA, 1578 bp, Vigna unguiculata
ggagggaggccacgtcagcactgtttgtgagttgggttgagacccagaacattgcgttttcttccgcagcccacacagagtttgcaccagtgctgctgcgtgagagagtgagacaacgactcttacgctcccacactttctttggcggctgcggcggcgcgtcgttttctctccgtttcactcatcatttcttctctggtttggtgcatttcattctgattcattatgggcaatggtccggctccgttttctgatattggaaaaagggcgagagaccttttgtacaaggattacaactttgaccacaagtttagcctgtcaatcccaaactccactggattggggcttatagcaacaggattgaagaaggatcaagtttttgtcggtgacataagtacactctacaagagtggaaatactacagtggatgtgaaagttgatacatactctaatgtatctacaaaagtgactgtgaatgatatcttgcatggtacaaaagctgctttgagcttcaacatacctgatcacaagtcagggaagctggatgtgcagtaccttcatcctcatgcagccattgattctagtattggtttgaatccatcccctctattggagctttcagctgcaattggcagcaaagatctttgtctgggtgctgaaattggatttaatacaacttctgcttcgttcacaaaatataatgctggagttaccttcaataaaccggatttctctgcagcgcttatgctggctgataaaggacagaccgtgaagacatcttacattcattatgttgatcgccctgatgccttcacagttgctgctgaaatgacgcacaggttttccacctttgagaatagatttactattgggagctcacagttaatagatcccaagacagttttgaagactcggttcagtgacgatggcaaagctgcctttcaatgtcaacgagcatggaggccaaattcacttataactctgtcggctgaatatgactccacaaagatctttagttcatccaccaagttcggtcttgctctttcgctcaagccttaacttggccatcctattaaatctgatttggtgacttcaacttttaccgttatcattttgcattgtttccaaaacccatggttggttgttttaagccccctatcataaattaaaccaaagaaactagtaatatttgtgaattctaaagcggcacagggaaggaggacccagttttgaaatacttacataatggctagagggttttgtagctgatttgtgatactaccatccaggatctagcatatgattttggggccaaattctataatttgatatactgactcatggtcaggtggatttgtaaatgcctgatgtctcatttcatattattttcgcagtcatatcttctcaaatggcacagatattaccgttctatttcaccagctccctcatctacccttgagaataaaaactaggagggttgcaaaacaatttttttgactatcctcagcaattgaatgactgcaagttatattaaatataatttccgtgtctgggttgaatttagctagaggaattaat

SEQ ID NO: 9257 - DNA, 1658 bp, Cajanus cajan
caacgcaagttgaatgagatttacttttttaatttataactaagccggtgagtgtaggtaggactaggtagtaggtctagtaggtgtgaataggccacgtcaccatttgagtgagttgcgaccgggcctttgcattttgttgcgcagcccacagagagagtctgcacccgtgctccgtgtgagagagagacaacgactcagacgcttccactccttctttggcggcggcgtcgttttctctcccccttcacccattcattctctggtttggtgcatttcattctgattcaatatggccaatggtccagcaccttactctgagattggaaaaagggcaagagaccttttatacaaggattacaactttgatcacaagtttaccctatcgattcccaactccactggattggggcttgtagcaacaggattgaagaaggatcaactttttgtgggtgacataagtacactttacaagagtggaaatactacagttgatgtgaaagttgatacatactctaatgtatctacaaaagtaactgtgaatgatatcttgcatagtacaaaagcaactttgagcttcaacatacctgatcataagtctggaaagctggatgtgcagtaccttcatcctcatgcagccattgattctagtattggtttgaatccatcccctctattggagctttcagctgcaattggaagcaaagatctttgtctgggtggtgaagttggatttaatacaacttctgcttcattcacaaaatataatgctggagttgccttcaataaatcagatttctctgcgtcccttatgctggctgataaaggacaaaccctgaaggcgtcttacattcattatgttgatcgcccagatggatttacagtagctgctgaaatctcccacaggttttcttcctatgagaacagatttacaattgggagctcacaattaatagatccaaagactgttttaaagactcggttcagtgatgatggcaaagctgccttccaatgccaacgagcatggaggcccaattcacttgttaccctgtctgctgaatatgactccacgaagatctttagttcatccaccaagttcggtcttgctctttctctcaagccttaacatggcctgcctattgactcttatttggtggcttcaacttttatcattatatcattttacattgtttcgaaaacccatggtgggttgttttaagccctatcatatcataaggtaaaacaaaggaactagaaatatttgtgaaatcttctaaagcggcaccgggaaggacccagttttgaaatacttgcataaatggctagagggttttgtagctgatttatgatactacagttcaggatctagcatatgattttggggttaaattctattttgatatattgactcgtggtcaggtgggttgtggatgcctgatctctcatttcataattttttttcgccgtagtatactgttaacttctcatatggcacaaattttatcgttctatttcaccagctcctcattcaataatggaccagtattcggagaacttcctttggtttatcccgagcaattgaatgattacaaattagatttttaatgtctgttcttcgtttattctgagtgaggaagtgagattttgttgagggggta

SEQ ID NO: 9258 - DNA, 1188 bp, Arachis hypogaea
gagagagacaaagggggttttggctttgcggctgaggcagctcctattccttggtagccgcaacctaatctcaatcgcaatcaatcatctctcgtcggtgtattgcgccgacgtcgttttaccctctcttctcttctagaatacatacattttattctgaaccactatgggtaatggtccagcaccattttctgatattggcaaaagggcaaaagatcttttgtacaaggattacaactttgatcagaagtttagcttgtccatccctagcaccactggattgggccttatagctactggattgaagaaggatcaaatttttgttggtgacataaacaccctttacaagagtggaaatactatagtggatgtgaaagttgatacatactctaatgtaactacaaaaatcacggtgaatgatatcttgcatggtactaaagctgctttgagcttcaatatacctgatcacaagtctgggaagctgtatgtacattatgttcatcctcatgctgccattgattctagtattggcttgaatccatcccctcaattggaggtttctgctgcaattggcagcaaggatctttgtttgggtgctgaagtcggatttaacaccacttctgcttcatttacaaaatacaatgctggaattgctttcaatagaccagatttttctgcagctcttatgttggctgacaaaggacagaacttgaaggcatcctatattcattatgtggatcgcccagatggattaacagtagctgctgaaattactcacaggttttccagctttgaaaacagatttactattgggagttcacagtcaatagatccaattacagtcttaaagactagattcagtgatgatggaaaagctgctctccaagtccagcgagcatggaggccgaattcactaataaccctatctgctgaatatgactccacaaaaatctttggttcatctacaaggcttggtcttggtcttgctctcaagccatgaatctcctttgtctaacaatctattcttctttggtgattttatccttccatctcatcggttttacattgtttccaaaactcatgttgggtgtttaagccctatcatatcattatcataagtcaaaccaaaggataaattgtatttgttaaatcctctacagcggacaaggggaaagaggacccaatttt

SEQ ID NO: 9259 - DNA, 1070 bp, Lupinus angustifolius
gtgaggtacaaattgatttggcgtcgttgtcgtttgtcctcatttttcaactctctcactggtttggtgcatttcattctgattcatcatgaccagtagtccagcgccgttttctgatattggtaaaagggcaagagaccttttatacaaggattacaacttcgaccaaaagtttaccttgcaaattccaagctctactggattgggccttgtagctacagggttgaagaaggatcaaatttttgttggggacatcaataccctttacaagagtggaaatactacagtggatgtgaaagttgatacatactctaatgtatctacaaaagtcactgtgaatgatatcttccatagcacaaaagcagccttgagcttcaatatacctgatcacaagtctggaaagctggatgtgcagtacgttcatccccatgcagccattgattctagtattggcttgaacccatcccctcaattgcagctttcagctgcaattggcagcaaagatgtttgtctaggtgctgaagttggatttaatacagcttctgccacattcacaaaatataatgctggaattgccttcaataagccagatttctctgcagcacttttacttgctgatagaggagaggctctgaaggtgtcttacattcatcatgtggatcgtccagatggatttacagttgctgctgaaatcacccacaagttttcatcctttgacaacaggttcaccattgggagttcaaattcaatagatccgcgtacagttttgaagactcgattcagcgacgatggtaaagctgccttccaagtccaacgagtgtggagaccaaattcgcttataaccctctctggtgaatatgactccaccaagatctttaattcatccaccaagcttggtctttctcttgctctcaagccttgacttggtctgccagttaaaaatttcatttgatgactttaccttccattattttacattgtttcaataacccatgatgggttgttataagccttatcgtagcataagataaaccaagagttagtgacatttgaaaaatcttctaaagcgg

SEQ ID NO: 9260 - DNA, 1210 bp, Lotus japonicus
gcttctacacactcacattgaatcttgcaagtgcggctctgctgtcagctgcgccactgtcagagagaccacgacccacccactccttcctctccttcctttggcggcagcggcggcgttttctcccctcctccggtttggtgcatttatcctgactcattatggctaatggtccagcgctgtatcctgagattggcaaaagggcaagagacctcttgtacaaggattataactttgatcaaaagtttaacctgtcaattccaagctccactggattgggccttatagctacagggttgaagaaggatcaaattttcattggtgacataaatacgctttacaagagtgggaatcttactgtggatgtgaaagttgatacatactctaatgtatcgacaaaagtgactttgaatgatatcttccgttgtaaaaaagtagctttgagcttcaatatacctgatcacaagtcaggaaagctggatgtgcagtatcttcatcctcatgcagccattgattcgagtattggcttgaatccatcccctcaattggagctttcaactgcaattggcagcaaagatctttgtatgggtgctgaagttggattcaatacaacttctgcttcgttcacaaaatataatgctggaattaccttcaatagaccagatttctctgcagcgctcatgctggttgataaaggaaagtccctgaaagcatcttacattcatcatgtggatcgccctgatggatttacagttgctgctgaaatcaatcacaggttttcctcctttgagaacagatttacaattgggagctcacagttaatagatccaaacacagttctcaagactcgattcagcgatgatggcaaagccgccttcctatgccaacgagcatggaggccgaaatcacttataaccctctctgctgaatatgactccaccaagatctttggttcatccaccaagctcggtcttgccctcgctctccagccttaacctggtcttccaattaaaatctcattattcgctgacattcacttttgcaatcatcattatacattgtttccagaacccatgatgggttgttttaaagccttgtcataaaggtaaaaccaaaggaattagtaacatttgtgaaatctgctaaagtggcagggagaaagaggacccagttttgaaatacttacataatggctagaggttttttagct

SEQ ID NO: 9261 - DNA, 1310 bp, Lupinus angustifolius
cacacacaccaaactattatattcaatagagagaagaaagagagaacggtcgaagcgttcctttgatttacggcgtcgtcgttttctctcctttttcaaatctctcttaactgtttggcgcatttcattctgactcattatggccaataacccagcgcctttttctgatattggcaaaagggcaagagacctcttatacaaggattacaactttgatcaaaagtttaccctgcatattccaagctctactggattgggccttgtagctacagggtcgaagaaggatcaattttttgttggtgacataaataccctttacaagagtggaaatactacggttgatgtgaaagttgatacatactccaatgtatctacaaaagtcactgtgaatgatatcttccacagtacaaaagcagcgttgagcttcaatgtacctgatcacaagtctggaaagctggatgtgcagtaccttcatcctcatgcagccattgactctagtattggcttgaatccctcccctcaattggagctttcagcagcgattggtagcaaagatctttgtctaggtgctgaagttggatttaatacaacttctgcctcattcacaaaatataatgctggaattgccttcaacaaaccagatttctctgcagcacttttactggttgatagaggacaggccctgaaggcatcttacattcattatgtggatcgcccagatggatttacaattgctactgaaatcactcacaggttttcgtccttcgagaacagatttaccattggtagctcaaagtcaatagatccccatacaattttaaagactcgattcagcaacgatggcaaagctgctttccaagtccaacgagcgtggaggccaaattcacttgtaattttgtctggggaatatgaccctacgaggatctttagttcatccaccaagcttggtctttctcttgctctcaagccttgacttggtatgccagttatatctcatttgttgactttacccttcccatcattttacattgtatccagaacccatgatgggttgttataagccttattatatctattataaggtaaaccaagagaattagtgacatttgttaaatcttctgcaagggggaaaggacccaattttgcaattcttacataataatgcctcgaatttttgtaactatggtgttgttgtgcattacatctttgctattgcaattcttccatatccaaactagcaggaaaactcttccaaaactaccacttgtgtctctagtaagacatgctaccactttaaatctgttattgag

SEQ ID NO: 9262 - DNA, 1674 bp, Trifolium pratense
attcttttgcattttatcaaacttattttaatttcaatcaaacttaagtttgtaatctatttcaagtttatatttgcagcaactgtcgcttgctcacacttgtatgagaagcaacaagtagtagtagtggcactgaatctttctcgccgtaaaaagcaaaagctgctcggaaaacgccgccggacttaatcgccggcaccacaaactgttttggtgcagttcattctgattcaatatggccaatggtccagcaccgttttccgagattggcaaaagagcaagagacctgttgtacaaggattataacttcgaccacaagtttatcttttcagtgccaaattccactggattgggtcttacagctacagggttgaagaaggatcaattttttgttggtgacataagtggactttacaagagtggaaacgttgcagtggatgtcaaagttgatacacacaataatgtatctacaaaagtgactttgaacgatgttttccacagtaaaaaggtagctttgagcttcaatatacctgatcacaagtcaggaaagttggatgtgcagtatcttcatcctcatgcagccattgattccagtattgacttgaacccggcccctcgattggagctttcagctgcaattggaagcaaagatatatctatgggtgctgaagttggattcaatacaacttctgcttcattcacgaaatataatgccggaattgccttcaataaaccagatttctctgcaacacttatgctggctgataaaggagaggccctgaaggcatcatacattcattatgtggaccgcccagatgaattaacagttgctgctgaacttgctcacaaactgtcctcatccgagaacagattcaccattggaacctcacaattaatagatccaaaaacagttttgaagactcgattcagtgatgatggtaaagctgccttccaatgccaacgagcgtggaggccaaattcactcataaccctgtctgctgagtacgactccacaaagatctttggttcacctgccaaatttggtcttgctctttctctcaagccttaaactggtttgccaattaaaccctatttaataacttttaaactttagcattctatcattttacactgttgccattacccctggagggatgtttcaagccctatcatatcataaggtaaaccaaaggaatcagtatcatttgtgaattcttctaaagcaacatgggaaagagacccagttttgaaaacttacataatgacatttttgtagccaatttatagtactgccattcaatatctgacatatgcttttggggccaaattttatttatttcaaaacgattcatagtgacgtggataattggtgcctgaggtctaatttcattattttagtaacatcttctcatataacccaactttggtttatcattctattcctctgagcagttgaatggttacaaaggggatgttttgtactaaggatgtagtatgaataggagtaataaggtgctggagatgaatacattggtttgtgtgaataaattcaatggtatgtattatcttttttgagatgatcacattttggatactgatgtttattaaggcacgtttgattaagattactctaatagttaaaacttgtatcatattcgttgcaattccacctgt

SEQ ID NO: 9263 - DNA, 1360 bp, Trifolium pratense
gttttggtgcatttcattctgattcattatggccaatggtccagcaccgttttccgagattggcaaaagagcaagagacctcttgtacaaggattataactacgaccacaagtttatcttttcagttccaaattccactggattgggccttacagctacaggattgaagaaggaccaattttttgttggtgacataagtggactttacaagagtggaaatgttgcagtggatgtcaaagttgatacacacaataatgtatctacaaaagtgactttaaacgatgttttccacagtaaaaaagtagctttgagcttcaatatacctgatcacaagtcaggaaagttggatgtgcagtatcttcatcctcatgcagctattgattccagtattggcttgaacccggcccctcgattggagctttcagctgcagttggaagcaaagatatatctatgggtgctgaagttggattcaatacaacttctgcttcattcacgaaatataatgccggaattgccttcaataaaccagatttctctgcaacacttatgctggctgataaaggagaggctctgaaggcatcgtacattcattatgtggaccgcccagatggattaacagttgctgctgaacttgctcacagactgtcctcctccgagaacagattcaccattggaacctcacagttaatagatccaaaaacagttttgaagactcgattcagtgatgatggtaaagctgccttccaatgccaacgagcgtggaggccaaattcactcataaccttgtctgctgagtacgattccacaaagatctttggttcacccgccaaatttggtctcgctctttctctcaagccttaaactggtttgcaaattaaaccttatttgataacttcttaactttagcattctatcattttacactgttgccattacccctggagggatgtttcaagccctatcatatcataaggtaaaccaaagaaatcagtatcatttgtgaattcttctaaagcgacatgggaaagagacccagttttgaaaacttacataatgacatttttttgtagccagtttatttattgtactgccattcaatatttgccatatgattttggggccaaattttatttatttcaaagtgattcatagtgacgtggataattggtgcctgaggtctaatttcattattgtagtttatcattctattcctctgaatggttacaaaatagatgtattgtaccaaggatgcagtatgaatgaataggagtaataaggtgctgcagatgaatacattggtctatatgaataaattaaatgctatgtattatcttttttgagatgattacattttggata

SEQ ID NO: 9264 - DNA, 1400 bp, Trifolium pratense
agccggacttatcaccggccgccacaaactgtaaaaaagttttggtgcatttcattctgattcatcatggccaatggtccagcaccgttttccgagattggcaaaagggcaagagacctcttgtacaaggattataactacgaccacaagtttatcttttcagtgccaaattccactggactgggccttacagctacagggttgaagaaggatcaattttttgttggtgacataagtggactttacaagagtggaaatgttgcagtggatgtcaaagttgatacacacaataatgtatctacaaaagtgactttaaacgatgttttccacagtaaaaaagtagctttgagcttcaatatacctgatcacaagtcaggaaagttggatgtgcagtatcttcatccccatgcagctattgattccagtattggcttgaacccggcccctcgattggagctttcagctgcaattggaagcaaagatatatctatgggtgctgaagttggattcaatacaacttctgcttcattcacgaaatataatgccggaattgccttcaataaaccagatttctctgcaacacttatgctagctgataaaggagaggccctgaaggcatcatacattcattatgtgaaccgcccagatggattaacagttgctgctgaacttgctcacaaactgtcctcctccgagaatagattcaccattggaacctcacagttaatagatccaaaaacagttttgaagactcgattcagtgatgatggtaaagctgccttccaatgccaacgagcgtggaggccaaattcactcataaccctgtcagctgagtacgactccacaaagatctttggttcacccgccaaatttggtctcgctctttctctcaagccttaaactggtttgcaaattaaaccttatttgataacttcttaactttagcattctatcattttacactgttgccattacccctggagggatgtttcaagccctatcatatcataaggtaaaccaaagaaatcagtatcatttgtgaattcttctaaagtgacatgggaaagagacccagttttgaaaacttacctaatgacattttttttgtagccagtttatttatagtactgccattcaatatttgccatatgattttggggcccaattttatttatttcaaaatgattcatagtgacgtggataattggtgcctgaggtctaatttcattattgtagtttatcattctattcctctgagcagttgaatggttatgtattgtactaaggatgcagtatgaataggagtaataaggcgctggagatgaatacattggtttatatgaataaattcaatgctatgtattatcttttttgagatgattacattttggatagtgata

SEQ ID NO: 9265 - DNA, 1545 bp, Trigonella foenum-graecum
cagctccataagttttttgaacagctgccactctgtccaagcaggcgtcgcactgaacctagctgcccatagaaaacgcagccggacttggtcgtcgccgccacaatcaggtttagtgcatttcattctgattcagtatggcaaatggtccagcaccgttttctgagattggaaaaagagcaagagaccttttgtacaaggattataacttcgaccacaagtttagcctgtcgattccaagttccactggattgggccttacagctacagggttgaagagggatcaattttttgctggtgacataaacacgctttacaagagtggaaatgttacagtggatgtgaaagtcgatacagaatctaatgtatctacaaaagtgactttgaacgatgtttccctttcccatagtaaaaaagtagctttgagcttcactatacccgatcacaagtcaggaaagttggatgtgcaatatcttcatccccatgcagctattgattccagtattggcttgaacccagcccctcaattggagctttccgctgctattggaagcaaagatatatctatgggtgctgaagttggattcaatacaacctctgcttcattctcaaaatataatgctgggattgccttcaataaaccagatttctctgcaacacttatgctggctgataaaggggagtccctgaaggcgtcttacattcattatgtggaccgaccagatggattaacagttgctgctgaactcgctcacaggttgtcctcctctgagaacagatttaccattgggacctcacagtcaatagatccaaaaacagttttgaagactcgattcagtgatgatggtaaagctgccttccaatgccaacgagcgtggaggccaaattcactcataaccctatctgccgagtatgactccaaaaaatcattggttcacccgccaaatttggtcttgctctttctctcaagccttaaactggtttgccaatcaaatcgtattcaatgactttttaactttaccattctatcattttacgttgttgccattaccccctggtgggatgttttaagccctctcatatcataaggtaaaccaaaggaatcagtataatttgtgaaatcttctaaagcggcacagggaaagagacccagttttgaaaacttacacaatgattagaatttttgtagccgattttttgtagtgccattcaatatctggcatatgattttggcgataaacctttttctcctagtgattcatgatcaggtggatagaagatgtctgaggtctaatctcattattttacataacatctcatatgtaccaattgtggtttatcattctattcctccagcacttcatatcttcggaataatacgcatcccagagtatggtgctgaatgatttcaacttagatgttttatactaagtctaaggatgtagagtaaatgaggtgttggagatggatacatatggcgtatgtgaataaattcaatggtgtgtattttgattgagattgatatttaataagggcctgtttgat

SEQ ID NO: 9266 - DNA, 1524 bp, Medicago truncatula
caaacccagcagctccataaaaaaatgcagtagctggacactttgctcttgtatcagaaacgagcagccagtacttcgccacgaacaggtttagcacatttcatcctcattcattatggctaacggtccagcaccgttttctgagattggcaaaagagcaagagacctcttgtacaaggattataatttcgaccacaagtttagcctgtcgattccaagttccactggattgggccttacagctacagggttgaagagggataaattttttgttggtgacttaaacacgctttacaagagtggaaatgttacagtggatgtgaaagtcaatacagactctaatgtatctacaaaagtgactttgaatgatgtttccctttcccatagtaaaaaagtagcgttgagcttcaatatacctgatcacaagtcaggaaagttggatgtgcagtatcttcatcctcatgcagctattgattccagtattggcttgaacccagcccctaaattggagctttccgctgcaattggaagcaaagatatatctatgggtgctgaagttggattcgatacaacctctgcttcattctcaacatataatgccgggattgccttcaataaaccagatttctctgcaacacttatgctggctgataaaggacagtctctgaaggcatcttacattcattatgtggaccgcccagatggattaacagttgctgctgaactcgctcacaagttgtcctcttctgagaacagatttacctttgggacctcacagtcaatagatccaaaaacagttttgaagactcgattcagtgatgatggcaaagctgccttccaatgccaacgagcgtggaggccaaattcactcataaccctatctgccgagtatgactccaaaaaaatcattggttcacctgccaaattcggtctcgctctttctctcaagccttaaactggtttggcaatcaaatcttattcaacgactttttaactttaccattctatcattttacattgttgccattacctctggtgggatgttttaagccctctcatatcataaggtaaaccaaaggaatcaatataatttgtgaaatcttctaaagcggcacaggggagagacccggttttgaaaacttacataatgattagaatttttgttgccgatttattgtgctgccattctatatctggcataagttgtgggataaacgttttttccctagtgattcatggtcaggtgaatagtggatgtctgaggtctaatctcattattttacacaacatcttctcatatgaaccaattgtggtttatcattctattcctttaacacttcatctacagaaaaatacgcatctcgagcagttgaatgattacaatttagatgttttatactagggatgtagtatgcataagagtagatgaggtgctggagacggattcatatggtgtatgtgaataaattcaatgatatgtattatctttttgacgtggttacatattggatattgatgttcaga

SEQ ID NO: 9267 - DNA, 1149 bp, Leymus cinereus x Leymus triticoides
ctccccacacaccaaccccccaggcggctcccctccccagtcgtccgctccgccgtgcccccccaccgccgacgccgcagcccccccgtcggcagccgttcgtttcgagaaaccacagccactgaagatggcgcagcctgctgagctttcccgcgaggagaatgtgtacatggctaagcttgcagagcaggctgagaggtacgacgagatggttgagttcatggagaaggtggccaagaccgttgactccgaggagctcaccgtcgaggagcgcaaccttctatcagttgcttacaagaatgttattggtgcccgccgtgcctcgtggcgcatcatttcctccatcgagcagaaggaagagagccgtggcaatgaggaccgtgtcacactcatcaaggactaccgtggaaagatcgaggttgagctcactaagatctgtgatggtatcctcaagcttcttgattcccaccttgtcccctcatctaccgctccagagtccaaggtcttctacctgaagatgaagggtgattactataggtaccttgcggagttcaagagtggaactgagaggaaggatgctgctgagaacaccatggtggcatacaaagctgctcaggagattgcactggcagagctgcccccgactcatcctattaggcttgggctggcactcaacttctcggtgttctattatgagatcctcaactctcctgaccgtgcttgtgacctcgccaagcaggcttttgacgaggccatctcggaactggactctctgagcgaggagtcctacaaggacagcactttgatcatgcagcttctgcgtgataacctgacgctgtggacttctgacatctcggaggacgctgctgaagaaatgaaggatgctcccaagggtgaatctggagatggacagtaaacattgtctatgtgtccagaaacttgtctttctcgcttgttcagtgtagattgtaatgtcattgtggttgttggtaattggaggctccaatttgtgttgtgatagggaagcttgtagctgccttgcttgctcgacggcctgattatccggctgcactggttattgcctcttgttgaacctttctgtcaccttggtggttttagaaactttctgctgctcttccttgtgggtca

SEQ ID NO: 9268 - DNA, 1142 bp, Pseudoroegneria spicata
gcggctcccctccccagccgcgccgcgccacccccgacgccgcagctcctccgccggcagccgttcgtctcgaggttgaccttcggtgaccattagaaaccacagacactgaagatggcgcagcctgctgagctttcccgcgaggagaatgtgtacatggctaagctcgcagagcaggctgagaggtacgaggagatggttgagttcatggagaaggtggccaagacagttgactctgaggagctcaccgtcgaggagcgcaaccttctatcagttgcttacaagaatgttattggtgcccgccgtgcctcgtggcgcatcatttcctccatcgagcagaaggaagagagccgtggcaatgaggaccgtgtcacactcatcaaggactaccgtggaaagattgaggttgagctcactaagatctgtgatggtatcctcaagcttcttgattcccaccttgtcccctcatctactgctccagagtccaaggtcttctacctgaagatgaagggtgattactataggtacctcgcagagttcaagagtgaaactgagaggaaggatgctgctgagaacaccatggtggcatacaaagctgctcaggagattgcactggcagagctgcccccgactcatcctattaggcttgggctggcactcaacttctctgtgttctattatgagatcctcaactctcctgaccgtgcttgtgaccttgccaagcaggctttcgacgaggccatctcggaactggactctctgagcgaggaatcctacaaggacagcactttgatcatgcagcttctgcgtgataacctgacgctgtggacttctgacatctcggaggatgctgctgaagaaatgaaggatgctcccaagggtgaatctggagatggacagtaaacattgtgtctatgtgtccggaaacttgtctttctcgcttgttcagtgtagattgtaatgtcatcgtggttgttggtaattggaggctccaatttgtgttgtgatagggaagcttgtagctgccttgcttgctcgacggcccgactatcgggctgcactggttattgcctcttgttgaacctttgtgttacttttggtggttttagaaattttctgctgctcttgtttgtggcccaaaa

SEQ ID NO: 9269 - DNA, 1109 bp, Secale cereale
cgccaccgccgacgccgcagtcccgccgccggcagccgttcgtctcgagattgaccttgaccagtagaaacagacactgaagatggcacagcctgctgagctttcccgtgaggagaatgtgtacatggctaagcttgcagagcaggctgagaggtacgaagagatggttgagttcatggagaaggtggccaagacagttgactctgaggagctcaccgtcgaggagcgcaaccttctatcagttgcttacaagaatgttatcggtgcccgccgtgcctcgtggcgcataatttcctccatcgagcagaaggaagagagccgtggcaacgaggaccgtgtcacactcatcaaggactaccgtggaaagattgaggttgagctcaccaagatctgtgatggtatcctcaagcttcttgattcccaccttgtcccctcatccaccgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactctccagaccgtgcttgtgacctcgccaagcaggctttcgatgaggccatctcggaactggactctctgagcgaggagtcctacaaggacagcacattgatcatgcagcttctgcgtgataacctgacactgtggacttctgacatctcggaagacgctgctgaagaaatgaaggatgctcccaagggtgaatctggagatggacagtagtaaacactgtctgtgtgcccagaaacttgtctttctcgcttgttcagtgtagattgtaatgtcatcgtggttgctggtaattggaggctccaatttgtgttgtgatagggaagcttgtagctgccttgcttgctcgaccgcctgattatcgggctgcactggttattgcctcttgttgaaccttttgtgttactttggtggttttagaaattttctgctgctcttgtttatgatccct

SEQ ID NO: 9270 - DNA, 2373 bp, Secale cereale
cccccctactcctcctggtgtcttcgttcgagtcttctgttttagttttttttttttggagtacaatctcatctcttttcattatttgattgacttgagaaaattaacactaggcatgaatacgcaatcaaaatccgaccacagcagcaagtactaagtacgtactgtactttgtaactcctcaatatcctgatacagttcgaacgtcgtgcatggtacacgcgcacgatggaaacgggtcgaactaaacaaatcagtgaattcaagcggtgagctcctcctccttgtgggtctcgatgacgaggtccgaggtggggtacgcggcgcaggtgagcacccaccccgcctcgatctggtcgtcgtcgaggaagctctggtcggactggtccagctggccggagatcaccttcccggcgcaggaggagcaggagccggcgcggcaggagtagggcaggtcgatcccttcctcctcggcgtggtcgaggatgtagacgtcgtcggggacctcgaggtccacctcgccctccggcgtgatcagcttcaccttgtacgtcgcctgcgcgcggagcctcatgcccctggcggccgtcgacgacagcgggagcgccacgcgggatgccaagggcgccgacggggcggcggggcagacggagaagggcaagcggaggctgctcaccacggtggccattgcggcggagctgcgagctagctagcttgggaagtactactccgtcgtcgcggaaaacctctgtggaactggtccacgctgcggagatcacttccggcgcaggaggagcaggagccggcgcggcaggatagggcaggtcgatcccttcctcctcctcccgacctcccacccacctaccagcccctccaccaagcccagccgcgccgcgccaccgccgacgccgcagctcctccgccgccggcagccgttcgtctcgagattgaccttgaccagtagaaacagacactgaagatggcgcagcctgctgagctttcccgtgaggagaatgtgtacatggctaagcttgcagagcaggctgagaggtacgaagagatggttgagttcatggagaaggtggccaagacagttgactccgaggagctcaccgtcgaggagcgcaaccttctatcagttgcttacaagaatgttatcggtgcccgccgtgcctcgtggcgcatcatttcctccatcgagcagaaggaagagagtcgtggcaatgaggaccgtgtcacgctcatcaaggactaccgtggaaagattgaggttgagctcaccaagatctgtgatggtatcctcaagcttcttgattcccaccttgtcccctcatccactgctccagagtccaaggtcttctacctgaagatgaagggtgattattataggtaccttgcagagttcaagagtggaactgagaggaaggatgctgctgagaacaccatggtggcatacaaagctgctcaggagattgcactgaaagagctgcccccgactcatcctattaggcttggcctggcactcaacttctcggtgttctattacgagatcctcaactctccagaccgtgcttgtgaccttgccaagcaggcttttgacgaggccatctcggaactggactctctgagcgaggagtcctacaaggacagcactttgatcatgcagcttctgcgtgataacctgacactgtggacttctgacatctcggaggatgctgctgaagaaatgaaggatgctcccaagggtgaatctggagatggacagtaaacactgtcgatgtgcctcgaaacttgtctttctcgcttgttcagtgtagattgtaatgtcatcgtggttgctggtaattggaggctccaatttgtgttgtgatagggaagcttgtagctgccttgcttgctcaacggcctgattatcgggccgcactggttattgcctcttgttgaacctttgtgttactttggtggttttagaaattttctgctgctcttgtttatgatcccctgtcttcgttttcttctttcgggacgggcgtcttctgaaccctttccgctttgccaagtcttgttcccatgttatgggagtttcgctgcattcttcaccgtgcacagtgctcttaaaacacatttcctacatctggttcaaggaatggcatgcaagtgttgcgatttcttggtgggagtattatttatctcatggcatatgaaaatggagacgaaagcaacaaatttgcaactagcttacgttatgttaacctgatagctttctacaggtgctatccgtaatcttatgaacatcctgagttgtaaaaaggtttccatagcgattacagtgaaaggtccatccactatttctgctgtttaattgcatatata

SEQ ID NO: 9271 - DNA, 1058 bp, Secale cereale
cggcagccgttcgtctcgagattgaccttgaccattagacagacactgaagatggcgcagcctgccgagctttcccgtgaggagaatgtgtacatggctaagcttgcagagcaggctgagaggtacgaagagatggttgagttcatggagaaggtggccaagacagttgactccgaggagctcactgtcgaggagcgcaaccttctatcagttgcttacaagaatgttatcggtgcccgccgtgcctcgtggcgcatcatttcctccattgagcagaaggaagagagccgtggcaatgaggaccgtgtcacactcatcaaggactaccgtggaaagattgaggttgagctcaccaagatctgtgatggtatcctcaagcttcttgattcccaccttgtcccctcatccactgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttggcctggcactcaacttctcggtgttctattatgagatcctcaactctccagaccgtgcttgtgacctcgccaagcaggcttttgacgaggccatctcggaactggactctctgagcgaggagtcctacaaggacagcactttgatcatgcagcttctgcgtgataacctgacgctgtggacttctgacatctcggaagacgctgctgaagaaatgaaggatgctcccaagggtgaatctggagatggacagtaaacactgtcgttgtgtccagaaacttgtctttctcgcttgttcagtgtagattgtaatgtcatcgtggttgctggtaattggaggctccaatttgtgttgtgatagggaagcttgtagctgccttgcttgctcgacggcctgattatcgggccatactggttattgcctcttgttgaacctttgtgttactttggtggttttagaaattttctgctgct

SEQ ID NO: 9272 - DNA, 1184 bp, Secale cereale
acaccattattttcctcctcctcctcccgaccacccacccacctaccagcccctccaccaagcccagccgcgccgcgccaccgccgacgccgcagtcccgccgccggcagccgttcgtctcgagattgaccttgaccagtagaaacagacactgaagatggcacagcctgctgagctttcccgtgaggagaatgtgtacatggctaagcttgcagagcaggctgagaggtacgaagagatggttgagttcatggagaaggtggccaagacagttgactccgaggagctcaccgtcgaggagcgcaaccttctatcagttgcttacaagaatgttatcggtgcccgccgtgcctcgtggcgcatcatttcctccatcgagcagaaggaagagagccgtggcaatgaggaccgtgtcacgctcatcaaggactaccgtggaaagattgaggttgagctcaccaagatctgtgatggtatcctcaagcttcttgattcccaccttgtcccctcatccactgctccagagtccaaggtcttctacctgaagatgaagggtgattattacaggtaccttgcagagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactccccagaccgtgcttgtgacctcgccaagcaggctttcgatgaggccatctcggaactggactctctgagcgaggagtcctacaaggacagcacattgatcatgcagcttctgcgtgataacctgacactgtggacttctgacatctcggaagacgctgctgaagaaatgaaggatgctcccaagggtgaatctggagatggacagtagtaaacactgtctgtgtgcccagaaacttgtctttctcgcttgttcagtgtagattgtaatgtcatcgtggttgctggtaattggaggctccaatttgtgttgtgatagggaagcttgtagctgccttgcttgctcgaccgcctgattatcgggctgcactggttattgcctcttgttgaaccttttgtgttactttggtggttttagaaattttctgctgctcttgtttatgatccct

SEQ ID NO: 9273 - DNA, 1229 bp, Secale cereale
gccgttcgtctcgagattgaccttgaccagtagaaacagacactgaagatggcacagcctgctgagctttcccgtgaggagaatgtgtacatggctaagcttgcagagcaggctgagaggtacgaagagatggttgagttcatggagaaggtggccaagacagttgactctgaggagctcactgtcgaggagcgcaaccttctatcagttgcttacaagaatgttatcggtgcccgccgtgcctcgtggcgcatcatttcctccattgagcagaaggaagagagccgtggcaatgaggaccgtgtcacactcatcaaggactaccgtggaaagattgaggttgagctcaccaagatctgtgatggtatcctcaagcttcttgattcccaccttgtcccctcatccactgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactctccagaccgtgcttgtgacctcgccaagcaggcttttgacgaggccatctcggaactggactctctgagcgaggagtcctacaaggacagcacattgatcatgcagcttctgcgtgataacctgacgctgtggacttctgacatctcggaggacgctgctgaagaaatgaaggatgctcccaagggtgaatccggagatggacagtagtaaacactgtcgatgtgcccagaaacctgtctttctcgcttgttcagtgtagattgtaatgtcatcgtggttgctggtaattggaggctccaatttgtgttgtgatagggaagcttgtagctgccttacttgctcgacggcctgattatcgggccgcactggttattgcctcttgttgaacctttgtgttactttggtggttttagaaattttctgctgctcttgtttgtggccccttgtctctgtattcatctgccattcttctttcggatgggcgtcttccgaaccctttccactttgccaagtcttgttcccatgttatgggaggttcgatgcattcttcaccgtgcatggtgctcttaaaacatactacctccgtcccaaaaaaagtc

SEQ ID NO: 9274 - DNA, 1173 bp, Secale cereale
cacacgacccattattttcctcctcctcctcccgacctcctacccacctaccagcccctccaccaagcccagcgccgcgccaccgccgacgccgcagctcctccgccggcggcagccgttcgtcgcgagattgaccttgaccattagacacagacactgaagatggcgcagcctgccgagctttcccgtgaggagaatgtgtacatggctaagcttgcagagcaggctgagaggtacgaagagatggttgagttcatggagaaggtggccaagacagttgactccgaggagctcactgtcgaggagcgcaaccttctatcagttgcttacaagaatgttatcggtgcccgccgtgcctcgtggcgcatcatttcctccatcgagcagaaggaagagagccgtggcaatgaggaccgtgtcacgctcatcaaggactaccgtggaaagattgaggttgagctcaccaagatctgtgatggtatcctcaagcttcttgattcccaccttgtcccctcatccactgctccagagtccaaggtcttctacctgaagatgaagggtgattattacaggtaccttgcagagttcaagagtggaactgagaggaaggacgctgctgagaacaccatggtggcatacaaagctgctcaggagattgcactgaaagagctgcccccgactcatcctattaggcttggcctggcactcaacttctcggtgttctattatgagatcctcaactctccagaccgtgcttgtgacctcgccaagcaggcttttgacgaggccatctcggaactggactctctgagcgaggagtcctacaaggacagcactttgatcatgcagcttctgcgtgataacctgacactgtggacttctgacatctcggaagacgctgctgaagaaatgaaggatgctcccaagggtgaatctggagatggacagtagtaaacactgtctgtgtgcccagaaacttgtctttctcgcttgttcagtgtagattgtaatgtcatcgtggttgctggtaattggaggctccaatttgtgttgtgatagggaagcttgtagctgccttgcttgctcgacggcctgattatcgggctgcactggttattgcctcttgttgaaccttttgtgttactttggtggttttagaaattttctgctgct

SEQ ID NO: 9275 - DNA, 1029 bp, Secale cereale
agccgttcgtctcgagattgaccttgaccagtagaaacagacactgaagatggcacagcctgctgagctttcccgtgaggagaatgtgtacatggctaagcttgcagagcaggctgagaggtacgaagagatggttgagttcatggagaaggtggccaagacagttgactccgaggagctcaccgtcgaggagcgcaaccttctatcagttgcttacaagaatgttatcggtgcccgccgtgcctcgtggcgcatcatttcctccatcgagcagaaggaagagagccgtggcaatgaggaccgtgtcacgctcatcaaggactaccgtggaaagattgaggttgagctcaccaagatctgtgatggtatcctcaagcttcttgattcccaccttgtcccctcatccactgctccagagtccaaggtcttctacctgaagatgaagggtgattattacaggtaccttgcagagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactccccagaccgtgcttgtgacctcgccaagcaggcttttgatgaggccatctcggaactggactctctgagcgaggagtcctacaaggacagcactttgatcatgcagcttctgcgtgataacctgacactgtggacttctgacatctcggaagacgctgctgaagaaatgaaggatgctcccaagggtgaatctggagatggacagtaaacactgtcgttgtgtccagaaacttgtctttctcgcttgttcagtgtagattgtaatgtcatcgtggttgctggtaattggaggctccaatttgtgttgtgatagggaagcttgtagctgccttgcttgctcgacggcctgattatcgggccatactggttattgcctcttgttgaacctttgtgttactt

SEQ ID NO: 9276 - DNA, 1575 bp, Triticum aestivum
gaccacccacccacctaccagccaccaaggcggccgatctcccctcaccgccaccgctaccgccgacgccgcagctccggcagccgttcgtctcgagattgacctttggtgactgttagaagcaacagacactgaagatggcgcagcctgctgagctttcccgcgaggagaatgtgtacatggccaagcttgcagagcaggctgagaggtacgaggagatggttgagttcatggagaaggtggccaagacagtcgactccgaggagctcaccgtcgaggagcgcaaccttctatcagttgcttacaagaatgttattggtgcccgccgtgcctcgtggcgcatcatttcctccatcgagcagaaggaagagagccgtggcaatgaggaccgtgtcacactcatcaaggactaccgtggaaagattgaggttgagctcactaagatctgtgatggtatcctcaagcttcttgattcccaccttgtcccctcatccactgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactctccagaccgtgcttgtgacctcgccaagcaggcttttgatgaggccatctcggaactggactctctgagcgaggagtcctacaaggacagcactttgatcatgcagcttctgcgtgataacctgacgctgtggacttctgacatctcggaggacgctgctgaagaaatgaaggatgctcccaagggtgaatctggagatggacagtaaacactgtctatgtgcccagaaacttgtctttctcgcttgttcagtgtagattgtaatgtcatcgtggttgctggtaattggaggctccaatttgtgttgtgatagggaagcttgtagctgccttgcttgctcgacggcctgatcatcgggctgcactggttattgcctcttgttgaacctttgtgttactttggtggttttagaaattttctgctgctcttgtttgtgaccccttgtttccgtattcatccgcttttcttctttccggacgggtgtctctgaacccttccactttgccaagtcttattcccatgttatgggagtttcgacattcacggtgctcctaaagcacatttgggagtattatttacctggttatatgactggaccgaaggcatctgagatggagacgaaagcaacaaatttgcaactagcttgcgttatgttaaccatatgggtttctacaggtggtatgcagaaatcttatgatgcggcgaacatcatgagttgtaaaaaggcttccatagcgacgacagtgccggttcacaagtatttctgcttgtactcacatgtatgctgctgttttctcattttccgctcctttccccatgcaacaaagcttacaacttgctccctctgttcacaaata

SEQ ID NO: 9277 - DNA, 1042 bp, Avena sativa
ttagaaaccacagacagtgaagatggcgcagcctgctaagctttcccgtgaggagaatgtgtacatggctaagcttgcagagcaggctgagagatacgaagagatggtcgagttcatggagaaggtggcaaagacagttgactccgaggagctcaccgtcgaagagcgcaaccttctatcagttgcttacaagaatgttattggtgcccgccgtgcctcgtggcgcatcatttcctccatcgagcagaaggaagagagccgtggcaagaggaccgtgtcacactcatcaaggactaccgtggaaagattgaggttgagctcaccaagatctgtgacggtatcctcaagcttcttgattcccaccttgtcccctcatctactgctccagagtccaaggtcttctacctgaagatgaagggtgattactataggtaccttgcggagttcaagagtggaactgagaggaaggatgctgctgagaacaccatggtggcatacaaagctgctcaggagattgcactggcagagctgcccccgactcatcccattaggcttgggctggcactcaacttctcggtgttctattatgagatcctcaactctcctgaccgtgcttgcgaccttgccaagcaggcttttgatgaggccatctcggaactggactctctgagcgaggagtcgtacaaggacagcactttgatcatgcagcttctgcgtgataacctgacgctgtggacttccgacatctcggaggacgccgctgaagaaatgaaggatgctcccaagggtgaatctggagatggacagtaaacactgtctatgtgtccagaaacttgtctttctcgcttgttcagtgtagattgtaatgtcatcgtggttgctggtaattggaggctccaatttgtgttgtgatagggaagcttgtagctgccttgcttgctcgacagcctgattatcgggctgcactggttattgcctcttgttgaacctttgtgttactttggtggttttaaaatttttctgctgctcttgtttgtggccg

SEQ ID NO: 9278 - DNA, 1311 bp, Triticum aestivum
tcgggggacacaccattattttcctctccctcctcctgaccacccacccacctaccagccaccaaggcggccgatctgccctcaccgccaccgctaccgccgacgccgcagctccggcagccgttcgtctcgagattgacctttggtgactgttagaaaccacaggcggtgaagatggcgcagcctgctaagctttcccgtgaggagaatgtgtacatggccaagcttgcagagcaggctgagaggtacgaagagatggtcgagttcatggagaaggtggccaagacagttgactccgaggagctcaccgtcgaggagcgcaaccttctgtcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaggttgagctcactaagatctgtgatggtatcctcaagcttcttgattcccaccttgtcccctcatccaccgctccagagtccaaggtcttctacctgaagatgaagggtgattactataggtaccttgcagagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactctccagaccgtgcttgtgacctcgccaagcaggcttttgatgaggctatctcagaactggactctctgagcgaggagtcgtacaaggacagcactttgatcatgcagcttctgcgtgataacctgacgctgtggacttcggacatctcggaggacgctgctgaagaaatgaaggatgctcccaagggtgaatctggagatggacagtaaacactgtctatgtgcccagaaacttgtctttctcgcttgttcagtgtagattgtaatgtcgtcgtggttgttggtaattggaggctccaatttgtgttgtgatagggaagcttgtagctgccttgcttgctcggcggcctgattatcgggctgcactggttattgcctcttgttgaacctttgtgttacttttggtggttttagaaattttctgctgctcttgtttgtgaccccctgcctttgtattcactagatgaccagttgcgccaatggcgcaaaggccgagagtaagccatgtattgaaagaatgtacattaatattattcgggcacatattgaaacatatga

SEQ ID NO: 9279 - DNA, 1108 bp, Secale cereale
ccggcagccgttcgtctcgagattgacctgaccagtagaaacagacactgaagatggcacagcctgctgagcttcccgtgaggagaatgtgtacatggctaagcttgcagagcaggctgagaggtacgaagagatggttgagttcatggagaaggtggccaagacagttgactctgaggagctcactgtcgaggagcgcaaccttctatcagttgcttacaagaatgttatcggtgcccgccgtgcctcgtggcgcatcattcctccattgagcagaaggaagagagccgtggcaatgaggaccgtgtcacactcatcaaggactaccgtggaaagattgaggttgagctcaccaagatctgtgatggtatcctcaagcttcttgattcccaccttgtcccctcatccactgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttggcctggcactcaacttctcggtgttctattatgagatcctcaactctccagaccgtgcttgtgacctcgccaagcaggcttttgacgaggccatctcggaactggactctctgagcgaggagtcctacaaggacagcactttgatcatgcagcttctgcgtgataacctgacgctgtggacttctgacatctcggaagacgctgctgaagaaatgaaggatgctcccaagggtgaatctggagatggacagtaaacactgtcgttgtgtccagaaacttgtctttctcgcttgttcagtgtagattgtaatgtcatcgtggttgctggtaattggaggctccaatttgtgttgtgatagggaagcttgtagctgccttgcttgctcgacggcctgattatcgggccatactggttattgcctcttgttgtaacctttgtgttactttggtggttttagtaaattttctgtctgtctcttgtttatgatccctgttctttgttttcttctattccggtatggg

SEQ ID NO: 9280 - DNA, 1009 bp, Secale cereale
cagcctgccgagcttcccgtgaggagaatgtgtacatggctaagcttgcagagcaggctgagaggtacgaagagatggttgagttcatggagaaggtggccaagacagttgactccgaggagctcactgtcgaggagcgcaaccttctatcagttgcttacaagaatgttatcggtgcccgccgtgcctcgtggcgcatcattcctccatgagcagaaggaagagagccgtggcaatgaggaccgtgtcacactcatcaaggactaccgtggaaagattgaggttgagctcaccaagatctgtgatggtatcctcaagcttcttgattcccaccttgtcccctcatccactgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactctccagaccgtgcttgtgacctcgccaagcaggcttttgacgaggccatctcggaactggactctctgagcgaggagtcctacaaggacagcacattgatcatgcagcttctgcgtgataacctgacgctgtggacttctgacatctcggaggacgctgctgaagaaatgaaggatgctcccaagggtgaatccggagatggacagtagtaaacactgtcgatgtgcccagaaacctgtctttctcgcttgttcagtgtagattgtaatgtcatcgtggttgctggtaattggaggctccaatttgtgttgtgatagggaagcttgtagctgccttgcttgctcgaccgcctgattatcgggctgcactggttattgcctcttgttgaaccttttgtgttactttggtggttttagaaattttctgctgctcttgttt

SEQ ID NO: 9281 - DNA, 1146 bp, Avena sativa
aggagaagagcagcagagacatttcccgtccttcgattggagcacaggagcacgcgaagcacgggaagctagtagccgccggagagcagatttaaccatcggtgactattagaaactacagaaagtgaagatgacacagtctgctgagctttctcgtgaggagaatgtgtacatggctaagcttgcagagcaggctgagagatatgaagagatggttgagttcatggagaaggtggcaaagacagttgactccgaggagctcactgtcgaagagcgcaaccttctatcagttgcttacaagaatgttattggtgcccgccgtgcctcatggcgcatcatttcctccatcgaacagaaggaagagagtcgtggcaatgaggaccgtgtcacactcattaaggactaccgtggaaagattgagactgagctcactaagatctgcgatggtatcctcaagcttcttgattcccaccttgtcccctcatctactgctccagagtccaaggtcttctacctcaagatgaagggtgattactacaggtaccttgcggagtttaagagtggagctgagaggaaggatgctgctgagaacaccatggtggcatacaaagctgcccaggatattgcactggcagagttgcccccaactcatcctatcaggcttgggctggcactcaacttctccgtgttttattacgagattctcaactcccctgaccgtgcttgcaaccttgccaagcaggcttttgatgaggccatctcagaactggacacactgagcgaggaatcctacaaggacagcaccttgatcatgcagctgctgcgtgataacctgacgctatggacttctgacatctcggaggacgctgctgaagaaatcaaggatgctcctaagggtgaatctggcgatggacagtaaaatggtctgtctgctcggagacttgaattatagttttctgtcttccgagcgacagttcagtgtgctctgggttgtcttttcttcagtgtagattgtatgttgtggttcttgggaattagaggctccaatttgtgttgtgataggggggccatgtagctgcctagctgcttggtgggttggttatcggcctaatctagttgtggagcctcttattgaaccttttgttt

SEQ ID NO: 9282 - DNA, 1114 bp, Avena sativa
agcacgggaagctagtagccgctggagcgcagatttaaccatcggtgactattagaaactacagaaagtgaagatgacacagtctgctgagctttctcgtgaggagaatgtgtacatggctaagcttgcagagcaggctgagagatatgaagagatggttgagttcatggagaaggtggcaaagacagttgactccgaggagctcactgtcgaagagcgcaaccttctatcagttgcttacaagaatgttattggtgcccgccgtgcctcatggcgcatcatttcctccatcgaacagaaggaagagagtcgtggcaatgaggaccgtgtcacactcattaaggactatcgtggaaagattgagactgagctcactaagatctgtgatggtatcctcaagcttcttgattcccaccttgtcccctcatctactgctccagagtccaaggtcttctacctcaagatgaagggtgattactacaggtaccttgcggagttcaagagtggagctgagaggaaggatgctgctgagaacaccatggtggcatacaaagctgcccaggatattgcactggcagagttgcccccaactcatcctatcaggcttgggctggcactcaacttctccgtgttttattacgagattctcaactctcctgaccgtgcttgcaaccttgccaagcaggcttttgatgaggccatctcagaactggacacactgagcgaggaatcttacaaggacagcaccttgatcatgcagctactgcgtgataacctgacgctgtggacttctgacatctcggaggatgctgctgaagaaatcaaggatgctcctaagggtgaatcgggcgatggacagtaaacatggtctgtctgctaggagacttgaattatagtgttctgtcttctgagcgacagttcagtgtgctctgggttatcttttcttcagtgtagattgtgatgttgtggttcttgggaattggaggctccaatttgttttgtaatagtggggcaatgtagctgcctagctgcttggtgggttggttatcggcctaatctagttgtggagccccttgttgaaccttttgtttctctgtttttcttttagagtgtt

SEQ ID NO: 9283 - DNA, 1307 bp, Avena sativa
cagcagcagcagaaacatttcccgtccttcgattcgagcacaggagcacgggaagctagtagccgccggagcgcagatttaaccttcggcgactattagaaactacagaaagtgaagatgacgcagtctgctgagctttctcgtgaggagaatgtgtacatggctaagcttgcagagcaggctgagagatatgaagagatggttgagttcatggagaaggtggcaaagacagttgactctgaggagctgactgtcgaagagcgcaaccttctatcagttgcttacaagaatgttattggtgcccgccgtgcctcatggcgcatcatttcctccatcgaacagaaggaagagagtcgtggcaatgaggaccgtgtcacactcattaaggactaccgtggaaagattgagactgagctcactaagatctgcgatggtatcctcaagcttcttgattcccaccttgtcccctcatctactgctccagagtccaaggtcttctacctcaagatgaagggtgattactacaggtaccttgcggagtttaagagtggagctgagaggaaggatgctgctgagaacaccatggtggcatacaaagctgcccaggatattgcactggcagagttgcccccaactcatcctatcaggcttgggctggcactcaacttctccgtgttttattacgagattctcaactcccctgaccgtgcttgcaaccttgccaagcaggcttttgatgaggccatctcagaactggacacactgagcgaggaatcctacaaggacagcaccttgatcatgcagctgctgcgtgataacctgacgctgtggacttctgacatctcggaggacgctgctgaagaaatcaaggatgctcctaagggtgaatctggcgatggacagtaaaatggtctgtctgctcggagacttgaattatagttttctgtcttccgagcgacagttcagtgtgctctgggttgtcttttcttcagtgtagattgtatgttgtggttcttgggaattagaggctccaatttgtgttgtgataggggggccatgtagctgcctagctgcttggtgggttggttatcggcctaatctagttgtggagcctcttattgaaccttttgtttctctgttttctttttagagttttctgctgctcttgcttgtgagctgttgtcttcatattcatgtatttgtcttatttccaaaagggtcatgcgtgtcttcctgggtatgttttgttggtatctcaaaccatcattcaccgacttcttgcacacagaaaggcctttgtttggatg

SEQ ID NO: 9284 - DNA, 1341 bp, Avena sativa
gatagggctgggagcgcctcggctgcgggaagggagaacagcagcagcagcagaaacatttcccgtccttcgattcgagcacaggagcacgggaagctagtagccgccggagcgcagatttaaccatcggtgactattagaaactacagaaagtgaagatgacacagtctgctgagctttctcgtgaggagaatgtgtacatggctaagcttgcagagcaggctgagagatatgaagagatggttgagttcatggagaaggtggcaaagacagttgactccgaggagctcactgtcgaagagcgcaaccttctatcagttgcttacaagaatgttattggtgcccgccgtgcctcatggcgcatcatttcctccatcgaacagaaggaagagagtcgtggcaatgaggaccgtgtcacactcattaaggactatcgtggaaagattgagactgagctcactaagatctgtgatggtatcctcaagcttcttgattcccaccttgtcccctcatctactgctccagagtccaaggtcttctacctcaagatgaagggcgattactacaggtaccttgcagagttcaagagtggagctgagaggaaggatgctgctgagaacaccatggtggcatacaaagctgcccaggatattgcactggcagagttgcccccaactcatcctatcaggcttgggctggcactcaacttctccgtgttttattacgagattctcaactctcctgaccgtgcttgcaaccttgccaagcaggcttttgatgaggccatctcagaactggacacactgagcgaggaatcttacaaggacagcaccttgatcatgcagctactgcgtgataacctgacgctgtggacttctgacatctcggaggatgctgctgaagaaatcaaggatgctcctaagggtgaatcgggcgatggacagtaaacatggtctgtctgctaggagacttgaattatagtgttctgtcttctgagcgacagttcagtgtgctctgggttatcttttcttcagtgtagattgtgatgttgtggttcttgggaattggaggctccaatttgttttgtaatagtggggcaatgtagctgcctagctgcttggtgggttggttatcggcctaatctagttttggagccccttattgaaccttttgtttctctgttttctttttagagttttctgctgctcttgcttgtgagctgttgtcttcatattcatgtatttgtcttctttccagaagggtcatgcgtgtcttcctgggtatgttttgttggtatctcaaaccatcattcaccgactttcttgcacacagaaaggcctt

SEQ ID NO: 9285 - DNA, 1275 bp, Avena sativa
gatagggctgggagcgcctcggctgcgggaagggagaacagcagcagcagcagaaacatttcccgtccttcgattcgagcacaggagcacgggaagctagtagccgccggagcgcagatttaaccatcggtgactattagaaactacagaaagtgaagatgacacagtctgctgagctttctcgtgaggagaatgtgtacatggctaagcttgcagagcaggctgagagatatgaagagatggttgagttcatggagaaggtggcaaagacagttgactccgaggagctcactgtcgaagagcgcaaccttctatcagttgcttacaagaatgttattggtgcccgccgtgcctcatggcgcatcatttcctccatcgaacagaaggaagagagtcgtggcaatgaggaccgtgtcacactcattaaggactatcgtggaaagattgagactgagctcactaagatctgtgatggtatcctcaagcttcttgattcccaccttgtcccctcatctactgctccagagtccaaggtcttctacctcaagatgaagggcgattactacaggtaccttgcagagttcaagagtggagctgagaggaaggatgctgctgagaacaccatggtggcatacaaagctgcccaggatattgcactggcagagttgcccccaactcatcctatcaggcttgggctggcactcaacttctccgtgttttattacgagattctcaactctcctgaccgtgcttgcaaccttgccaagcaggcttttgatgaggccatctcagaactggacacactgagcgaggaatcttacaaggacagcaccttgatcatgcagctactgcgtgataacctgacgctgtggacttctgacatctcggaggatgctgctgaagaaatcaaggatgctcctaagggtgaatctggcgatggacagtaaacatggtctgtctgcttggagacttgaattatagtgttctgtcttccgagcgacagttcagtgtgctctgggttgtcttttcttcagtgtagattgtgatgttgtggttcttgggaatcagaggctccaatttgtgttgtgataggggggccatgtagctgcctagctgcttggtgggttggttatcggcctaatctagttgtggagcctcttattgaaccttttgtttctctgttttctttttagagttttctgctgctcttgcttgtgagctgttgtcttcatattcatgtatttgtcttatttccagaagggtcatgcgtgtctt

SEQ ID NO: 9286 - DNA, 1105 bp, Festuca arundinacea
gagcagccgccggagcgcagatttgaccatcggtgactagaaaccacagaaagtaaagatggctgagctttctcgcgaggagaatgtgtacatggctaagcttgcagagcaggctgagagatatgaagagatggttgagttcatggagaaggtggcaaagacagttgactctgaggagctcactgttgaggagcgcaaccttctatcagttgcttacaagaatgttattggcgcccgccgtgcctcatggcgcatcatttcctccatcgagcaaaaggaagagagtcgtggcaatgaggaccgtgtcacactcatcaaggactatcgtggaaagatcgagactgagctcactaagatctgtgatggtatcctcaagcttctggattctcaccttgtcccctcatcaaccgctccagagtctaaggtcttctacctcaagatgaagggtgattactacaggtaccttgcggagttcaagagtggagctgagaggaaggatgctgctgagaacaccatggtcgcatacaaagccgcccaggatattgcactggcagagttgcccccaactcatcctatcaggcttgggctggcactcaacttctcagtgttttattatgagatcctcaattctcctgaccgtgcttgcaacctcgccaagcaggcttttgatgaggccatctcagagctggacactctgagcgaggaatcctacaaggacagcaccttgatcatgcagctgctgcgcgataacctgacgctgtggacttctgacatctcggaggacgctgctgaagaaatcaaggatgctcctaagggtgaatctggtgatggacagtaaacgtggtctatgtgcccggagactcgaactattgtgttcttgtgacacttcaatgtgctatgggttgtcttttcttcagtatagattgtagtggtcttgtggtttggaggcaccttgtgctgtgatagggaaggttgtagcgatgtagctgcctagctgctgggcgggttggttatcaggctatgcttgttggggagcctcttgttgaaccttgggttcctttgtttttagaattttctgctgctctcgtttgtcagctgttgtctt

SEQ ID NO: 9287 - DNA, 1137 bp, Festuca arundinacea
agaaacggaaacatttcccgaccccagattcgagcagccgccggagcgcagatttgaccatcggtgactagaaaccacagaaagtgaagatggctgagctttctcgtgaggagaatgtgtacatggctaagcttgcagagcaggctgagagatatgaagagatggttgagttcatggagaaggtggcaaagacagttgactctgaggagctcactgttgaggagcgcaaccttctatcagttgcttacaagaatgttattggcgcacgccgtgcctcatggcgcatcatttcctccatcgagcagaaggaagagagtcgtggcaatgaggaccgtgtcacactcatcaaggactatcgtggaaagatcgagactgagctcactaagatctgtgatggtatcctcaagcttctggattcccaccttgtcccctcatcaaccgctccagagtctaaggtcttctacctcaagatgaagggtgattactacaggtacctcgcggagtttaagagtggatctgagaggaaggatgctgccgagaacaccatggtcgcatataaagctgcccaggatattgcactggcagagttgcccccaactcatcctatcaggcttgggctggcactcaacttctcagtgttttattatgagatcctcaactctcctgaccgtgcttgcaacctcgccaagcaggcttttgatgaggccatctcagagctggacactctgagcgaggaatcctacaaggacagcaccttgatcatgcagctgctgcgtgataacctgacgctgtggacttctgacatctcggaggacgctgctgaagaaatcaaggatgctcctaagggtgaatctggcgatggacagtaaacgtggtctatgtgcccggagacttgaactattgtgttcttctgtcttcgagtgacacttcaatgtgctctggattgtcttttcttcagtatagattgtagtgttcttgtggtttggaggctccttatgttgtgatagggaaggttgcagagcctagctgcttggcgggttggttatcaggctatgattgttggggagcctcttgttgaaccttgccttactttgtttttagaattttctgttgctcttgtttgtcagccgttgtctt

SEQ ID NO: 9288 - DNA, 1243 bp, Festuca arundinacea
ggagcacgggaagcgagtagccgccggagcgcagatttgaccatcagtgactagaaaccacagaaagtgaagatggccgagctttctcgtgaggagaatgtgtacatggctaagcttgcggagcaggctgagagatatgaagagatggttgagttcatggagaaggtggcaaagactgttgactctgaggagctcactgtcgaggagcgcaaccttctgtcagttgcttacaagaatgttattggtgcccgccgtgcctcatggcgcatcatttcctccatcgagcagaaggaagagagtcgtggcaatgaggaccgtgtcacactcatcaaggactaccgtggaaagatcgagactgagctcactaagatctgtgatggtatccttaagcttcttgattcccaccttgtcccctcatcaaccgctccagagtctaaggtcttctacctaaagatgaagggtgattactacaggtaccttgcggagttcaagagtggagctgagaggaaggatgctgctgagaacaccatggtcgcatacaaagctgcccaggatattgcactggcagagttgcccccaactcatcctatcaggcttgggctggcactcaacttctcagtgttttattatgagatcctcaactctcctgaccgtgcttgcaacctcgccaagcaggcttttgatgaggcaatctcagagctggacactctgagcgaggaatcctacaaggatagcaccttgatcatgcagctactgcgcgataacctgacgctgtggacttccgacatctcggaggacgctgctgaagaaatcaaggatgctcctaagggtgaatctggcgatggacagtaaatgtggtctatgtgcccggagacttgaattattttgtgttctgtcttcgcgtgacacttcaatgtgctctgggttgtcttttcttcagtatagattgtagtgttcttgtggtttggaggctcctacttgtgccgagatagggaagcttgtagccatgtagctgcttggcgtgttggttatcaggctatgctagttgggacgcctcttgttgaaccttccgttactctgtttttagattttctgctgctattgtttgtgagctgttgtcttgaattcatctatttttcttctttttcagatgtgtcatagctgtcttctagagtatgttttgtccaacctttaccgaaaaaaaaaagaaaaaaaaacaaaagtactctgcgttgataccact

SEQ ID NO: 9289 - DNA, 1305 bp, Lolium multiflorum
agaaacggaaacatttcccgaccccagattcgagcagccgccggagcgcagatttgaccatcggtgactagaacccacagaaactcaagatggctgagctttctcgtgaggagaatgtgtacatggctaagcttgcagagcaggctgagagatatgaggagatggttgagttcatggagaaggtggcaaagacagttgactctgaggagctcaccgttgaggagcgcaaccttctatcagttgcttacaagaatgttattggtgcccgccgtgcctcatggcgcatcatttcctccatcgagcagaaggaagagagtcgtggcaatgaggaccgtgtcacactcatcaaggactaccgcggaaagatcgagactgagctcactaagatctgtgatggtatcctcaagcttctggattcccaccttgtcccctcatcaaccgctccagagtctaaggtcttctacctcaagatgaagggtgattactacaggtaccttgcggaattcaagagtggatctgagaggaaggatgctgctgagaacaccatggttgcatacaaagctgcccaggatattgcactggcagagttgcccccaactcatcctatcaggcttggtctggcactcaacttctcagtgttttattatgagatcctcaactctcctgaccgtgcttgcaacctcgccaagcaggcttttgatgaggccatctcagagctggacactctgagcgaggaatcctacaaggacagcaccttgatcatgcaactgctgcgcgataacctgacgctgtggacttctgacatctcggaggatgctgctgaagaaatcaaggatgctcctaagggtgaatctggggatggacagtaaacgtggtctatgtgcccggagacttgaactattgtgttcttgtgtcttcgagtgacacttcaatgtgctctggattgtcttttcttcagtatagattgtagtgtccttgtggtttggaggctccttatgttgtgatagggaaggttgcagagcctagctgcttggcgggttggttatcaggctatgattgttggggagcctcttgttgaaccttgcgttactttgtttttagaattttctgttgctcttgtttgtcagccgttgtcttctattcctctacctcttttccagtgggtcatgggtgtcttctaggttatgttttgttggtgtctaaaaccaacatttaccagtttcttgctgatagccaaatttatggtctttgtttggatgactgctaatttttttatgctggtgactccttttggttagaaaaaaa

SEQ ID NO: 9290 - DNA, 1301 bp, Avena sativa
agcagcagcagcagaaacatttcccgtccttcgattcgagcacaggagcacgggaagctagtagccgccggagcgcagatttaaccttcggcgactattagaaactacagaaagtgaagatgacgcagtctgctgagctttctcgtgaggagaatgtgtacatggctaagcttgcagagcaggctgagagatatgaagagatggttgagttcatggagaaggtggcaaagacagttgactctgaggagctgactgtcgaagagcgcaaccttctatcagttgcttacaagaatgttattggtgcccgcgtgcctcatggcgcatcatttccccatcgaacagaaggaagagagtcgtggcaatgaggaccgtgtcacactcattaaggactaccgtggaaagattgagactgagctcactaagatctgcgatggtatcctcaagcttcttgattcccaccttgtcccctccatctactgctccagagtccaaggtcttctacctcaagatgaagggtgattactacaggtaccttgcggagtttaagagtggagctgagaggaaggatgctgctgagaacaccatggtggcatacaaagctgcccaggatattgcactggcagagttgcccccaactcatcctatcaggcttgggctggcactcaacttctccgtgttttattacgagattctcaactcccctgaccgtgcttgcaaccttgccaagcaggcttttgatgaggccatctcagaactggacacactgagcgaggaatcctacaaggacagcaccttgatcatgcagctgctgcgtgataacctgacgttgtggacttctgacatctcggaggacgctgctgaagaaatcaaggatgctcctaagggtgaatctggcgatggacagtaaacatggtctgtctgcttggagacttgaattatagtgttctgtcttccgagcgacagttcagtgtgctctgggttgtcttttcttcagtgtagattgtgatgttgtggttcttgggaattagaggctccaatttgtgttgtgataggggggccatgtagctgcctagctgcttggtgggttggttatcggcctaatctagttttggagcctcttattgaaccttttgtttctctgttttctttttagagttttctgctgctcttgcttgtgagctgttgtcttcatattcatgtatttgtcttctttccagaagggtcatgcgtgtcttcctgggtatgttttgttggtatctcaaaccatcattcaccgactttcttgcacacagaaaggcctt

SEQ ID NO: 9291 - DNA, 1241 bp, Festuca arundinacea
catttcccgaccccagattggagcaccggagcacgggaagcgagcagccgccggagcgcagatttgaccatcggtgactagaaaccacagaaagtgaagatggctgagctttctcgtgaggagaatgtgtacatggctaagcttgcagagcaggctgagagatatgaagagatggttgagttcatggagaaggtggcaaagacagttgactctgaggagctcactgttgaggagcgcaaccttctatcagttgcttacaagaatgttattggtgcccgccgtgcctcatggcgcatcatttcctccatcgagcagaaggaagagagtcgcggcaatgaggaccgtgtcacactcatcaaggactatcgtggaaagatcgagactgagctcactaagatctgcgatggtatcctcaagcttcttgattcccaccttgtcccctcatcaaccgctccagagtctaaggtcttctacctcaagatgaagggtgattactacaggtaccttgcggagttcaagagtggagctgagagaaaggatgctgctgagaacaccatggtcgcatacaaagctgcccaggattttgcactggcagagttgccaccaactcatcctatcaggcttgggctagcactcaacttctcagtgttttattatgagatcctcaactctcctgaccgtgcttgcaacctcgccaagcaggcttttgatgaggccatctcagagctggacactctgagcgaggaatcctacaaggacagcaccttgatcatgcagctgctgcgcgataacctgacgctgtggacttctgacatctcggaggacgctgctgaagaaatcaaggatgctcctaagggtgaatctggcgatggacagtaaacgtggtctatgtgcccggagacttgaactattgtgttcttctgtcttcgagtgacacttcaatgtgctctgggttgtctttcttcagtatagattgtagtgttcttgtggtttggaggctccttgtgttgtgatagggaaagcttgtagcgatgtagctgcctagctgcttggtgggttggttatcaggctatgcttgttggggagcctcttgttgaacctttgcgttcccttgtttttagaattttctgctgctcttgtttgtcagccgttgtcttgtattcatctattttcctcttttccgatgtgccatgggtgttttttctagggtatgttttgttggtgtctaacaccaacattta

SEQ ID NO: 9292 - DNA, 1159 bp, Oryza sativa
ccgaatttgaactccacctgagcacaggagaagccgcagccactgagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtcc

SEQ ID NO: 9293 - DNA, 1112 bp, Cenchrus ciliaris
gaagatgtcgcagcctgctgagctttcccgtgaggaaaacgtgtacatggctaagcttgcagagcaggctgagaggtatgaagagatggttgagttcatggagaaggtggctaagacagttgattctgaggagcttactgtggaggagcgcaaccttctgtcagttgcttacaagaatgtcattggagcccggcgtgcctcatggcgcatcatatcctccattgagcagaaagaagagggtcgtggcaatgaggaccgtgttactctcatcaaggactaccgtagcaagatagaagttgaactcaccaagatctgtgatggaattctcaagctccttgattcccaccttgtcccctcatctacagctccggagtccaaggtcttctacctcaagatgaagggtgactactacaggtatcttgcggaatttaaaactggatctgagaggaaggatgcagctgagaacaccatggtggcatacaaagctgctcaggatattgcattggcagagttggctcccactcatcctattaggcttgggctggcactcaacttctcagtattttattatgagatcctcaactctcctgaccgtgcttgcaatcttgccaagcaggcttttgatgaggccatctcagagctggataccctgagcgaggaatcctacaaggacagcactctgatcatgcagcttctgcgtgataacttaaccctgtggacttcagacatcacggaggatgctgccgaagaaatcaaggaggctcccaagggcgagtctggagatgggcagtaaagatgatctatgtgcctagaaacaacatttcagtgttcgtctactagtgaatctgccaatgtgctctgggttcttgtttcgtcggtataggctgtattgttgcttgtgatagctggaaattggagactcccatttgcgctgtgttagaaaatgcttgctagtaccttgctggttggcaggtgttgtcaagctacgattgtttgagggagggagcctttatctatttgaatcattggtgctactttgtatttgtagattgagtgttcctgttgctggtctccatgttctcctcttttctattgttgattttgatgtgttt

SEQ ID NO: 9294 - DNA, 1326 bp, Pennisetum glaucum
gaaacagaaagctgaaagcgagaagcatttccttccccactcgattcgaaaaggggaaaccagcagcggcggcgagtttgacctttgttggaccgttagaaaccataaacagtgaagatgtcgcagcctgctgaactttcccgtgaggaaaacgtgtacatggctaagcttgcagagcaggctgagaggtatgaagagatggttgagttcatggagaaggtggctaagacagttgattctgaggagcttactgtggaggagcgcaaccttctgtcagttgcttacaagaatgtcattggagcccggcgtgcctcatggcgcatcatatcctccattgagcagaaagaagagggtcgtggcaatgaggaccgtgttactctcatcaaggactaccgtagcaagatagaagttgaactcaccaagatctgtgatggaattctcaagctccttgattcccaccttgtcccctcatctacagctccggagtccaaggtcttctacctcaagatgaagggtgactactacaggtatcttgcggaatttaaaactggatctgagaggaaggatgcagctgagaacaccatggtggcatacaaagctgctcaggatattgcattggcagagttggctcccactcatcctattaggcttgggctggcactcaacttctcagtattttattatgagatcctcaactctcctgaccgtgcttgcaatcttgccaagcaggcttttgatgaggccatctcagagctggataccctgagcgaggaatcctacaaggacagcactctgatcatgcagcttctgcgtgataacttaaccctgtggacttcagacatcacggaggatgctgccgaagaaatcaaggaggctcccaagggcgagtctggagatgggcagtaaagatgatctatgtgcctagaaacaacatttcagtgttcgtctactagtgaatctgccaatgtgctctgggttcttgtttcgtcggtataggctgtattgttgcttgtgatagctggaaattggagactcccatttgcgctgtgttagaaaatgcttgctagtaccttgctggttggcaggtgttgtcaagctacgattgtttgagggagggagcctttatctatttgaatcactggtgctactttgtatttgtagattgagtgttcctgttgctggtctccatgttctcctcttttctattgttgattttgatgtgtttccgtaacgtgtcatgatgctctgaattgaggggctgtttggtctccgggccacacttccggtggcaacagccaccgccaccggaataggtgatttccgtgg

SEQ ID NO: 9295 - DNA, 1211 bp, Pennisetum glaucum
gaagcatttccttccccactcgattcgaaaaggggaaaccagcagcggcggcgagtttgacctttgttggaccgttagaaaccataaacagtgaagatgtcgcagcctgctgaactttcccgtgaggaaaacgtgtacatggctaagcttgcagagcaggctgagaggtatgaagagatggttgagttcatggagaaggtggctaagacagttgattctgaggagcttactgtggaggagcgcaaccttctgtcagttgcttacaagaatgtcattggagcccggcgtgcctcatggcgcatcatatcctccattgagcagaaagaagagggtcgtggcaatgaggaccgtgttactctcatcaaggactaccgtagcaagatagaagttgaactcaccaagatctgtgatggaattctcaagctccttgattcccaccttgtcccctcatctacagctccggagtccaaggtcttctacctcaagatgaagggtgactactacaggtatcttgcggaatttaaaactggatctgagaggaaggatgcagctgagaacaccatggtggcatacaaagctgctcaggatattgcattggcagagttggctcccactcatcctattaggcttgggctggcactcaacttctcagtattttattatgagatcctcaactctcctgaccgtgcttgcaatcttgccaagcaggcttttgatgaggccatctcagagctggataccctgagcgaggaatcctacaaggacagcactctgatcatgcagcttctgcgtgataacttaaccctgtggacttcagacatcacggaggatgctgccgaagaaatcaaggaggctcccaagggcgagtctggagatgggcagtaaagatgatctatgtgcctagaaacaacatttcagtgttcgtctactagtgaatctgccaatgtgctctgggttcttgtttcgtcggtataggctgtattgttgcttgtgatagctggaaattggagactcccatttgcgctgtgttagaaaatgcttgctagtaccttgctggttggcaggtgttgtcaagctacgattgtttgagggagggagcctttatctatttgaatcactggtgctactttgtatttgtagattgagtgttcctgttgctggtctccatgttctcctcttttcttattgttgattttgtatgtgtttccgtt

SEQ ID NO: 9296 - DNA, 1431 bp, Oryza sativa
agaaacatctcgccgaatttgaactccacctgagcacaggagaagccgcagccactgagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcggttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaatattattctgtcaggtatgtgtgataagcggtttcatatgcaacaatgctgtagggacccaaatgttcactggcatcatgtacagatacttgtagtaccaaaattagttt

SEQ ID NO: 9297 - DNA, 1216 bp, Cenchrus ciliaris
gaaagctgaaagcgagaagcatttctccccccctcgattcgaaaaggggaaacctgcagcggcggcgagtttgacctttggtggactgttagaaaccataaacagtgaagatgtcgcagcctgctgagctttcccgtgaggaaaacgtttacatggctaagcttgcagagcaggctgagaggtatgaagagatggttgagttcatggagaaggtggctaaggcagttgattctgaggagcttactgtggaggagcgcaaccttctgtcagtagcatacaagaatgtcattggagcccggcgtgcctcatggcgcatcatatcctccattgagcagaaagaagagggtcgtggcaatgaggaccgtgtcactcttatcaaggactaccgtagcaagatagaagttgaactcaccaagatctgtgatggaattctcaagctcctcgattcccaccttgtcccctcatccacagctccagagtccaaggtcttctacctaaagatgaagggtgactactacaggtaccttgcggagtttaaaactgggtctgagaggaaggatgcagctgagaacaccatggtggcatacaaagctgctcaggatatcgcactggcagagttggcccccactcatcctattaggcttgggctggcgctcaacttctcggtattttattacgagatcctcaactctcctgatcgtgcttgcaatcttgccaagcaggcttttgatgaggccatctcagagctggataccctgagtgaggagtcctacaaggacagcactctgatcatgcagctcctgcgtgataacttgaccctgtggacttcagacatcacggaggatgctgctgaagaaatcaaggaggctcccaagggcgagtctggagatgggcagtaaagatgatccctgtgcccagaaactacatttcagtgttcgtctactagtgaatctgccaaatgtgctctgggttcttgtcgcgttgatataggctgtattgttgcttgtgatagctggaaattggagactcccatttgtgcttgtgctagaaaggcttgctagtacctttgctggttggcaggtgttgtcaagctacgattggttgagggagggagactttatttcttttaatcattggtgttgctttgtacctgtagattgagtcttcctgttgctggtctccatgttcgtctcttttctactgttgattttgatgc

SEQ ID NO: 9298 - DNA, 1234 bp, Echinochloa colona
ggcaggaaacagaaagctgaaagcgtgaaacatttcaccctcgattcgaaaagggggaaaccagcagcggcgcccaagtttgacccttggtggactgttagaaaccataaacagtgaagatggcgcttcctgctgagctttcccgtgaggaaaatgtttacatggctaagcttgcagagcaggctgagaggtatgaggagatggttgaattcatggagaaggtggctaagacagttgattctgaggagcttactgtagaggagcgcaaccttctgtcagttgcttacaagaatgtcattggggcccgtcgtgcctcatggcgcatcatatcatccattgagcagaaggaagagggccgtggcaacgaggaccgtgtcactcttatcaaggactaccgtagcaagatagaagttgaactcaccaagatctgtgatggaattctcaagctccttgattcccaccttgtcccctcatccacggctccagagtccaaggttttctacctcaagatgaagggtgactactacaggtaccttgcggagtttaaaactggatctgagaggaaggatgcagctgagaacaccatggtggcatacaaagctgctcaggatattgcactggcagagttggcccccactcatcctattaggcttgggctggcgctcaacttctcagtattttattacgagatcctcaactctcctgaccgtgcctgcaatcttgccaagcaggcttttgatgaggccatctcagagctggataccctgagcgaggaatcctacaaggacagcactctgatcatgcagcttctgcgtgataacttgaccctgtggacttcagacatcacggaggatgccaccgaagaaatcaaggaggctcccaaaggcgagtctggagatgggcagtaaagatgatctatgtgcccagaaactacatttcagtgttcgacctactagtgaatctgccatgtgctctgggttcttgtttcgtcgatataggttgtactgttgcttgtgatagctggaaattggagactcccatttgtgctgtgctagaaaggcttgcaagtaccttgctagttggcaggtgttgtcaagctacacttggttgagggagcctttatttatttgaatcattggtgttactttgtatttgtaggttgagtcttcctgttgattgtctccatgtttgttcttttctattgttgatttcttcatgttcatgccacctttat

SEQ ID NO: 9299 - DNA, 1229 bp, Panicum virgatum
aatgttttttccttcaatcctccagtttgacctttggtgaactgttagaaaccataaactgtgaagatgtcgctgcctgctgagctttcccgcgaggaaaatgtttacatggctaagcttgcagagcaggctgagaggtatgaagagatggttgaattcatggagaaggtggctaaggcagttgattctgaggagcttactgtggaggagcggaaccttctgtcagttgcttacaagaatgtcattggagcccgacgtgcctcatggcgcatcatatcctccattgagcagaaggaagagggacgtggcaatgaggaccgtgtcactcttatcaaggactaccgtagcaagatagaagttgaactcaccaagatatgtgatggaattctcaagctccttgattcccatcttgtcccctcatccacggctccagagtccaaggtcttctacctcaagatgaagggtgactactacaggtaccttgcagaatttaaaactggatctgagaggaaggatgcagctgagaacaccatggtggcatacaaagcagctcaggatattgccctggcagagttggcccccactcatcctattaggcttgggctggcgctcaacttctcagtattttattatgagatcctcaactctcctgaccgtgcttgcagtcttgctaagcaggcttttgatgaggccatctcagagctggataccctgagcgaggaatcctacaaggacagcactctgatcatgcagcttctgcgtgataacttgaccctgtggacttcagacatctcggaggatgctgccgaggaaatcaaggaggctcccaagggtgagtctggagatggacagtaaagatgatccatgttccaagaaactacatttcagtgttcggtctcctagtgaatctgtttgggttctggtttcgtccatataggttgtattgctgctgtgatagctggaaattggtgactccctcttgtgctgtggtagaaaggcttgcaagtaccttgctgcttggcaggtgtcgtcaagctacacttggttggagcctttatttattcgaatcattggctttacttttgtatttgttggttgagtcttcctgttgcttgtctccatgttcgtgtcttttctattgttgattgattttgatgtgtttccgtcaatgtgcatgcatgatgctcttgagctgaaatagtttttgccatctggttgtgatgctggat

SEQ ID NO: 9300 - DNA, 1892 bp, Setaria italica
cgtcgattatcgaaattgatgcttgagcgatgtcaaatggagctcgagcccttcgacctcggcagccactcccagcaccctctgcatggtatgccttctccttgctcctcaattcgatttgcgtcggaccggatttgccgctcgatttgtcagcaacaaatcgagctcgagctcgagttgccgtttcctagcatggtacggcgggcggtgctgctgcgtgtgtaggagttgtggcggaggagcgatgccgccaccgaaggggccagggcggcgcacgagaacggcgcgcgtggaagggacatacgtgcgcgataggtgaaaccgaagaaccggtcaagtagacacatccgcacatctgcagacacccgcaagagaaggggtttggaaggaaaaagtaggaggcctccctggagtgagagaccctgctggagttggatttttggctgtcggtccctattttttagcaggggctcggatctcacccaacccccagtgacatcgtgggaccaggttgccagggtccgcggcgcgtcgtctcgtagaccgtaaggacgcgtgtcgaggtttcattggacggaggacgccttcttatactgaccttgcgcctccgtggtgagagcaggaaacagaaagctgaaagcgagaagcatccccccacccccccaccccccaaaaggggaaaccagcagcagcagcgcggagtttgacctttggtggactgttagaaaccataaacagtgaagatgtcgcagcctgctgagctttcccgtgaggaaaacatttacatggctaagcttgcagagcaggctgagaggtatgaggagatggttgagttcatggagaaggtggctaaggcagttgattctgaggagcttactgtggaggagcgcaaccttctgtcagttgcttacaagaatgtcattggagcccggcgtgcctcatggcgcatcatatcctccattgagcagaaagaagagggtcgtggcaatgaggaccgtgtcactcttattaaggactaccgtagcaagatagaagttgaactcaccaagatctgtgatggaattctcaagctccttgattcccaccttgtcccctcatccacagctccagagtccaaggtcttctacctcaagatgaagggtgactactacaggtaccttgcggagtttaaaactggatctgagaggaaggatgcagctgagaacaccatggtggcatacaaagctgctcaggatattgcactggcagagctgtcccccactcatcctattaggcttgggctggcactcaacttctcagtattttattacgagatcctcaactctcctgaccgtgcttgcaatcttgccaagcaggcttttgatgaggcaatctcagagctggacaccctgagtgaggaatcctacaaggacagcactctgatcatgcagcttctgcgtgataacttgaccctgtggacttcagacatcacggaggatgctgccgaagaaatcaaggaggctcccaagggcgagtctggagatgggcagtaaagatgatccatgtgcccagaaactacatttcagtgttcgtctactagtgaatctgccaatgtgctatgggttcttgtttcgttggtataggctgtattgttgcttgtgatagctggaaattggagactcccatttgtgtcgtgctagaaaggcttgcgagtagcttgctggttggcaggtgttgtcaagctacacttggttgagggagggagcctttatttatttggattattggtgttactttgtatttgtaggttgagtcctgttgctcgtctccatgttcgtctcttttctattgttgattttgatgtatttccgtaaatgcgcatgatgctctgaactgaattagtttttgccgtc

SEQ ID NO: 9301 - DNA, 1231 bp, Echinochloa colona
ggaaacagaaagctgaaagcttgaaacatttcaccctcgattcgaaaagggggaaaccagcagcggcgcccaagtttgacctttggtggactgttagaaaccataaactgtgaagatgtcgctgcctgctgagctttcccgtgaggaaaatgtttacatggctaagcttgcagagcaggctgagaggtatgaggagatggttgaattcatggagaaggtggctaaggcagttgattctgaggagcttactgtagaggagcgcaaccttctgtcagttgcttacaagaatgtcattggggcccgtcgtgcctcgtggcgaatcatatcatccattgagcagaaggaagagggacgtggcaacgaggaccgtgtcactcttatcaaggactaccgtagcaagatagaagttgaactcaccaagatctgtgatggaattctcaagctccttgattcccaccttgtcccctcatccacggctccagagtccaaggttttctacctcaagatgaagggtgactactacaggtaccttgcggagtttaaaactggatctgagaggaaggatgcagctgagaacaccatggtggcatacaaagctgctcaggatattgcactggcagagttggcccccactcatcctattaggcttgggctggcgctcaacttctcagtattttattacgagatcctcaactctcctgaccgtgcctgcaatcttgccaagcaggcttttgatgaggccatctcagagctggataccctgagcgaggaatcctacaaggacagcactctgatcatgcagcttctgcgtgataacttgaccctgtggacttcagacatcacggaggatgccaccgaagaaatcaaggaggctcccaagggcgagtctggagatgggcagtaaagatgatctatgtgcccagaaactacatttcagtgttcgacctactagtgaatctgccatgtgctctgggttcttgtttcgtcgatataggttgtattgttgcttgtgatagctggaaattggaaactcccatttgtgctgtgctagaaaggcttgcaagtaccttgctagttggcaggtgttgtcaagctacacttggttgagggagcctttatttatttgaatcattggtgttactttgtatttgtaggttgagtcttcctgttgattgtctccatgttcgtttcttttctattgttgatttctccatgttcatgccacctttat

SEQ ID NO: 9302 - DNA, 1203 bp, Brachypodium distachyon
cctctccctagttcgaaagcccccagcgccacgagacaagcggcgacgcaagcagccaagcatagatttgaccatttgaaaagtttccaattgtaaactttgaagatgtcggcacctgcggagctttcccgtgaggagaatgtgtacatggccaagctcgctgagcaggcagagaggtacgaggagatggtcgagttcatggagaaggtggccaagacagttgactccgaggagctcaccgtggaggagcgcaaccttctctctgttgcgtacaagaatgtgattggcgcccgccgtgcctcttggcgcattatctcctccatcgaacagaaggaggagagccgtggcaacgaggaccgggtcacactcatcaaggactaccgtggcaagatcgagactgagcttaccaagatctgcgatggcatcctcaagctgctcgaaacccatcttgtcccctcttccactgcccctgagtccaaggtcttctaccttaagatgaagggtgactactacaggtatctggcagaattcaagagtggggctgagaggaaggatgctgctgagaataccatggtggcatacaaggctgctcaggatattgctttggctgagctggctccaactcatccaattaggcttggactggcactaaacttctcggtcttctattatgagatcctcaactcccctgatcgtgcttgcaatcttgcaaagcaggcttttgatgaggccatctcggagctggacaccctgagcgaggaatcctacaaggacagcacattgatcatgcaactccttcgtgacaacctgaccctgtggacttccgacatcacggaggacactgcggaggagatcagggaggctccgaagggtgactctggtgatgggcagtaaagccagttttacctgccctgggctggaaactactagctagtgtttgcttactgtctaatgacgctatgcacagtccgggtcctggtttctttggtgcactgttgttagccttggtatggttatcgtccgcaaaattcagggctccccgtatgtggtgttgctaggggaaagttgtcgccgcttgtatcaacagacggagacgggctggggacggggatggggacggggatgggagcccgtttgcactgttggtggcagttcgtattttcggtctgcctttttattgctgttattgtgattggtctggcg

SEQ ID NO: 9303 - DNA, 1051 bp, Eragrostis curvula
aaaaaaaaaaaaaaaaccccgggacagaagtggaagcgagaaacattttcctcctcgattcgaaaaggaaacccagcagccgacgcacagtttgatcactgtcaaaaatcacaaacagtgaagatgtcgcagcctgctgagctttcccgtgaggaaaatgtttacatggctaagcttgcagagcaggctgagaggtatgaagagatggttgagttcatggagaaggtggcgaaggcggttgattcagaggagctcacagtggaggagcgcaaccttctatcagttgcttacaagaatgtcattggagcccgacgtgcctcatggcgcatcatatcctccattgaacagaaggaagagggccgtggcaatgaggaccgagtcaccctcatcaaggactaccgtagcaagatagagactgaactcaccaagatctgtgatggaatcctcaagctcctggattcccaccttgtcccctcatctactgctccggagtccaaggtcttctacctcaagatgaagggtgactactacaggtaccttgcagagttcaaaactggatctgagaggaaggatgctgctgagaacaccatggtggcttacaaagctgctcaggacattgcactgacagagttggcccctactcatcctattaggcttgggctggcgctcaacttctcagtgttctattatgagatcctcaactctcctgaccgcgcttgcagtctcgccaagcaggcttttgatgaggccatctcagagctggataccctaagcgaggaatcctacaaggacagcactttgatcatgcagcttctgcgtgataacttgaccttgtggacatctgacatctcggaggacaccgccgaagagatcaaggaggctcccaagggtgaatccggacatgggcagtaaagatagcatgtgcccagaaactacattgccgttattgatctgctatccaccctgctatgtgctatgggttcttgtttcgtcaatatagattgtatctgttcctgtgatagttcaaaattggtgacatccgtttgtgctg

SEQ ID NO: 9304 - DNA, 1146 bp, Oryza sativa
aaaatttccgacgccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtcaa

SEQ ID NO: 9305 - DNA, 1314 bp, Brachypodium distachyon
tgagtactacagaaaagaaaagcattttcccagattaagcatggtcttgtgaagaatgacttgagattgaccttcgctgactattagaaccacagacagtggagatggcacagactgtggagctttcccgtgaggagaatgtgtacatggctaagcttgcagaacaggctgagaggtacgaagagatggttaagttcatggagaaggtagctaagacagttgactctgaggaactcactgtggaggagcgcaaccttctatctgttgcatacaagaatgttattggtgcacgccgtgcctcgtggcgcatcatttcctccattgagcagaaggaagagagtcatggcaatgatgaccgtgtcacactcatcaaggactaccgtggaaagattgagacagagcttaccaagatttgtgatggcatcctcaagcttcttgattcccaccttgtcccctcatccactgctccagagtccaaggtcttctacctgaagatgaagggtgattactacaggtacgttgcggagttcaagagcggagctgagaggaaggatgctgctgagaacaccatggtggcatacaaagctgctcaggatattgcactggcagagttggcaccgactcatcctattaggcttgggctggcactcaacttctcggtgttttattatgagatcttgaactctcctgaccatgcttgcaatctagccaaacaggcttttgatgaggccatctcagaactagacactccgagtgaggaatcctacaaggacagtactttgattatgcagcttctgcgtgataacctgacactctggatttctgacatctcggaggatgctgctgaacacatcaaggaggcacccaagggagaatctggagacggacagtaaccatgggctatatgcccataaacttatatcatagtgtcctatcttccagtggcacttcaatgtgctctgggttcactttttttcggtagagatcatcatgttctcgtggttgttggaaattggaggccccagtttgtgttgtgaccgggaactctgttagtgacctcactgctaggtgggggttggttatcgggcttaccctagccgggcgctgggaccttggggaagcttcaagttgaagcttttatgttactttgctttttgatttgtttctgttgctcttggttgtgtgaagttgtcttcatattcatctattttcgttgtttgaccggactacacagtggcgtgaactactgagctgggttgctcatcgctgttacacctggtgattccccttccaaaaatgcatgcacccatatgg

SEQ ID NO: 9306 - DNA, 1174 bp, Setaria italica
caaaccccccccgattcgaacgccggagcgcgaggaagacgcacgcagagatttggcacactgcaagttttaggaactgaaccataagatggcatcagcggagctttcccgtgaggagaatgtgtacatggccaagctcgccgagcaggctgagaggtacgaggagatggttgagttcatggagaaggtagccaagaccgtggactcggaggagctcaccgtggaggagcgcaacctcctttctgttgcatacaagaatgtcattggagcccgtcgtgcctcatggcgcatcatctcctccatcgagcagaaggaggaaggccgaggcaatgaggaccgtgtaacactcatcaaggactaccgtgggaagattgagactgagctcaccaagatctgtgatggcatcctcaagctgctcgagtcccaccttgtcccctcttccactgcccccgagtccaaggtcttctacctcaagatgaagggtgactactacagataccttgctgagttcaagactggggctgagagaaaggacgctgctgagaataccatggtggcatacaaggctgcccaggacattgctttggctgagctgcctccaactcaccctattaggcttggtctggcacttaacttctcagtgttctactatgagattctgaactcacctgatcgcgcatgcagtcttgcaaagcaggcttttgatgaggccatctcggagctcgacaccctgagcgaggagtcctacaaggacagcactttgatcatgcaactccttcgtgataacttgaccctatggacttccgacatctcggaggaccctgcggaagagatcagggaggcacccaagcacgactcgagcgaggggcagtaaagacggatttacgtgccctagaaactagtcgctagtgtttgctgctgtctaatgacactatgcaatgtgatctggaccctggtttctttggtgcgacgctgtagccgtgctatgattattgtcgggaaaatctgtgggctccccatatgagatgttgccgggcaaggcctcgggtgcgtcccacttgttggtgggggtcactggagccaggtttggttgggttgggaagcccttttaaaactgttggtgttactttgtattttaccttttcatcgcagtttattgtgagtggtcctgcgt

SEQ ID NO: 9307 - DNA, 1167 bp, Oryza sativa
gcctccccccaaaatttccgacgccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtcaatcctgtgtcta

SEQ ID NO: 9308 - DNA, 1122 bp, Cynodon dactylon
gggggcccaccccattccacctcacgacccccaagtttcgaacgccggagcgcgaggaggacgcacgcagagatttggcaccccgcaagttagagtaagatggcatcagcagagctttcccgtgaggagaatgtgtacatggccaagctcgccgagcaggctgagaggtacgaggagatggttgagtacatggagaaggtggccaagacagttgactcggaggagctcaccgtagaggagcgcaacctcctgtctgtggcatacaagaatgttattggagcccgccgtgcctcatggcgcatcatctcctccatcgagcagaaggaggagggccgtggcaacgaggaccgtgtaacactcatcaaggactaccgtggcaagatcgaaactgagctcaccaagatttgtgatggcatcctcaagctgctcgaatctcaccttgtgccctcttccaccgcccccgagtccaaggtcttctacctaaagatgaagggtgactattacaggtacctcgctgagttcaagactggcactgagagaaaggatgctgcggagaataccatggtggcatacaaggctgcccaggatattgctttggctgaactggcaccaacacaccctattaggcttgggctggcacttaacttctcagtgttctactatgagattctcaactcacctgatcgtgcttgcagccttgcaaagcaggctttcgatgaggccatctcagagctggacaccctgagcgaggagtcttacaaggacagcactttgatcatgcagcttctccgtgataacttgaccctctggacttctgacatctcggaggaccctgcggaagagatccgggaggcggcacccaagtccggcgaggggcagtaaagcaggctttacgtgccctagaaactagtagctagtgttttgttgctgtctaatgacactgcaatgtgatctggaccctggtttcttcggtgcgattctgtagccatgctatgattggcgcccatatgtgatcttgccgcgcgaggcctagcctggcccggttgggggggtagccttgtcaactgttggtgtcaatttgtattttggctttgccttttattattgtgctgttcatgcgcc

SEQ ID NO: 9309 - DNA, 810 bp, Secale cereale
cgccgttcgtctcgagattgaccttgaccagtagaaacagacactgaagatggcacagcctgctgagctttcccgtgaggagaatgtgtacatggctaagcttgcagagcaggctgagaggtacgaagagatggttgagttcatggagaaggtggccaagacagttgactctgaggagctcaccgtcgaggagcgcaaccttctatcagttgcttacaagaatgttatcggtgcccgccgtgcctcgtggcgcataatttcctccatcgagcagaaggaagagagccgtggcaacgaggaccgtgtcacactcatcaaggactaccgtggaaagattgaggttgagctcaccaagatctgtgatggtatcctcaagcttcttgattcccaccttgtcccctcatccaccgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactcccagaccgtgcttcgtgacctcgccaagcaggcttttgatgaggccatctcggaacctggactctctgagcgaggagtcctacaaggacacgcactttgatcatgcagcttctgcgtgataacctgacactcgtggacttctgtacatctcggaagacgctgactgaagaaatgaaggat

SEQ ID NO: 9310 - DNA, 1227 bp, Echinochloa colona
aggccaccgattcgaacgcagcagagcgaggaggacgcacgcagagatttagcacaccgcaagttttagacactgaacaagatggcatcagcggagctttcccgtgaggagaatgtgtacatggccaagctcgccgagcaggctgagaggtacgaggagatggttgagttcatggagaaggtagccaagaccgttgactcagaggagctcacagtcgaggagcgcaacctcctgtctgttgcatacaagaatgtcattggagcccgccgtgcctcatggcgcatcatctcctccattgagcagaaggaagagggccgaggcaatgaggaccgtgtaacactcatcaaggactaccgtggcaagattgagactgagctcaccaagatctgtgatggcatccttaagctgctcgagtcccaccttgtgccctcgtccactgcccccgagtccaaggtcttctacctcaagatgaagggtgactattacagataccttgctgagttcaagactggggctgagagaaaggatgctgctgagaataccatggtggcatacaaggctgcccaggacattgctctggctgagctgcctccaactcaccctattaggcttggcctggcacttaacttctcagtgttcttctatgagattctcaactctcctgatcgcgcctgcagtctagcaaagcaggctttcgatgaggccatctcagagctggataccctgagcgaggagtcctacaaggacagcactttgatcatgcagctccttcgtgataacttgaccctctggacttccgacatctcggaggacccagctgaagagatcagggaggcacccaagcgcgactcaagcgaggggcagtaaagccggctttacgtgccctagaaactagtagctagcgtttgctgttgtctaatgacactatgcaatatgatctggaccctggtttcttcggtgcgacgcttgtagccgtgctataattattgtcgggaaaatctgggggctctccatatgagatgttgccgggcagggtgtcgttgtgtcccacttgtagttgtagcaggtgggggtgcactgaacctgctctggctgggtagggaagtccctttaaaattgttggtgtcactttgtattttaccttttcatcgctggttattgtgggtggtcctgcgtcaattgctggtctctgttatcgcctgtcggttcttttttgggttcctctac

SEQ ID NO: 9311 - DNA, 1156 bp, Zea mays
cccaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcc

SEQ ID NO: 9312 - DNA, 1171 bp, Pennisetum glaucum
ctcgcaagcgccccccaattcgaacgccggagcgcgacgaagacgcacgcagagatttggcacactgcaagtaataggaactgaactgtaagatggcatcagctgagctttcccgtgaggagaatgtgtacatggccaagctcgccgagcaagctgagaggtatgaggagatggttgagttcatggagaaggtagccaagaccgtggactcggaggagctcaccgtggaggagcgcaacctcctttctgttgcatacaagaatgtcattggggcccgtcgtgcctcatggcgcatcatctcctccatcgagcagaaggaggagggccgaggcaatgaggaccgtgtaactctcatcaaggactaccgtggcaaaattgagactgagctcaccaagatctgtgacggcatcctcaagctgctagagtcccacctggtcccctcttccacagcccctgagtccaaggtcttctacctcaagatgaagggtgactactacagataccttgctgagttcaagactggggctgagagaaaggacgctgctgagaataccatggtggcatacaaggctgctcaggacattgctttggctgagctggctccaactcaccctattaggcttggtctggcacttaacttctcagtgttctactatgagattctgaactcacctgatcgcgcctgcagtcttgcaaagcaggcttttgatgaggccatctcagagcttgacaccctgagcgaggagtcctacaaggacagcactttgatcatgcaactccttcgtgataacttgaccctatggacctctgacatctcggaggaccctgcggaagagatcagagaggcgcccaagcgcgactcgagcgaggggcagtaaagacggatctacgtgccctagaaactagtagctagtgtttgctgctgtctaatgacattatgcaatgtgatctggaccctggtttctttggtgcgaggctgtagccgtgctatgattattgtcgggaaaatctgggggctccctatatgagatgttgccgggcaaggctttcggtggtgggggtcactggagctaggtttggttgggttgggaatccttttaaaactgttggtgtcactttgtatttttaccttttcatcgctgtttattatgagtggtgctgcgtcaattgt

SEQ ID NO: 9313 - DNA, 1162 bp, Pennisetum glaucum
aagcgccccccaattcgaacgccggagcgcgacgaagacgcacgcagagatttggcacactgcaagtaataggaactgaactgtaagatggcatcagctgagctttcccgtgaggagaatgtgtacatggccaagctcgccgagcaagctgagaggtatgaggagatggttgagttcatggagaaggtagccaagaccgtggactcggaggagctcaccgtggaggagcgcaacctcctttctgttgcatacaagaatgtcattggggcccgtcgtgcctcatggcgcatcatctcctccatcgagcagaaggaggagggccgaggcaatgaggaccgtgtaactctcatcaaggactaccgtggcaaaattgagactgagctcaccaagatctgtgacggcatcctcaagctgctagagtcccacctggtcccctcttccacagcccctgagtccaaggtcttctacctcaagatgaagggtgactactacagataccttgctgagttcaagactggggctgagagaaaggacgctgctgagaataccatggtggcatacaaggctgctcaggacattgctttggctgagctggctccaactcaccctattaggcttggtctggcacttaacttctcagtgttctactatgagattctgaactcacctgatcgcgcctgcagtcttgcaaagcaggcttttgatgaggccatctcagagcttgacaccctgagcgaggagtcctacaaggacagcactttgatcatgcaactccttcgtgataacttgaccctatggacctctgacatctcggaggaccctgcggaagagatcagagaggcgcccaagcgcgactcgagcgaggggcagtaaagacggatctacgtgccctagaaactagtagctagtgtttgctgctgtctaatgacattatgcaatgtgatctggaccctggtttctttggtgcgaggctgtagccgtgctatgattattgtcgggaaaatctgggggctccctatatgagatgttgccgggcaaggctttcggtggtgggggtcactggagctaggtttggttgggttgggaatccttttaaaactgttggtgtcactttgtatttttaccttttcatcgctgtttattatgagtggtgctgcgtcaa

SEQ ID NO: 9314 - DNA, 1012 bp, Sorghum bicolor
gcgcacccccaattcgaacgccggagctcgacgaggacgacagcacgcagagatccggcctactgcaagttttgaaaaccgaactgtaagatggcatcagcagagctttcccgtgaggaaaatgtgtacatggccaagctcgcggagcaggcagagaggtacgaggagatggttgagttcatggagaaggtagccaagactgttgactctgaggagctcactgtggaggagcgcaacctcctgtctgttgcatacaagaatgtcattggagcccgccgcgcctcatggcgcatcatctcctccattgagcagaaggaggagggccgtggcaatgaggaccgtgtaacactcatcaaggactaccgtggcaagattgagactgagctcaccaagatctgcgatggcatcctcaagctgctcgagtcccaccttgtgccctcttcaactgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcacttaacttctcagtgttctactatgagattctcaactcacctgatcgcgcctgcagtcttgcaaagcaggcttttgacgaggccatctcggaactggacaccctgagcgaggagtcctacaaggacagcactttgatcatgcagctcctccgtgataacttgaccctatggacttctgacatctcggaggaccctgctgaagagatcagggaggcacccaagcgtgactcgagcgaggggcagtaaagccggctttacgtgcctagaaactagtagctagtgtttgctgctgtctaatgacactatgcaatgtgatctggaccctggtttcttgggtgcgacccttgtagccgtgttatgattattgtcgggaaaatttggg

SEQ ID NO: 9315 - DNA, 1092 bp, Saccharum officinarum
gtctcttcgcgcacccccaattcgaacgccggagctcgacgaggtcgacgcacgcagagatccggcgtactgcaagttttgaaaactgaattgtaagatggcatcagcagagctttcccgtgaggaaaatgtgtacatggccaagcttgcggagcaggcagagaggtacgaggagatggttgagttcatggagaaggtagccaagactgttgactctgaggagctcactgtggaggagcgcaacctcctgtctgttgcatacaagaacgtcattggagcccgccgtgcctcatggcgcatcatctcctccattgagcagaaggaggagggccgaggcaatgaggaccgcgtaacactcatcaaggactaccgtggcaagattgagactgagctcaccaagatctgcgatggcattctcaagctgctcgagtcccaccttgtgccctcttcaactgctcccgagtccaaggtcttctacctcaagatgaagggtgactactacagataccttgctgagttcaagactggagctgagagaaaggacgctgctgagaacaccatggtggcatacaaggctgcccaggatattgctttggctgagcttgctccaactcaccctattaggcttggactggcacttaacttctcagtgttctactatgagattctcaactcacctgatcgtgcctgcagtcttgcaaagcaggcttttgatgaggccatctcggaactggacaccctgagcgaggagtcctacaaggacagcactttgatcatgcagctcctccgtgataacttgaccctatggacttctgacatctcggaggaccctgctgaagagatcagggaggcgcccaagcgcgactcgagcgaggggcagtaaagccggctttacgtgcctagaaactagtagcttagtgtttgctgctgtctaatgacactatgcaatgtgatctggaccctggtttcttggtgcttgtagccgtgttatgattattgtcgggaaaatttgggggcctcccatatgagaatgcctgcgggccagccttccttgtccaacctcgtttcaggcaggggcactggagccagctt

SEQ ID NO: 9316 - DNA, 1185 bp, Zea mays
cttgccgcaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaa

SEQ ID NO: 9317 - DNA, 1226 bp, Avena sativa
cgccgacgcacgcaagcacagatttgctattcagaacaaggttaagcattctgaactgcgaagatgtcggcaccagtggagctttcccgggaggagaacgtgtacatggccaagctcgccgagcaggccgagaggtacgaggagatggtcgagttcatggagaaggtggccaagaccgtcgactccgaggagctcaccgtggaggagcgcaacctcctctctgtcgcgtacaagaatgtgattggagcacgccgtgcctcgtggcgcatcatctcctccattgaacagaaggaggagagccgtggcaacgaggaccgggtcacgctcatcaaggactaccgtggcaagatcgagactgagcttaccaagatctgcgatggcatcctcaagctgctcgaaacccaccttgtcccctcttccaccgctcctgagtccaaggtcttctaccttaagatgaagggtgactactacaggtatcttgccgaattcaagagtggggctgagaggaaggatgctgctgagaataccatggtggcatacaaggctgctcaggatattgctttggctgagctggctccaactcatccaattaggcttggtctggcactgaacttctccgtgttctattatgagatcctcaactcgcctgatcgtgcttgcaatcttgcaaagcaggctttcgatgaggccatttcagagctggacaccctgagcgaagaatcctacaaggacagcactttgatcatgcaactccttcgtgacaacttgaccctgtggacttcagacatcacggaggacactgctgaggaggagatcagggaggcgccgaagggcgaggggcagtaaagctggttttatgcacccccatgacatagtgtttggtactgtctattggcactgcagcgtgttgtggatcatgtcctagctgtgttatggttgttgtcgctaaatttggggggctccccgtatgtgatgtgctatgattggttttggtcgccgcctgtaggcttgtcgcacagcagacggtgactttagcctggactggcttggggggagagcccctcttacattattggtggtggcagttcgtatttcggtctgccttgctgtttatcctgattggtcctgtgtcattgtctgcctttttcgtcagttcttttcgtggtcagttaatggtacttgcatctgctaaggctttcagccagcgttgtttactgattccccgc

SEQ ID NO: 9318 - DNA, 1221 bp, Avena sativa
tgcccagttcgaacgaaagcctgagagagcccgaggagcagaccagcgccgacgcacgcaagcgcagatttgctattcggaagaaggttaaactttctgaactgccaagatgtcggcaccagtggagctttcccgggaggagaacgtgtacatggccaagctcgccgagcaggccgagaggtacgaggagatggtcgagttcatggagaaggtggccaagaccgtcgactccgaggagctcaccgtggaggagcgcaacctcctctctgtcgcgtacaagaatgtgattggagcacgccgtgcctcgtggcgcatcatctcctccattgaacagaaggaggagagccgtggcaacgaggaccgggtcacgctcatcaaggactaccgtggcaagatcgagactgagcttaccaagatctgcgatggcatcctcaagctgctcgaaacccaccttgtcccctcttccaccgctcctgagtccaaggtcttctaccttaagatgaagggtgactactacaggtatcttgccgaattcaagagtggggctgagaggaaggatgctgctgagaataccatggtggcatacaaggctgctcaggatattgctttggctgagctggctccaactcatccaattaggcttggtctggcactgaacttctccgtgttctattatgagatcctcaactcgcctgatcgtgcttgcaatcttgcaaagcaggctttcgatgaggccatttcagagctggacaccctgagcgaagaatcctacaaggacagcactttgatcatgcaactccttcgtgacaacttgaccctgtggacttcagacatcacggaggacactgctgaggaggagatcagggaggcgccgaagggcgagggacagtaaagccagttttatgcaccccatgacatagtgtttggtattatctattggcactgcagtgtgttgtggatcatgtcctagctgtgttatggttattgtcgctaaatttggggggctccctgtatgtgatgtgctaggataggttttcgtcgccgcctgtaggcttgtcgcatagcaggcggtgactttaccctggactagcttggggggagagcccctcttacattgttggtggtggcagttcgtgtttctggtctgccttgctgtttatcctgattggtcctgcgtcattgtctgccttcgacagttttttccgtggtcggttaatggta

SEQ ID NO: 9319 - DNA, 1208 bp, Avena sativa
gcctgagagagcccgaggagcagaccagcgccgacgcacgcaagcgcagatttgctattcggaagaaggttaagcattctgaactgcgaagatgtcggcaccagtggagctttcccgggaggagaacgtgtacatggccaagctcgccgagcaggccgagaggtacgaggagatggtcgagttcatggagaaggtggccaagaccgtcgactccgaggagctcaccgtggaggagcgcaacctcctctctgtcgcgtacaagaatgtgattggagcacgccgtgcctcgtggcgcatcatctcctccattgaacagaaggaggagagccgtggcaacgaggaccgggtcacgctcatcaaggactaccgtggcaagatcgagactgagcttaccaagatctgcgatggcatcctcaagctgctcgaaacccaccttgtcccctcttccaccgctcctgagtccaaggtcttctaccttaagatgaagggtgactactacaggtatcttgccgaattcaagagtggggctgagaggaaggatgctgctgagaataccatggtggcatacaaggctgctcaggatattgctttggctgagctggctccaactcatccaattaggcttggtctggcactgaacttctccgtgttctattatgagatcctcaactcgcctgatcgtgcttgcaatcttgcaaagcaggctttcgatgaggccatttcagagctggacaccctgagcgaagaatcctacaaggacagcactttgatcatgcaactccttcgtgacaacttgaccctgtggacttcagacatcacggaggacactgctgaggaggagatcagggaggcgccaaagggcgaggggcagtaaagctggttttatgcacccccatgacatagtgtttggtactgtctattggcactgcagcatgttgtggatcatgtcctagctgtgttatggttgttgtcgctaaatttggggggctccccgtatgtgatgtgctatgattggttttggtcgctggttttggtcgcctcctgtaggcttgtcgcacagcagacggtgacttagcctggactggcttggggggagagcccctcttacattattggtggtggcagttcgtatttcggtctgccttgctgtttatcctgattggtcctgtgtcattgtctgcctttttcgtcagttcttttcgcggtca

SEQ ID NO: 9320 - DNA, 1592 bp, Panicum virgatum
cggtccccacacgtcgtgacggccttgtgcctccgcgcctgcgcggtggggcccgacgaccacatgggccgcgccggggcttggagctgccacggtggcgcccacacgcggcgcgctaccattgggcggaggtactcggaggcagcccttttctaggccccccggggcagcgccgggggccgccccttcgcaagagcctcctccccacccctttcgaacgccggagcgcgaggaagacgcacgcagagaattggcgcactgcaagaattagaaactgaactgtaagatggcatcagcggagctttcccgtgaggagaatgtgtacatggccaagctcgctgagcaggctgagaggtacgaggagatggttgagttcatggagaaggtagccaagactgttgactcagaggagctcactgtcgaggagcgcaacctcctttctgttgcgtacaagaatgtcattggagcccgccgtgcttcgtggcgcatcatctcctcgattgagcagaaggaggagggccgaggcaatgaggaccgtgtaacactcatcaaggactaccgtggcaagattgagactgagctcaccaagatctgtgatggcatcctcaagctgctcgagtcccaccttgtgccctcatccactgcccccgagtccaaggtcttctacctcaagatgaagggtgactactacagataccttgctgagttcaagactggggctgagagaaaggatgctgctgagaataccatggtggcatacaaggctgcccaggacattgctttggctgagctacctccaactcaccctattaggcttggcttggcacttaacttctcagtgttctactatgagattctcaactcacctgatcgtgcctgcagtcttgcaaagcaggcttttgatgaggccatctcggagctggacaccctgagcgaggagtcctacaaggacagcactttgatcatgcagctccttcgtgataacttgaccctatggacatccgacatctcggaggaccctgctgaggagatcagggagccgctgaagcatgactcgagcgaggggcagtgaagcaggctttacgtgccctagaaactagtagctagtgtttgctgctgtctaatgacactatgcaatatgatctggaccctggtttcttcggcgcgatgcttgtagccgtgctatgactattgtcgggaaaattctgggggctccccatatgagatgttgccgggcaaggcctcgatgtgtcccacttgtagtaggtgggggacactggagccgggtttggttgggtagggaagccaaactgttggtgtcacttgtatttttaccttttcgtcctgtttattgtgagtggtcctgcgtcaattgctggtctatgctgtcggttcttcgattcttttcccgacccatctcagcgatgaatgttttttctttggtcgggtaaaatgaggtgaagttattatggtttgatcaactatttactagtagttgtttctgcacctagggtgatttgtaaatctctaccaaaccatcaatcctccccttcggttaaaattcgagatctagctcgataaaaggaattcta

SEQ ID NO: 9321 - DNA, 1123 bp, Triticum aestivum
gaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaaggaggagggccgaggcaatgaggaccgagtaacactcatcaaggattaccgtggcaagattgagactgagctgaccaagatctgtgatggatcctcaagctgcttgagaccatcttgtgccgtcttcaactgcccccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgctagtagccgtgttatgattattgtcgggaaaatttgggggctccccatatgagatgctgccgggcaagacctcgatgccccacctcgtttcaggcgggggcactagagccaggcccggttgggttgggaagccccttaaactgttgtcacttgcatttt

SEQ ID NO: 9322 - DNA, 1104 bp, Festuca arundinacea
gagcaccaggagcagagcagaccagcgccgacgcacgcaaacacagatttggtcttcagaacaagccgtgagctttcaacatgtcggcaccagcggagctttcccgggaggagaacgtgtacatggccaagctcgccgagcaggccgagaggtacgaggagatggtcgagttcatggagaaggtggccaagaccgtcgactcggaggagctcaccgtcgaggagcgcaacctcctctccgtcgcctacaagaacgtcatcggggcgcgccgcgcctcctggcgcatcatctcctccatcgagcagaaggaggagagccgcggcaacgaggaccgcgtcacgctcatcaaggactaccgcggcaagatcgagaccgagctcaccaagatctgcgacggcatcctcaagctgctcgagacacacctcgtcccctcctccaccgcccctgagtccaaggtcttctacctcaagatgaagggtgactactacaggtatcttgcggaattcaagagtggggctgagaggaaggatgctgctgagaataccatggtggcatacaaggctgctcaggatattgctttggctgagctggctccaactcaccccattaggcttgggctggcactcaacttctcggtgttctattatgagatcctcaactcgcctgatcgtgcttgcaaccttgcaaagcaggctttcgatgaggccatctcggagttggacaccctgagcgaggaatcctacaaggacagcactttgatcatgcaactccttcgtgacaacttgaccctgtggacttcagacatcacggaggacactgcggaggaggagatcagggaggccccgaagggcgccgccgagtaaagctggctttacccaccccatgacatagtgtttggtactgtctattggcactgcagtgttttatggatcatgtcctagccgtgttatggctattgtcgcaaaattaggggctccccatatgtgatgttgctgggataggttgcggttgccgcttggacggagactgtagcctggactagcttggggggagagcccctcttacaatgttggtggtggcgtattttatcgtgattggtcctgt

SEQ ID NO: 9323 - DNA, 1159 bp, Leymus cinereus x Leymus triticoides
gcacgagggaggaaaccagcggcgacgccaacgcacgcagatttggcatttagaaaaaggtaaaatcgtaaactgtgaagatgtcggcaccagcggagctttcccgtgaggagaatgtgtacatggctaagctcgccgagcaggctgagaggtacgaggagatggttgagttcatggagaaggtggccaagacggtcgactccgaggaactcactgtggaggagcgcaacctcctctctgttgcatacaagaatgtgattggagcccgccgtgcctcatggcgcatcatctcctccattgaacagaaggaggagagccgtggcaatgaggaccgggtcacactcatcaaggaataccgtggcaagatcgaaactgagcttagcaagatctgcgatggcatcctcaagctgctcgaaacccaccttgtcccgtcttccactgcccctgagtccaaggtcttctaccttaagatgaagggtgactactacaggtatcttgcggaattcaagagtgggcctgagaggaaggatgctgctgagaatactatggtggcatacaaggctgctcaggatattgctttggctgagctggctccaactcatccaattaggcttgggctggcactaaacttctcggtgttctattatgagatcctcaactcgcctgatcgtgcttgcaatctcgcaaagcaggcattcgatgaggccatttcggaactggacaccctaagcgaagaatcctacaaggacagcactttgatcatgcaactccttcgtgataacttgaccctctggacttctgacatcacggaggacaccgcggaggaggagatcagggaggcgccgaagcacgactccagcgaggggcagtaaagctgtctttgcgatgccccgcaagctactagctagtgtttgctactgtcaatgacgttgcaatgtgctctggatcatgtcgtagccgtgttatggttgttgttgcaagatttggggctccccgtatgtgatgttgctagggaaggttgttgtcgccgcttgtagcatagcaggcggggactgcctcctggtctggcttgggggggagccccatacgctgctggtggtggccgttcgtatttcgttgtgccttaatattgcttcttatcgtgagtggtccttcgtca

SEQ ID NO: 9324 - DNA, 1357 bp, Secale cereale
ggcgacgcgaacgcacgcagatttggcatttagaaaggaaaaaattgtaaactgtgaagatgtcggcaccagcggagctttcccgtgaggagaatgtttacatggctaagctcgctgagcaggctgagaggtacgaggagatggttgagttcatggagaaggtggccaagaccgtagactctgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagattgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctttggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatgccccgcaagctactagctagtgtttgctactgtcaatgacattgcaatgtgctctggaccgtatcatagctgtgttatggttgttgttgcaagatttggggctccccatatgtgatgttgccagggaaggttgtggtcgccgcttgtagcgtagcaggcggggactgcctcctggtttggcttgttgggggggagccccatacactgctcctggtggtggccgttcgtattttcgttctgccttaaatattgcttcttatcgtgagtggtcctgcgtctgtgtctcttgcctgttctgtttcagttcttttggtgtttttgactgggggttctcgcacttgatctggctttgaggctggctcatttgggattggccgggttgcttgctccggataagattgtagcgctgtcaaaattcgatggagtcagcccttcctgtacctgaaattctgaaatagacgtcctagcccatctccatccaaaaaaaaaa

SEQ ID NO: 9325 - DNA, 1105 bp, Secale cereale
atttggcatttagaaagaaaaaaattgtaaactgtgaagatgtcggcaccagcggagctttcccgtgaggagaatgtttacatggctaagctcgctgagcaggctgagaggtacgaggagatggttgagttcatggagaaggtggccaagaccgtagactctgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctttggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatgccccgcaagctactagctagtgtttgctactgtcaatgacattgcaatgtgctctggaccgtatcatagctgtgttatggttgttgttgcaagatttggggctccccatatgtgatgttgccagggaaggttgtggtcgccgcttgtagcgtagcaggcggggactgcctcctggtttggcttgttgggggggagccccgatacactgctcctggtggtggccgttcgtattttcgttctgccttaaatattgcttct

SEQ ID NO: 9326 - DNA, 1294 bp, Secale cereale
gtacactgggacgcgaacgcacgcagtacccccgcctcctcgccgtttctcctcaaactctcgtctccacgtctctcaatttccttccaattatcgtcgttcgactagatcctcaccgatttggcatttagaaagaaaaaattgtaaactgtgaagatgtcggcaccagcggagctttcccgtgaggagaatgtttacatggctaagctcgctgagcaggctgagaggtacgaggagatggttgagttcatggagaaggtggccaagaccgtagactctgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagattgaaactgagcttagcaagatctgtgatggcatcctcaagctgctcgaaacccatcttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctttggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatgccccgcaagctactagctagtgtttgctactgtcaatgacattgcaatgtgctctggaccgtatcatagctgtgttatggttgttgttgcaagatttggggctccccatatgtgatgttgccagggaaggttgtggtcgccgcttgtagcgtagcaggcggggactgcctcctggtttggcttgttgggggggagccccatacactgctcctggtggtggccgttcgtattttcgttctgccttaaatattgcttcttatacaaaaaaaaaaaaaaaaagaaaaaaaaaaagaaactctagtcgttgagtacacctagtctacttcgtag

SEQ ID NO: 9327 - DNA, 1447 bp, Secale cereale
ccctcgcaacctcggttgtcccgctgcgccgtggggccgagagggggacacgcgtcggggccccattgggcgcaggggcctcgggggttgcttttctaggcccccccgggcgccgcctcctctccccagttcgaaagcccagacgcgacgaaaccagcggcgacgcgaacgcacgcagatttggcatttagaaaggaaaaaattgtaaactgtgaagatgtcggcaccagcggagctttcccgtgaggagaatgtttacatggctaagctcgctgagcaggctgagaggtacgaggagatggttgagttcatggagaaggtggccaagaccgtagactctgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagattgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctttggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatgccccgcaagctactagctagtgtttgctactgtcagtgacattgcaatatgctctggaccgtgtcatagctgtgttatggttgttgttgcaagatttggggctccccatatgtgatgttgccagggaaggttgtggtcgccgcttgtagcgtagcaggcggggactgcctcctggtttggcgttgggggggagccccatacactgctcctggtggtggccgttcgtattttcgttctgccttaaatattgcttcttatcgtaaagaaaaaaaaaaaaaaaaaagaaaaaaaaaaaaaaaagaaaaaaaaaaaaaaagaaaaaaaaaaaagaaaaaaaaacaaaaaaagaaaagaaaaagaagaagaagagagagagagatagagagagacagacagacgagacagacgagagagagggagga

SEQ ID NO: 9328 - DNA, 987 bp, Secale cereale
gatttggcatttagaaagaaaaattgtaaactgtgaagatgtcggcaccagcggagctttcccgtgaggagaatgtgtacatggctaagctcgccgagcaggctgagaggtacgaggagatggttgagttcatggagaaggtggccaagaccgtagactctgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctttggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatgccccgcaagctactagctagtgtttgctactgtcaatgacattgcaatgtgctctggaccgtgtcatagctgtgttatggttgttgttgcaagattttgggctcccatatgtgatgttgccagggaaggttgtggtcgccg

SEQ ID NO: 9329 - DNA, 1495 bp, Triticum aestivum
tgcggcgacacacgcagacgcaggtacccagccgtttcctcctcaaatcaaatctcgcctccccgtctctcaattctcctccgattatcgtcgtcgttcgactagatctgatttggcattcagaaaaaattaaaatcgtgaactgtgaagatgacggcaccagcggagctttcccgtgaggagaatgtgtacatggctaagctcgccgagcaggctgagaggtacgaggagatggttgagttcatggagaaggtggccaagaccgtcgactccgaggaactcactgtggaggagcgcaacctcctctctgttgcatacaagaatgtgattggagcccgccgtgcctcatggcgcatcatctcctccattgagcagaaggaggagagccgtggcaacgaggaccgggtcacgctcatcaaggaataccgtggcaagatcgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtgggcctgagaggaaggatgctgctgagaataccatggtggcatacaaggctgctcaggatattgctttggctgagctggctccaactcatccgattaggcttgggctggcactaaacttctcggtgttctattatgagatcctcaactcgcctgatcgtgcttgcaatctcgcaaagcaggcattcgatgaggccatttcggagctggacaccctgagcgaagaatcctacaaggacagcaccttgatcatgcaactccttcgtgataacttgaccctctggacttctgacatcacggaggacaccgcggaggaggagatcagggaggctccaaagaacgactcgagcgaggggcagtaaagccggctttgcgacgccccgcaagctactagctagtgtttgctactgtcaatgacgttgcaatgtgctctggatcgtgtcgtagttgtgttatggttgttgttgcaagatttggggctccccatatgtgatgttgccagggaaggttgtggtcgccgcttgtagcgtagcaggcggtggctgcctcctggtctggcttgggagggagccccatagactggtggtggtggccgttcgtattttcgttctgccttaatattgcttcttaaacgtgagtggttctgcatctgtgtctggcctgttctgtttcagttcttttggtggtttttcgtgggggttactcgcactgaatctggctttgtggctggctcatatgggaattgggattgcccgggttgtttgctccggacaagattgaagcgctgacaaaatgggttaattattcgatggacgcagcccttcctgaacctgaaattctgaaacagacgtcctagcacaactccttcctctccctaattcctgactcctatcctagctgctctagcggttcctc

SEQ ID NO: 9330 - DNA, 1286 bp, Hordeum vulgare
cagttcgaaagcccgaggagaccagcggcgacgcaggcgcaaaacgcagatttggcattcagaaaaaattaaagcagtaaactgtgaagatgtcggcaccaggggagctttcccgtgaggagaatgtgtacatggctaagctcgccgagcaggctgagaggtacgaggagatggttgagttcatggagaaggtggccaagaccgtcgactccgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatatgtgatggcattctcaagctgcttgaaacccaccttgttccgtcttccactgcccctgagtccaaggtcttctatcttaagatgaagggtgactactacaggtatcttgcggaattcaagagtgggcctgagaggaaggatgctgctgagaataccatggtggcatacaaggctgctcaggatattgctttggctgagctggctccaacacatccgattaggcttgggctggcactaaacttctcagtgttctattatgagatcctcaactcgcctgatcgtgcttgcaatcttgcaaagcaggcattcgatgaggccatttcggagctggacacactaagcgaagaatcctacaaggacagcaccttgatcatgcaactccttcgtgataacttgaccctctggacttccgacatcacggaggacaccgcggaggaggagatcagggaggctccgaagcatgactcgagcgaggggcagtaaagccggctttgcgacgccccgcaagctactagctagtgctcgctactgtcaatgacgttgcatgcaatgtggtctggatcgtgtcgtagccgtgtgttatggttgttgttgcaagatttggggctccccgtatgtgatgttgccggggaaggttgtggtcgctgcctgtaggcggctgcctcctggtctggcttgggggggagccacatgcactgctggtggtcgtggccgttcgtattttcgttctgccttaatgttgcttcttatcgtgagtagtggtcctgtttcggttcgcttggtggcttttggtggggggtctcgtggtgaatcttgctttgaggctggctcatttggggttggacgggttgttttctccgggcaaggttgaagcgctgacaaaatggg

SEQ ID NO: 9331 - DNA, 1725 bp, Hordeum vulgare
gtggtcgagcttatcggcacgacgcgcccggggcccgcctgtcggtcgtccccatcgcagagcctcggttgtcccgctgcgcggtggggctagcgcgggggcacgcgtcgggccgccattgggcgcaggggcctcggggggttgcttttctaggcccccccgggcgccgcctcctctccccagttcgaaagcccgaggagaccagcggcgacgcaggcgcaaaacgcagatttggcattcagaaaaaattaaagcagtaaactgtgaagatgtcggcaccaggggagctttcccgtgaggagaatgtgtacatggctaagctcgccgagcaggctgagaggtacgaggagatggttgagttcatggagaaggtggccaagaccgtcgactccgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatatgtgatggcattctcaagctgcttgaaacccaccttgttccgtcttccactgcccctgagtccaaggtcttctatcttaagatgaagggtgactactacaggtatcttgcggaattcaagagtgggcctgagaggaaggatgctgctgagaataccatggtggcatacaaggctgctcaggatattgctttggctgagctggctccaacacatccgattaggcttgggctggcactaaacttctcagtgttctattatgagatcctcaactcgcctgatcgtgcttgcaatcttgcaaagcaggcattcgatgaggccatttcggagctggacacactaagcgaagaatcctacaaggacagcaccttgatcatgcaactccttcgtgataacttgaccctctggacttccgacatcacggaggacaccgcggaggaggagatcagggaggctccgaagcatgactcgagcgaggggcagtaaagccggctttgcgacgccccgcaagctactagctagtgctcgctactgtcaatgacgttgcatgcaatgtggtctggatcgtgtcgtagccgtgtgttatggttgttgttgcaagatttggggctccccgtatgtgatgttgccggggaaggttgtggtcgctgcctgtaggcggctgcctcctggtctggcttgggggggagccacatgcactgctggtggtcgtggccgttcgtattttcgttctgccttaatgttgcttcttatcgtgagtagtggtcctgtttcggttcgcttggtggcttttggtggggggtctcgtggtgaatcttgctttgaggctggctcatttggggttggacgggttgttttctccgggcaaggttgaagcgctgacaaaatgggttaattaagcgctgacaaaatgggttaattaagcgctgacaaaatgagttagttaaacgctggtttatttgaaattcagaaacagacgtcctagcctatctcctttgtctcctaattcctgaatccaagctgctataggcctatagcggtgcctctggctgtgcgatccgggcgcagttcggcggaatgcttttctgtaaggatttgcggaggtgccagcgtgtgcgagtgttggcatgttgggtgatgtgtgcgtcac

SEQ ID NO: 9332 - DNA, 1127 bp, Festuca arundinacea
gagcaccaggagcagaccagaccagcgccgacgcacgcaaacacagatttggtcttcacaacaagccgcgagccttcaacatgtcggccccagcggagctttcccgggaggagaacgtgtacatggccaagctcgccgagcaggccgagcgctacgaggagatggtcgacttcatggagaaggtggccaagacggtcgactcggaggagctcaccgtcgaggagcgcaacctcctctccgtcgcctacaagaacgtcatcggggcgcgacgcgcctcctggcgcatcatctcctccatcgagcagaaggaggagagccgcggcaacgaggaccgcgtcaccctcatcaaggactaccgcggcaagatcgagaccgagctcaccaagatctgcgacggcatcctcaagctgctcgagacccacctcgtcccatcctccaccgcacccgagtccaaggtcttctacctcaagatgaagggtgactactacaggtatcttgcggaattcaagagtggggctgagaggaaggatgctgctgagaataccatggtggcatacaaggctgctcaggatattgctttggctgagctggctccaactcatcccattaggcttgggctggcactcaacttctcggtgttctactatgagatcctcaactcgcctgatcgtgcttgcaacctcgcaaagcaggctttcgatgaggccatctctgagttggacaccctgagcgaggaatcctacaaggacagcactttgatcatgcaactccttcgtgacaacttgaccctgtggacttcagacatcacggaggacactgcggaggaggagatcagggaggccccgaagggagccgccgagtaaagctggctttacccatcccatgacatagtgtttggtactgtctattggcactgcagtgtgttatggatcatgtcctagccgtgttatggttattgtcgcaaaatttggggctccccatatgtgatgttgctgggataggttgcggttgccgcttggacggagactgtagcctggactagcttggggggagagcccctcttacaatgttggtggtggcgtattttatcgtgattggtcctgtgtaaaaaaaaaaaaaaaaaaaaa

SEQ ID NO: 9333 - DNA, 1287 bp, Secale cereale
cgaacgcacgcaggtacccccgctcctgccgttttctcctcaaatctcgtctcccagtctctcaattttcctccaattatcgtcgttcgactagatcttcaccgatttggcatttagaaagaaaaaattgtaaactgtgaagatgtcggcaccagcggagctttcccgtgaggagaatgtttacatggctaagctcgctgagcaggctgagaggtacgaggagatggttgagttcatggagaaggtggccaagaccgtagactctgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctatggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatgccccgcaagctactagctagtgtttgctactgtcaatgacattgcaatatgctctggaccgtgtcatagctgtgttatggttgttgttgcaagatttggggctccccatatgtgatgttgccagggaaggttgtggtcgccgcttgtagcgtagcaggcggggactgcctcctggtttggcttgggggggagccccatacactgctcctggtggcggccgttcgtattttcgttctgccttaaatattgcttcttatcgtgagtggtcctgcgtctgtgtctctggcctgttctgtttctagttcttttggtgttttggacgttggggttctcgtcg

SEQ ID NO: 9334 - DNA, 1078 bp, Secale cereale
aaagaaaaaaattgtaaactgtgaagatgtcggcaccagcggagctttcccgtgaggagaatgtttacatggctaagctcgctgagcaggctgagaggtacgaggagatggttgagttcatggagaaggtggccaagaccgtagactctgaggaactcactgtggaggagcgcaacctcctctctgttgcatacaagaatgtgattggagcccgccgtgcctcatggcgcatcatctcctccattgaacagaaggaggagagccgtggcaacgagaccgggtcacactcatcaaggaataccgtggcaagatcgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctttggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatgccccgcaagctactagctagtgtttgctactgtcaatgacattgcaatgtgctctggaccgtatcatagctgtgttatggttgttgttgcaagtatttggggctcccatatgtgatgttgccgaggaaggttgtggtcgccgcttgtagcgtagcgagggcgggactcgcccttccgtggtttggtcggttgggggggacgccccgataccactgctccgtgggtggtggtccgttcgttatttt

SEQ ID NO: 9335 - DNA, 1336 bp, Lolium multiflorum
agcgccgacgcacgcaccacagacttggtattcagaacaagccgtgaccagcaaacatgtcggcgccagcggagctttcccgggaggagatggtgtacatggccaagctggccgagcaggcggagcggtacgaggagatggtggagttcatggagaaggtggccaagacggtcgactcggaggagctcaccgtcgaggagaggaacctgctctccgtcgcctacaagaacgtcatcggcgcgcgccgcgcctcctggcgcatcgtctcctccatcgagcagaaggaggagagccgcggcaacgaggaccgcgtcaccctcatcaaggactaccgcggcaagatcgagaccgagctcaccaagatctgcgacggcatcctcaagctgctcgagacccacctcgtcccctcctccaccgcaccagagtccaaggtcttctacctcaagatgaagggtgactactacaggtatcttgcggaattcaagagtggggctgagaggaaggatgctgctgagaatacaatggtggcatacaaggctgctcaggatattgctttggctgagctggctccaactcaccccattaggcttgggctggcactcaacttctcggtgttctattatgagatcctcaactcgcctgatcgtgcttgcaacctcgcaaagcaggctttcgatgaggccatctcggagctggacaccctgagcgaggaatcctacaaggacagcactttgatcatgcaactccttcgtgacaacttgaccctgtggacttcagacatcacggaggacaccgcagaggaggagatcagggaggccccgaagggagccgccgagtaaagctggctttacccaccccatggcatagtgtttggtactgtctatcggcactgcagtgtgttatggatcatgtcctagctgtgttatggttattgtcgcaatatttggggctccccgtatgtgatgttgctgggataggttgtggtcggctggtcgccgcttcgacggggacggtagcctaacttggcttggggggagagcccctcttacagtgttggtggtgtcagttcgtattttatggtgattggtcctgcgtcaatgcctggcttcttctactgttttttgtggtttgtggtaggttagtgggttcttgcacctggtaaggctttcagcctggctcataagatctaagcgatatgactgggttgattattcgatgggatatggccatatcggaaaatcttaccttgtacctaaatcgacgcatcttgctgataccgtctcagtagtctgtcactagtgccctctgaatcctgattcctatctcttggctgctg

SEQ ID NO: 9336 - DNA, 1079 bp, Cynodon dactylon
acaggagccacacagtgaagatgtcgcagcctgctgagctttcccgtgaagaaaatgtttacatggctaagcttgcagagcaggccgagaggtatgaagagatggttgagttcatggagaaggtggcaaaggcagttgattcggaggagctcacagtggaggagcgcaaccttctatcagttgcttacaagaacgtcattggagccagacgtgcctcatggcgcatcatatcctctattgaacagaaggaagagggtcgtggcaatgaggaccgtgtcactcttatcaaggactaccgcagcaagatagagaccgaactaactaagatctgtgatggaatcctcaagctccttgattcccaccttatcacctcatctactgctcccgagtccaaggtcttttacctcaagatgaagggtgactattacaggtaccttgcagagtttaagactgattctgagaagaaggatgctgctgacaacacaatggtggcatacacagctgctcaggaaattgcagtagcagagttggcccctactcatcccattaggctcggactggcgctcaacttctcagtattttattatgagatcctcaactctcctgaccgtgcttgcaatcttgccaaacaggcttttgatgatgccatcgcagagctggataccctgagcgaggaatcttacaaggacagcaccttgatcatgcagcttctgcgtgataacttgaccttgtggacttcggacatcacggaggacactgttgacgaaatcaaggaggctcccaagggtgaatctggagatgggcagtgaagatgattcgtgcgccaagaaaacaataacataattggtcttctagtgacattgcattgtgctggggtttcttgttttatcaatatagacttgtgcttttcttgtgatagttcgacttctatttgtgttgtgctaggaacgcttgcaagtgcctcggtgtttggcaagtggtgcagtcaagctatatcggttcagcagagacaccatgttacttaaatttttaagattttgcttcttgtttcctgtgatccaaagtctatattccattca

SEQ ID NO: 9337 - DNA, 1012 bp, Festuca arundinacea
gagctttcccgggaggagaacgtgtacatggccaagctggcagagcaggcggagaggtacgaggagatggtcgagttcatggagaaggtggccaagaccgtcgactcggaggagctcaccgtggaggagcgcaacctcctctctgtcgcctacaagaacgtgatcggggcgcgccgtgcctcatggcgcatcatctcctccatcgagcagaaggaggagagccgtggaaacgaggacagggtcacgctcatcaaggactaccgcggcaagatcgagactgagctcaccaagatctgcgagggcatcctcaagctgctcgacacccacctcgtcccctcttccaccgctcccgagtccaaggtcttctacctcaagatgaagggtgactactacaggtatcttgcggaattcaagagtggcgctgagaggaaggatgctgctgagaataccatggtggcatacaaggctgctcaggatattgctttggctgagctggctccaactcatccaattaggcttgggctggcactaaacttctcggtgttctattatgagatcctcaactcgcctgatcgtgcttgcaacctcgcaaagcaggctttcgatgaggccatctcggagttggacaccctgagcgaagaatcctacaaggacagcactttgatcatgcaactccttcgtgacaacttgaccctgtggacttcagacatcacggaggacactgccgaggaggagatcagggaggccccgaagggcgccgccgagtaaagctggctttacccaaccccatgacatagtgtttggtactgtctattggcactgcagtgttttatggatcttgtcctagccgtgttatggttattgttgcaaaattaggggctccccatatgtggtgttgctgggataggttgcggttgccgcttggatggagactgtagcctggactagcttggggggagagcccctcttacaatgttggtggtggcgtattttatcgtgattggtcctgtgt

SEQ ID NO: 9338 - DNA, 1254 bp, Pennisetum glaucum
gaggaaacagaaagctgaaagcgagaagcattccttccccactcgattcgaaagggggaaccagcagcggcggcgagtttgacctttgttggaccgttagaaaccataaacagtgaagatgtcgcagcctgctgaactttcccgtgaggaaaacgtgtacatggctaagcttgcagagcaggctgagaggtatgaagagatggttgagttcatggagaaggtggctaagacagttgattctgaggagcttactgtggaggagcgcaaccttctgtcagttgcttacaagaatgtcattggagcccggcgtgcctcatggcgcatcatatcctccattgagcagaaagaagagggtcgtggcaatgaggaccgtgttactctcatcaaggactaccgtagcaagatagaagttgaactcaccaagatctgtgatggaattctcaagctccttgattcccaccttgtcccctcatctacagctccggagtccaaggtcttctacctcaagatgaagggtgactaccacaggtatctcgctgagtttaagactggtgcagagaggaaggaatctgctgagagcacaatggtggcttacaaggctgctcaggatattgctcttgctgagctggcacctacacatccgataaggcttggacttgctctgaacttctcggtgttctattatgagattctgaactccccagacaaagcatgcaaccttgcaaagcaggcattcgatgaggctatctcagagttggacactcttggggaggagtcatacaaagacagcactctaatcatgcagctcctgagggacaacctgaccctctggacctctgacctcacggaggatggtgctgaggatggcaaggaagccaccaaaggtgatgctggcgagggacagtaacccttagatgtccctgcgctgtcaaagctgtgtgctgcaccattattgtagctgttatcgtctaccctgctcgcttcttttcctgtagtaggctggtagaggtcgaattagttctcattgctttgcattgccgctagttggcactaggcccatgtggactggtattgttctcctggatttggcaagtatgtgtgtggttgctctagcgttttattgagcaatattgaagttgttttcatctagttgttgccatcagttattggtatttgcctgtctgctggctgcatgtattcttctgagttctgacacagtgcatctgggcctacgcaatggcaattggcaacatg

SEQ ID NO: 9339 - DNA, 938 bp, Secale cereale
aaaggaaaaaattgtaaactgtgaagatgtcggcaccagcgggagcttttcccgtgaggagaatgtttacatggctaagctcgctgagcaggctgagaggtacgaggagatggttgagttacatggagaaggtggccaagaccgtagactctgaggaactcactgtggaggagcgcgaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagattgaaactgagcttagcaagatctgtgatggcatcctcaagctgctcgaaacccaccttgtcccgtcttccactgcccctgagtccaaggtcttctatcttaagatgaagggtgactactacaggtatcttgccgaattcaagagtggccctgagaggaaggatgccgctgagaataccatggtggcatacaaggctgctcaggatattgctttggctgagctggctccaactcatccaattaggcttgggctggcactaaacttctcggtgttctattatgagatcctcaactcgcctgaccgtgcttgcaatctcgcaaagcaggcattcgatgaggccatttcggagctggacaccctgagcgaagaatcttacaaggacagcaccttgatcatgcaactccttcgtgataacttgaccctttggacttctgacatcacggaggacaccgcggaggaggaaatcagggaggctccaaagaacgactcaagcgaggggcagtaaagctggctttgcgatcgccccgcaagctactagctagtgtttgctactgtcaatgacattgcaatatgctctggaccgtgtcatagctgtgttagtggttgttgttgcgagtagtt

SEQ ID NO: 9340 - DNA, 1077 bp, Cenchrus ciliaris
gtgtacatggccaagctcgccgagcaagctgagaggtatgaggagatggttgagttcatggagaaggtagccaagaccgtggactcggaggagctcaccgtggaggagcgcaacctcctttctgttgcatacaagaatgtcattggagcccgtcgtgcctcatggcgcatcatctcctccatcgagcagaaggaggagggccgaggcaatgaggaccgtgtaactctcatcaaggactaccgtggcaaaattgagactgagctcaccaagatctgtgatggcatcctcaagctgctagagtcccaccttgtcccctcttccactgcccctgagtccaaggtcttctacctcaagatgaagggtgactactacagataccttgctgagttcaagactggggctgagagaaaggacgctgctgagaataccatggtggcatacaaggctgctcaggacattgctttggctgagctggctccaactcaccctattaggcttggtctggcacttaacttctcagtgttctactatgagattctgaactcacctgatcgcgcctgcagtcttgcaaagcaggcttttgatgaggccatctcagagctcgacaccctgagcgaggagtcctacaaggacagcactttgatcatgcaactccttcgtgataacttgaccctatggacctctgacatctcggaggaccctgcggaagagatcagagaggcgcccaagcgcgactcgagcgaggggcagtaaagacggatttacgtgccctagaaactagtagctagtgtttgctgctgtctaatgacattatgcaatgtgatctggaccctggtttctttggtgcgaggctgtagccgtgctatgattattgtcgggaaaatctgggggctccctatatgagatgttgccgggcaaggctttcggtggtgggggtcactggagctaggtttggttgggttgggaatccttttaaaactgttggtgtcactttgtatttttaccttttcatcgctgtttattatgagtggtgctgcgtcaattgttggtctctttttgggcatcttttcatcaaaa

SEQ ID NO: 9341 - DNA, 1221 bp, Cocos nucifera
gagaccgagcggcgaagtagatcgaggaaaaatcaaggagtccgagggttttgtttcggaggaaggaagagtttaggagacaaaattacgatgtcgccggccgaatcgtcccgtgaagagaatgtctacatggccaagctggccgagcaggccgagcggtacgaggagatggtggagttcatggagaaggtagtgaagacggtcgacgtggaggagctgaccgtcgaggagcgcaacctcctctccgtggcttacaagaatgtgattggtgctcgccgggcttcgtggcgcatcatctcctccatcgagcagaaggaagagagccgtgggaacgaggaccgtgtcgccttgatcaaggagtaccgcggcaagattgaggctgagcttagcaagatctgtgatgggatcctgaaactgcttgactcccacctcattccctcggccactgccgtggaatccaaggtgttctaccttaagatgaagggggattaccacaggtaccttgcggagtttaaaactggagctgagaggaaagaagcagctgagagcacactgttggcatacaaatctgctcaggatattgcactggctgaattggctccgactcatccaataaggcttgggcttgcactcaatttctcagtgttttattatgagatcctgaactcaccagaccgtgcttgcagtcttgcaaaacaggcttttgatgaggccatttcagagcttgactctttgggtgaggagtcttacaaggacagcacattgatcatgcagcttcttcgagacaacttgacactgtggacctctgatatcacagaggacggaggtgacgagatcaaggaagctcccaaacgggaatcaggagatgggcagtgatgagaaatcagatgtctggcctatgcttctaccttgtgccccggaattggtgttttgacctttatctagatgcagtgaaaattcatgtgcttggagattgttacccattttactgctgtggtgtgtggatgaacctcctatctgtcttatagatgttttatggttggattgttctagtttgttagtgtttcattatattctctttgttttacaatagtggaagatttaaagcttgcggatgttaagcaaggtacaaacgaatcaatagcttcatgttacaataccatcgtggaaaagctatttgaccaaaatcttaagtagcatctcttagtttggtgccgttct

SEQ ID NO: 9342 - DNA, 1553 bp, Elaeis guineensis
agcgatatgttcgatcatcccaatcacgtccctccatgcagtacgatcggggcatggacggatgtgattcagcgtggtagcgcagccgagaacgcccaacacgacgtgcggctgggccccttttgacgcgcagcgccagcgtggcagtgctgcatgagcaacactagatgccggcctatcgaccgaacacgtgtctgttggtgatttgaccgggggtggggaacgatttagggctcgacgcctcttcggccgaagaaaactaaaacaaagcgaggccgaccgggcagcgaagtagatcgaagaaaaacaagaaagagtccgagggttccctttcggaggagggaagagtttaggagacaaaattacgatgtcgccggccgaatcgtcccgtgaagagaatgtctacatggccaagctggccgagcaggccgagcggtacgaggagatggtggagttcatggagaaggtcgtgaagacggtcgacgtggaggagctgaccgtcgaggagcgcaacctcctctccgtggcttacaagaatgtgattggtgctcgccgggcttcgtggcgcatcatctcctccatcgagcagaaggaggagagccgtgggaatgaggaccgtgtcaccttgatcaaggagtaccgcggcaagattgaggctgagcttagcaagatctgtgatgggatcctgaaactgcttgaatcccacctcatcccctcggccactgctgtggaatccaaggtgttctaccttaagatgaagggggattaccacaggtaccttgcggagtttaaaactggtgctgagaggaaagaagcagctgagagcacactgttggcatacaaatctgctcaggatattgcactggctgaattggctccgactcatccaataaggcttgggcttgcactcaatttctcagtgttttattatgagatcctgaactcgccagaccgtgcttgcagtcttgcaaaacaggcttttgatgaggccatttcagagcttgactctttgggtgaggagtcttacaaggacagcacattgatcatgcagcttctccgagacaacttgacactgtggacctctgatatcacagaggacggaggtgatgagatcaaggaagctcccaaacgggaatcaggggatgggcagtgatgagaaatcagatgtctggcctatgcttctaccttgtgccctggaattggtgtttttaatcctagatgtagcgaaaattcatgtgcttgcagattgttgccctttttactgctgtggtgtgtggatgaacctcctatctatcttatagatgttttatggttggattgttctagcctgttagtgtttcattatattttctttatttcacaatagtggaagatttaaagctagcagatgttaaacaaggtacaatcgaatcaatagcttggtgttacaataccatcgtggaaacgctatttgaccaaaatctaaagtagcatctcttagtttggtgttactttaaaaacaaaaaaaaaaaaaactaagtaagaactacgaccaacggacacaacaagggaag

SEQ ID NO: 9343 - DNA, 1209 bp, Elaeis guineensis
gggcgaggttgtccagagtccgatacctcgcccccgcgacctcccattcccaccctcggagacccaaagctggtgcgagggttagcaagagtgcgcgcggcgaaaaataaaggacagagtttcccaccctcgaatataggagaaggtagcaagtgagacatagaagaggaggaggaaagatgtcttcggccgaatcaactcgtgaggagaatgtgtacatggccaaactggccgagcaggcagagaggtacgaggagatggtagaattcatggagaaggtggcaaagactgtggatgtggaggagctcagtgtggaggagcgcaaccttctgtccgtggcctacaagaatgtgatcggggcccgccgggcctcgtggcgcatcatctcctcgatcgagcagaaggaggagagccgtgggaacgaggaccgtgtttccctgatcaaggagtatcgtggcaagattgaagccgagctcagcaacatctgtgatggcatcctgaagctgcttgattcccacctcattccctcgtccactgttgctgagtccaaggtgttctatctcaagatgaagggagattaccacaggtacctcgcggagtttaaggcgggggcagagaggaaggaggctgctgagagtacgctggtggcttacaaagctgctcaggatattgctctggctgaactggccccaactcacccaataaggcttggactggcacttaatttctctgtgttctactatgagatcctgaactccccagaccgtgcttgcagtcttgcaaaacaggcttttgatgaggccatctccgagttagacagtttgggcgaggaatcctacaaggacagtacactgatcatgcagcttctccgagacaacttgaccctctggacctctgatatcacggaagatgctggggatgagatcaaagcagccccaaagaaagaaccaggagaggggcagtgatgaacccatccgttctctcaggatgctgccctggattctggagtctgtagttggtaattcagatatggatgtaggatattacccggaactgcctgttgtgtatggctgtgccttctttccttctgacggatcagcataaacttttttatacttggattgctggtttatctgaagaagactcattatttctctttttccctatcaccctgcagatgatgaaaactagctaatcccaggctggttt

SEQ ID NO: 9344 - DNA, 1182 bp, Musa acuminata
ctctctcgctcgctcgctctctctctctatcgctctctcaaccaaaaagcgcaaatagaaaccaaaccaaagacgggaaaatagagagaaagagagagtcttgcgcaggtttttccgcgtttcccccaccgttccatcgctgagattttaaaggggattagtgcgtaggtttccaaagaggtagtgaagatgtctccggctgattcatcccgtgaggacaatgtatacatggccaagctggctgagcaggcagagcgctacgaggagatggtggagttcatggagaaggttgcgaagacagtggacgtcgaagaactcactgtagaggagcgcaacctcctctctgtggcttacaagaatgtcatcggggctcgccgggcctcgtggcgcatcatctcctcgatcgagcagaaggaagagagccgtgggaatgaggatcatgtttcggtgatcaaggagtatcgtggcaagatcgagactgagctcagtaagatctgcgatggcatcctcaagttgctcgattcccatctgattccttcttccgctgctgccgagtccaaggtgttttacctaaagatgaagggcgattaccacaggtaccttgcggagtttaagaccggagccgagaggaaggaggctgcagagagtacgctggtatcctataaatctgctcaggatattgccctggctgaacttgctccgactcatcctattaggttggggctggcactaaacttctctgtattctattatgaaattgtaaactcacctgatcgtgcttgcagccttgcaaaacaggcttttgatgaggccatctcggagttggacactctgagcgaggaatcttacaaagacagcacattgatcatgcagcttcttcgcgacaacttgaccttatggacctctgacataactgaggatgctggggaggagatcaaagaggccccaaagcgcgaatccgaggaaggacagtaactggaagcaagcctgtcctaagatggacatcgcctcattctggactatggtttctcttttgtagtttgtggtatgttagagcattttcgtgtacttttttcttcttcttcttcttcttcttcttccttgaacgatgtcttttggtgttgaacttttcatctcttcggcctacaactaggcttgcctttaaaagactgattatgccca

SEQ ID NO: 9345 - DNA, 1318 bp, Cocos nucifera
gattgcctggtcttgggcgaggtattccagagttcgatacctcgccctcgcgacctccggttcccaacctcggaaacccaaagccggtgcgagggttagaaagggcgcgcgcggcgagaaataaaaggaatatacgagaaggtagcaagtgagacatagaagaggaggaggaaagatgtcttcggccgaatcaactcgtgaggagaatgtgtacatggccaaactggccgagcaggcagagaggtacgaggagatggtagaattcatggagaaggtggcaaagactgtggatgtggaggagctcagtgtggaggagcgcaaccttctgtccgtggcctacaagaatgtgatcggggcccgccgggcctcgtggcgcatcatctcctcgatcgagcagaaggaggagagccgtgggaacgaggaccgtgttgccctgatcaaggagtatcgtggcaagattgaagccgagctcagcaacatctgtgatggcatcctgaagcttctcgattcccacctcattccctcttccactgctgctgaatccaaggtgttctatctcaagatgaagggagattaccacaggtaccttgcggagtttaagacaggggcagagaagaaggaggctgctgagagtacgctggtggcttacaaagctgctcaggatattgctctggctgaattggccccaactcacccaataaggcttggtctggcacttaatttctctgtgttctactatgagatcctgaactccccagatcgtgcttgcagtcttgcaaaacaggcttttgatgaggccatctccgagttggacagcttgggcgaggaatcctacaaggacagtacgctgatcatgcagcttctccgagacaacttgaccctttggacatctgatatcacggaagatgctggggatgagatcaaagcagcctcaaagaaagaagcaggagaggggccgtgatcaacccatccgttctctgaggatggtgccctctattctagagtttgtagttggtaattcagatatgaatgtaggatatttttacccagaactgcctgttgtgtatggctgtgccttctttccttctgacctatcagcataaaccttattatacttagattgctggtttatctgaagaagactcatttattttctctttttcccggtcacccagcagatgactaaaactaactaatcccaggttggtttgaagttcttattaatccttattcttgtcctgattgcccgtaaggaggacaactaccattgatgctgaggatctggaaggctcaaaatataatcaccatcaaccttgaa

SEQ ID NO: 9346 - DNA, 1270 bp, Elaeis guineensis
cgtttctcctttttattggtggattgaatggaaactgacgagagtttttagggctcagacagctacccggctagagaaaagctaaacgaaatcttggggtcgaccgagcggcgaagtcgattgaagaagaaacaaaaagaggggaaaagaaaacacagagtcgggggggttcgcttcagaggaaggaagagtttaggaagctacgatgtcgccggccgaatcgtcccgtgaagagaatgtgtacatggcgaagctggccgagcaggccgaaagatacgaggagatggtggagttcatggagaaggtagcgaagaccgtcgacgtggaggagctgaccgtcgaggagcgcaaccttctgtccgtggcttacaagaacgtgatcggcgctcgccgggcttcgtggcgcatcatctcttccatcgagcagaaggaggagagccgcgggaatgaggatcatgtcgccatgatcaaggagtaccgcggcaagattgaggctgagcttagcaagatctgcgatgggatcctcaagctgcttgactcccacctcatcccctcggccactgccgcggagtccaaggttttctaccttaagatgaagggggattaccacaggtaccttgcagagtttaaaactggagctgagaggaaagaagcagccgagagcacactgttggcatacaaatctgctcaggatattgcacttgctgaattggccccgactcatccaataaggcttgggcttgcactcaacttctcagtgttctattatgagatcttgaactcaccagaccgtgcttgcagcctagcaaagcaggcgtttgatgaggccatctcagagcttgatactttgggtgaggagtcttacaaggacagcaccttgatcatgcaacttctccgagacaacttgacactatggacatctgatatcacggaggatggaggtgatgagatcaaggaagcgaccaaacgggaatcaggagaggggcagtgatgaaaatcagggatccggcctgtttgatcccttgtgcccctgaatatgtatttttaagctttagatgtagtgatgttgtagtgatgtgcttggagattgttactcgtctagttgctgtggcttgtggatgaacctcctatctgcccgacaaatgtggtttaatggttggattgttctagcttgttagtgtttcattgcatccttatttcacagtgcacgatttaaggttattgtatgtcaaacaaggtagaagctaattaattgccatatatttgcatc

SEQ ID NO: 9347 - DNA, 1797 bp, Ananas comosus
ggtcatttatcccagtcataaacaggaggaagagaccagtgtattggcaaattttgggagatcagtttatattttcattcgtatggattgagagtccacttgatgtttttctcgaagaaaaagttaagcgtcaatagatcaaatctttgtttttacgttatgttgagagaataaagaacaaaggttttgtccctaaatgcccttgctggagcttctaaacaaatgctgcctcagtaagctcccccgtcacaccccccaacccggccccaatagcttcataccccagcgaaactaggagattcaaattggatcatcctgttttgggaacgaaacgttcatttcatcacatcaaaccttcagattgtttgtttatcaaagcctacgtattgctttttagatggagaagttattccaaaagtcaagctattgttttcctactatgccgagaaagtatagacataaatcataatgtgatcttctttttgatcattttattcataaacagggagataactaaggaacaatggcgccagccgaatcatcccgtgaggagaacgtgtacatggccaagctggccgagcaagccgagcggtacgaggagatggtggagttcatggagaaggtggtgaaggcagttgatgcagaggagctgaccgtggaggagcgcaacctcctctctgtggcctacaagaatgtgattggggcccgccgtgcctcatggcgcattatctcctccatcgagcagaaggaggagagccgtggcaacgaggatcatgtcagcatgatcaaagaataccgaggtaagattgaggctgagctcagcaagatctgtgatggtatccttaagctgctcgactcccatctcgtgccttctgccactgccccagagtccaaggtgttctatctcaagatgaagggtgattaccacaggtaccttgcggagttcaagactggtgccgagaggaaagaagcagctgagagcactcttttggcatacaagtctgctcaggatattgcgttggctgaattggctccaactcacccgataaggcttgggcttgcacttaacttctcagtattctattatgagatactgaactcccctgatcgtgcatgcaatcttgctaaacaggcgttcgacgaggctatctccgagctcgacaccttgggcgaagaatcgtacaaagacagcacactgatcatgcagcttcttcgggacaacttaactctatggacttctgacatcagggatgatggtggagacgaaattaaggaagctcctaagaaggaaggggaggaccagtaatgtgcccaatcaaatcacggattgttacgatgccaatatctacccattaatttgtggttcattttttatcatagatgtaatggggatgtatttgcaattgatgttgcgtttcagcttgaaatttgcgattgttccttttaatgcgacatatttgtgcttattaagtgtaagattggatttaagtagtgattgctctatggtttagtcaaagagttgtctgttggcatataaatagacagttgaataatctatcttgatcattgttacagttcctgcagtgacttcttagactttgttggtctgtttattgtgttattgtgtacttgttgaaatgaaggatttttcacatcagatgctgaatctataaaatatggcttggtattggcaaatctaatctgatgcataatcagatgggataggattgataagattgattcgtttagactttaaattgtatttttaattctcaaatttattctagtaatttgttt

SEQ ID NO: 9348 - DNA, 1162 bp, Elaeis guineensis
ctcggagacccaaagctggtgcgagggttagcaagagtgcgcgcggcgaaaaataaaggacagagtttcccaccctcgaatataggagaaggtagcaagtgagacatagaagaggaggaggaaagatgtcttcggccgaatcaactcgtgaggagaatgtgtacatggccaaactggccgagcaggcagagaggtacgaggagatggtagaattcatggagaaggtggcaaagactgtggatgtggaggagctcagtgtggaggagcgcaaccttctgtccgtggcctacaagaatgtgatcggggcccgccgggcctcgtggcgcatcatctcctcgatcgagcagaaggaggagagccgtgggaacgaggaccgtgtttccctgatcaaggagtatcgtggcaagattgaagccgagctcagcaacatctgtgatggcatcctgaagctgcttgattcccacctcattccctcgtccactgttgctgagtccaaggtgttctatctcaagatgaagggagattaccacaggtacctcgcggagtttaaggcgggggcagagaggaaggaggctgctgagagtacgctggtggcttacaaagctgctcaggatattgctctggctgaactggccccaactcacccaataaggcttggactggcacttaatttctctgtgttctactatgagatcctgaactccccagaccgtgcttgcagtcttgcaaaacaggcttttgatgaggccatctccgagttagacagtttgggcgaggaatcctacaaggacagtacactgatcatgcagcttctccgagacaacttgaccctctggacctctgatatcacggaagatgctggggatgagatcaaagcagacccaaagaagaaccaggagagggcagtgatgaacccatccgttctctcaggatgctgccctggattcgtggagtctgtagttggtaattcagatatggatgtaggatattatccggaactgccctgttgtgtatggctgtgaccttctttccttctgacggatcagcataaactttttcacttggattgctggtttatctgaagaagactcattatttctctttttcccgatcacccagcagatgatgaaaactgctaatcccaggctggtttgaagttctt

SEQ ID NO: 9349 - DNA, 1223 bp, Amorphophallus konjac
gtcgcgccgacacaaccatcaacgtggagctctttcaacactgccctcgcaagggaggacgcgaaatttgcaggaaggggcgagcgggggcctgaagaagagggagggaatagggttaggggtgtgcaaaacttgggttcgaggttgtgaattgtcctgcatagagagggggcaagatgtcgctggcggagtcctcgagggaggagaatgtgtacatggcgaagctggccgagcaggccgagcggtacgaggagatggtggagttcatggagaaggtcgtcaagatcgtggacacggaggagctgacggtggaggagcgcaaccttctctcggtggcctacaagaacgtgatcggcgcacgccgcgcctcgtggcggatcatctcctccatcgagcagaaggaggagagccgcggcaacgaggaccacgtcgcgctgatcaaggagtacaggggcaagatcgaggccgagctcagcaagatctgcgacggcatcctgaagctgctggagtcacacctcatcccctccgcctccgctgccgaatccaaggtcttctacctcaagatgaagggcgactaccacaggtaccttgccgagttcaagactggggccgagaggaaggatgctgctgagagcacacttttggcttacaaggctgctcaggacattgctctagcggacttggcacctacccatccgatcaggctgggtcttgcactgaacttctccgtgttctattatgagattctgaattcaccagaccgtgcctgcaatcttgcaaagcaggcattcgatgaggcgatctcagagctggacacactgggcgaagagtcttacaaggacagcacattgatcatgcaacttctcagggacaacttgaccctatggacctctgatatcacggaggatgctggggatgagattaaagaggccccgaaacgtgaaagtggcgagggacagtgacatcaatcaagtacacacttcgctgcttaaccttgagatcgaggtaagcagctgaatgtgccagcgatggtgtgtctccccttggtgtttgttttctggttttttttttttgccttatcttttgtctttgtttttctccccctcttacgtttgaatagtatcagatgtagcaacgatgtcagaggctgctgttcgacattattcctgggtgttctttgttgtgactgatgattgcccgtgccgtcgcgttgtgcacctcat

SEQ ID NO: 9350 - DNA, 1476 bp, Aristolochia fimbriata
gttcagggagaaatcgagggagggtttcggagtttttctctcctctctgcttttttattttcctttcgagaatcccagagaatcttgtgttaggaagctatgtctccggcagaatcgtctcgagaggaaaatgtctacatggccaagttggctgaacaagcggaacgttatgaggagatggtggagttcatggaaaatgttgccaagactgtagatgttgaggaactcactgtggaagaaagaaaccttctttctgtggcttataagaatgtgattggtgcgaggagagcttcctggaggatcatctcttccattgagcaaaaggaggagagtcgtggcaacgaggaccatgtaactgctatcaaagaatacaggggcaagattgaagcagagcttagcaaaatctgtgacggtatcttgaagttgttggaatcacatcttatcccttcatctacagctgctgagtccaaggtgttttacctcaagatgaagggtgactaccatcgctatcttgcagagtttaagactggagctgagagaaaggaggctgccgagagcaccctgttagcttacaagtctgctcaggatattgcattggcggaacttactcctactcaccccattagactggggctggcacttaacttttctgtcttttattatgaaattcttaattctccagatcgtgcttgcaaccttgctaagcaggcctttgatgaggctatctcagagttggacactttaggtgaggaatcatacaaggacagtaccttaatcatgcagcttcttcgagataacttgaccttgtggacatcggacatccaggaggatcccgaggattcaatgaaagagtcttccaaacgtgagtcaggagagggacagtaacatacagatttggaaggtgttcattgagcctagcgtaagcgtaaaaaagagcaatcagacgcagcaaggcgacgatgattaacctgtggaattgtcaactgtgggttttatcatacagattccatttgggttgttgtagcaagattgtctagagactcgacaccattgcatttggggagagtttctttatggattttttttcaagtttcaagacacaaacgtgttttagttagtgttaattggtatatgttgcttggggctatcagaatttggcttcagtgcttgtattctatgctggtgcatgttatttgatataatttccttttatagtttgaatgtttcatgagggctgtgggtgtttttaatgaatgcggtcaggttttccttgtgcttgccggtgacggaattcaattttgaataattgtaggaagtgtatcgatgagctcttacgtaatggatttgggatgtacgccattttgatgaaagatttatagttaaatagttaattgataatggcgttttctcttgcatttcctccatgagcagtgactgatagactaggtaccgctcttatggatacaagaggagttg

SEQ ID NO: 9351 - DNA, 1255 bp, Eschscholzia californica
ttagtagagagaaagttatttagtagagagagagagagaggcggaatcacgtcgtacaaattagtttgatattttgttgttgagaaaattaggtattaagaatgtctccttcggaatcatcacgagaggaaaatgtttacatggccaaattggctgaacaagctgaacgatatgaagaaatggttgagttcatggagaaagtagcaaaaactgttgatgttgaggaactaacagttgaggaaagaaatttactttctgttgcttataagaatgtgattggagctagaagagcttcatggaggattatttcatccatagaacagaaggaagagagtcgaggaaatgaagatcatgtgtctattattaaggaatatagggcaaagattgaaactgagctcagtaagatctgtgatggaattctagggcttcttgactctcaccttgtcccttcgtcaactgctgctgagtctaaggtgttttaccttaagatgaagggtgattaccataggtaccttgctgagtttaagagcggtgccgacaggaaggaagctgctgagagtactttgttggcttacaaatccgctcaggatattgctttggccgaactgagtcccactcacccaataaggctggggcttgctcttaacttttcggtcttctactatgaaatcctgaactcacctgaccgcgcttgcaatcttgcaaagcaggcttttgatgaagctatttctgaattggatactttgggcgaggaatcttacaaggatagcacattgattatgcaactactgcgcgacaacttgactctgtggacttctgatattacggaggatggcggtgatgagatcaaggaagcttcaaaacctgaatcaggggaaggccagtaactgtgatgaatacgtcttatgttggagaattgaatgttagtagtagagtaaagttaagtttttaacaaagaccaatttattttaagttgtatttgctgctactcctattggtgttctttagtttttctttttaagtaagattcctcgtagttagcccgtctgtgttatggtagtgagagaatttcttctgtctggttgaagacagaagaagatttcaaatcttcctacgcattaagggtgtttgtaatatttgaacgtggttgttgttgtcgtcagtagtgaacaaatttggatttgggtttgaaacgattgtttggatattaagatatctattagtttcgttatgtaagttaaaaaaaaaaaaaaaa

SEQ ID NO: 9352 - DNA, 1144 bp, Allium cepa
attttcgttttgccctaattcatcttcagctggtgtttggtggtcaccaaagaaaatagaaaaaatgtctccagtcgaagcaacccgtgaagagaacatatacatggccaagttggcagaacaggcagagcgatatgaagagatggttgaatttatggaaaaggttgcaaagaccgtaaacagtgaagagctatctgttgaggaacgcaaccttctgtctgttgcatacaaaaatgtgattggagcacgcagagcctcatggcgcataatctcctccatagagcaaaaggaggagagccgtggaaatgaggaccatgtgaagatgatcaaggagtaccgtggcaatgtcgaggttgaactcagcaagatttgtgatggtattctgaagctcttggaaactcacctcgttccttcttccactgctgccgagtctaaggttttctatctcaaaatgaagggagattattacaggtaccttgctgagtttaagagtggtgatgagaggaaagaggcagctgagaacaccctaactgcttataaatctgcccaggatattgctctaactgagatgcctccaacccatcccataaggttgggattagctctcaatttttcagtgttctactatgagattcttaactcacccgaccgtgcctgtaaccttgctaaacaggcgttcgacgaagccatttccgaactagacagtttaggcgaggaatcatacaaggacagcacattgatcatgcaacttctacgtgacaacttgactctatggacctcagacattacagaggatgctggggatgagattaaggatgcttcgaaaggagagggtcagtgatgggaaaattaattaagaccattagaatgtaatatgtgtgtgcagatctaattctctgatctgtttaggtgtagtaatcggttatgcttggcttggccataaatagttcgaaactgtactgagcttactggtcgtttgtttgtagtagtcttctattcagctatgatttttcgttattctgtgagaatatcaagctttcccttttctaatgttttccatgtttagcatttttggttttgtttgtaaatagttcctagggtaactagaaattttcatgaaaaaagatgattgtgtcattctttc

SEQ ID NO: 9353 - DNA, 1067 bp, Allium cepa
aaaggtttgccctaattcatcttcaggtgtttgacggtcaccaaagaaaatagaaaaaaagatgtctccagctgaagcaacccgtgaagagaacatatacatggccaagttggcagaacaggctgagcgatatgaagaaatggttgaatttatggaaaaggtagcaaagactgtaagcagtgaagagctatctgttgaggaacgcaaccttctgtctgttgcatacaaaaatgtgattggagcgcgtcgagcctcatggcgcataatctcctctatagagcaaaaagaggagagccgtggaaatgaggatcatgtgaagatgatcaaggagtaccgtggcaatgtcgaggctgaactcagcaagatatgtgatggtatactgaagcttttggaaacccacctcattccttcttccactgctgctgagtctaaggttttctatctcaaaatgaaaggagattattacaggtaccttgctgagtttaagagtggtgatgagaggaaagaggcagctgagaacaccctaactgcttataagtctgcccaggatattgctcttgctgagatgcctcctacccatcccataaggttggggttagctctcaatttttcagtgttctactacgagattcttaactcacccgaccgtgcctgcaaccttgctaagcaggcatttgatgaagccatttcggaactagacagtttaggcgaggagtcatacaaggacagcacgttgatcatgcaacttctccgtgacaacttgactctatggacttcggacattacagaggatgctggagatgagatcaaggatgcgtcgaaaggagagggtcagtgacgggaaaaataatcaagacccgttagagtgtaatatgtgtgtgcagatctgatgctgtgatctgtttaggtgtagtagtcttttttatgcttggcttagccagaaatatctcagaactgtgctgggcttgctactcagtttgtttgtagtagttttattcagttgtgattctaacattcaatgtttttcattgttctgttataattccaagctttccctttttctactg

SEQ ID NO: 9354 - DNA, 1362 bp, Ananas comosus
ggagagccaaaggcctaaacatcgcgactcggcttttggaggagcagcgaaatcgagagagaagggtctccgaggatcatcgaaaagatgtcggctgtcgaaccatcacgcgaggagaacgtgtacatggccaagctggccgagcaggccgagcggtacgaggagatggtagagttcatggagaaggtggcgaagacagtggacgtggaggagctcactgtggaggagcgaaaccttctttctgtggcctacaagaatgtgatcggggcccgccgcgcctcgtggcgcatcatctcctccatcgagcagaaggaggagagccgcgggaacgagaaccatgtttctctgatcaaggattaccgcagcagggttgaggccgagctcaccaagatctgtggcggcatcttggcgctgctcgactcccaccttgtgcctgcatccagtaccgctgaatccaaggttttctacctcaagatgaaaggcgattaccacaggtaccttgcggagtttaagactggagctgagaggaaggaagctgctgaaaacacaatgtcggcatacaaggctgcgcaggacattgctctggctgaactggccccaactcaccccatcaggctgggactggcacttaatttctcagtattttattatgagattctgaattcgccagatcgcgcttgtacccttgcaaaacaggctttcgatgaggctatctcagagttggattccttgggcgaggaatcatacaaggatagcacgttgattatgcaacttctgcgtgataatttgaccctatggacctctgatattacggaggatgccgcggatgacatcaaagaagccccgaagcgtgagccaggagagggacagtgatgatcgtccagtgtgctctcagaattaggaatttagttgtttccctttgtcgatttgattgtgcaatgtactctggactctggactctggtctctttctatttagtaggcagtgttggtttgttcacatttgcttggatatttctactccattagatttgcggtgtggattgatctcgtatctacattttctgagccatctatgaatgatttattgcttggtggatttgccaaattctaagtgtttcttttggttttggcatttcttctccgcaaatggttattatgccatgtgagaagccttttccgtaatctttgtgatttctctggtgttagcttcggcttcataagcctcactatggtcaaacgccatgtgcttaaaaatctattgttcttctttgattattgggtggttacatttttgtactgttgattattttggccacggaacataaataaaatatccaggccaaaaaatttgaaaagaaaa

SEQ ID NO: 9355 - DNA, 1578 bp, Panicum virgatum
cgaatctgtcccggacccacatgtcataggcaggggcccaacctttaccagttcgcggagcccgagggagaggttctccatcgcgcagggggggatattccccaccgaccacgtactccgagcccgccacccacggcagcccatcccactgacgctttggatcccaccgcctcccggggcccgcatggcagccgcagccgccgctcgccacgaggggtgccggcatgggccccgccgcaggcgtggcgccgcgccattggcccgccgaccgcaggctcgcggtcgcgtcccgctataaaacacgctacgcccacggagttgcgcctccttgtccaccccaccccaacagcaagccggcgttccccgacagcaccgtcccgctgcgctcgagaggccgccgccccccacccgcgccaggagtaagtttattacgtgaccaatatgtcgagggaggagaacgtttacatggccaagctggccgagcaggctgaaaggtatgaggagatggttgagtatatggagaaagtggccaagactgtagatgttgaagagctcactgttgaggagcgtaacctcctctcagttgcatacaagaatgtgattggggctcgccgtgcttcatggcgcatcgtctcatccattgaacagaaggaggagagccgtaagaatgaggagcatgttactttgatcaaggaataccgtggcaagattgaagctgagctgagcaatatctgtgatggcatcctgaagctgcttgactcacacctggttccttcttctactgctgctgagtcaaaggtcttctacctcaagatgaagggtgactatcacaggtatcttgctgagtttaagactggcgctgagaggaaggaatctgccgagagcacgatggttgcttacaaggctgctcaggatattgctctggctgaactggcacctactcatccgataagacttgggctcgctcttaacttttcggtgttctattacgagatcctgaactccccagacaaagcttgcaaccttgcaaagcaggcgtttgatgaggctatctccgagttggacacccttggggaggagtcatataaggatagcaccctgatcatgcagctcctgagggacaacttgaccctctggacctctgacctaacggaggatggtgctgaggaggggaaagaagccccaaaaggtgacgccggcgatggccagtaatccttgagtgcatgttcttgaagcccattgttttagatgcctctgtgctgtttgaagctgtgcgctgcgccattattgtagctgctttcatcactgctcgcttctttccttgtagtaggctggtagtggtcgaattagttgtcattgctttgcattgccgctagttggcactaggtccgtgtggactggtattgttgtcctggatttgacaagcatgtgtgttgtccctctagcgttttattgagcaatattgaagttgtcattttcatctagttgttgcaatcagctgttggaagtgctttgcgcgtcaggtgtgtggactggccgactggagttttgctgacctgtgtgctctacagatgtgct

SEQ ID NO: 9356 - DNA, 1049 bp, Pennisetum glaucum
gtatgaagagatggttgagttcatggagaaggtggctaagacagttgattctgaggagcttactgtggaggagcgcaaccttctgtcagttgcttacaagaatgtcattggagcccggcgtgcctcatggcgcatcatatcctccattgagcagaaagaagagggtcgtggcaatgaggaccgtgtaactctcatcaaggactaccgtggcaaaattgagactgagctcaccaagatctgtgatggcatccttaagcttctggactcacacctcgtgccttcttctactgctgccgagtcgaaggtcttctacctcaagatgaagggtgactactacaggtatcttgcggaattaaaactggatctgagaggaaggatgcagctgagaacaccatggtggcatacaaagctgctcaggatattgcattggcagagttggctcccactcatcctattaggcttgggctggcactcaacttctcagtattttattatgagatcctcaactctcctgaccgtgcttgcaatcttgccaagcaggcttttgatgaggccatctcagagctggataccctgagcgaggaatcctacaaggacagcactctgatcatgcagcttctgcgtgataacttaaccctgtggacttcagacatcacggaggatgctgccgaagaaatcaaggaggctcccaagggcgagtctggagatgggcagtaaagatgatctatgtgcctagaaacaacatttcagtgttcgtctactagtgaatctgccaatgtgctctgggttcttgtttcgtcggtataggctgtattgttgcttgtgatagctggaaattggagactcccatttgcgctgtgttagaaatgcttgctagtaccttgctggttggcaggtgttgtcaagctacgattgtttgagggagggagcctttatctatttgaatcattggtgctactttgtatttgtagattgagtgttcctgttgctggtctccatgttctcctcttttctattgttgattttgatgtgttttccgtaaaaaaaaa

SEQ ID NO: 9357 - DNA, 1008 bp, Musa acuminata
ggtcgagcggcgcaactcgtcctcacggaaagagaggaaagcaagaaccctaagcgtctcgattcgagaggaaatactttactagagatcgagcagaatgtctccggtggagtcgtcgcgcgaggagaacgtgtacatggccaagctggcggagcaggcagagcggtacgaggagatggtggagttcatggagaaggtggtgaagacgatcagcggggaggagctcaccgtggaggagcgcaacctcctctcggtggcctacaaaaacgtgatcggagctcgccgcgcgtcctggcggatcgtctcatccatcgagcagaaggaggagagccgcgggaacgaggagcatgtcgcgctcatcaaagagtaccgcggcaggatcgaggccgagctcagcaagatctgtgatgggatcctgaagctgcttgattctcacctcgtcccctctgcgagcgccgccgagtccaaggtgttttaccttaagatgaagggtgactaccacaggtaccttgcagagttcaagactggagctgagaggaaagaagcagctgagagcactctggtggcttacaaatctgcgcaggatattgctttagctgaattggctccgactcatccgataaggcttgggctggcacttaacttctctgtgttctattacgagattcttaactcaccagaccgtgcatgcagccttgcaaagcaggcatttgatgaggccatctctgaactggataccttgggcgaagaatcctacaaggatagtactctaatcatgcagcttctccgagacaacttgacattatggacctcggatatcacggaggatggagctgatgagatcaaggaagctccgaagaaggaatcaggagatggccagtgatcatgatctagttatttatcgttttatcgtccatatagattctatcgtttaagtaggtgttgccagaatcttgtgtttgttaatcgtccacctcttcctctgcctagtggagaaacatactggga

SEQ ID NO: 9358 - DNA, 1178 bp, Musa acuminata
aaaaaaaagtctcgtgcagggttttccacgttcccccctcggatccaccaccatctcgacgattttataagaaattggtgcttaagatttagaaaacgggaagatgtctccggccgaatcatcccgtgaggacaatgtgtacatggccaagctggccgaacaggcggagcgctatgaggagatggtggagttcatggagaaggtagcaaagacggtggatgttgaggagctcaccgtggaggagcgcaacctcctctctgtggcttacaagaatgttattggagcccgccgggcctcttggcgtatcatctcctctattgagcagaaggaagagagccgtgggaatgaggatcatgtttccctgatcaaggagtatcgtggaaagatcgaggctgagcttagcaagatctgtgatggcattctgaagttgcttgattcccatctgatatcctcttccaccacggccgagtccaaggtgttttacttgaagatgaagggggattaccacaggtaccttgcggaatttaagacgggggctgagagaaaggaggctgctgagagtacactgtcagcctataagtctgctcaggacattgccctggccgaactggccccaactcatcctattaggctggggttggctcttaatttctcagtgttctattatgaaattgtgaactcgcctgatcgtgcttgcagtcttgcaaaacaggctttcgatgaggctatctcggagttggacactctgagtgaggaatcttacaaggatagcacattgatcatgcagctgcttcgtgacaacttgaccttgtggacctccgatatcactgaggatgctggagacgagatcaaagaacccttggtgcgtgaatctggaggacagtaaaactaatcacaaagcctgcttgtgatggacattgccttgtatttttcttttgtggtttcttggtgtgtttgaaggtttcaggtctttctcctcgatgctgttgttggtagcgaacctttttagtttatttgacctacaatttaacatcttttggaagatccaatgtgcttatacttttatcagagaacaattaggatcagtgacagaaatagagtgggaatatctcaaatccatcatctgtcgttgtcggtggtgtaccaaaatgtcctcgcggtcggccctctacctctaa

SEQ ID NO: 9359 - DNA, 1062 bp, Musa acuminata
agagagagagagagagagatagagagggagagtgttttgcgcagttgttttcgctgttctcctgccgattcagttccgagattttgtaagagttgcgggctagatttatacagagggaggaaggatgtctccagctgaatcatcccgtgcggacaatgtgtacatggcgaagctggccgagcaggcagagcgctacgaggagatggtggagttcatggagaaggttgcaaagacagtggacgtcgaggagctcactgtagaggagcgcaacctcttatctgtggcttacaagaatgtcatcggggctcgcagggcctcatggcgcatcatctcctcgatcgagcagaaggaagagagccgtgggaatgaggatcatgtttccgtgatcaaggaatatcgtggcaagatcgaggctgaactcagcaaaatctgtgatggcatccttaagctgcttgagtcccatctgataccctcttccactgctgccgagtccaaggtgttttacttgaagatgaagggcgattaccacaggtaccttgcagagtttaagactggaaatgaaaggaaggaggctgcagagagtacgctggtagcctataattctgctcaggatattgccctggctgagttggctccaactcatcctattaggttggggctggctcttaatttctcagtgttctattatgaaattgtgaactcacctgatcgtgcttgcagccttgcaaaacaggcatttgacgaggctatttcagagttggacactcttagcgaggaatcgtacaaggatagcacattgatcatgcagcttcttcgcgacaacctgaccttatggacttccgacatcaatgatgatgtcggggacgagatcaaagaagccccaaaacaagaatctggggaaggacagtgaccaaaagcaaagcatgccttctgatggataccgccttgtgtgttcttgagtttgtagtttctttgatgtaactgtggtgtgttagaaacattcaagcttcttattccattgaaggttgtcctgtggtgttgaacaaacaagtgtgctttaaa

SEQ ID NO: 9360 - DNA, 1160 bp, Brachypodium distachyon
gcacgacacacgaaaccccgacacgctgcaaacaacgcgctgcaccagcacaacacctcgccactcagacaagtaagttagttcctcgatcaaaatgtcgcgggaggacaatgtttacatggccaagctggctgagcaggcagaaaggtatgaggagatggttgagtacatggagaaggtggctaagacagtagatgtcgaagagctcactgtcgaggagcgtaacctcctatctgttgcctacaagaatgtgattggggctcgccgtgcttcatggcgtattgtctcatccattgaacagaaggaggaggggcgtgggaacgaggaccatgttactctgatcaaggattaccgtggcaagatcgaggctgagctgagcaagatttgcgatggtattctgaagttgcttgactcacaccttgtgcccatgtctactgctgctgagtcaaaggtgttttaccttaagatgaagggtgattatcacaggtacttggctgaatttaaggctagtgctgagaggaaggaagctgccgagagcacaatggtggcttacaaggctgctcaggacattgctctggccgaactggctcccacccatcccataaggcttgggcttgcacttaacttctcagtgttctactatgagattctaaactctccagacaaagcttgcaaccttgcaaagcaggcatttgacgaagctatctctgagttggacacccttggagaggagtcttacaaggacagcacattgatcatgcagctactgagggacaacttgaccctctggacctctgacctcacggaggagggcgctgaagaaggcaaagaagcctcaaaaggtgaagctggcgagggccagtaactgcgattgctcaatggttccgcttgtttccggagctcatttggtttagatgccctctgtgctgtcaaaggctgtgcgttgcgccatggatgtattctccaattctagctgttccttgtcctcccctcgccccatttcttgtggtaggctggtagtggttgaattagttccattgcctttgcgttgctgctagttggcactcggtccatgtttggactggtattgttctgctggatttgactgcatgtgtgttatctctcgctagtgcttttatttatgtcctcgttctctcagc

SEQ ID NO: 9361 - DNA, 1488 bp, Cocos nucifera
cgcgtacactacacctgtcgaaatctagccatgcatcgcgcaaaatggcttccagcggcaccatgttttcttcctcgcctcggtcgcgcagccgtctgtcagcaaccgcggtggctcgcgagtctttccactgcttgtcgcttccccattggctaattcgctatccgtgcccgagctttttagggctcgacacctcacctatcgcatcctcccacccccaccttctcttcgccctcagaaacccaaacccggaaagagaggttgcgacgaagaatagagaaaggaaagaagtctcgagaatttacgagagagtgagaagttcgacataaaagaggaggagaaaagatgtcttcggccgaatcaactcgtgaggagaatgtgtacatggccaagttggccgagcaggcagagaggtatgaggagatgatagaatccatggagaaggtggtaaagactgtggatacggaggagctcactgtagaggagcgcaaccttctgtctgtggcctacaagaatgtgatcggggcccgccgggcctcgtggcgcatcatctcctcgatcgagcagaaggaggagagccgtgggaacgaggaccgtgttgccctgatcaaggagtatcgtggcaagattgaagccgagctcagcaacatctgtgatggcatcctgaagcttctcgattcccacctcattccctcttccactgctgctgaatccaaggtgttctatctcaagatgaagggagattaccacaggtaccttgcggagtttaagacaggggcagagaagaaggaggctgctgagagtacgctggtggcttacaaagctgctcaggatattgctctggctgaattggccccaactcacccaataaggcttggtctggcacttaatttctctgtgttctactatgagatcctgaactccccagatcgtgcttgcagtcttgcaaaacaggcttttgatgaggccatctccgagttggacagcttgggcgaggaatcctacaaggacagtacgctgatcatgcagcttctccgagacaacttgaccctttggacatctgatatcacggaagatgctggggatgagatcaaagcagcctcaaagaaagaagcaggagaggggccgtgatcaacccatccgttctctgaggatggtgccctctattctagagtttgtagttggtaattcagatatgaatgtaggatatttttacccagaactgcctgttgtgtatggctgtgccttctttccttctgacctatcagcataaaccttattatacttagattgctggtttatctgaagaagactcatttattttctctttttcccggtcacccagcagatgactaaaactaactaatcccaggttggtttgaagttcttattaatccttattcttgtcctgattgcccgtaaggaggacaactaccattgatgctaaggatctggaaggctcaaaatataatcaccatcaaccttgaa

SEQ ID NO: 9362 - DNA, 1123 bp, Zea mays
accacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggcgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattagtttgctttgtgttgccgctagtccatgtggactggtattgttcccctggatttatttggcaagcgtgtccgtgctcgctctagcgttttattgagcttttaaagtcatcgcattcttttt

SEQ ID NO: 9363 - DNA, 1251 bp, Phalaenopsis aphrodite
tagatatatcggccggccattcgccattattagggtttctctttactttcgacccgctcttatcgtcttggtcctaaggatctcggcatcggaggttaaggagatccagatctataataagtagatccgagaattcgtggtgatctggtgttcataacataaatcacaagtaaagatgtcatcagcagagtcttcccgtgaggagaatgtctatttggcaaagcttgctgagcaggctgagcgatatgaggagatggttgaatttatggagaaggtggctaaaactgttgatgtggaggagctaaccgtggaggaacgtaatcttttatctgttgcttataaaaatgtaattggtgctcgtcgtgcctcatggaggatcatttcttccattgagcagaaggaagagagtcgtgggaatgaagatcatgtggccataatcaaagactaccgtggaaagattgaggctgagcttagcaagatttgtgatgggattttgaagctccttgattctcatctcattccttctgccactgcagccgagtctaaggttttctatcttaagatgaagggtgattaccacaggtaccttgctgagtttaagactggagcagagaggaaggaggctgcggagaacacactgttagcctataaatcagctcaggacattgcattggctgatctaactccaactcatcctataaggctggggttggcacttaacttctctgtattctattatgaaatattgaattctccagaccgtgcttgcaatttggcaaagcaggcctttgatgaggccatatcagagctggatacattgggagaggaatcttacaaggacagcacattgatcatgcaactcctccgagataacttgacgctgtggacttctgatataaatgaggatgctggagatgagatcaaagaagctccaaaacaggaatcttgaggagaccaagtaagcagaaactggagctggttcttaattgcttcattagtttagtagatttactgaacgcttcaattagattttatatgaaaaactgctgtgtgggggaaatttaactgttttatcaactggagttcttttcttttttccttctttataagtgatttgtgctgatgattgctgctacttcttattctggcaattaattatttattttgcagaaactaaggtaagctatgcttaatattgttggtttggatttggttatccattagttaaatggtcagattgctgctacttct

SEQ ID NO: 9364 - DNA, 1508 bp, Amborella trichopoda
ggtgaaaatcctcttcaagggtaacaccacctggtttataggtggaagtattaaaataagggtggaagtagctaaaatatggtgcgaatagtgtgtttttttaaaaatagatttatcggtgataggggtattttggtcatttcggacccgttttaaaaataggatgagggttcgctgagcttcacaatatctccaatttctcgtcctctttgttcgcatttgcgagcgaagaaattttccatttctatttttttctgtggatccaaggcctgaaacttcctctcttttttcttcgtttgaatccagaatcctttctttgttacccattattctctgaaaatgtcacctgccgagtcttctcgtgaggagaatgtgtacatggcaaagctcgccgaacaggctgagcgttatgaggagatggttgaattcatggaaaatgttgcgaaaacagtagatgttgaggagctcactgtcgaagagaggaacctcctatctgttgcgtacaaaaatgtcataggagcacgtagggcctcatggagaattatttcttcgatcgaacaaaaggaagagagtcgtggaaatgaggaccatgttgccatcattaaggagtacaggggaaagattgaatctgagcttagcaagatctgtgatggcatattgcgtctcctcgattctcatctcattccttcctcgactgctgctgaatctaaggtgttttatcttaagatgaagggggactatcacaggtatcttgctgagtttaagacgggggcagagaggaaggaggcagctgagagcactttggtggcttacaaatctgctcaggatattgctcttgcagaactcactcctacccatcctataagattgggccttgctcttaacttttcggtgttctactatgagattttgaattcaccggatcgggcatgcaacttggccaaacaggcttttgatgaggccatctcagagctggacactttgggcgaggagtcttacaaagacagcacccttatcatgcagcttctcagggacaacttgaccttgtggacctcagatttgcaggaccaggaggatggaggggacgagatcaaggaggcctcaacaaagcgtgaatcaggagacggccagtaatgaaaataccgtctttcaaaactttggtttggattcagaatgtcgagtctgtattctcttttgttataaagtcttagcttgagtctctttgctgcttggtcctagtttcactcggtatcatttattagataaattgtgacactcttgaacgcatcttgtaatggtgggttcgcttagtttggcttttgacatagcgtgctttatctcattcttctcttttatgcctcatcttccacatatgtgacagttgagtaattatgattaatttgagaggaagtatgtttgaaaatttggcaggattttggcatttgtgtctattacaatttgttttctttgttgcaatttcgaataaatcctgatctaattttgctcct

SEQ ID NO: 9365 - DNA, 1062 bp, Platanus occidentalis
aggaagactttccggtcccaaaggagaaagttttgctcaagaaagatgtcttcggctgaatattctcgggaggaaaatgtctacatggccaaattggctgagcaggcagaacggtatgaggaaatggtggagttcatggagaaggtagcgaagacagatgtcgaggagctaacggtagaggagcggaaccttctctctgtggcttataaaaatgtgattggagccaggagggcttcttggcggattatctcctccattgagcagaaggaagagagccggggaaatgaagatcatgtggtggctatcaaggagtacagggcaaagattgaatcagaactcagcaagatctgtgatgggatcttaggccttcttgattcacatctcatcccttcgtcgactgctgcagagtccaaggtcttctatcttaagatgaaaggtgattaccacaggtacttggctgagttcaagactggggctgagaggaaggaagctgcggagagcaccttgctggcttataagtctgctcaggacatcgctcttgctgaactggctcccactcacccaataaggctggggcttgctcttaacttctcagtgttctactacgaaatcctgaactcaccagatcgtgcctgcaatcttgcaaagcaggcttttgatgaggctatttctgagcttgacactttgggtgaggaatcatacaaggacagcacattgatcatgcaacttctccgagacaatttgacattgtggacctctgacattacggaggatactggggatgagatcaaggaagctccgaaacgggaatcaggagaggggcagcaataatgaatccaacttgaattgggacaatggtaaacagaattgggtttgctatgcagttggggacttggatttgccacctgtggtgttagtttagatggcatttgttgttgtagcaagatttctttgtgaacttccaggtcttgaatgtgttgtgacgaatttggcttgaagattgatcgttgtgatagttgatatcatgtgttaaaataggagggatatcttatgtgcttatga

SEQ ID NO: 9366 - DNA, 1149 bp, Echinochloa colona
gaacgaacgcagccgagcgaggaagacgcacgcagagatttagcacaccgcaagttttagaagctgaacaagatggcatcagcggagctttcccgtgaggagaatgtgtacatggccaaactcgccgagcaggctgagaggtacgaggagatggttgagttcatggagaaggtagccaagaccgttgactcagaggagctcacagtcgaggagcgcaacctcctgtctgttgcatacaagaatgtcattggagcccgccgtgcctcatggcgcatcatctcctccattgagcagaaggaggagtcacgtaagaatgaggagcatgttgctcagatcaaggaataccgtggcaagattgaggctgagttgagcaatatttgtgatggtatcctgaagctccttgactcgcaccttgtgccttcctcaactgctccagagtcaaaggtgttttacctcaagatgaagggagattatcacaggtaccttgctgagtttaagactggtgctgagaggaaagaatctgcggagagcacaatggtggcttacaaggcagctcaggatattgcactggctgaactggcacctaccatccataaggcttggacttgcactcaacttctcggtgttccattatgagattctgaactctccagacaaagcttgcaaccttgcaaagcaggccttgatgaggctatctctgagctggacacccttggagaggagtcatacaaagacagcaccttgatcatgcagctcctgagggacaacttgaccctctggacctctgacctcacggaggacggcattgaggagagcaaagaagcctcaaagggtgatgcttgtgagggtaccagctaaaccttgatcgatggttcggcatatttttcaagcccattgtgttggatgctcctgtgctggttgaagccgtgcgctgctgctccatggattcgctgattagagcttcccctcacctcgctccatttcatgtagtaggctggtagtggtcggattagtcccattgctctagttggcactgggtccatttggactattgctattgaagtcgtctttctcatcgcggttgcaatttgttgctgtgtatgtcatgttttgctttcttatatcgttattaggtgctaatgacgtcta

SEQ ID NO: 9367 - DNA, 1191 bp, Amorphophallus konjac
ctagggctgtgcgaacctagggttcgaggttgtgaactttgctgaattgggaggagggcaagatgtcgtctgcggagtcctcgagggaggagaatgtgtatatggcgaagctggccgagcaggccgagcggtacgaggagatggtggagttcatggagaaggtcgtgaaggtcgtggacacggaggagctgacagtggaggagcgcaaccttctctctgtggcctacaagaacgtgatcggtgcgcgccgcgcgtcgtggcggatcatctcttccatcgagcagaaggaggagagccgcggtaacgaggaccacgtcgccctgatcaaggagtacaggggcaagatcgaggccgagctcagcaagatctgcgacggcatcctgaagctgctagagtcgcacctcattccctccgcctccgccgccgaatctaaggtcttctacctcaagatgaagggcgactaccataggtaccttgccgagttcaagactggggccgagaggaaggatgctgctgagagcacgctgttggcatacaagtcagctcaggacattgctctggcggacttggcgcctacccatccgatcaggctgggtcttgcactgaacttctccgtgttctattacgaaattctgaattcaccggaccgtgcctgcaatcttgcaaagcaggcattcgatgaggcgatctcagagctggacacactgggcgaagaatcttacaaggacagcacattgatcatgcaacttctcagggacaacttaactctatggacctctgacatcacggaggatgctggagatgaaattaaagaggccccgaaacgtgaagccggggagggacagtgatatcaatcacatctcgctgcttagccttgagatcgaggtaagcagctgatgtgccagcaatggagtgtctccttggtgtttattttatgtttttttcatcttttcttttccatctcttttttaatagtatcatatgtagcaacaatatgaggggctgctcttcgacattatttctgggtgttcttatgtgattgattgctgtgctgtcgagtgcacctacttctgccagttccttgtctgatggtttaatgatttaatcattgatggtaatggttagaagcaagattctcttggccccaattgtgtgtcttcttatgtcaagtcactcgaattcatcgcatag

SEQ ID NO: 9368 - DNA, 1017 bp, Cenchrus ciliaris
tcaacatgtcgagggaggaaaatgtttacatggccaagctggcagagcaggccgaaaggtacgaggagatggttgagtacatggagaaggtggccaagaccgtagatgttgaagagctcactgttgaggagcgtaacctcctgtctgttgcatacaagaatgtgattggggctcgccgtgcttcatggcgcattgtctcatccatcgaacagaaagaggagtcccgtaagaatgaagagcatgttaatctgatcaaggaataccgtggaaagattgaggctgagctgagcaatatctgtgatggaatccttaagcttcttgactcacaccttgtgccttcttctactgctgctgagtcaaaggtcttctacctcaagatgaagggtgactaccacaggtatcttgctgagtttaagactggtgccgagaggaaagaatctgcagagagcacaatggtggcctacaaggctgctcaggatattgctctggctgagctggcacctacacatccgatcaggcttggacttgctctgaacttctcggtgttctattacgagattctgaactccccagacaaggcttgcaaccttgcaaagcaggcattcgatgaggctatctctgagttggacactcttggggaggagtcatacaaagacagcactttaatcatgcagctcctgagggacaacctgaccctctggacctctgacctcacggaggatggtgctgaagaggtcaaggaagccccgaaaggtgatgctggtgagggacagtaacccttagatgtccctgcgctgtcaaagctgtgtggtgcaccattattgtagctgttatcgtttatcctgctcgcttcttttcctatagtaggttggtagaggtcgaattagttttcattgctttgccttgcttttagttggcactaggcccttgtggactggtatcattctcctggatttgacaagcatgtgtgtgattgctctagcgttttattgagcaatattgaagttgttttcatcc

SEQ ID NO: 9369 - DNA, 1258 bp, Echinochloa colona
cccacccctaccccagcacccggagttccccgaccgcacgcgccgttccgccccgtcccgctgtgctcgacagccgcccgcacccgcgccaggagtaagatttttccttgaccaatatgtcgagggaggagaatgtttacatggccaagctcgctgagcaggccgaaaggtatgaggagatggttgagtatatggagaaggtggccaagactgtggatgtcgaagagctcactgttgaggagcgtaacctcctatcagttgcgtacaagaatgtgattggggctcgccgtgcttcatggcgcattgtctcatccattgaacagaaggaggagtcccggaagaatgaagagcatgttaatctgatcaaggaataccgtggcaagattgaggctgagctgagcaatatctgtgatggcatcctgaagctgcttgactcacaccttgtgccttcttctactgctgccgagtcaaaggtcttctacctcaagatgaagggtgactaccacaggtaccttgctgagtttaagactggtgctgagaggaaggaatctgccgagagcactatggtggcttataaggctgcacaggatattgctctggctgagctggcacctactcatccgattaggcttggacttgctcttaacttctcagtgttctactatgagattcttaactccccagacaaagcttgcaaccttgcaaagcaggcgtttgacgaggctatttctgagttggatacccttggggaggagtcatacaaggatagcacactgatcatgcagctcctgagggacaacttgaccctctggacctctgacctcacggaggatggtgccgaggaaggcaaagaagccccgaaaggtgatggcgagggacagtaaccccaaggcttgcatgttcttggagcccattgttttagatgcccctgtgctgtcgaagctgtgcgtgcgccattattgtagctgctattgtcaccccttcttttcctatagtaggctggtagtggtcgaattagttctcattgctttgcattgccgctagttggcactaggtccatgtggactggtattgttctcctggatttgtcaagcatgtgtgtggtctctctagcgttttattgagcaatattgaagtcgttttcatctagctgttgcaatcagttgttggtagtggtttgcgcgtcagatgtgctgatccgtgtctacacatgttgtgtttttggccttccgaatggcatcatgccatcatcgttcct

SEQ ID NO: 9370 - DNA, 1245 bp, Panicum virgatum
gctagctcttggcagtggcttatcagttccttctgttgttgcagtaagttttttacttgaccaatatgtcgagggaggagaacgtttacatggccaagctggccgagcaggctgaaaggtatgaggagatggttgagtatatggagaaggtggccaagactgtagatgtcgaagagctcactgttgaggagcgtaacctcctgtcagttgcatacaagaatgtgattggggctcgccgtgcttcatggcgcattgtctcatccattgaacagaaggaggagtcccgtaagaatgaggagcatgttactttgatcaaggaataccgtggcaagattgaagctgagctgagcaatatctgtgatggcatcctgaagctgctcgactcacaccttgttccttcttctactgctgctgagtcaaaggtcttctacctcaagatgaagggtgactatcacaggtatcttgctgagtttaagaccggtgctgagaggaaggaatctgccgagagcacgatggttgcttacaaggctgctcaggatattgctctggctgaactggcgcctactcatcctatcaggcttggactcgctcttaacttctcggtgttctattatgagattctgaactccccagacaaagcttgcaatcttgcaaagcaggcgtttgatgaggctatctccgagttggacacccttggggaggagtcatacaaggacagcactctgatcatgcagctcctgagggacaacttgaccctctggacctctgacctcacggaggatggtgctgaggaggggaaagaagccccgaaaggcgacgccgtcgagggccagtaacccttgaggcttgttcttgaagaacattgttttagatgcccctgtgctcgttgaagctgtgcgctgcgccattattgtagctgctttcgtttccgctcgcttctttccctacagtaggctggtagtggtcgaattagttgtcattgctttgcattgccgctagttggcactaggtccgtgtggactggtattgttgtcctggatttgacaagcatgtgtgttgtccctctagcgttttattgagcaatattgaagttgtcgttttcatatagttgttgcaatcagctgttggtagtggtttgcgagtcaggtgtgtggactggcctactggacttttgctgacctgtgtggcctacaaatgtgcttctgttctccggaatggacaatgccacgatgggcactctttcgt

SEQ ID NO: 9371 - DNA, 1588 bp, Panicum virgatum
ggcaggggcccaacctttaccagttcgcggagcccgggggagaggttctcaatcgcgcagggggatattccccaccgaccacgtactccgagcctgccacccacggcagcccatcctactgatgcttgggtcccaccgcctgaccgggcccgcatgccagcctcagctgccgctcgccgcgccttgctcgaggggtgtcggcgtgggcccccccgacgcaggcgtggcgccgcgccattggcccgctgaccgcagcctcgcggtcgcgtcccgctataaagatgctaccccctcggagttgcttccccttccaccaccacccccgcagcaatccggcgtcccccccgatcgctcgagaggcagccgccccccacccgcgcccaggagtaagttttttacttgaccaatatgtcgagggaggagaatgtttacatggctaagctggccgagcaggctgaaaggtatgaggagatggttgagtatatggagaaggtggccaagactgtagatgtcgaagagctcactgttgaggagcgtaacctcctgtcagttgcatacaagaatgtgattggggctcgccgtgcttcatggcgcattgtctcatccattgaacagaaggaggagtcccgtaagaatgaggagcatgttactttgatcaaggagtaccgtggcaagattgaagctgagctgagcaatatctgtgatggcatcctgaagctgctcgactcacaccttgttccttcttctactgctgctgagtcaaaggtcttctacctcaagatgaagggtgacttcaaggtatcttgctgagtttaagaccggtgctgagaggaaggaatctgccgagagcacgatggttgcttacaaggctgctcaggatattgctctggctgaactggcgcctactcatcctatcaggcttggacttgctcttaacttctcggtgttctattatgagattctgaactccccagacaaagcttgcaaccttgcaaagcaggcgtttgatgaggctatctctgagttggacacccttggggaggagtcatacaaggacagcactctgatcatgcagctcctgagggacaacttgaccctctggacctctgacctcacggaggatggtgctgaggaggggaaagaagccccgaaaggcgacgccgtcgagggccagtaacccttgaggcttgttcttgaagcccattgttttagatgcctctgtgctggttgaagctgtgcgctgcgccattattgtagctgctttcgtttctgctcgcttctttccctacagtaggctggtagtggtcgaattagttgtcattgctttgcattgccgctagttggcactaggtccgtgtggactggtattgttgtcctggatttgacaagcatgtgtgttgtccctcaagcgttttattaagcaatattgaagttgtcattttcaaatagttgttgcaatcagctgttggtagtggtttgcgagtcaggtgtgtggattggccgactggacttttgctaacctgtgtggcctacaaatgtgcttctggttctccggaatgggcaatgccacgatgggactctttcgtaa

SEQ ID NO: 9372 - DNA, 1144 bp, Musa acuminata
cgaacaacagatggagatcgatcgatcggcttagctccatcgcggacaacaaagcagagccctaagcgtctcgcttcggtgaaggaagaggttctttcgtagagatctaccgaaatgtctccggttgagtcgccgcgcgaggagaatgtgtacctggccaagcttgcggagcaggcggaacggtacgaggagatggttgagttcatggagaaggtggtgaagacgatcaacaaggaggagcttaccgtggaggagcgcaacctcctctcggtggcctacaagaacgtgatcggagctcgccgtgcgtcctggcgcattatctcctctatcgagcagaaggaggagagccgtgggaacgaggatcacgtcgcgttgatcaaggagtaccgtggcaaggttgaggccgaactcagcaagatctgtgacgggatcctgaagttgcttgattcccaccttgtcccctctgcaacttctgcggagtccaaggtgttttaccttaagatgaagggtgactaccacaggtacctggcagagtttaagactggagctgagaggaaagaagccgctgagagcacacttgtggcttacaaatctgcacaggatattgctttagctgaattggctccgactcatccaataaggcttgggttggcacttaatttctctgtgttctactatgagattcttaactcaccagatcgagcttgcagccttgcaaagcaggcttttgatgaggccatttctgaactggataccttgggagaagaatcatacaaggacagcaccttgattatgcagcttctccgagacaacttgacattatggacctctgatatcacggaggatggagctgatgaaatcaaggaaactccaaagaaggaatctggagagggccagtgatctccaattagttgctttctcgtgctgataagaatgtatcatttaactagatgctgtcaggatcttgtgcttttttattgtcctctttatgtgtagaggacgacaaactattcgacaattattttctagtcattggattctcctttgtcttcagtaatttttcatcatgattcttgatggataattatctacctctcgctattggtagcagggaaaatgctgggtgtgactggttgacttcatg

SEQ ID NO: 9373 - DNA, 1017 bp, Cenchrus ciliaris
tcaacatgtcgagggaggaaaatgtttacatggccaagctggcagagcaggccgaaaggtatgaggagatggttgagtacatggagaaggtggccaagaccgtagatgttgaagagcttactgttgaggagcgtaacctcctgtctgttgcatacaagaatgtgattggggctcgccgtgcttcctggcgcattctctcatccatcgaacagaaagaggagtcccgtaagaatgaagagcatgttaatctgatcaaggagtaccgtggaaagattgaggctgagctgagcaatatctgtgatggcatccttaagcttcttgactcacaccttgtgccttcttctactgctgctgagtcaaaggtcttctacctcaagatgaagggtgactaccacaggtatcttgctgagtttaagactggtgctgagaggaaggaatctgccgagagcacaatggcggcctacaaggctgctcaggatattgctctggctgagctggcacccacacatccgataaggcttggtcttgctctgaacttctcggtgttctattacgagattctgaactccccagacaaggcttgcaaccttgcaaagcaggcattcgatgaggctatctctgagttggacactcttggggaggagtcatacaaagacagcactctaatcatgcagctcctgagggacaacctgaccctctggacctctgacctcacggaggatggtgctgaagaggtcaaggaagccccaaaaggtgatgctggcgagggacagtaacccttagatgtccctgcgctgtcaaagctgtgtggtgcaccattattgtagctgttatcgtctatcctgctcgcttcttttcctatagtaggctggtagaggtctaattagttctcattgctttgccttgcttctagttggcactaggcccttgtggactggtatcgttctcctggatttgacaagcatgtgtgtgattgttctagcgttttattgagcaatacttaagctgttttcatcc

SEQ ID NO: 9374 - DNA, 1172 bp, Echinochloa colona
accccagcacccggagttccccgaccgcacgcgccgttccgccccgtcccgctgtgctcgacagccgcccgcacccgcgccaggagtaagatttttccttgaccaatatgtcgagggaggagaatgtttacatggccaagctcgctgagcaggccgaaaggtacgaggagatggttgagtatatggagaaggtggcaaagactgtagatgtcgaagagctcactgttgaggagcgtaacctcctgtcagttgcatacaagaatgtgattggggctcgccgtgcttcatggcgcattgtctcatccattgaacagaaggaggagtcccggaagaatgaagagcatgttaatctgatcaaggaataccgtggcaagattgaggctgagctgagcaatatctgtgatggcatcctgaagctgcttgactcacaccttgtgccttcttctactgctgctgagtcaaaggtcttctatctcaagatgaagggtgactaccacaggtatcttgctgagtttaagactggcgcagagaggagggaatctgctgagagcactatggtggcttacaaggctgcccaggatattgctctggctgagctggcacctactcatccgattaggcttggacttgctcttaacttctcagtgttctactacgagattctgaactcaccagacaaagcttgcaaccttgcaaagcaggcgtttgacgaggctatctctgagttggacacccttggggaggagtcgtacaaggatagcacactgatcatgcagctcctgagggacaacttgaccctctggacctctgacctcacggaggatggtgccgaggaaggcaaagaagccccgaaaggtgatggcgagggacagtaaccccaaggcttgcatgttcttggagcccattgttttagatgcccctgtgctgtcgaagctgtgcgtgcgccattattgtagctgctattgtcaccccttcttttcctatagtaggctggtagtggtcgaattagttctcattgctttgcattgccgctagttggcactaggtccatgtggactggtattgttctcctggatttgtcaagcatgtgtgtggtcgctctagcgttttattgagcagtattgaagtcgttttcatctagctgttgcaatcagttgttggtagtggtttgc

SEQ ID NO: 9375 - DNA, 1097 bp, Setaria italica
cccagcatccggagttcccgaccgcgccgttccgctgcggtcgagagccgacccccgctccaggagtaagccttatccttgatcaacatgtcgagggaagagaatgtttacatggccaagctggcagagcaggccgaaaggtacgaggagatggttgaatacatggagaaggtggccaagaccgtagatgttgaagagctcactgttgaggagcgtaacctcctgtctgttgcatacaagaatgtgattggggctcgccgtgcttcatggcgcattgtctcatccattgaacagaaagaggagtcccgcaagaatgaggagcatgtttctctgataaaggaataccgtggcaagattgaggctgagctgagcaatatctgtgatggcatcctgaagctgcttgactcacaccttgtgccttcttctagtgctgctgagtcaaaggtcttctacctcaagatgaagggtgactaccacaggtatcttgctgagtttaagactggcgctgagaggaaggaatctgccgagagcacaatggtggcctacaaggctgctcaggatattgctctggctgagctggcacctacccatccgataaggcttggactagctcttaacttctcggtgttctattacgagattctgaactccccagacaaagcttgcaacctcgcaaagcaggcatttgatgaggctatctctgagttggacacccttggggaggagtcatacaaagacagcactctgatcatgcagctcctgagggacaacttgaccctttggacctccgacctcacggaggatggtgctgaggagggcaaagaagccccgaaaggcgatgctggcgagggacagtaacccttagatgtcctgtgctgtcaaagttgtgcgctgcgccattattgtagctgctatcgtctaccccgctcgcttcttttcctatagtaggctggtagaggtcgaattagttctcattgctttgcattgccgctagttggcactaggcccatgtggactggtattgttctcctggatttgacaagcatgtgtgtggtcggtctagcgttttattgagcaatattgaagttgtcgttttt

SEQ ID NO: 9376 - DNA, 1148 bp, Panax ginseng
gtttcgcgaaaagaataaagtactattcaactgtataaaagatggtgtcaactgagtcatctcgtgaggacaatgtttacatggccaagctggccgaacaggctgaaaggtatgaagaaatggttgagttcatggaaaaagttgctaaaactgtggacgtcgaggagctcacagtggaggagaggaatcttctctctgttgcctacaagaatgtcattggagcgagaagggcttcatggaggatcatctcttccatagagcagaaggaagagagccgtgggaatgaagatcacgtcaccattatcaaggagtacaggggaaagattgaggctgaactcagcaagatctgtgatgggattttgaaccttctcgagtcccatcttgttccctcggcatcgtctgctgagtccaaggtgttttacttgaagatgaaaggtgattaccacaggtacctggccgagtttaagacgggggctgagaggaaagaagctgctgagagcaccctggtggcttacaaatctgctcaggacattgctttggctgaacttgctcctactcacccaataaggctgggacttgcacttaacttctccgtcttttattatgaaattcttaactccccagaccgtgcttgcaaccttgcaaagcaggcttttgatgaagccatctctgagttggatactttgggtgaggaatcttacaaggacagcacattgatcatgcaacttctccgagacaatttgacattgtggacatctgatataatggatgaggctggggatgagatcaaagaagctcccaagcagtctggtgaaggtcaatagtgatgaatagcaatctgtacttctgcatttgtgccttaatatagattttcatgtggtggttgtagcaggacataatggatgtggagatctcgagtcctagtggtgtttgggggttgtgattttccaacagattataagcttgttataatagtgatggaagaatgtggtttggtgataatgtctctcttatgtggtttgcttgtttctaaattaatagcagtagttctctctcttgtttggtggttacagtttgatgagatgattggaaggggacttgttttggaactgagactgccaaggcacacaggggataggccccccccc

SEQ ID NO: 9377 - DNA, 1193 bp, Panax ginseng
gcagtggtatcaacgcagagtacatggggaccattctattttttatacctctgcaatttctgaagaaagaaatcgactcgctgtttcgcgaaaagaataaagtactattcaactgtataaaagatggtgtcaactgagtcatctcgtgaggacaatgtttacatggccaagctggccgaacaggctgaaaggtatgaagaaatggttgagttcatggaaaaggttgctaaaactgtggacatcgaggagctgacagtggaggagaggaatcttctctctgttgcctacaagaatgtcattggagcgagaagggcttcatggaggatcatctcttccatagagcagaaggaagagagccgtgggaatgaagatcacgtcaccattatcaaggagtacaggggaaagattgagactgaactcagcaagatctgtgatgggattttgaaccttctcgagtcccatcttgttccctcggcatcgtctgctgagtccaaggtgttttacttgaagatgaaaggtgattaccacaggtacctggccgagtttaagacgggggctgagaggaaagaagctgctgagagcaccctggtggcttacaaatctgctcaggacattgctttggctgaacttgctcccactcacccaataaggctgggacttgcacttaacttctccgtcttttattatgaaattcttaactccccagaccgtgcttgcaaccttgcaaaacaggcttttgatgaagccatctctgagttggatactttgggtgaggaatcttacaaggacagcacattgatcatgcaacttctccgagacaatttgacattgtggacatctgatataatggatgaggctggggatgagatcaaagaagctcccaagcagtctggtgaaggtcaatagtgatgaatagcaatatgtacttctgcatttgtgccttaatatagattttcatgtggtggttgtagcaggacataatggatttggagatctcgagtcctagtggtgtttgggggttgtgattttccaacagattataagcttgttataatactgatggaagaatgtggtttggtcataatgtctctcttatgtggtttgcttgtttctaaattaatagcagtagttctctctcttgtttggtggttacagtttgatgaaatgattggaaggggacttgtttgggtcgt

SEQ ID NO: 9378 - DNA, 1155 bp, Panax ginseng
ttttttattcctctgcaatttctgaagaaagaaattgacttgctgtttcgcgaaaagaataaagtactattcaactgtataaaagatggtgtcaactgagtcatctcgtgaggacaatgtttacatggccaagctggccgaacaggctgaaaggtatgaagaaatggttgagttcatggaaaaggttgctaaaactgtggacatcgaggagctgacagtggaggagaggaatcttctctctgttgcctacaagaatgtcattggagcgagaagggcttcatggaggatcatctcttccatagagcagaaggaagagagccgtgggaatgaagatcacgtcaccattatcaaggagtacaggggaaagattgagactgaactcagcaagatctgtgatgggattttgaaccttctcgagtcccatcttgttccctcggcatcgtctgctgagtccaaggtgttttacttgaagatgaaaggtgattaccacaggtacctggccgagtttaagacgggggctgagaggaaagaagctgctgagagcaccctggtggcttacaaatctgctcaggacattgctttggctgaacttgctcccactcacccaataaggctgggacttgcacttaacttctccgtcttttattatgaaattcttaactccccagaccgtgcttgcaaccttgcaaaacaggcttttgatgaagccatctctgagttggatactttgggtgaggaatcttacaaggacagcacattgatcatgcaacttctccgagacaatttgacattgtggacatctgatataatggatgaggctggggatgagatcaaagaagctcccaagcagtctggtgaaggtcaatagtgatgaatagcaatatgtacttctgcatttgtgccttaatatagattttcatgtggtggttgtagcaggacataatggatttggagatctcgagtcctagtggtgtttgggggttgtgattttccaacagattataagcttgttataatagtgatggaagaatgtggtttggtgataatgtctctcttatgtggtttgcttgtttctaaattaatagcagtagttctctctcttgtttggtggttacagtttgatgagatgattggaaggggacttgttttggtcgt

SEQ ID NO: 9379 - DNA, 1176 bp, Oryza sativa
gccgaacaaaaagcattcgcatccacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgccggcgagggccagtaaaatgggaagatcgatcgatcgatggctccgcatgttattggagaccattgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtccacctcctc

SEQ ID NO: 9380 - DNA, 1171 bp, Oryza sativa
gccgaacaaaaagcattcgcatccacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgcctgcgagggccagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtccacc

SEQ ID NO: 9381 - DNA, 1106 bp, Amorphophallus konjac
ggtgcttcccccccttccgcgagagtttcggggtttttctagcgttggagagtatattgttcagttcagaaagagggcaagatgtctccggcggagtcgtcgagggaggagaatgtgtacatggcgaagctggccgagcaggccgagcggtatgaggagatggtggagttcatggagaatgtggtcaagacggtagagtcggacgagctgaccgtggaggagcgcaatctcctctccgtggcctacaagaacgtcatcggagcccgccgtgcctcgtggcggatcatctcctccatcgagcagaaggaggagagccgaggcaacgaggaccacgtcgccacgatcaaggagtacaggggtaggatcgaggccgagctcagcaagatctgcgacggcatcctgaagctgctcgagtcccacctgattccctctgccaccgctgcggagtcgaaggttttctacctcaagatgaagggcgactaccacaggtacctcgccgagttcaagaccggtgctgataggaaggactccgccgagaacacactgttagcatacaagtctgctcaggacattgctttggctgatctggcacctacgcaccctatcagacttgggcttgcactgaatttctctgttttctattatgagatcctgaattcgcctgaccgtgcatgcaatcttgcaaagcaggcctttgatgaggcaatctcggagctggacactctaggcgaagaatcttacaaggacagcacactgatcatgcaactcctgagggacaacttgacattgtggacttctgacatcacggaggatgcgggggacgaaattaaagaagcaccaccaaaacgtgagtctggcgagggccagtgagcgcacggaagcctcgctgcttacattctggaggggtaaagcaggtgatttttaaagtgcaactcaactgttacccaagggttcgtgttccttttctccattttatgttgtcttgtttatcatagtatataggtgtagtagctaatgtgtcgaatgttttgggaacactcaaattctagttgtggacattatatcattctcccattgttgccgttgctggagtaaatctgtttttt

SEQ ID NO: 9382 - DNA, 1085 bp, Cenchrus ciliaris
cgggagtaagccttttccttgatcaacatgtcgagggaggagaacgtttacatggccaagctggcagagcaggctgaaaggtacgaggagatggttgagtatatggagaaggtggccaagactgtagatgtcgaagagctcactgttgaagagcgtaatctcctgtcagttgcctacaagaatgtgattggggctcgccgtgcttcatggcgcattgtctcgtccattgaacagaaagaagagtcccgtaagaatgaggagcatgttaatcttatcaaggaataccgtggcaagattgaggctgagctgagcaacatctgtgatggcatccttaagcttcttgactcacacctcgtgccttcttctactgctgccgagtcgaaggtcttctacctcaagatgaagggtgactaccacaggtatctcgctgagtttaagactggtgcagagaggaaggaatctgctgagagcacaatggtggcttacaaggctgctcaggatattgctcttgctgagctggcacctacacatccgataaggcttggacttgctctgaacttctcggtgttctattatgagattctgaactccccagacaaagcatgcaaccttgcaaagcaggcattcgatgaggctatctcagagttggacactcttggggaggagtcatacaaagacagcactctaatcatgcagctcctgagggacaacctgaccctctggacctctgacctcacggaggatggtgctgaggatggcaaggaagccaccaaaggtgatgctggcgagggacagtaacccttagatgtccctgcgctgtcaaagctgtgtgctgcaccattattgtagctgttatcgtctaccctgctcgcttcttttcctgtagtaggctggtagaggtcgaattagttctcattgctttgcattgccgctagttggcactaggcccatgtggactggtattgttctcctggatttggcaagtatgtgtgtggttgctctagcgttttattgagcaatattgaagttgttttcatctagttgttgccatcagttattggtatttgcctgtctgctggctgcat

SEQ ID NO: 9383 - DNA, 1114 bp, Cynodon dactylon
cacagaacgagaggaagacgacccgcgccgcacccaagcaccgctgcacgctccacctcggaagattcagtaagtttatccttcgatcaatatgtcgcgggaggagaatgtttacatggccaagctggctgagcaggcagaacgctatgaggaaatggttgaatacatggagaaggttgcaaagactgtagatgtggaagagctcaccgttgaggagcgcaaccttctctctgttgcctacaagaatgtgattggtgctcgccgcgcctcatggcgtattgtttcctccattgagcaaaaggaagagtcccgtaagaacgaggatcatgttaatctgatcaaggaataccgtggcaagattgaggctgagctgagcaatatttgcgacggtattctgaagctccttgactcgcaccttgtgccttcctccactgttgcagagtcaaaggtgttctacctcaagatgaagggtgattaccacaggtatcttgctgagttcaagactgatgctgagaggaaggaatcagcagagagcacaatggttgcttacaaggcagctcaggatattgcactggctgaactagcaccaacccatcccataaggcttggacttgcacttaacttctcagtgttctattacgagattctgaactctccagacaaagcttgcaaccttgcaaaacaggcttttgatgaagcaatctctgagttggacacccttggggaagagtcctacaaagatagcactttgatcatgcagcttctgagggacaacttgaccctctggacttctgacctcacggaggagggagccgaggaaggcaaagaggccccgaaaggtgatgctggcgagggacagtaaccctccttcgaatggtctgcatggttttgaagctcattgttttagaatctcctatgtcgtcaaagccatgcgctgtgccactagtaaatgctttcttctctcctttgctcactccttttcccataggagtaggctggcagcggtcgtagttcccatttctttgctttgctgcttggcagtaggtccatgtggacttgtattgctctcctgaatttgacaagcatgtgggtggtcgctctattgttttttatc

SEQ ID NO: 9384 - DNA, 1317 bp, Setaria italica
accacagcatcccgcagttccccgaccacaccgttccgccgcgcacaagagccagccgcccagccccgcgccgggagtaagtttgttcttttgtcaatatgtcgagggaggagaatgtttacatggccaagctggctgagcaggctgaaaggtatgaggagatggttgagtatatggagaaggtggctaagactgtagatgttgaagagctcactgttgaggagcgtaacctcctgtctgttgcatacaagaatgtgattggggctcgccgtgcttcatggcgcattgtctcttccattgaacagaaggaggagtcccgtaagaatgaagagcatgtgaaccttatcaaggaataccgtgggaagattgaggctgaattgagcaatatctgtgatggcatcctgaagctgcttgattcccacctagttccttcttctactgctgccgaatcaaaggtcttctacctcaagatgaagggtgattatcacaggtatcttgcggaatttaagactggcacagagaggaaggaatctgctgagagcacgatggtggcctacaaggctgctcaggacattgctctggctgagatggcacctacccatccgataaggcttgggcttgctcttaacttctcagtgttctattatgagattctgaactccccagacaaagcttgcaaccttgcaaagcaggcgtttgatgaagctatctctgagttagacacccttggggaggagtcatacaaagatagcactctgatcatgcagctcctgagggacaacttgaccctttggacctctgacctcacggaggatggtgccgacgagggcaaagaagcctcgaaaggtgatgctggcgagggacagtaatcttcggagcgggcatgttgttcgagcccattgttttagatgctcaatgctgtcgaagctgtgccgtgccattattgtagcttatttcctctcccctcactcctttttccttgtattgtaggctggtagtggtcgaattagttccccattgctttgtgttgccgctagttggcactaggtccgtgtggactggtattgttccctgttgcggtcttagcacgtcaagaccgcgatgggatcagattcactcgtgctcgactgagtcagagaagaattgggagaaacgaaaagggaaggaagaacagcgaagaacgaggaacagaaagagagggaacagacagcatagccgtgattgatcttcgtttattccttgtctgtgtaatgcttacacctttatacgcgtttttacaacagccttgggcccaccctaacaacccaacttataggc

SEQ ID NO: 9385 - DNA, 1274 bp, Panax ginseng
cagtggtatcaacgcagagtacgcgggggccaccattctatttgttattcctctgcaatttctgaagaaagaaatcgacttgctgtttcgcgaaaagaataaagtactattcaactgtataaaagatggtgtcaactgagtcatctcgtgaggacaatgtttacatggccaagctggccgaacaggctgaaaggtatgaagaaatggttgagttcatggaaaaagttgctaaaactgtggacgtcgaggagctcacagtggaggagaggaatcttctctctgttgcctacaagaatgtcattggagcgagaagggcttcatggaggatcatctcttccatagagcagaaggaagagagccgtgggaatgaagatcacgtcatcattatcaaggagtacaggggaaagattgaggctgaactcagcaagatctgtgatgggattttgaaccttctcgagtcccatcttgttccctcggcatcgtctgctgagtccaaggtgttttacttgaagatgaaaggtgattaccacaggtacctggccgagtttaagacgggggctgagaggaaagaagctgctgagagcaccctggtggcttacaaatctgctcaggacattgctttggctgaacttgctcccactcacccaataaggctgggacttgcacttaacttctccgtcttttattatgaaattcttaactccccagaccgtgcttgcaaccttgcaaaacaggcttttgatgaagccatctctgagttggatactttgggtgaggaatcttacaaggacagcacattgatcatgcaacttctccgagacaatttgacattgtggacatctgatataatggatgaggctggggatgagatcaaagaagctcccaagcagtctggtgaaggtcaatagtgatgaatagcaatatgtacttctgcatttgtgccttaatatagattttcatgtggtggttgtagcaggacataatggatttggagatctcgagtcctagtggtgtttggggattgtgattttccaacagattataagcttgttataatactgatggaagaatgtggtttggtcatataatgtctctcttatgtggtttgcttgtttctaaattaatagcagtagttctctctcttgtttggtggttacagtttgatgagatgattggaaggggacttgtttgggtcgtcattgttttttctcatcttttcctctcatttatttatatattaatgaccacataaaagacttacaattacaacaaaa

SEQ ID NO: 9386 - DNA, 1380 bp, Pennisetum glaucum
ccgaaatcgactgcggcgccctgtccaccccaccccagcatccgcaccccgaccgcgccgctccgctgcgctcgagacctgccccgacccgcccccgctccaggagtaagccttttccttgatcaacatgtcgagggaggagaacgtttacatggccaagctggcagagcaggctgaaaggtacgaggagatggttgagtatatggagaaggtggccaagactgtagatgtcgaagagctcactgttgaagagcgtaatctcctgtcagttgcctacaagaatgtgattggggctcgccgtgcttcatggcgcattgtctcgtccattgaacagaaagaagagtcccgtaagaatgaggagcatgttaatcttatcaaggaataccgtggcaagattgaggctgagctgagcaacatctgtgatggcatccttaagcttcttgactcacacctcgtgccttcttctactgctgccgagtcgaaggtcttctacctcaagatgaagggtgactaccacaggtatctcgctgagtttaagactggtgcagagaggaaggaatctgctgagagcacaatggtggcttacaaggctgctcaggatattgctcttgctgagctggcacctacacatccgataaggcttggacttgctctgaacttctcggtgttctattatgagattctgaactccccagacaaagcatgcaaccttgcaaagcaggcattcgatgaggctatctcagagttggacactcttggggaggagtcatacaaagacagcactctaatcatgcagctcctgagggacaacctgaccctctggacctctgacctcacggaggatggtgctgaggatggcaaggaagccaccaaaggtgatgctggcgagggacagtaacccttagatgtccctgcgctgtcaaagctgtgtgctgcaccattattgtagctgttatcgtctaccctgctcgcttcttttcctgtagtaggctggtagaggtcgaattagttctcattgctttgcattgccgctagttggcactaggcccatgtggactggtattgttctcctggatttggcaagtatgtgtgtggttgctctagcgttttattgagcaatattgaagttgttttcatctagttgttgccatcagttattggtatttgcctgtctgctggctgcatgtattcttctgagttctgacacagtgcatctgggcctacgcaatggcaattggcaacatgcaattatcgtgtctgggctgtcatttcactaaaggctgaactcttctaaagcccatgttgacgtgtgctctttgtctttgagtgccggtttgtgtatttggaattcagaatctggtcttgagtcaacagcagtgg

SEQ ID NO: 9387 - DNA, 1897 bp, Ananas comosus
gccggcgaatgtaaaaatcttgcaaccaaataatttgtgttggagtatgagatttagaggatgtgttttatgacttgaaatttagttgaggtcgaatgctttcgaaagcacatgcatctggtgcttccacctttttgctcattgcatgcaagttcacattcattctcatgtcagagagctcgatcttgatgtgcatcatgtggtcatgcatgttggaatagatacatgtggttcttgatgcatgaaaagttagaaatattgaccccatgctgcttttgatagcattcctggttaattccttaaacattatgaatttattttgcaaagcaagagatgctaaactggtcacatttgttgatctgcgtgtggaaggaagaatctagttactattaatataaaacaaaatgtctcgggaggagaatgtctacatggccaagctggcagagcaggccgagcggtacgaggaaatggtagagttcatggagaaggtggccaagtctgccgacactgaagaactcactgtagaggagcgcaacctcctctctgttgcctacaagaacgtgatcggggcccgccgcgcctcgtggcgcataatctcctccattgagcaaaaagaggagagccgcgggaatgaggaccacgttgcccttatcaaggagtaccgcggcaagattgaggccgagctcagcaagatctgtgatggcatcttgaagctgcttgattctcatcttgtaccgtccgcgaccaccgcagagtctaaagtgttttatctgaagatgaagggtgattatcacaggtatcttgcggagttcaagactggagctgaaaggaaggaagctgctgagagcacacttctggcctacaagtctgctcaggatattgctttggctgaactggcccctactcatccgatcaggctcggcctggcactcaacttttccgtgttctattatgagatcctgaactcgccagatcgtgcttgcaatcttgcaaaacaggcttttgatgaggcgatctcggagttggacactttgggtgaggaatcgtacaaggatagcacattgattatgcaactcctacgagataacttgaccttatggacctctgatatcacggatgaagctggggatgagatcaaagaagcccccaaacgcgagtcggcagaggggcagtaaacgattcgttcgaatggcatcaggaacgaagttgctagaactctcttcgtatgtctgagttgttggaacaatgtattatgatgaattcttgtttctatttggacataatggtggaaagtcctcacgtttgctttgggatattgctaccaatgatcatggttttgtcggtgtatgtcgacattctatttggccttaggttttattgatattttctgctgcttacaacccagctgttttgtggtgtttctcattctactcttgatgaaatggctttctttgtaggacttggtgaagagcggcaagattgctgcacataaatcaaaaaattgaattcgaattaggtttgtacgatattgttgcatttcacagttggcgtgtggtagtaaaattcttattattatgattcaagcaattgattttgtgagattatttattgcactgttagtgaataattaataaaatagttaggggacgccaaatatttttgtctcgggtgaaaagtaaactgtaattagatgccttggtcttcgttggtgggttaatttcctctcattatccaatgccatgtaaaaagaataatgatattttcttaatgtcaattataattagttaatctccgtcgaccatctgatacgtggcccaaaccaactagtgggttgagtcaagttcacgtgagacacagatcatttggccgtatgatcctatgtaaccctatctcggac

SEQ ID NO: 9388 - DNA, 1046 bp, Sorghum bicolor
catccgcagtttccccccgaccacaccgttccgccgcgcacaggagagcacagcccccgcgcccaggagtaagtttgttcttttaccaacatgtcgagggaggagaatgtttacatggccaagctggctgagcaggctgaaaggtatgaggagatggttgagtatatggagaaggtggccaagactgtagatgttgaagagctcactgttgaggagcggaacctcctgtctgtcgcatacaagaatgtcattggggctcgccgtgcttcatggcgcattgtctcttccattgaacagaaggaggagtctcgtaagaacgaagagcatgtgaaccttatcaaggaataccgtgggaagattgaggctgaactgagcaacatctgtgatggtatcctgaagctacttgactcccacctagtgccttcttctactgctgccgaatcaaaggtcttctacctcaagatgaagggtgactatcacaggtatcttgcggaatttaagactggtgctgagaggaaggaatctgctgagagcacgatggtagcctacaaggctgctcaggacattgctctggctgagctggcaccaacccatccgataaggcttgggcttgctcttaacttctcggtgttctattatgagattctgaactccccagacaaagcttgcaaccttgcaaagcaggcgtttgatgaagccatctctgagttggatacccttggggaggagtcatacaaagatagcactctgatcatgcagctcctgagggacaacttgaccctttggacctctgacctcacggaggacggtgctgatgagtgcaaagaagcctcgaaaggcgatgctggcgagggacagtaatcttcggacagggcatgttgtctgagcccattgttttagatgctctatgctgtcgaagctgtgccgtgccattattgtagctgatttcctctccccctcactttttctaggctggtagtagttccccattgctttgtgttgcagctagttgggcactaggtccctgtggactggtattgttcccc

SEQ ID NO: 9389 - DNA, 1153 bp, Saccharum officinarum
cagttcccccgaccacaccgttccgccgcgcacagaagccagccccgcgccaggagtaagtttgttctttttaacaatatgtcgagggaggagaatgtttacatggccaagctggctgagcaggccgaaaggtatgaggagatggttgagtatatggagaaggtggctaagactgtagatgttgaagagctcactgtggaggagcgtaacctcctgtctgtcgcatacaagaatgtgattggggctcgccgtgcttcatggcgcattgtctcttccattgaacagaaggaggagtcccgtaagaacgaagagcatgtgaaccttatcaaggaataccgcgggaagattgaggctgaactgagcaacatctgtgatggcatcctgaaactgcttgactcccacctagtgccttcctctactgctgccgaatcaaaggtcttctacctcaagatgaagggtgactatcacaggtatcttgcggaatttaagactggtgctgagaggaaggaatctgctgagagcacaatggtagcctacaaggctgctcaggacattgctctggctgagctggcacctacacatccgataaggcttgggcttgctcttaacttctcagtgttctattatgagattctgaactccccagacaaagcttgcaaccttgcaaagcaggcgtttgatgaagctatctctgagttagacacccttggggaggagtcatacaaagatagcactctgatcatgcagctcctgagggacaacttgaccctttggacctctgacctcacggaggatggtgctgatgagggcaaagaagcctcaaaaggcgatgctggcgagggacagtaatcttcggagagggcatgttgttccagcctggttttagatgctctatgctgtcgaagctgtgccgtgccattattgtagcagatttcctcttcccctcacttcttgcctcattagtaggctggtagtggtcgaattagttcccattgctttgtgttgcagctagttggcactaggtccgtgtggactggtattgttcccctggatttgacaagcatgtctggtcgctctagcgttttattgagctttgaagttatcacatttatttctgtcgcaatcagttattgtctggatatgcggacggctg

SEQ ID NO: 9390 - DNA, 1561 bp, Saccharum officinarum
acaccaccccgcatcttccgccccagcgccactcgcatcgagacgacccgcgtccgccgcgcccgtgcatcacctcgcctcgcactcccggaagtaactctattccttgatcaacatgtcgcgggaggagaatgtctacatggccaagctggctgagcaagcagaacggtacgaggaaatggttgagtacatggagaaggtggctaagaccgttgatgtggaagagctcaccgttgaggagcgtaacctcctatctgttgcctacaagaatgtgattggggcccgccgtgcctcatggcgcattgtctcctccatcgagcagaaggaggagtcccgcaagaatgaggaacatgttgctcagattaaggagtaccgtggcaagattgaggctgaattgagcaacatttgtgatggtatcctgaagctgcttgactcgcaccttgtgccttcctccactgctgcagagtccaaggtgttttacctcaagatgaagggtgattatcacaggtaccttgctgagtttaagactggtactgagaggaaggaatctgcagagagcacaatggtagcttataaggcagcccaggatattgcattggctgaactggcacctactcatcccataaggcttggacttgcacttaacttctcagtgttctattatgagattctgaactctccggacaaagcttgcaaccttgctaagcaggcatttgatgaggctatttctgagttggacacacttggcgaggaatcctacaaagatagcaccttgattatgcagctcctgagggacaacttgaccctgtggacctctgacatcacggaggagggcattgaggagggcaaagaagccacgaagggtgatgcaggcgagggtcagtagcctggtaaaccttgatggatggttcggcatgtttttctagcccattgtgttggacgccatgtgctgatagaaggtgtttgctgctccatggattccaagcttctgccctctcgttccctccctcttcatgttgtaggctggtagtggtcaaattagtcccattgctttagttggccctgggtccattggactgatgtactgctgttgaagtcatccgttctcgttttgctcttgcagtggattgctgtctgttgggttctgtttgccatcttttttagtttcccaacatgctagttttagatttgcttaggatggtgttagcagtaggctagtggcaaatattctgtttcactgcatgaccgcctttgtctgcccagccgaacagcagcattggctcatgaccactggatccgtgacggatcttccaggcacggtgttccttgctgaaaagggctaggtcggttctagaaaccggataagttgtgcactcgctgttggctaccgtgttgcacggcccgtgcgaagttagcacacatagtggatcccttgctgtgtcaataagatgatacagacctgggggctattttactttgatcgattcaaaagagactgtagggcagtaggaatgtaaagcctggaggaatgtgattgaaatgaaatgtcatcaattctttc

SEQ ID NO: 9391 - DNA, 1218 bp, Tabernaemontana elegans
attggcccagcccatccgaaccttacgccttcgctttaaaattcatccccttctcgctctcactccctccgtaatttgatcgctgcattggcattcggcaaatcggtacttttcgatttcctcttgggctaggatctgtgttttattaatacaagtgaaaatggtgccacctgagtcacgtgaggagaatgtgtacatggctaagctggctgaacaggctgagcgttatgaggaaatggttgaattcatggagaaggtggcaaagactgttgatgttgaggagttgacagtggaggaaaggaatcttctttctgtggcttacaagaatgtgattggtgctaggagggcttcatggaggattatctcttccattgagcaaaaggaagagagccgtgggaatgaagatcatgtgaacaccatcaaggaatacaggggtaagattgaggctgagctcagcaagatctgtgatgggattttgagccttcttgagtcccatctgattccctcagcctctgctgctgagtccaaggtcttttacttgaagatgaagggagattaccataggtacctggctgagtttaagactggtgcagagaggaaagaagctgctgagagcactttgttggcttataagtctgctcaggatattgctttgtctgaattgccccccacacacccaattaggcttggccttgcacttaacttctcagttttctattatgaaattcttaactcacctgaccgtgcatgtaatcttgcaaagcaggcttttgatgaagccatagccgagcttgatacattgggtgaggaatcatacaaggacagtacattgataatgcaactcctacgtgacaatctgactctgtggacttctgatgttacggaagacgctggggacgagatcaaggaagcatcaaaaactgagaaaggagacgggcagtaaagcctgtagtgtagccttgtactctttgtttgttattttagtacaggacttccgttggggggtttatagcaaagatttgatggtttggtaatggtgctcgggtcgcaatgttctacctatttatgtttcaatatttaaagagaagattttagtgctttggatgtctcattaggaggggatgtagtgcttttattgagcgattctatttctgttttaatatgagaatgggatgaactaatggctttgccatgatgatatatttattcctattaatt

SEQ ID NO: 9392 - DNA, 1296 bp, Jatropha curcas
gttttttaaactctatttcccttctcattttttacatcgtcactcacacctgcagcgactctttctcttttgtacgtccatcgatccctctcagcgaatcgttgtaaagagttaatatttagattgatatagaaaaaaatgtcgcctactgaaacatcccgtgaggaaaatgtctacatggccaaattggctgaacaggctgaacgctatgaggaaatggtggagtttatggaaaaggtagcaaagaccgtggatgttgaggagctaaccgtggaggaaaggaatcttctatccgtagcttacaagaatgtaataggggctaggagggcttcatggaggataatctcttcaattgagcagaaggaagagagcaggggaaatgaggatcatgtcaccatcattaaggaatataggggtaagatcgaatcagagctgagcaagatttgtgatgggatattgagcctccttgagtcacatctcattccctctgcctcatctgccgagtctaaggtgttttatcttaagatgaagggagattaccacaggtatcttgctgagtttaagactggggcagagaggaaggaagctgccgagagcactttgttggcttataagtctgctcaggatattgctcttgctgaactggctcctactcacccaataaggcttgggcttgcccttaacttctccgtattctactatgagatccttaactcacctagaccgtgcttgcaatcttgcaaagcaggcttttgatgaggctatttctgagcttgacacattgggtgaggaatcttacaaggacagtacattgatcatgcaacttctccgggacaatctgacactatggacttctgatatcacggatgaggctggggatgagatcaaggaggcatcaaaacgtgaatcaggcgaaggacaaccacagcagtaatgaattaaaatttgtaggatatgtttactctgtacttctttcttgtgacctccgcatagatgcgatgctggttgttgtagctggatttgcataatgaaattggtaaatcctgagtgctgatctgatgctacttgggattgaggtaattccatagattatcaagcttctgctgttgatgttaagaattcatgtctgtattcttattgcttgaccatgtaatagtgttggaactaggggttcgaaccttccaacttacatataacatcaagtgcaagaaaattgttgggtgttattgtactttgtatgatgaaatattgggtggaccctttctccatcttttgtttttatcgcttactcgaaat

SEQ ID NO: 9393 - DNA, 1095 bp, Allium cepa
tcagctggtgtttggtggtcaccaaagaaaatagaaaaaaatgtctccagtcgaagcaacccgtgaagagaacatatacatggccaagttggcagaacaggcagagcgatatgaagagatggttgaatttatggaaaaggttgcaaagaccgtaaacagtgaagagctatctgttgaggaacgcaaccttctgtctgttgcatacaaaaatgtgattggagcgcgtcgagcctcatggcgcataatctcctctatagagcaaaaagaggagagccgtggaaatgaggatcatgtgaagatgatcaaggagtaccgtggcaatgtcgaggctgaactcagcaagatatgtgatggtatactgaagcttttggaaacccacctcattccttcttccactgctgctgagtctaaggttttctatctcaaaatgaaaggagattattacaggtaccttgctgagtttaagagtggtgatgagaggaaagaggcagctgagaacaccctaactgcttataagtctgcccaggatattgctcttgctgagatgcctcctacccatcccataaggttggggttagctctcaatttttcagtgttctactatgagattcttaactcacccgaccgtgcctgtaaccttgctaaacaggcgttcgacgaagccatttccgaactagacagtttaggcgacggaatcatacaaggacagcacattgatcatgcaacttctacgtgacaactttgactctatggacctcagacattacagaggatgctgggatgagattaaggatgcttcgaaagagagggtcagtgatgggaaaattaattaagaccattagaatgtaatatgtgtgtgcagatctaattctctgatctgtttaggtgtagtaatcggttatgcttggcttggccataaatagttcgaaactgtactgagcttactggtcgtttgtttgtagtagtcttctattcagctatgatttttcgttattctgtgagaatatcaagctttcctttctaatgtttccgtgtttagctatttttggttttgtttgttaaattagttcctagggtaactagaaattttcatag

SEQ ID NO: 9394 - DNA, 1371 bp, Spinacia oleracea
tctctccaattaagaaatttggaaattgacattattaactattatagttgttgtaatttactagaaaaaatacatattttattttaatttttaatgttagatggttattaagtgggtcggtgattgtttgatttgtggtctgatttgatgtttgattattttttcctggggtgggagttgagggtttgtaatttagagcaaaacggatgtagttagaccattttagagttttgttacggctggatccatcgaaagggcattgatgtaaacgagattttctgtcgggttcccagtgagaaacaatgttggcggtagaaggatcccgggaagagaatgtgtacttggcgaaattggctgagcaggctgagaggtacgaggaaatggtagagttcatggagaaggttgcaaagactgcggatgttgagttgactgtggaggaaaggaacctcctttctgtggcttataagaatgttattggagccaggagagcttcatggagaatcacctcttccattgaacaaaaggaggagagccgtggaaatgaggaccatgtaaccatcatcaaggaatacagagggaaaatcgaggctgaactcagcaagatctgtgaagggatattgaaacttcttgattcacatcttgtcccatctgcaactgcttctgagtcaaaggtgttttatcttaagatgaagggtgattaccataggtatttggctgaattcaagagtggaactgaaagaaaggatgctgctgagcacaccttgttggcttacaagtctgctcaggacattgcactcactgaattacctcctactcacccaataaggcttgggcttgctcttaatttctccgtcttctactatgagatcttgaattcccctgatcgtgcttgtgctctggctaaacaggcttttgacgaagccatttcagagctggacactctcggtgaggaatcctacaaggacagcaccttgatcatgcagctccttcgcgacaatttgacactatggacttctgacaatgcggaggatgtcggggatgagatcaaggaagcttcaaaagatgaagcagctcctgggcaacaatgatttgattattatgttgaaggagttagataaaatgtatttatttttatttaacttggatgaatgttctgttgttctaggcttttcccatacttggtatgtttgtttatcatctgcagcgtcatttagacgctcaacatatcttaccgagacatactccattaattgttattgtcgactttcaattttcaacacttgggacttccgtgcccttgtttcggattatgaaatgaagctatgtagtccaataatgttctcaactatgtgtgcagttttttctgttcaa

SEQ ID NO: 9395 - DNA, 1251 bp, Amaranthus tuberculatus
gtgagaaaagatgtcaccagcagaaggatcccgggatgagaatgtttacctggctaaattggccgagcaggccgaaagatatgaggaaatggtagagtttatggaaaaggtagcgaagacagtcgatgttgaggagttaacagtggaggagaggaaccttctatctgtggcttacaagaatgtgattggagctaggagagcttcttggagaattatctcttccattgaacaaaaggaagagacccgtgggaatgatgatcatgtagctattattaaggagtaccgagggaaaattgaggccgaacttagcaagatttgtgatgggatattgaaacttcttgattcacatctcgtcccatcagccaccgctgctgagtcgaaggtgttctatttgaagatgaagggtgactaccacaggtatttggctgaatttaaggctggagccgagagaaaggaagctgctgagcacactttgttggcttataagtctgctcaggacattgcgctcgctgaattgcctcctactcacccaataaggttggggcttgctcttaatttctctgtgttctactatgagatcttgaattccccggaccgtgcttgtgctcttgctaagcaggcttttgatgaagccatttcagagctggacactctcggtgaggaatcctacaaagatagcaccttgattatgcagctcctccgtgacaacttgacattatggacctctgacaatacggatgatgttgatgagatcaaggaagcctcaaaagatgaagcagctccagggcagtaatgaaatatttaccaagtcggaggagttaagtgaaatgtatttatgtaacttggttatttgttgtgttttaggcgtttactatacttggtttgtttgtttgtcgtatgcagcgtcaatgagacgctcaatataagtgaccattattgtctacttcgtcaaagtctttgcatttcaggctgtcgtcctcggatgcatcaactaaaaccaatgtagtagtcagtgattgtttggatgaagttgtacttctctcaactggaactggtattctttcagtttatcaagaaaattcttgtgtattttgggtatcattaagaaaaaaggatagaccttttgcttgtattttctgtttctgaaacttgcatttgttttactattgaaaggaatgcctaattattgggctctttacagcaaaactcatacgctcccaccaagctttctcaaaagatattttatagtcg

SEQ ID NO: 9396 - DNA, 844 bp, Amsonia hubrichtii
gaatctgtatttaattaacataagcgaaaatgatgccacctgagtcccgtgaggagaatgtgtacatagccaagctagctgaacaggctgagcgctatgaggaaatggttgaattcatggagaaggtcgcaaagactgttgatgttgaggagctgacagtggaggaaaggaatcttctttctgtggcttacaagaatgtgattggtgctaggagggcttcgtggaggattatctcttccattgagcaaaaggaagagagccgtgggaatgaagatcatgtgaacattatcaaggagtataggggtaagattgaggctgaactcagcaagatctgtgatgggattttgagccttctcgagtcccatctgattccctcagcctctgctgctgagtccaaggtgttttacttgaagatgaagggagattaccatagatacctggctgagttcaagactggtgcggagaggaaagaagctgctgagagcactttgctggcttataagtctgctcaggatattgctttggctgatttggcccctacccacccaattaggcttggccttgcactgaacttctcagttttttattatgaaatccttaactcacctgaccgtgcatgcaatcttgctaagcaggcttttgatgaggccatctctgagcttgatacattgggagaggaatcatacaaggacagtacattgatcatgcaacttttacgtgacaatctgactctctggacttctgatatttcggaggaagctggagacgagatcaaggaagcgccaaaaactgagaaaggcgaagggcagcagtaatgagcctgtagtgtagccttgtactcttt

SEQ ID NO: 9397 - DNA, 1273 bp, Amsonia hubrichtii
ggcaacactgaaaagttggtttgtttactctcttgctttcaatcagtagaaaagggtaagagttaagtttgaccaggaaaatatggtgcccaccgagtcatctcgcgaggagaatgtctacatggcgaagttggctgagcaggctgagaggtacgaggaaatggttgaattcatggaaaaagttgccaagggggcggatgctgaagaacttactgtggaggaaagaaatctgctttctgtagcttacaagaatgttattggcgctaggagagcttcctggcgaatcatctcctctattgagcaaaaggaagagagccgtgggaatgaagatcacgtggtaattattaaggattatagaggaaaaattgaggctgagctcacaaaaatatgtgatgggatattgcgacttctggacacacatctcataccctcagccaatactgcagagtcaaaagtgttttatctgaagatgaaaggtgattatcatagatacttagctgagttcaagactggagccgagaggaaggaagccgctgagaacacactagttgcttacaaatctgctcaggacattgcactgactgagctgccccccacacatcccataaggctaggtcttgcacttaacttctctgtgttctattatgagatactgaactcgcctgatcgtgcttgtgctcttgcaaagcaggcttttgatgaagctatatctgagctggatacattgggtgaagaatcctacaaagacagcacactcatcatgcaacttctccgagacaatttgactttgtggacttcagatgtgccagaggatgctggtgctgagatcaaggaagcatccactactgaaccagtcgatggccagaagtgattttcagaattttgctggagggttcaacagattgactaggtttagggcttgggttcaacacaatttatctcttgtgattctctacaaattgtgttgaattctgagattatgctttcataatacgtagaaccatgtgatgtgatattgaagtatactatgtttcccgtagtcatcactcagccttttatatatgttagtcatagagagtgtagaacccagaaaattgttattctatggtgtacccatcagtatcttctttacaacttaatttggtatcttttaatactttcagagatggtttgccagactgcatagccggatcagttataggtaaaccgcagttatggcttctcttagatactgttttatatttggttgtagcggaagatcaaaaatgtacag

SEQ ID NO: 9398 - DNA, 1360 bp, Musa acuminata
ctaccgattgagcggtgtgcacagagaaagcgagagaaaaagagtcgacatcttcgttgagatctatcaaaatgtcaccggtggagtcgccccgcgaggagaatgtgtacatggccaagctggcggagcaggcggagcggtacgaggagatggtggagttcatggagaccgtcgtgaagacgataaacggggaggagctcacggtggaggagcgcaacctcctctcggtggcctacaagaacgtgattggagctcgccgcgcgtcctggcgtatcatctcctccatcgagcagaaggaggagagccgcgggaacgaggatcacgtcaccttgatcaaggagtaccgcagcaaggtcgaggccgagctcagcaaaatctgcgatggaatcctgaagctgcttgacacccacctcgtcccctccgccaccaccgctgagtccaaggtgttttaccttaagatgaagggtgactaccacaggtacttggcagagttcaagactggagctgagaggaaagaagcagctgagagcactcttttggcttacaaatctgcacaggatattgctttagctgatctggctcctactcatcctataaggctggggctggcactcaacttctctgtgttctattatgagattcttaactcaccagaccgtgcttgcagccttgcaaaacaggcttttgatgaggctatctccgaactggacaccttgggcgaagaatcatacaaggacagtacgttgatcatgcagcttctccgagacaacttgacactatggacctctgatatcacggaggatggagctgatgagatcaaagaagctccaaagaaggaatcaggagagggccagtgatctggaaatcgacacttcctcatgggtgatacaggatgtaccctttttaagtagttgcgagaatcttgtgcttcttggttgtcctctcttcttttgtgttgcggacaacataaagccaactgatactttctagggattggattgccttcagtattttactatcatagttatctattagcttgttctaatgggagataaaaatgattctgtatggttaatcatggacaacttggttttagtagctgggaagatactggtaaccagaaggtagcatgcataattcctgcgtgtccgaggctatctggtgatcaaattctatttggatcattattccatccgtgatattttcttctttaatgtactttggtcttttgatgcatgcgtgcaatggttgcaatttccatattaaaagatgtaaaagatgcatccgtgatatttggatcattcttccacctacagaaatgttcaaaggtgtaaattctcttattgtttcaatgaacttt

SEQ ID NO: 9399 - DNA, 1116 bp, Musa acuminata
cgggcggcttaactcatctcggacaagaaagaagaaccctaagcgtctcgcttcggtggaacgggagtcttcttgtcgccctcgttggctgtgcttccacaagatcctgtttacttgatcgttttctggaaggaaagaggaactttcttgaatagagacctagcaaaatgtctcccgtggaatcgtcgcgcgagggcaatgtgtacatggccaagctcgcggagcaggcggaacggtacgaggagatggtggagttcatggagaaggtggtgaagacgatcaacggggaggagctcacggtggaggagcgcaaccttctctctgtggcctacaagaacgtgatcggagcgcgccgtgcgtcctggcgcattgtctcctccatcgaacagaaggaggagagccgcgggaacgaggatcacgtggcgttgatcaaggagtaccgcggcaaggtggaggccgagctcagcaagatctgtgatgggatcctgaagctgcttgattcccatcttgtcccctccgccaccgctacagagtccaaggtcttttaccttaagatgaatggtgactaccacaggtacctggcagagttcaagactggagctgagaggaaagaagcagctgagagcacgctttcggcttacaaatctgctcaggatattgctttagctgaattagcttcaactcatccgataaggctggggttggcacttaacttctctgtgttctactatgaaattcttaactcaccagatcgtgcttgcagccttgcgaagcaggcatttgatgaggcaatatctgagctggatacattgggtgaagaatcatacaaagacagtactttgattatgcagcttcttcgagacaacttgacattatggacctctgatattacggaggatggagctgatgagatcaaggaagctccaaagaaggaatcaggagaggaccagtgatcacgaattcagtttctttctaatgatataggatgtacctttttaagtagatgcttgtgaggatcctgtgtgttcgttgatgtctctctcctatgggttgaggacaaacacaatgtttgaactaataccttctaaacattggtttcttgtctgtttgttgtct

SEQ ID NO: 9400 - DNA, 2717 bp, Cocos nucifera
aacgggaggagtatgaacacggcggagattcattcacgcctctcacgcgtacactacacctgtcgaaatctagccatgcatcgcgcaaaatggcttccagcggcaccatgttttcttcctcgcctcggtcgcgcagccgtctgtcagcaaccgcggtggctcgcgagtctttccactgcttgtcgcttccccattggctaattcgctatccgtgcccgagctttttagggctcgacacctcacctatcgcatcctcccacccccaccttctcttcgccctcagaaacccaaacccggaaagagaggttgcgacgaagaatagagaaaggaaagaagtctcgagaatttacgagagagtgagaagttcgacataaaagaggaggagaaaagatgtcttcggccgaatcaactcgtgaggagaatgtgtacatggccaagttggccgagcaggcagagaggtatgaggagatgatagaatccatggagaaggtggtaaagactgtggatacggaggagctcactgtagaggagcgcaaccttctgtctgtggcctacaagaatgtgatcggggcccgccgggcctcgtggcgcatcatctcctcgatcgagcagaaggaggagagccgtgggaatgaggatcatgttgccatgatcaaggagtaccggggaaagattgaggctgagctcagcaagatttgtgatagcatcctgaagcttcttgattcccacctcatcccctctgccgctgctgctgagtcgaaggtgttctacctcaagatgaagggagattaccacaggtaccttgcagagtttaagacaggggtggagaggaaggaggctgctgagaatacactgatggcttacaagtctgcccaggatattgctctggctgaactggccccaactcacccaataaggcttgggcttgcacttaatttctctgtgttctactatgagatcctgaactccccggaccgcgcttgcagtcttgcaaaacaggcttttgatgaggctatatctgagttagacactttgggcgaggaatcctacaaggacagtacactgatcatgcagcttctccgggacaacttgaccctttggacctctgatatcacggaagatgctggggttgagatcaaagaagctccaaagaaggaagcaggagagcggcagtaatggactcatctgttctttcaggatggtgccatgtgcgatggagtttgtggtttcttttgagcggatatagtggtaattcatataagcatgcaggatgttactcgaaactgctgttttgcgtgggtgcacttcttttctatttgacctaccagcaaacatgctttacttattgattgctgttctaattgagcaaactcgttttcttttttattcatgtggtggatggtgtcctgttgaaatatattaaattatagactgaggaattgaaagagtaaagaaagccatatggcaactttggatcactagtaaagggcgagctggtgcatgaggctcttgcaattggaggatatggggcaggtcagatgtatgcaaccttatatctacatgctgagctgttattttataataattatattttatgaagtgctgggataaaccataattgcttcattattgttatattttattcatgagaacttgtaggctagcacattagcaaccctaactgaaatcaacctggtgaatattgcaccgtatgatttcagaatgtttgtgagcgcatttgaaaagactccttgaatgatgtatgacttaatcttgttatctttaccaggttaaactgtttgaaatctttctagatttcagcagtttgaactgttgaaatcttattagctttactaatggatgttgaaatcatatttagcttttactaggttgaagcctatgagggtctgtaggcctctaattctactgctgatagagctgatcatctatgaagttggattatggtttctggaggatggttgttaatacatagagaatttggacgtaaaaagattgttacgagtttttcagatgatgagactactttggaagcataagcctgtccattactaggatcacctcagatttgtccatggaattctgcaccatagatatcataccatgcagtatctaatcaaacttctgcattcatcactcccatcatcaaatataatctcttttggacaagcaatgaacttgaatgtgtgtcttggtgaaagccacctggacatgtcataagctgcattggcctctgttttggggtgttttctctatcacatgtcacaagctgcactggcctctgttttgaggtgttttcttcatttaattcatgtggatgtatatgttaagcagggaaggatgtgtttgcattgcacatagtggtgttttcatctattttatgtggacctgtcttttaagcagtgaaggatgttttcatgtggcagattggtggtttttgtagggcgtgcacatgtaggattagcatttttctttactgctgttttattgatagtttaaatgattgttagcttccttgtctctgaacctgcttatgtcctagtttgaacattcccttttatgttcattttacatcaggttcttcattatttaatctgacaatggtctgtaatggttgaaagctaaaacttgtctgagacttgattaattggttggttgcttattattgtttgtttcttcccaagataaaaggttcattg

SEQ ID NO: 9401 - DNA, 1235 bp, Festuca arundinacea
ctcccccgaatccgctgcaagccaagcgccaccccacgcctcgccaccccgaagtaagttactttcctgatcaaaatgtcgcgggaggagaatgtctacatggccaagctggccgagcaggcagaaaggtacgaggagatggttgagtacatggagaaggtggccaagacagtagatgtggaggagctcactgtcgaggagcgtaacctcctgtctgttgcctacaagaatgtgatcggggctcgccgtgcttcgtggcgtatcgtctcatccattgagcagaaggaggagggtcgtgggaacgaggagcatgtcactctgatcaaggaataccgtggaaagatcgaggccgagctgagcaagatctgcgatggtatcctcaagttgctagacttacaccttgtgcccatgtctactgctgctgagtccaaggtgttttacctcaagatgaagggtgattatcacaggtacttggctgaatttaaggctagtgctgagaggaaggaagctgccgagagcaccatggtggcttacaaggctgctcaggatattgctctggcggaactggcccccacacatcccataaggcttggacttgcacttaacttctcagtgttctactacgagattctgaactctccagacaaagcttgcaatcttgcaaagcaggcttttgatgaggctatctctgagttggacaccctcggtgaggagtcctacaaggacagcacattgatcatgcagctcctgagggacaacttgaccctatggacatctgacctcacggaggagggcggtgctgaggatggcaaagaagcctcgaaaggcgaaggcggcgagggccagtaactgtgttgaatcaatgtgtttgcgtgtttctggagctcatttggtttagatgccccatgtgctgttgaagtccgcgttgcgctgtggatggattgtcctgttctaactgtctctcatgtactcccctccctttttccctgttgtaggctggtagtggtcgaagtagttctattgcctttgcgtcgtttctagttggcgcagtcggtccattttggaccgatattgttctcctggatttgactgcatggtgttgtgtctcaccagtggtttcattttattcgtctttgtctcttcgcctcggcaatcacatactattgcacttattcaaaaaaaaaaaaaaaaaaaaaaaaaaaaaaaaaaaaaaaaaaaaaaaacaaaaaaaaaaa

SEQ ID NO: 9402 - DNA, 983 bp, Festuca arundinacea
agcgccacccccgaagctgaagtaagttactccgctgctcaaaatgtcgcgggaggagaatgtctacatggccaagctggccgagcaggcggaaaggtacgaggagatggtcgagtacatggagaaggtggccaagacggtagatgtggaggagctcactgtcgaggagcgtaacctactatccgttgcctacaagaacgtgatcggggctcgccgtgcttcgtggcgtatcgtctcatccattgagcagaaggaggagggtcgtgggaacgaggagcacgtcactctgatcaaggaataccgcggaaagattgaggccgagctgagcaagatctgtgatggtatcctcaagttgctagactcgcacctcgtgcccatgtctaccgctgctgagtccaaggtgttttacctcaagatgaagggtgattatcacaggtacttggctgaatttaaggctagtgctgagaggaaggaagctgctgagagcaccatggtggcttacaaggctgctcaggatattgctctggcggaactggcccccacacatcccataaggcttggacttgcacttaacttctcagtgttctattacgagattctgaactctccagacaaagcttgcaatcttgcaaaacaggcttttgatgaggctatctctgagttggacaccctgggtgaggagtcctacaaggacagcacattgatcatgcagctcctgagggacaacttgaccctatggacatctgacctcacggaggagggcggtgctgaggatggcaaagaagcctcgaaaggcgaaggcgccgagggccagtaactgtgttgaatcaatgtgtttgcgtgttgaagtctgcgttgcgccgtggatggattgtcctgttctagctgtctctcatgtactcccctccctcccttttaacctgttgtaggctggtagtggttgaagtagttctattgcctttgcgtcgtttctagttggcgca

SEQ ID NO: 9403 - DNA, 1090 bp, Setaria italica
ccccctcctcctccccagcgccactcgcatcgagacgacccgcgtccgccacgcccccggaaggctaggtaactcaatttcttgatcaacatgtcgcgggaggagaatgtctacatggccaagctggctgagcaggcagaacggtacgaggagatggttgagtacatggagaaggtggctaagaccgtagatgtggaagagctcaccgttgaggagcgtaacctcctgtctgttgcttacaagaatgtgattggggctcgccgtgcctcatggcgcattgtctcctccattgagcagaaggaggagtcccgcaagaacgaggaacatgtcgctcagatcaaggaataccgtggcaagattgaggctgaattgagcaatatttgtgatggtatcctgaagctgcttgactcgcaccttgtgccttcctccactgctgcagagtcaaaggtgttctacctcaagatgaagggtgattatcacaggtaccttgctgagtttaagactggtactgagaggaaggaatctgcagagagcacaatggtggcttataaggcagctcaggatattgcactggctgaactggcacctacccatcccataaggcttggacttgcacttaacttctcagtgttctattatgagattctgagctctccggacaaagcttgcaacctagcaaagcaggcatttgacgaggctatctctgagttggacacccttggagaggagtcatacaaagacagcaccttgatcatgcagctcctgagggacaacttgaccctctggacctccgacctcacggaggatggtgctgaggagggcaaagaagcccccaagggcgatgctggtgaggcttagtagcctggtaaaccttgatggatggttcggcatgtttttcctgtgctgctcgaagccgtgcccttgctcctccatggattccctgactccgagcttcatgtagtaggctggtagtggtcggattattagccccattgctttagttggcactgggtccatttggactgatgctattgaagtcgtctttcttgttttgctgttgcaatttgttgctattgtgttctgttccgcg

SEQ ID NO: 9404 - DNA, 1122 bp, Zea mays
aggcccaccgctagcatccgcagttcccccgcgcccgagacgcaaccccgcgccaggagtaagtttgttcttttatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaaggtgaggctggtgacggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcactaagtccgtgtggactggtattattcactggatttgagaagcatgtcagtggttgctctagcgttttattgagttttgaagtcatctccct

SEQ ID NO: 9405 - DNA, 1467 bp, Elaeis guineensis
aacgagaggagtgtgaacacgggagagattcgcgcctctgactgcgcctgtcgaaatctggccatgcgtcgcgcgaaatggcttccagcggcggcgtgttttcttcctcgcctcggtcgcgcagccgtctgtcagcaactgcgcaggctcacgagtctttccaccacttgtcgcttccccattggctgattcgctatctttgcccgagctttttagggctcgacacctcacctctcgcagcctcccagccccaccttctctccgccctcagaaacccaaacccggaaaaagagagagcgcgacgaagaacagagagaggaaaaatataggagagagtgagaacttctacacaaaagagggggagaaaagatgtcttcggccgaatcaactcgtgaagagaatgtgtacatggccaagttggccgagcaggcagagaggtatgaggagatgatagaatccatggagaaggtggtaaagactgtggacacagaggagctcactgtagaagagcgcaaccttctgtctgtggcctacaagaatgtgatcggggcccgccgggcctcatggcgcatcatttcctcaatcgagcagaaggaggagagccgtgggaatgaggatcatgttgccgtgatcaaggagtaccgggggaagattgaagctgagctcagcaagatctgtgatggcatcctgaagctgcttgattcccacgtcatcccatctgccgctgctgctgagtcgaaggtgttctacctcaagatgaagggagactaccacaggtaccttgcggagtttaagacgggggcagagaggaaggaggctgctgagaatacactgatggcttacaagtctgctcaggatattgctctggctgaactggccccaactcacccaataaggctcgggcttgcacttaatttctctgtgttctactatgagatcctgaactccccagaccgtgcttgcagtcttgcaaaacaggcttttgatgaggctatatctgagttagacactttgggtgaggaatcctacaaggacggtacactgatcatgcagcttctccgggacaacttgaccctttggacctctgatatcacggaagatgctggggatgagatcaaagaagctccaaagaaggaagcaggagaggggcagtaatggacctatctgttctttcaggatggtgccatgtaccatggggtttgtggtttcttttgagcagatatagtggtaattcatataaacattcaggatgctactcgaaactgctgttgtgtgtgggtgtacctcttttctatttgacctaccagcaaacatgttttacttattgattgctgttctaattgtgcaaactcgttttcttttctattcatgtggtggatggtgttctgttgaaatatattaaattatagactgaggatttcaaagagacaagaaaaaaaaaaaaaactaagaagaatagcaaggaca

SEQ ID NO: 9406 - DNA, 1343 bp, Phalaenopsis aphrodite
tgcatatattctggctctgttaggaaaatctttcgtctctctgtctctctctctaccccagtcggcacgaaagaagtacagagtaggagacggagatccaggtcgggagaagaagaaggtagagttgggcgagaatagtgattcgtaatatatatagcagaagtgagaatgtcacctgcggaaccttctcgtgaggataatgtttacttggccaagctctctgagcaggctgagcgatatgaagagatggttgaatttatggagaaagtggctaaaacagttgatgaggaggagctaactgtggaagaacgcaatcttctatctgttgcatataaaaatgtgattggtgctcgtcgtgcctcatggaggattatctcttccattgagcagaaggaagagagccgtgggaatgaggatcatgtggctttgatcaaggagtatcgtagcaagatcgagcatgagctcagcaagatctgtgatgggatcttaaagctgctcgattctaatctcattccttctgcgaaggcagctgaatcaaaagtgttctatctcaagatgaagggtgattatcacaggtatctagcggagttcaagactggagcagagaggaaggacgctgccgagaacacacttttagcttataaatctgctcaggacattgcattggccgatctagccccaactcatccaataagactggggttggcgctgaacttctcagttttctattatgaaattttgaattctccagaccgtgcttgcaatctagcaaagcaggcctttgatgaggctatatccgagctggacacattgggcgaggagtcatacaaggacagcacattgatcatgcaactcctcagagacaacttgacactgtggacctctgatataaatgaggacactggagatgagctcaaagatgccccaaaagttgaagcagccgagccctagtcttcaggggacttggtattttatgttacattcaaaagccatatactttaaagaactttgtcgtgtggcaaaattacttcatttttcattggatgtttaatttatttatcattggtggggttctgcttcttgtaatatagctatcattgtgatttgtttgtgttgcagataattaaagctttaagatctatatatgatatttatgttggttcttgtcggaaatgatattcgaagtttcgatgatatagagaggcatcatttgtttcaaatcacacacaaatgatgattttaaatattccattcattttatatatttgttatatgttatcatttcataatattaaagacttttattggttgacattattactgatctatgtagctgggttgcc

SEQ ID NO: 9407 - DNA, 930 bp, Platanus occidentalis
ttctccgtcttctaaccggtcagaatcgagttttagttttgtaaaagaaaatgtctccggctgaatcgtctcgggaagaaaatgtctacctggccaaattggcagagcaggctgaacgatacgaggaaatggttgagtttatggagaatgttgcgaagacagtggatgtcgaggagctaaccgtagaggagcggaaccttctctctgtggcttacaagaatgtgattggagcgaggagggcttcgtggcgaattatctcctctattgagcagaaggaagaaagccggggaaatgaagatcatgtggtggctatcaaggagtacagagggaagattgaatcagaactcagcaatatctgtgatgggatcttacgtcttctcgactcacatctcatcccatcatcgacggctgcagagtcaaaggtgttttaccttaagatgaaaggtgattaccataggtatttggctgagttcaagacagggcctgacaggaaggaagctgctgagagcacattgttggcttataagtctgctcaggacattgctctggctgatttgacacccacccacccaataaggctggggcttgctctcaatttctcagtcttctattacgaaatcctgaactcaccagatcgtgcttgcaatcttgcaaagcaggcttttgatgaggctatttctgagctggatacattgggtgaggaatcttacaaggacagcacattgatcatgcaacttcttcgcgacaatttgacattatggacctctgacattacggaggataatggggatgagatcaaggaagctccaaaacgggactctggagaggggcagcagtgatttacccatctggacttggggtaatgataaacaaaacttggggttttttttttgtgtgatatctgtattgtactgtgctattagtatagat

SEQ ID NO: 9408 - DNA, 1285 bp, Podocarpus macrophillus
aagtaaatcccgtattttaccatataaataggtcggttcctgcctggaagatccttcatgtgtctgtgtgttcttcctcttctagcggatttaaaatctgagtcttgggcttagatttcgtgcctggatcgatcgtttgctggcttggagctgatttctccgtttgatttcagtatttaaaagggtaagataatggctcctgtggaatcttctcgggaagagaatgtttacatggcaaaattagccgagcaggcagagcggtatgaggaaatggttgagttcatggagaaggtggcgaagactgtggatgtggaggagctgacagtagaggagcggaatttgttgtccgtggcctacaagaacgtcatcggcgcccgcagggcttcctggaggattatttcatccatcgagcagaaggaagagagtcgcggtaatgatgagcatgtcgtcatgatcaaagagtatagggctaaggtggagtctgagctaagtaatatttgcgacggtattctgggtctcctggattcgcaccttattccctcctcaaccagcggggaatccaaggtgttttatttgaaaatgaagggagattaccaccgttatttggcagagttcaagaccggcgctgagaggaaagaggcagcggaaagcactttgctggcctacaagtctgctcaggatattgccttggcagaactggctccaactcacccaatcaggctgggattggctctcaacttctctgttttctactacgaaattctgaattctcctgatcgtgcttgtacgcttgccaagcaggcctttgatgaagccattgccgagttggatacactaggcgaagaatcttacaaagacagcacacttattatgcaactccttcgagacaatttgactttatggacttcagacatgaatgaggatactgctgatgaaatcaaagaagccccttcaaagcgtgaggagggagatgggcaatgacctggagtgttttctgatttatttttaatacttgtttgaaaagtgaatttctgtgtaaaattttacttactggaccaaatagttttttgaagtatagtggacgagggcatcttttattgttgtccctgctatactattaaacttgtcaggaacgagttccagataagatgcatttatgctatcttgctggcatttgaagatgaccttctatttggcacctttattttggtttccgaagaaataggacctttttctgtggaggcatggatagtatctaatatcaatttataatctttcaaaatgc

SEQ ID NO: 9409 - DNA, 907 bp, Valeriana officinalis
ctactaataataatacttacttacttaccaatcatttctctacttcttctctctacactccgtctcatttttcccctcaattcaatcaggctctgatttgtaatcctaatcaacactaaaatatgtctcgtgaggaaaatgtttacatggccaagcttgccgagcaagcagaacggtacgaagaaatggtagagttcatggagaaagttgcaaagacagttgatgttgaagaactcactgtagaggagagaaatctgctttccgttgcatacaagaacgtgatcggtgctaggagagcttcatggaggatcatatcttctattgagcagaaagaagagagccgtggtaatgatgatcacgttgccctaatcaaggattacaggggcaagatcgaaaccgagcttagcaagatctgtgatggaatcttgctccttctagattctcaccttgttccttctgcttcgtccgctgaatctaaggtgttttacttgaagatgaagggtgattatcacaggtatttggctgagtttaagactggcgctgagaggaaagatgcggccgagtctacattggttgcatacaaatccgctcaggatatcgctttggctgatttggctccaactcacccgataaggctagggcttgcacttaacttctccgttttctattacgaaatcctcaactcgcctgatcgtgcgtgcaatcttgcaaagcaggcttttgatgaagctatatctgagttggacactttgggtgaggaatcatacaaagacagcactttgatcatgcagcttctccgagataaccttactctttggacatccgatctcacggacgaagctggtgatgaaataaaggaaagttcaaagccagaatcaggggacgctcagtagcagaaaattgaaat

SEQ ID NO: 9410 - DNA, 959 bp, Citrullus lanatus
tctctctctctctgggctcgattttctcgagagaattaatagtttattacattgaagatgtcgcctgttgattcttcacgggaggaaaatgtttacatggccaagttggccgaacaggctgaacgatatgaggaaatggtagagttcatggagaaagttgccaagactgtagatgtcgaggagctgactgttgaggagaggaatctcctctctgttgcttacaagaatgtcattggggctcggagggcctcatggaggattatttcttccattgagcagaaggaagagagtcggggaaatgaggaccatgttgcaattatcaaggattaccgtggcaaaatcgagactgaactgagcaagatctgtgatggaattttgagcctacttgagtctcatctcatcccatcagcctcatctgctgagtcaaaggtgttttatctcaaaatgaaaggtgattaccacaggtacctggctgagtttaagactggagctgaaagaaaagaagcagctgagagcacattgttagcctacaagtctgctcaggatattgctcttgccgaattggctcctactcatccaattaggctaggtctcgctcttaacttctcagtgttttattatgagatccttaattcgccagaccgtgcttgcaatttggcaaagcaggcttttgacgaagcaatttctgagcttgatacattgggtgaagaatcatacaaggatagcaccttgatcatgcaactcctccgagacaacttgaccctttggacttctgatattggggacgaagctggcgatgagattaaggaagcatcaaaacgtgaatcaggggagggacagtagcttgcgttgttgagttgatacttgataggagttgtactctgtactttttttttctctcttcttttttcccccttttctcttctctctctctctctctcttcttcttcttcttcttt

SEQ ID NO: 9411 - DNA, 996 bp, Echinochloa colona
cccacccctaccccagcacccggagttccccgaccgcacgcgccgttccgccccgtcccgctgtgctcgacagccgcccgcacccgcgccaggagtaagatttttccttgaccaatatgtcgagggaggagaatgtttacatggccaagctcgccgagcaggccgaaaggtacgaggagatggttgagtatatggagaaggtggccaagactgtagatgtcgaagagctcactgttgaggagcgtaacctcctgtcagttgcgtacaagacatgattggggctcgccgtgcttcatggcgcattgtctcatccattgaacagaaggaggagtcccggaagaatgaagagcatgttaatctgatcaaggaataccgtggcaagattgaggctgagctgagcaatatctgtgatggcatcctgaagctgcttgactcacaccttgtgccttcttctactgctgctgagtcaaaggtcttctatctcaagatgaagggtgactaccacaggtatcttgctgagtttaagactggcgcagagaggagggaatctgctgagagcactatggtggcttacaaggctgcccaggatattgctctggctgagctggcacctactcatccgatcaggctcggacttgctcttaacttctcagtgttctactacgagattctgaactccccagacaaagcttgcaaccttgcgaagcaggcgtttgacgaggctatctctgagttggacacccttggggaggagtcatacaaggatagcacactgatcatgcagcttctgagggacaacttgaccctctggacctctgacctcacggaggatggtgctgaggagggcaaagaagccccgaaaggcgacggcgagggacagtaaccccaaggctctattcttagagccaattgttttagatgcccctgtgctgtcgaagctgtgcgctgcgccattattgtagctgctatcgtcacacctccgctcgcttcttttcc

SEQ ID NO: 9412 - DNA, 1174 bp, Euonymus alatus
cttattattggacctctccaacctcgtctccgtactttctctcccattttttagacagtcctcttcggtctcgcttttatcgtcaccaacatttcacacttcaaatctctctccgaatcttgattgataggctgtggcaaaatgtcgtctgactcatcacgagaggaaaatgtctacatggccaagttggctgaacaggctgaacgatatgaggaaatggtggagttcatggagaaagttgcaaagacagtggatgttgaggagctgactgttgaggaacggaacctcctttctgtagcttacaaaaatgtgattggggcaaggagggcctcatggaggattatctcttccattgagcagaaggaagaaagtaggggaaatgaggaccatgtcactatcatcaaggagtacaggggcaagattgagtctgagctaagcaagatatgtgatgggattttaaaccttctagagtcacatcttgtcccctcagctagtgctgctgagtccaaggtgttttaccttaagatgaagggtgattatcacaggtacctggctgagtttaagactggtgctgagaggaaggaagctgcagagagcactttgctggcttacaagtctgcccaggacattgctctggctgaactagcccctactcaccctataaggctgggacttgcattgaacttctctgttttctattatgaaatccttaattcaccagatcgtgcttgcaatcttgcgaagcaggcttttgatgaagctatctctgagctggataccttgggtgaggaatcatacaaggacagtacattgatcatgcaacttctccgggacaatctgacactttggacttctgatattacggatgatgctggggatgaaataaaggaggcatcatcaaaacgcgaatctggcgaggggcagcagtcgtgatctaagaactcatagaatatcctattctgtactttgtttttaatcttgcgacatttacttagttttagatgccttgtgggttgttgtggcaggatttcttaatgtatttggtgatcttgattgcagacagctcttaggttttaaatgttcaagtagatcataaatgtgcttttattatttatgatgaagatttgattgatttggcatccttgtttatcaaattcattgcataagatgccta

SEQ ID NO: 9413 - DNA, 1166 bp, Catharanthus roseus
cagttggttacttcactcccttgccttcaggcaatagaaacaggataagaatttgatttgaacaagaaaatatgttgcccactgaattatctcgtgaggagaatgtttacatggccaagttggcagagcaggctgagaggtatgaggaaatggttgaattcatggaaaaagttgcaaagggggcagattctgatgaacttactgtggaggaaagaaatttgctttctgttgcttacaagaacgttattggcgctagaagagcttcctggagaatcatctcctctattgagcaaaaggaagagagccgtggtaatgaagaccatgtgtcaattattaaggattataggggaaagattgaggctgagctcactaatatatgcaatgggatattgcgacttcttgacacgcatctaattccctcggccaatatttcagagtcaaaagtgttttatctgaagatgaaaggcgactatcatagatacttagctgagttcaagactggagccgaaaggaaggaagctgctgagaacacactagttgcttacaaatctgctcaggacattgccctggctgagctgcctccaacccatccaataagactaggtcttgcacttaacttctccgtgttctactatgagatactgaactcacctgatcgtgcttgcgctcttgcaaagcaggcttttgacgaagctatatctgagctggatacattgggtgaagaatcctacaaagacagcacgcttatcatgcaacttctccgtgacaatttgactctatggacttctgatgtgccggaggatgctggtgctgagatcaaggaggcttccactgctgaggcaggcaatgttcaaaagtgatgtttgtaattttgctggagggttcaacagacttgggttaggacttggctggcatgtatcatcatcatcttctctctctctagtgttgaattctgagattatgcttaattccatatatagtagtacttagaacgtgtatgctatgatattgaagtatattatgcttagttcttgagcagtgagctcacctttcaatatatctgctagtttttctttgatggcgacgatttttatccttctttgttacgacttgtgcatggttttcatgtatttcagagatggtttggcaagagaccttgcactgtg

SEQ ID NO: 9414 - DNA, 1273 bp, Avena sativa
gttgcgaattgctacacagaccacagcaaggccacgcgagaccccaacctctcccccaatcagctgcaagccaagcgtaactgcacgctgtgcacgcccctcgccaccccgaagtaagttacttccctgatcaaaatgtcgcgggaggagaatgtctacatggccaagctggctgagcaggcagaaaggtacgaggagatggttgagtacatggagaaggtggctaagacagtagatgtcgaggagctcactgtcgaggagcgtaacctcctatctgttgcctacaagaatgtgattggggctcgccgtgcttcatggcgtattgtctcatccattgaacagaaggaggaagggcgtgggaatgaggaacatgttactctaatcaaggaataccgtggaaagattgaggccgagctgagcaagatttgtgatggtatccttaagttgctagactcacaccttgtgcccatgtctgccgctgctgagtccaaggtgttttacctcaagatgaagggtgattatcacaggtacttagctgaattcaaggctagtgccgagaggaaggaagctgccgagagcaccatggtggcttacaaggctgctcaggatattgctctggcggaactggcccccacacatcccataaggcttggacttgcacttaacttctcagtgttctactacgagattctgaactctccagacaaagcttgcaacctcgcaaagcaggcttttgatgaggctatctctgagttggatacccttggcgaggagtcctacaaggacagcacattgatcatgcagctcctgagggacaacttgaccctatggacctccgacctcacggaggagggcggtgccgaggatggcaaagaagccttgaaaggtgatgctggcgagggccagtaacttgcgttgaatcaatgggtctgcatgttgctggagctccattggttttagatgacccctgtgctgtcaaagtctgtgttgcgccgcggatggattgttgtgttctagctgtttttcatgtactccactccctccctccctccttcactgttgtcaggctggtagtgctcgaattagttccattgcctctgctagttggcactcggtccattttggaccgatattgttctcctggatttggctgcattgtgtttcgctagtggtttcattatatgcgtctcggtctcttccccgtggcagcattctgaatttttctttgctcttgtacagttgtactgtactgcctattgcgctattctttgcg

SEQ ID NO: 9415 - DNA, 907 bp, Allium cepa
aacccggtccagtatctacaaaattcaaaagcctaatttgccgtcgcaagtagcaacaagacgcaaaggaaacatagggtttctcaattgttagaaattaaaaacattgtttagttcaaaatgtctgctacacgagatgaaaatgtatacatggcaaagcttgcagagcaagctgagcgttacgaggagatggttgagttcatggaaaaggtagcaaaaacagttgatgctgacgaacttactgtagaagagaggaaccttctttcggttgcatacaaaaatgttattggggctcgccgtgcttcttggagaatcatatcttctatcgagcagaaagaagagagcagagggaatgaagatcatgtggttatgattaaggaataccgtggtaaaattgaggccgagttaagtaaaatctgtgatggaattctgaatttgcttgacactcatcttgtaccttcatcgaccgccgctgagtccaaggtgttttatttgaagatgaagggagattatcataggtatcttgctgagttcaagaccggggcagagagaaaagaggctgctgagagcacgcttattgcctacaaatcagcacaggatattgctttggctgaattgcctcctacccatcctataaggcttgggctggccctcaacttttcagtgttttattatgagattctcaactcgcccgatcgtgcttgtagtcttgccaaacaggcatttgatgaagcaatatcagaattggatactttgggtgaagagtcatacaaggacagtactttgatcatgcaacttctccgagataacttgactctttggacatctgacctcactgaggatgctggtgatgaaatcaaagaagctgtcccaaagcaagaaggacagtgataagttgcaactttct

SEQ ID NO: 9416 - DNA, 1614 bp, Populus trichocarpa
caagtcccaattttccttgaagtgataaccaacctaaagaaaagaaaaggaaagtcgggcccaccacacacagaccgtcgaatcatcaataaatttagactttttagccttccgactacacacgcacacagaggatcactcgttcagaccatctccgttgacggtcaaagctagagtgtccttcccagaaataataaatcagaaaagaaaaatacgaactcccacgaaatctccgccacccaatacttgtcactttctcattggacccctaacttcatgacctctctttttataagcccaaagtacccctccctcgcagtctttttaacgagcccaaaatacccctccctcgcagttacttcccctccatttcacgcacagagagagacccgtgtctgcagattctcttttcaagaagtaacttttagcttgatataaaaatgtctccaactgaatcatcacgtgaagagcatgtttacatggccaagttggccgaacaggctgaacgttatgaagaaatggtggagtttatggagaaagttgcaaagacagttgattcggaggagctaactgtggaggaaaggaacttgctctccgtagcctacaaaaatgtcattggagctaggagggcttcttggaggatcatatcttccattgagcagaaggaagagagcagaggaaatgaagatcatgtcacaatcatcaaggagtacaggggcaaaattgaagctgagctcagcaagatctgtgacggaatcttgaacctccttgagtcgcatcttattccctctgcctcatctgctgagtccaaggtattttacctcaagatgaagggtgattaccataggtatcttgctgagtttaagacgggggctgagaggaaggaagctgctgagagcactttgttggcttacaagtctgctcaggatattgcacttactgaactggctcctactcacccaataaggcttgggcttgctcttaacttctctgtcttctactatgagatccttaactctcctgatcgtgcttgcaatcttgccaagctggcttttgacgaggctatttctgagctggatacattgggtgaggagtcttacaaggacagcacattgatcatgcaacttctccgagataatctgacactctggacctctgatatcacggatgacgccgatgagatcaaggaagcatcaaaacgtgaatctggcgacgggctgcagtgatgaagttcagttcataggatatatgcaccctgtacttctatcttgtgaaatttacagacgcctgtgggttgttgtagttggatttattaatgaatttgataatcttgagtgccgtgccacagtacgtgggattgaaatgtaccaacagattatcaagtttttagtattgatgcctacaatctgggttgatgtttttatcagattttcatcttccaattctgggttttgatgttccttgtggctctgctatatgatattacatcagtgacgaaactacttgtttcgaatttttagcattcaaaaccctgtttggtttatcagtaacacctttaggtggttgtagtagaacagaacaggaattataaaagttcccgaatcagtttccctc

SEQ ID NO: 9417 - DNA, 1117 bp, Pteridium aquilinum
tcaacgaatcgaaaggcaaaaaatctgcaggcgaaaaaaattctcgattggatcaaatattagattgatatagtaaagatgtcgccaactgaatcatcacgagaggaaaatgtgtacatggccaagttagctgagcaggccgaacgctatgaggaaatggtggagttcatggaaaaagttgcaaaaaccgttgatgttgaggagctaactgtcgaggagcgaaaccttctctctgtggcttacaaaaatgtgatcggggctaggagggcttcatggaggatcatctcttccatcgagcagaaggaagagagcagaggaaatgaggatcatgttgcaatcatcaaggagtataggggcaagattgaagctgagctcagcaagatttgtgatggcattttgagccttcttgagtctcacctcattccttcagcctcatctgctgagtccaaggtgttttaccttaagatgaagggtgattatcacaggtatcttgctgagtttaagactggggttgagaggaaagaagctgctgagagcactttgttggcttacaagcctgcccaggatattgctcttgctgaacttgctcctactcacccaatcaggctgggacttgctcttaacttctctgtcttctactatgaaatcctcaactcacctgatcgtgcttgcaatcttgctaaacaggcttttgatgaggctatttctgagttggatacattgggtgaggaatcttacaaggatagtacattgatcatgcaacttctccgggataatctgaccctttggacatctgacatcacggatgaagctggagatgagatcaaggaagcttcaaaacgtgagtcaggcgaggggcagcagtgatgagctaagttcataggatatgtatctgtacttttatcttgcggttttacgtaggtgcaatatgggtcgtagaaggtgtttttaatgcattcatcaacacttggagttgaaatgttccaatggattatatatgtgcttttatattggacaagaagaatttggttggttttttcatgtgggtaatgttaaaaatagtgcgtttggcaaatcaagttgagcatacgaggtgctttgaatgtttaaaaaagaa

SEQ ID NO: 9418 - DNA, 998 bp, Tripterygium wilfordii
atgtcgcccgactcatcacgagaggaaaatgtctacatggccaagttggctgaacaggctgaacgttatgaggaaatggtggagttcatggagaaagttgcaaagacagtggatgttgaggagctgactgttgaggaacgaaacctcctttctgtagcttacaaaaatgtgattggggcaaggagggcctcatggaggattatttcttccattgagcagaaggaagagagtaggggaaatgaggaccatgtcactatcatcaaggagtacaggggcaaaattgagtcggagctaagcaagatatgtgatgggattttaaaccttctagagtcacatctcatcccctcagccagtgctgctgaatccaaggtgttttaccttaagatgaagggtgattatcacaggtaccttgctgagtttaaggctggtgctgagaggaaggaagctgcagagagcactttactggcttacaagtctgcccaggacattgctctggctgaactagcccctactcaccctataaggctgggacttgcgttgaacttctctgttttctattatgaaatccttaattcaccagatcgtgcttgcaatcttgcgaagcaggcttttgatgaggctatcgctgagctggataccttgggtgaggaatcatacaaggacagtacattgatcatgcaacttctccgagacaatctgacactttggacttctgatatcacggatgatgctggggatgaaataaaggaggcatcatcaaaacgcgaatctggcgaggggcagtagtcgtgattttagaactcgtagaatatcctattctgtactcttcttctttttcttttttcttttaaatattgtgacatttacttagttttagatgccttgtgggttgtttgttgtagcaggatttcttaatgtgtgtggtgatcttgattgcggacagctcctaggttttaaatgttccagtagtagatcataaatgtggtttttattatttg

SEQ ID NO: 9419 - DNA, 3366 bp, Brassica oleracea
ctaaatctcgttccatcgacttcgatctctcatcatcgaagatgtctgtgcgtgtgctgaatcctaatgcggaggtgctcaacaaaacggcggcgcttcatatgaccatcaacgccgctaaaggtttacaggatgtgctcaaatccaatctcggtcccaagggaaccatcaagatgcttgttggtggctccggtgatatcaagcttaccaaggacggcaacacgcttttgaaggaaatgcaaattcaaaatcctacggctatcatgattgcgaggactgctgttgcacaggatgacattagtggtgatggtactacttccactgtcatcttcattggtgagctcatgaaacagtccgagcgttgcatcgatgaaggaatgcatccacgtgtcttggttgatggtttcgagattgcaaaaagagctactcttcagtttctcgatactttcaagacacctgtggttatgggcgatgagcctgataaagagatcctgaaaatggttgccaggaccacgctaagaacaaagttgtatgaaggcttagctgatcaactgactgatattgttgttaattcggttctctgcattcggaagcctgaggaacctatcgatctgtttatggttgagataatgcacatgcgccataaatttgatgttgacacacgattggttgaggggcttgttctggatcatggttcaagacaccctgacatgaagcgacgtgcagagaattgtcacatccttacttgcaatgtgtctctggagtatgagaagagtgaaattaatgcagggtttttctactcgaatgctgaacagagggaagctatggttactgcagagcgacgttcagttgatgaaagagtcaagaaaattattgagctgaagaataaggtttgtgctggtaacgataacagctttgttatcattaatcagaagggtattgatcccccatcattggatctgcttgctagagaagggataattgcccttcgaagagcgaagaggaggaacatggaacgtttggtgttggcatgtgggggagaagctgtgaactccgttgatgacttgaccccggactctcttggctgggctggacttgtttatgagcacgttcttggggaagagaagtacacatttgtggagcaagtgaagaatcctcattcatgtactatcctcattaaagggcctaacgatcacaccattgctcaaattaaggacgctgtccgtgatggtttaagatcagtcaagaatacattggaagatgagtgtgttgtattaggagctggagcttttgaagttgcagcaagacagcacttaatgaatgaagtcaagaaaaccgttcaagggcgagctcagctcggtgtagaagcttttgctaacgctcttctcgtggttccgaagacactagctgaaaatgctgggctggatacacaagacgttatcatttcactaacgagtgagcatgacaaaggaaacgtcgtgggagtaagcctggtggatggagaacccatcgaccctcagcttgctggtatattcgacaactactcggtgaaacgccaacttatcaactcagggccggtgatagcttcgcagttgctattagtggatgaagtaattcgtgctggaaggaatatgaggaagcctacttaaaacaaacttcttgtattattgttttcaccttatgcttttgtttcctttcttccttataggtttgagtagtaccatatggaaattatgttattgcgctatctctttttttttccctttcccttggatctcctgtttgtcatagactcaataggtaatctcgaatatcggttttttttatgaagaaaacatgatgaatctactctagttaatttgttttgtttcattgggttctactctttttcttgttttttcttctctattctttcttttaagtacttgtgattttggaaagataacgaactttcatggaactgggagaaaatgattattttcaaaacaataaagtccaatttcccgacaatgcacggtgatactttaacgattccatcatataaattatgaatttttggcaaaaataaagtctttgacgggtcaacgacgctagacacttgtcgcactctaattgggccttcttccacgtactttctcagtacaatcaaagcccatctctttccctttttcccccttatttcttctcactgccttcattttgcgtctcaagacttcgaactcgacaaatccctaattcccaaaactcccctctctctcggatctataaccaagagtgtgatacgaaacgatgtcgtctcctcgtgaagagaatgtgtacttggccaagttagccgagcaagccgagcgttacgaggagatggtcgagttcatggagaaagtcgccaagaccgttgactccgaggagctcaccgtggaagagaggaacctcttgtccgttgcttacaagaacgtgattggtgctaggagagcttcctggaggatcatctcttcgattgagcagaaggaagagagcagagggaacgaggatcacgttgctattatcaaggactacagaggaaagatcgagacagagctaagcaagatctgcgatgggattttgaatcttttggattctcatcttgttcccgctgcgtctttggctgagtctaaggtgttttatctgaagatgaagggggattaccataggtaccttgctgagtttaagactggtgctgagaggaaggatgctgctgagaacactctcgtggcgtacaagtctgctcaggatattgcactttctgatttacctcctacgcatccgattagattggggcttgcacttaacttctctgtcttctactatgagattctcaactcgcctgaccgcgcttgcaacctcgccaaacaggcttttgatgaagcaatctctgagctggacacattaggagaagaatcatacaaggacagcacgctcataatgcaacttctccgtgacaatctgacgctctggacttctgacatcaatgatgaggcgggtggtgatgagatcaaggaggcgtcaaaagacgagcctgaagaaggcaaacaagcttagatgttgatgtgaccagagagagagagagcgagactttactgcctatgtatggatttggctcttgtttcttaaaaacatatgctatggggtttgtgtgttgaagcaggagaggatcatcatttgattttctcctttgcaaactcaaaaactctcgtttttctttttttgttgggttttttttttctagtgtttcgagtctttggttttacttcgttgcttgttattattttttaggaagtgaagaaacaaaactttctatgattgctttcgattcaactattttttttgccg

SEQ ID NO: 9420 - DNA, 1345 bp, Oryza sativa
ccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttctta

SEQ ID NO: 9421 - DNA, 1211 bp, Amaranthus tuberculatus
gtcgtggtctctttcagttccattttcctacttcctgccaaacacagactctaaatcttaacccatttctgtgagaaaagatgtcaccagcagaaggatcccgggatgagaatgtttacctggctaaattggccgagcaggccgaaagatacgaggaaatggtggagtttatggagaaggttgcgaagacagtcgatgttgaggagttaacagtggaggagaggaaccttctatctgtggcttacaagaatgtgattggagctaggagagcttcttggagaattatctcttccattgaacaaaaggaagagacccgtgggaatgatgatcatgtagctattattaaggagtaccgagggaaaattgaggccgaactcagcaagatttgtgatgggattttgaagcttcttgattcacatctcgtcccatcagccaccgctgctgagacaaaggttttctatttgaagatgaagggtgactaccacaggtatttggccgaatttaaggctggagccgagagaaaagaagctgctgagcacaccttgttggcttataagtctgctcaggacattgcgctcgctgaattgcctcctactcacccaataaggttggggcttgctcttaatttctctgtgttctactatgagatcttgaattccccagaccgtgcttgtgctcttgctaagcaggcttttgatgaagccatttcagagctggacactctcggtgaggaatcctacaaagatagcaccttgattatgcagctcctccgtgacaacttgacattatggacctctgacaatacggatgatattgatgagatcaaggaagcctcaaaagatgaagcagctccagggcagtaatgaaatatttaccaaatcgaaggagttaaatgaaatgtatttatgtaacttgggtatttgtcgtgttttaggcttttactatacttggtaattggtatgtttgtttgtcgtatgcagcgtcaatgagacgctcaatataagtgaccgttattgtctacttcgtcaaagtctttgcatttcaggctgtcgtcctcggatgcatcaactaaaaccaatgtagtagtcagtgattgtttggatgaagttatacttctctcaactggaactggtattctttcagtttatcaagaaaattcttgtgtattttgggtatcattaagaaaaaaggatagaccttttgcttgtagt

SEQ ID NO: 9422 - DNA, 962 bp, Cenchrus ciliaris
tcaacatgtcgcgggaggaaaatgtctacatggccaagctggctgagcaggcagaacggtatgaggagatggttgagtacatggagaaggtggctaagactgtagatgtggaagagctcaccattgaggagcgtaacctcctctctgttgcatacaagaatgtgattggggctcgccgtgcctcatggcgcattgtctcctccattgagcagaaggaggagtcccgcaagaacgaggaacatgtcgctcagatcaaggaataccgtggaaagatagaggctgaattgagcaatatttgtgatggtatcctgaagcttcttgactcgcaccttgtgccttcctccactgctgcagagtcaaaggtgttctacctcaagatgaagggtgattatcacaggtaccttgctgagtttaaaactggcactgagaggaaggaagctgcggagagcacaatggtggcttataaggcagctcaggatattgcgctggctgaactggcacctacccatcccataaggcttggactcgcacttaacttctcagtgttctattatgagattctgagctctccagacaaagcttgcaaccttgcaaagcaggcgtttgatgaggctatatctgagttggacacccttggagaggagtcatacaaagacagcaccttgatcatgcaactcctcagggacaacttgaccctctggacctcggacctcacggaggacggtgctgaggacggcaaagaagcctcgaagggtggtgatggtgaggctcagtagcttcggcatgtttttcaatcccatcatgtcggatgcgcatgtgctggtttaagatgtgcgccgctcctccatggattcactgattccgagcttcatgtagtaggctggtagtggtcggattagccccattgctttagttggcactgggtccatttggactgatgctattgaagtctcttttcgttt

SEQ ID NO: 9423 - DNA, 1310 bp, Fagopyrum esculentum
gggggaataaatttcccccaaattcaacatcaaccctaaccctacccccttgattctcacaaccccatttgccggatttgttttaagttttcggtgaggaaacatggctgctgagggatccagggaagagaatgtgtatcttgccaaattggctgagcaggcagagaggtatgaagagatggtcgagttcatggaaaaggtagccaagacggtcgatgttgaggaactgactgtggaggaaaggaaccttctctcggttgcttacaagaacgtaataggggcaagaagggccgcctggagaatcatctcatctattgagcagaaggaggagagtcgtgggaatgaggaccatgtttccaccatcaaagagtacagagccaagattgaggccgaacttagtaagatctgtgatgggatactgaagcttcttgatacacaccttgttccagcagctggagctgctgagtcaaaggtgttttatctgaagatgaaaggtgattatcatcggtatttggctgagttcaagactggtgctgagaggaaggaagctgctgagagcaccttggtggcttacaaagctgctcaggacattgcactggctgatctagctcctactcacccgataaggctggggcttgctcttaatttctctgttttctattacgaaatcttgaactctcctgatcgtgcctgcaatcttgcaaagcaggcttttgatgaggccatatcagagcttgatactttgggagaggaatcatacaaggacagcacactgatcatgcagctcctcagggacaaccttacattatggacttctgataacgcggatgatgcaggagaagagatcaaggaagctgctcccggtgaaggagctgatggaaaataggagtgtttgagcttcagagatagttgaagccatggattcatattaatatgtttgtcgtattattcgcgtctttagcttatttagcatggcgggtatgtgacctctttacatattgtttttatttttcatggatgctatggaatatgggccagaactaagcagtcattcattgaatgcttcacttcccgagtattttagagtctagggcggttggatccacacccgttgcttgcaaaaacgctgaatttgttaaccattgatcggtcatccatatggaccgagtgatagctcgggtagaccaattgccctaatctgtcatttcgagtttttattcaatgatatcttatagtttacatcctaaaaaaaagaaaagaaaaacaaactgtcgtgtatactaccacggtctgtgaagggcacgagacac

SEQ ID NO: 9424 - DNA, 1043 bp, Pennisetum glaucum
gccgctcgcatcgagacgacccgcgtccgccgcgcccgtgcgttcgcccgtctcacccccggaaggctaagtaactcaagagatcaacatgtcgcgggaggaaaatgtctacatggccaagctggctgagcaggcagaacggtatgaggagatggttgagtacatggagaaggtggctaagactgtagatgtggaagagctcaccattgaggagcgcaacctcctgtctgttgcgtacaagaatgtgattggggctcgtcgtgcctcatggcgcattgtctcctccattgagcagaaggaggagtcccgcaagaacgaggaacatgtcgctcagatcaaggaataccgtggcaagattgaggccgaattgagcaatatttgtgatggtatcctgaagctccttgactcgcaccttgtgccttcctccactgcggcagagtcaaaggtgttctacctcaagatgaagggtgattatcacaggtaccttgctgagtttaagactggcactgagaggaaggaatctgcagagagcacaatggttgcttataaggcagctcaggatatcgcactggctgaactggcacctacccatcccataaggcttggacttgcacttaacttctcagtgttctattatgagattctgagctctccggacaaagcttgcaatcttgcaaagcaggcctttgatgaggctatctccgagttggacacccttggagaggagtcatacaaagacagcaccttgatcatgcagctcctgagggacaacttgaccctttggacctccgacctcacggaggacggtactgaggagggcaaagaggccccgaagggtggtgatggtgaggctcagtagcttcggcatgtttttcaaggccatcttgttggatgcgcatgtgctggtctaagctgtgcgctgctccatggattcactgattccgagcttcatgtagtaggctgctagtgatcggattagccccattgctttagtttgcactgggtccatttggactgatgatattgaagtctcttctcgtttt

SEQ ID NO: 9425 - DNA, 1389 bp, Oryza sativa
ctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttcttattgtcatgagagttgagatgatgtttggattggcg

SEQ ID NO: 9426 - DNA, 1021 bp, Rosmarinus officinalis
cggccgggggagctttaccatttcctcagcttcttcttcttcacactgaagagttggtctgttcactctctttgctttcaatcgatagaaaaggataagaattaaatttgaacaagaaatatgttgcccccagaactatctcgtgaggagtatgtctacatggccaagctggctgagcaggcagagaggtacgaggaaatggttgaatttatggaaaaagttgccaagggggctgatgctgaagaacttactgtggaggagagaaatctgctttctgtagcttacaagaatgttattggcgctaggagagcttcctggcgaatcatctcctctattgagcaaaaggaagagagccgtggtaatgaagaccacgttgcaattattaaggattataggggaaaaattgaggccgagctcaccaatatatgcgatgggatattgcgacttcttgacacacatcttataccctcagccaatactgcagagtcaaaagttttttatctgaagatgaaaggtgactaccatagatacttagctgagttcaagagtggagctgagaggaaggaagctgctgagaacacgctggttgcttacaaagctgctcaggacattgccctgcctgagctgcctccaacacacccaataagactgggtcttgcacttaatttctctgtgttctattatgagatactgaactcacctgatcgtgcttgcgctcttgcgaagcaggcttttgatgaagccatctctgagctggatacattgggtgaagaatcctacaaagacagcacacatcatgcaacttctccgtgacaatttgactttgtggacttcagatgtgcaggaggatgctggtgctgagatcagggaagcttccgccactgagccaggcaatggtcataagtgattcttgtaattttgctggagggtttcacggattgactaggtttaggacttgggatgtactgtctgttgaattctgagatgatgctttgataacacttagaaccatatgatatga

SEQ ID NO: 9427 - DNA, 1198 bp, Panicum virgatum
agtttcaactggcttttgaaattgactcatcagtgtttcttttttgttattgcagtaataacccaagttcttgatcaacatgtcgcgggaggagaatgtttacatggccaagttggctgaataggcagaacggtatgaggagatggttgagtacatggagaaggtggctaagaccatggatgtagaagagctcaccgttgaggagcgtaacctcctatctgttgcctacaagaatgtcattggggctcgccgtgcctcatggcgcattgtctcctccattgagcagaaggaggagtcccgtaagaatgaggaacatgttgctcagatcaaggaataccgtggcaagattgaggccgaattgagcaatatctgtgatggtatcctgaagctgcttgactcgcaccttgtgccttcctccactgctgcagagtcaaaggtgttttacctcaagatgaagggtgattatcacaggtacctggctgagtttaagactggcgttgagaggaaggaatctgcggacagcacaatggtggcttataaggcagctcaggatattgcactggctgaattggcacctactcatccaatcaggcttggacttgcacttaacttctcagtgttctattatgagattctgaactctccagacagagcttgcaaccttgcaaagcaggcttttgatgaggctatctcagagttggacacccttggagaggagtcatacaaagatagcaccttgatcatgcagctcctgagagacaacttgaccctctggacctccgacctcacggaggatggtgccgaggagggcaaagaagcctcgaagggtgatgcaggcgagggtcagtagcctggtaaacattgatggatggttcggcatgtttttcaagcccattgtgttggacgccccatgctcctccatggattccccgattccgagcgtcgagccttgttcccctcacccctgctccatttcatgtactaggctggtagtggtcggattagtcccattgcattagttgtcactgggtccatttggactgatggtattgaagtcgtcttctctggtttttgctgtggcaagtagttgccattgtgttctgttttgcgttccttctttcaatcgttcggtgctcgtttagcatttgcaataatgtgtcagtatcacgttttggtcattgtcgtgctggtttgcacg

SEQ ID NO: 9428 - DNA, 927 bp, Euphorbia peplus
aaatagtaagaatgtcgcccactgaattatcacgcgaggaatatgtctacatggccaagttggctgaacaagcagaacggtacgaggaaatggtagagtttatggagaaggttgcaaagacagttgatgttgaggagctaaccgtggaggaaaggaatcttctctctgtagcttacaagaatgtcattggcgcccgcagggcttcatggaggataatctcttccattgagcagaaggaagagagccggggaaacgaggatcatgtcactataattaaggactacaggagtaagattgaaacagagctgagcaagatttgtgatgggatcttgaacctgctcgagtcgcacctcgtaccctctgcctcatctgctgaatctaaggtgttttatctcaagatgaaaggagattaccacaggtatcttgctgagttcaagacaggtgctgagaggaaggaagctgccgagagcactttgttggcatataagtcagctcaggatattgctcttgctgaacttgctcctacgcacccgataaggcttggactcgcacttaacttctctgtcttctactatgagatcctgaactcacctgaccgtgcttgcaatctcgcaaagcaggccttcgatgaggccatttcggagctggatacactaggtgaggaatcttacaaggacagtacccttatcatgcaacttctccgagacaatttgactctgtggacttctgatatcacggatgaggctggagatgaaatcaaagaagcatcaaaacgtgaatcaggcgagggacaaccgccacagcagtagcagtagggatgagttaaaattagtaggattatgtacttgtatttgtgacctttgcatagttgtcatactactggtggttgtagctggttgcataatgaatttgataaattctcatagc

SEQ ID NO: 9429 - DNA, 1256 bp, Brassica rapa
ccccttatttcttctcactgccttcattttgcgtctcaagacttcgatctcgacaaatccctaattcccaaaactccctctcggatctataacaaagactgtgatacgaaacgatgtcgtctcctcgtgaagagaatgtgtacttagccaagttagccgagcaagccgagcgttacgaggagatggtcgagttcatggagaaagtcgccaagaccgttgactccgaggagctcaccgtcgaagagaggaacctcttgtccgtcgcgtacaagaacgtgattggtgctaggagagcttcgtggaggatcatttcttctattgagcagaaggaagagagcagagggaatgaagatcacgttgctattatcaaggactatagagggaagatcgagaccgagcttagcaagatctgcgatgggattttgaaccttcttgattctcaccttgttcccgctgcgtctttggctgagtccaaggtcttttatctgaagatgaagggggattaccataggtaccttgctgagtttaagactggtgctgagaggaaagatgctgctgagaacactctcgtggcttacaagtcagctcaggatattgcacttgctgatttgcctccgactcatccgattagattggggcttgcacttaacttctctgtcttctactatgagattctcaactcgcctgaccgcgcttgcaatctcgccaaacaggcttttgatgaagcgatatctgagctggacacattaggagaagaatcatacaaggacagcacactgatcatgcaacttctccgtgacaatctgaccctctggacttctgacatcaatgatgaggcgggtggtgatgagatcaaggaggcgtcaaaagacgagcctgaagaagggaaacaagcgtagccgttgaagtgaccagagagagagtgagcgaggcattattaagtatgtatggatttggctcttgtttcttaaaaacatatgctatggggtttgtgtgtagaagcagagagaagatcatgatttgattttctcctttgcaaactcaaaaactctcttcttcttttttttgttggttttctttctagtgttttgagtctttggttttacttcgttgcttgttattattttttaggaagtgaagaaacacaactttctatgattgctttcgattcatctatttttttgccgtcaattaatctttcaacttaaaagtaagaaggcatgtaaacaagtagtgtccaagagagcaaagtgaga

SEQ ID NO: 9430 - DNA, 1301 bp, Eucalyptus grandis
ccggtcctcctcatttccgcctctctgcacgtctctcgctcacctccgaacgagagagtcccaatcattcgcagcttcgcagcttttgtaatttgatcagcacgttgaagatggcggcagctgattcttcacgcgaggaaaatgtgtacatggccaagttggctgaacaggccgaacgttatgaggaaatggtagaatttatggagaaagtggccaagacggttgatgtcgaggagcttactgttgaggaacgtaacctcctctccgtggcatacaagaatgtgattggtgccaggagggcttcatggaggatcatctcttccattgagcagaaggaagagagcaggggaaatgaggaccatgttgtgattatcaaggagtatagggggaagattgagactgagctcagcaagatctgtgatggcattctcaatctccttgagtcgcatctcgttccatcagcctcatcagctgagtcaaaggtgttctatctgaagatgaagggtgattaccacaggtacttggctgagtttaaggcgggaactgagaggaaggaggctgctgagagcaccttgttggcttataaatctgctcaggatattgctttggctgagctggctcccactcaccctattaggcttggacttgctcttaacttctctgtgttctattatgaaattctcaactcacctgatcgtgcctgcagtctggctaaacaggcattcgatgaggctatctccgagctagatacattgggtgaggaatcatacaaggacagcacattgattatgcaacttctccgagataacctaacactctggacttctgatgtcacggatgaagctggagatgagatcaaggaatcttcaaaaagggagtctggtgaggggcagccaccacagtgacgagctccattcgaagatggcttctctgtactttaagactgtgaactcttatgtaggcagcgctttgttataacatcatttggtcagcaccatgatcttagtacttgcactgcttttgggtgaaagtattatgggactgtgtacttttctctggttagttatgggaagagattgacttgatgcagtgctctgttttgtctcgtggtagtgatgtcagtggttttcttattgtgaagtgaataattctatagactcacactaccaatggttcacaaagtgattgtggtagacatatgtcgagtgctttaattggttcgccggttcatgtcaaatgctatcaccttttgccacagcactctgtgaatcttcttgctttggtagagttagtgtctctag

SEQ ID NO: 9431 - DNA, 925 bp, Euonymus alatus
gcttctcttgtcaccaacatctcagaattgaaatctctctacgattcttgatagatagtctgctgaaataaagatgtcgcccgaagcatcacgagaggaaaatgtctacatggccaagttggctgaacaggctgaacgatatgaggaaatggtggagttcatggagaaagttgcaaagacagtggatgttgaggagctgactgttgaggaacgaaacctcctttcagtagcttacaaaaatgtgataggggcaaggagggcctcatggaggattatctcttccattgagcagaaggaagagagtaggggaaatgaggaccgtgttaatatcatcaaggagtaccggggcaagatcgagtctgagctaagcaagatctgtgatgggattttaaaccttctagaggcacatctcatcccctcagtgagtgccgctgagtccaaggtgttttatcttaagatgaaaggtgattatcacagatacctggctgagtttaagactggtgctgagaggaaggaagctgcagagagcactttgctggcttacaagtctgcccaggatattgcgctggctgaactagcccctactcacccgataaggctgggacttgcattgaacttctctgttttctattatgaaattcttaattcccctgatcgtgcttgcaatcttgcaaagcaggcttttgatgaggctatctctgagctggataccttgggtgaggaatcgtacaaggacagtacattgatcatgcaacttctccgagacaatctgacactttggacttctgatattacggatgatgctggggatgaaattaaggaggcatcatcaaaacgcgaatctggcgaggggcagcagtcgtgattttagatctcatagaatatcctattcttccaattaaaaaaaaaatgaacatctcattct

SEQ ID NO: 9432 - DNA, 1123 bp, Coffea canephora
cggccgggggatatataaaaggacccatctgtgctgcatcttttctttttccttctcaactctgattaactctgtgactgtgctctttagcttccaaacggcataaaaggaaacaaaaactcacatttgagtaagacaatatgtctcgtgaagagaatgtttacatggccaagttggctgagcaggctgagaggtatgaggaaatggttgaattcatggagaaagttgctaagacagtggacagtgaagaactaactgtcgaggaaaggaatctactttcagttgcttataagaatgttattggagctagaagagcttcctggagaattatttcctctattgagcaaaaggaagagagccgtggaaacgaagagcatgttacaattatcaaggactataggggaaagattgaggctgagctcagcaagatatgtgatggaattttgcgtcttctggatacacatcttattcctgctgcctctactgccgagtctaaagtcttttatctgaaaatgaagggtgactaccataggtacttagctgagttcaaaactggggctgagaggaaagaagcagctgaaaacactttgtttgcctacaaatctgcacaggacattgccctgtctgaattggctccaacacacccaataagacttggtcttgctctgaacttctctgtgttctattatgagattttgaactcgcctgatcgtgcttgttcccttgccaagcaggcatttgatgaagctatttctgagttggatacattaggtgaagaatcttacaaagacagtacactcataatgcaacttctccgcgacaatcttactttgtggacttctgatgtgccggaggatgccgccggtgagatcaaggaggctcccacacaggaaacaggggatattacaaagtaatttgtctggctttgcccgtttaagtggaattcactagatttagcgtattgtagtgtggatttccggagcttatattgatgtcttaaacttgaagatcttattaacgtttagaaacatatgattggatgtttagagttataatagttagcagtggtttttattttatgcccgagtgtgttgatgcttctcaattaagtattcttgtagtg

SEQ ID NO: 9433 - DNA, 1379 bp, Cucumis sativus
gaggtaaaaaaccttactttttcatcttccacttctttctttcttctttctttttcattttgtattagggtttcgatttggactgggtttccttattcttacgattgtttttgttcatagagaattattagtttattacattgaagatgtcgcctgctgattcttcacgggaggaaaatgtttacatggccaagttggcagaacaggccgaacgatatgaggaaatggtagagttcatggagaaagttgccaagactgtggatgtcgaggagctgaccgttgaggagaggaatctcctctccgttgcttacaagaatgtcattggggctcggagggcttcatggaggattatttcttccattgagcagaaggaagagagtcggggaaatgaggaccacgtttcaattatcaaggattaccgtggcaaaattgagactgaactgagcaagatctgtgatggaattttgagcctccttgagtctcatctcatcccatcagcctcatctgctgagtcaaaggtgttttatctcaaaatgaaaggtgattaccacaggtacctggctgagtttaagactggagctgaaaggaaagaggcagctgagagcacattgttagcctacaagtctgctcaggatattgctctcgcggaattagcccctactcatccaattaggctaggtcttgctcttaacttctcagtgttttattatgagatccttaattcgccagaccgagcttgcaatttggcaaagcaggcttttgacgaagcaatttctgagcttgacacattgggtgaagaatcatacaaggatagcaccttgatcatgcaactcctccgagacaacttgactctttggacttctgatattggggatgaagctggcgatgagattaaggaagcatcaaaacgtgaatcaggggagggacatggacagtagtttgcgttgttgttgagttgatacttgataggaattgtactgtgtacttttttttctctttttttctcccttttaccttcttttcttttttttatttttcttcaaaagaaatgtggcgaccctgttttagtgttgttagtgctacttgggtttggtagttctgaatgaaatgtctttgattggctttggcttctgactcttttacctcacttgaatgggataccgttctagagcagtcactaaagatccagaagcattgttagggcctttgaatactcaacaagagtataatgtgtttttattatttatgagaagaatctgttgtttgttcgaatgctatgagagattttttttttatatatttttgttttgaacttattgatcagctcatctatattatctatatacaaagagagttgggttcaattcattcctttccct

SEQ ID NO: 9434 - DNA, 1400 bp, Cucumis melo
tctctctctctctgggctcgattttctcgagagaattaatagtttattacattgaagatgtcgcctgctgattcttcacgggaggaaaatgtttacatggccaagttggccgaacaggccgaacgatatgaggaaatggtagagttcatggagaaagttgccaagactgtggatgtcgaggagcttactgttgaggagaggaatctcctctccgttgcttacaagaatgtcattggggctcggagggcttcatggaggattatttcttccattgagcagaaggaagagagtcggggaaatgaggaccatgtttcaattatcaaggattaccgtggcaaaatcgagactgaactgagcaagatctgtgatggaattttgagcctccttgagtctcatctcattccatcagcctcatctgctgagtcaaaggtgttttatctcaaaatgaaaggtgattaccacaggtacctggctgagtttaagactggagctgaaaggaaagaagcagctgagagcacattgttagcctacaagtctgctcaggatattgctcttgcggaattagcccctactcatccaattaggctaggtcttgctcttaacttctcagtgttttattatgagatccttaattcgccagatcgagcttgcaatttggcaaagcaggcttttgacgaagcaatttctgagcttgacacattgggtgaagaatcatacaaggatagcaccttgatcatgcaactcctccgagacaacttgactctttggacttctgatatcggggatgaagctggcgatgagattaaggaagcatcaaaacgtgaatcaggggagggacatggacagtagtttgcagttgttgagttgatacttgataggagttgtactgtgtacttttttctctcttttttctcttttttctcccttttccttttttttccctgttctttaaaaaaaaaagtggcgaccctgtctttagtgttgttagtgctacttgggtttggtagttctgaatgaaatgtcttggttgctggctttggcttctgagagtatgacctcacttgaacgggagactgttctagaacaggctgtacccttgtgtctttgagtgctaaagatctagaagcattgttagggcctctggatactccacaagagtataatgtgttttatttatgagaagaatctggtgtttgatgtttgagtgctatgagatatgattttttatatttttggtttgaacacattgatctgttttacattctctatatacaaagagagtcgggtcaattcattcctttttttcatcaatcacattgtatcttattttggtacaatctttgccctttttcttcaaatttggtaaaatactttgttcacaaattggttagaaaaaaaaa

SEQ ID NO: 9435 - DNA, 1085 bp, Tropaeolum majus
tcagcggccgggggtgacacttgaatccctagctgtgaaagagtcgtcttttttgatcggataaatttctagatctatatagagaatatgtcgcaaactgattcaccacgagaggaaaatgtttacttggccaagttggctgagcaagctgaacgctacgaagaaatggtagagttcatggagaaagtagcaaaaactgttgatgttgaagagctaactgtggaggaaaggaacctcctctcagtggcttataagaatgttataggagctaggagggcttcatggaggataatatcttccattgaacagaaggaagagagcaggggaaatgctgatcatgtttcaatcatcaaggattaccggggcaagattgaagctgaactcagcaagatatgtgatggaattttgagccttcttgaatcacatcttgttccatctgcctcttctgctgagtccaaggtcttttaccttaaaatgaagggtgactaccataggtatctggctgagtttaagactggaagtgagaggaaggaggctgcagaaagcactctattggcatacaagtctgctcaggatatcgctcttgctgagttggctcctacacatcccataaggctgggacttgcacttaacttctcagttttctattatgaaattcttaactcgcctgatcgtgcatgcaatctcgcaaaacaggctttcgatgaagctatctctgagctcgatacattgggtgaggaatcatacaaggacagtacattgatcatgcaacttctccgcgacaatttgacactttggacctcagacatcacggatgatgctggggatgagattaaggaagcatccaagaatgattcaggcgatggacaacaacagtgatgagttgagaatccatagtcgatatgtttcctctatgtaattttttttatcttgtgatgcttacgtagattccatatgtggggttgctgtagaagaattcttagtgaatttatgatcttggagatgtcattgtgctctttatatttggctctattatcaatgaaatctgtgacttgcccaaagggcctacaccgaagggggtatta

SEQ ID NO: 9436 - DNA, 1168 bp, Papaver somniferum
aggcctttatttcggactctcagtttttttctccccttgcgattctcgagagaaaaggaaacaacgccttcttccgagtactagctaactaagatgtctacatcacgagaggaaaatgtgtatttggctaaattagctgaacaagctgaacgatatgaagagatggttgaatttatggaaaacgttgccaaaactgttgattctgaggaattaacagttgaggaacgaaacttgttgtctgttgcttataagaatgtgattggagctaggagagcttcatggaggattatttcaagtattgaacaaaaggaagaaagccgtgggaatgaagatcatgtttctattattaaagaatataggggaaagattgaatccgaacttcataagatttgtcaagggattttagggcttttggattcccatcttattccttcatcaactgctgctgaatctaaggtgttttaccttaagatgaagggtgattatcataggtatttggctgagtttaaatctggtagtgacaggaaagaagctgctgagagtacattgttagcttacaagtctgctcaggatattgctttggctgaattgagtcccactcacccaataaggcttggacttgctcttaacttctcggtgttctactacgaaatcctaaattcaccagatcgtgcttgcactctagctaagcaggcatttgatgaggccatttctgaattggattccttgggtgaggaatcatacaaggatagcacattgattatgcaacttctccgagacaatttgaccctgtggacttcggacatcggcgaggatgctgacaatgagattaaggaagcttcaaaacatgacgagtccaaggggccagaataaccctgatgggtttgaaggagtgaatgttttagtctatacaagtagtggttaggttttatttgtctaagaatggaccaactccgacttgtgtttgctgtttatgtttttcatttagtttagttatagattgcttcttagtcttgtgtgcttgtggattaatggcatttcttcttgtgatgcagtcagaagaaaaaggaaaacaaatgcctcacaatatgttatggtactgaccaagtttgaaatatatttatttttgcatgtgaaattattacctagccgttcatgcttttatcat

SEQ ID NO: 9437 - DNA, 1045 bp, Scabiosa columbaria
ttgaaaaacctaataatagcagtctccgtcaccacttaccaattggttttctcttcttctctatcaccagattcatctttatactaattcccctttgcacttgatacctcacatctgttcgtgatatcggatccacactcgctttattcgctcgattgaaagagattgcagtttaatcaacatcaacaaagatgtctcgtgaggaaaatgtttacatggccaagcttgctgagcaggctgaacggtatgaggagatggtggacttcatggagaaagttgctaagactgtggatgttgaggaactgactgtggaggaaaggaacctcctatcagtagcttacaagaatgtgattggtgctcggagagcttcgtggaggataatatcttccattgaacagaaggaagagagccgtggtaatgaagatcatgttactctcatcaaggattacaggggtaagatcgagactgaactcagcaagatctgtgatggcattctgaaccttctagattcccaccttgtgccatcggcctcgtctgctgagtccaaggtgttttatttgaagatgaagggcgactaccataggtacttggccgagtttaagactggagctgagaggaaagaggcagctgagagtactttactagcttacaagtctgctcaggatattgctctggctgatttggctcccactcatccgataaggctggggcttgcacttaacttctctgttttctattatgaaatccttaactcacctgatcgtgcttgcaaccttgctaagcaggcttttgatgaagcgatatcagagttggatacgttgggcgaggaatcatacaaggacagcacattgatcatgcagcttctccgagacaacctgacactttggacttctgatctcacggacgaagctggtgatgaaataaaggaaagttcgaagccagagtcgggtgaaggccagcagtgacgaattggttgatttgaagtcttcatagatctctaatatggaaatttaaaaaagtaggacttctgaattcgactattcag

SEQ ID NO: 9438 - DNA, 1560 bp, Sciadopitys verticillata
ggcacttccactggacacgtaggtacagtcaaaggtaatgccagcttgcattttgacgactgcaactaggttaaacggaagaaataagaccccctcattttctgtacctatatgtaggcagcttcttgcgtccaactttcttcttccgctgccttctttgtttcgcgtttacaagtttaaagccctcgcaggtgcctttaagagtcaatcttggcgttagatttgttgtctggattgcttgcggagggcccgtatcttcatttgattcaagtaattgcacaaaatggctcccatggagtcgtcccgcgaagaaaatgtgtacatggcaaaattagcggagcaggcggagcgttacgaggagatggtggagtttatggagaaggtggccaagactgtggatgttgaggaactgagtgtggaggagcggaatttgttgtctgtggcgtacaagaacgtgatcggtgctcggagggcttcctggagaatcatctcttccattgaacagaaggaggaaagccgcggaaatgatgagcatgtgaccatgatcagagaatacagggctaaggtcgagtctgagcttagtaatatctgcgacggtattcttcgccttcttgattcgcaccttgttccctcatctaccaccggcgaatccaaggtgttttatctcaagatgaaaggcgattaccaccggtacctggcagagttcaagaccggcgccgagaggaaagaggccgccgagagcacattgctagcctacaagtctgctcaagatattgccttggcagaattggctccaacgcaccctatcaggctaggtttagctctcaatttctctgtcttctactacgaaattctgaattcacctgaccgggcctgttctcttgccaagcaggcctttgatgaagcaattgcagagttggatacattgggggaagaatcttacaaggacagcacacttatcatgcaactactccgagacaatttgacattatggacatcagacatgaatgaggatactggagatgaaataaaggaagccccttcaaagcgtgaggagggagaggggcaatgacctgaaatagactctggtttattattaacacttgtttcataggtgaatttatgtgtaaagtcttgattagtagttcaaatgcttttcagagtaaagtgattctgggcatcttttgttgtcgtccctactatactattaagctcgtcaggaatgagttccagataagctgcttttatgctgtgtattgttagcatttgaagttggccactactatctgtcactgctgttttggtttcccaaaaactcttttgtggaagcgtgggtatgtaacagcagtacagagtccttttaggatcgtattattcatattaaaacctttctattttgccttgaaatgacttctatttattttaatttttcctctttagtgggctctcagcattaaatgcagttggcatgacttacccattttttttaatgtcatctgggagtacgtggctctgggctggctttcgtgttgaagatcacatggtctttagccaatcttc

SEQ ID NO: 9439 - DNA, 1059 bp, Vinca minor
gatcgctgcttacaacgctttcgcccaaatagaatctgtaatttattagtataaacgaaaatggtggtacctgaggcccgtgaggagaatgtgtacatggccaagctggctgaacaagctgaacgttatgaggaaatggttgagtttatggagaaggttgcaaagactgttgatgttgatgagttgacagtggaggagaggaatctcctttctgtggcttacaagaatgtgattggtgccaggagggcctcctggaggattatttcttccattgagcaaaaagaagagagccgtgggaatgaagaacatgtgagcattattaaggattataggagtaagattgaggctgagctcagcaagatctgtgatgggattttgagccttcttgagtcccatctcattccctcagcctctactgctgagtcaaaggtgttttacttgaagatgaagggagattaccacaggtacttggctgagtttaagactggggcagaaaggaaagaagctgctgagagcactttgttggcttataagtctgctcaggatattgcattggcagaattgccccccactcacccaattaggcttggccttgcacttaacttctcagttttttattatgaaatccttaactcacctgaccgtgcatgcaatcttgcaaagcaggcgtttgacgaggccatctctgagcttgatacattgggtgaggaatcatacaaggacagtacattgatcatgcaactcctacgcgacaatctgactctatggacttctgatatttctgaggaagctggagacgagattaaggaagcaccaaaaactgacaaaggagaagggcagcagtgatgagccaaatagcgtagcctagccttgtactctttgtgattttattacaggacttccgttggggggtttacagctataaagatttgatggtttgacagagagatgctcaagattccagtgtttctacctatttatgtttcgatacctggaaagaggattttagtgtttggacgtgtcattagggaactctttctgttttaatattgaaaaatg

SEQ ID NO: 9440 - DNA, 1193 bp, Avena sativa
gaattgcgacacagaccacagctaggccacgcgagaccccaacctctccccccaatcagctgcaagccaagcgtaactgcacgctgtgcacgcccctcgccttcccgaagtaagttacttccctgatcaaaatgtcgcgggaggagaatgtctacatggccaagttggccgagcaggcagaaaggtacgaggagatggttgagtacatggagaaggtggctaagacagtagatgtcgaggagctcactgtcgaggagcgtaacctcctatctgttgcctacaagaatgtgattggggctcgccgtgcttcatggcgtattgtctcatccattgaacagaaggaggaagggcgtgggaatgaggaacatgttactctaatcaaggaataccgtggaaagattgaggccgagctgagcaagatttgtgatggtatccttaagttgctagactcacaccttgtgcccatgtctgccgctgctgagtccaaggtgttttacctcaagatgaagggtgattatcacaggtacttagctgaattcaaggctagtgccgagaggaaggaagctgccgagagcaccatggtggcttacaaggctgctcaggatattgctctggcggaactcggcccccacacatcccataaggcttggacttgcacttaacttctcagtgttctactacgagattctgaactctccagacaaagcttgcaacctcgcaaagcaggcttttgatgaggctatctctgagttggatacccgttggcgaggagtcctacaaggacagcacattgatcatgcagctcctgagggacaacttgaccctatggacctccgacctcacggaggagggcggtgctgaggatggcaaagaagccttgaaaggtgacgctggcgagggccagtaacttgcgttgaatcaatgggcctgcatgtttctggagctcatttggttttagatgacccctgcgctgtcaaagtctgcgtgttgcgccgtgggtggattgttctgttctagctgtttttcatgtactccactccctccctccctccttcactgttgtcaggctggtagtgctcgaactagttccattgcctctgctagttggcactcggttcattttggaccgatattgttctcctggatttggctgcgttgtgtttcactagtggtttcattatatgcgtctttgt

SEQ ID NO: 9441 - DNA, 1532 bp, Chenopodium quinoa
cccctatcccctctcgtgccttcgcctcccacgactaattcaacctagtacgagaggaaccgttgattcacacgaatggtcatcgcgcttggttgaaagccagtggcgcgaagctaccgtcgtgctggattatgaactgaacgcctctaagtcagaatccgggccagaagcgacgcatgcgcccgccgcccgattgccgtcctacagtaggggcttcggcccccaagggcacgtgtcgtaggctaagctcgcgcggcggatgcgccgtgagagccgccttgaagtacaattcctaccgagcggcgggttgaatcctttgggagaaaccaaaaccccattttctgtgaggaacgatgtcgccagtagaaggatcccgggaagagaatgtctacttagccaaattggccgagcaggctgaaaggtatgaggaaatggtggagtttatggagaaggtagcgaagactgccgatgttgagttgacagtggaggagaggaacctcctctctgttgcctacaagaatgtgattggggcaaggagggcttcatggagaattacctcatccattgaacagaaggaagagagccgtgggaacgaggaccatgtagctatcatcaaggagtacagagcgaaaatcgaggctgagctcagcaagatctgtgaggggatcttgaaacttcttgattcacatcttgtcccatccgcaactgcttccgagtcaaaggtattttacctgaagatgaagggtgattaccacaggtatttggctgaattcaagaccggagctgagagaaaggatgctgctgagcacaccttgttggcttacaagtctgcccaggacattgcgttggctgaactgcctcctactcacccaataaggctggggcttgcacttaacttctccgtgttctactatgagatcttgaattcgcctgatcgtgcctgtgctctggccaagcaggcttttgatgaagccatttcagagctagatactctgggtgaggaatcctacaaagacagcaccttgatcatgcagctcctccgtgacaatttgacattatggacttctgataatgcggaggatgttggcgatgagatcaaggaagctacaaaagatgacgccgctcctggacaacaatgatttggtcattttgttgaaggagttagatggaatgtatttatttaacttggatatttgttatgttgctctagacttttcccatacttggtatgctttaatgtttgtttgtcatctgcagcgtcaattagatgctctatatatcttaccaagacacgcttcattaattattattgtctaccttcagttttcaacactttgcacttgagtgcactcgacgtagattcatcaaatgaaagctatgtagtccaataatgtgttcgaatgtatgtgctctttgttctaatcaatttttagcttagtagttttttttggtcaaggaaattcttctgctgcaatttttatgaagaatcttacatactacagtcgtgggaggcaaggcacacaggggatagg

SEQ ID NO: 9442 - DNA, 1148 bp, Musa acuminata
cggaaacaaacggacccgatccagcggcgcaactcgtcctcgcagaggaagacacgggaagcaaagaggagccctaagcgtctcgtttccgggaaaggagagagtatattcttcgatagagatctagcaaaatgtctccggtggaatcgacgcgcgaggagaatgtgtacttggccaagctagcggagcaggcggagcggtacgaggagatggtggagttcatggaaaaggtggtgaagacggctaatgtggaggagcttacggtggaggagcgcaacctcctctcggtggcctacaagaacgtgatcggagctcgccgcgcgtcgtggcgcatcatctcctccatcgagcagaaggaggagagccgcggcaacgaggagcatgtcgtgctgatcaaggagtatcgtgggaaggtcgaggctgaactcagcaagatctgcgatgggatcttgaagctgcttgattcccacctggtgccctctgcgagcgcggcggagtccaaggtgttctaccttaagatgaagggtgactaccacaggtaccttgcagagttcaagactggagctgagaggaaagaagcagctgagagcactctgttggcttacaaatcttcgcaggatattgctttagctgaactggccccaactcatccgatacggcttggtctggcacttaacttctctgtgttctattatgagattcttaactcaccagaccgtgcttgcagccttgcaaagcaggctttcgatgaggctatctctgaacttgatactttaggtgaggaatcgtacaaggacagtacgttgattatgcagcttctccgagacaacttgacattgtggacgtctgatatgacggaggatgttgatgagatcaaggaagctccaaagaaggaatcaggagatgaccagtgatcttgatttagttacttatgatcattaatgtagaatctacctttaaatagttccaaggataggagatccatatgactaggctgtctttattggagcaacttgtgtcaccaagggtatgtcacccgcctttctcagctcgtcttttatgtttcgtttcgagctattcttgttattggatattttacagtgtattggtttaagtacacagtattatttttgcaattcgatcacaag

SEQ ID NO: 9443 - DNA, 1106 bp, Musa acuminata
gacagaggaaccctaagcatctcgtttcggtgaaggagagggatttcttggtagagatctaacaaaatgcctccggtggagtcgccccgcgaggagaatgtgtacatggccaagctggcggagcaggcggagcggtacgaggagatggtggagttcatggagaaggtggtgaagaccatcaacggggaggagctcaccgtggaggagcgcaacctcctctccgtggcctataagaacgtgattggagctcgccgcgcgtcctggcggatcatctcctccatcgagcagaaggaggagagccgcggcaacgaagatcacgtcgccttgatcaaggagtacagtggaaaggtcgaggccgagctcagcaagatctgcgatgggatcctgaagctgcttgattcccacctcaccccttccgccaccagtgcagagtccaaggtgttttaccttaagatgaagggtgactaccacaggtaccttgcggaattcaagactggagctgagaggaaagaagcagctgaaagcactcttttggcatacaaatctgcgcaggatattgctttagctgaactggcttccactcatcctataagactggggctagcactcaacttctctgtgttctattacgagattcttaactctccagaccgagcttgcagccttgccaagcaggcatttgatgaagcaatctctgaacttgataccttgggtgaagaatcatacaaggacagtactttgattatgcagcttctccgagataacttgacattgtggacatctgatattacggaggatggagctgatgagatcaacgaagccccaaagaaggaatcagaagagggccagtgatcatgaaattgtcactttctcatgctgatgcaggatccacctttcaagtagtagtgagaatgttgtgcttgttgattgtcctcccttcttttgcattgtgggcaacgtaaagcaactattacttcatagattggatttttgtatatctccattttgattgttttaatggaagatccttaagatgggacaaaaaaaatgattgtggatggttaatcatcgacaacatgttaattttaaggaaaatgcaggtgggc

SEQ ID NO: 9444 - DNA, 1117 bp, Brassica napus
gattgtcgcgagtggagttaagaagacttcgaactcgacaatccctaattcctaaactccctctcgtatctataacaaagactgtgatacgaaacgatgtcgtctcctcgtgaagagaacgtgtacttagccaagttagccgagcaagccgagcgttacgaggagatggtcgagttcatggagaaagtcgccaagaccgttgactccgaggagctcaccgtcgaagagaggaacctcttgtccgtcgcttacaagaacgtgattggcgctaggagagcttcgtggaggatcatctcttctattgagcagaaggaagagagcagaggaaacgaagatcacgttgctattatcaaggactacagagggaagatcgagacagagcttagcaagatctgcgatgggattttgaatcttcttgattctcaccttgttcccgctgcgtctttggctgagtccaaggtcttttatctgaagatgaagggggattaccataggtaccttgctgagtttaagactggtgctgagaggaaggatgctgctgagaacactctcgtggcgtacaagtcagctcaggatattgcacttgctgatttgcctccgactcatccgattagattggggcttgctcttaacttctctgtcttctactatgagattctcaactcgcctgaccgcgcttgcaatctcgccaaacaggcttttgatgaagcgatctctgagctggacacattaggagaagaatcatacaaggacagcacactgatcatgcaacttctccgtgacaatctgaccctctggacttctgacatcaatgatgaggcgggtggtgatgggatcaaggaggcgtcaaaagacgagcctgaagaagggaaacaagcgtagccgttgaagtgaccagagagagagtgagcgaggcattattaagtatgtatggatttggctcttgtttcttaaaaacatatgctatggggtttgtgtgtagaagcagagagaagatcatcatttgattttctcctttgcaaactcaaaaactctcttctttctttttttgttggttttctttctagtgttttgagtctttggtttttacttcgttgcttgttattttttttttagg

SEQ ID NO: 9445 - DNA, 1018 bp, Brassica napus
acaaatccctaattcccaaaactcccctctctctcggatctataaccaagagtgtgatacgaaacgatgtcgtctcctcgtgaagagaatgtgtacttggccaagttagccgagcaagccgagcgttacgaggagatggtcgagttcatggagaaagtcgccaagaccgttgactccgaggagctcaccgtggaagagaggaacctcttgtccgttgcttacaagaacgtgattggtgctaggagagcttcctggaggatcatctcttcgattgagcagaaggaagagagcagagggaacgaggatcacgttgctattatcaaggactacagaggaaagatcgagacagagctaagcaagatctgcgatgggattttgaatcttttggattctcatcttgttcccgctgcgtctttggctgagtctaaggtgttttatctgaagatgaagggggattaccataggtaccttgctgagtttaagactggtgctgagaggaaggatgctgctgagaacactctcgtggcgtacaagtctgctcaggatattgcactttctgatttacctcctacgcatccgattagattggggcttgcacttaacttctctgtcttctactatgagattctcaactcgcctgaccgcgcttgcaacctcgccaaacaggcttttgatgaagcaatctctgagctggacacattaggagaagaatcatacaaggacagcacgctcataatgcaacttctccgtgacaatctgacgctctggacttctgacatcaatgatgaggcgggtggtgatgagatcaaggaggcgtcaaaagacgagcctgaagaaggcaaacaagcttagatgttgatgtgaccagagagagagagagcgagactttactgcctatgtatggatttggctcttgtttcttaaaaacatatatgctatggggtttgtgtgttgaagcaggagaggatcatcatttgattttctcctttgcaaactcaaaaactctcgttttcttttt

SEQ ID NO: 9446 - DNA, 888 bp, Euphorbia esula
gacatagtaacaatgtcacccactgaattatcacccccggaatatgtctacatggccaagttagctgaacaagcagaacgttatgaggaaatggtagagtttatggaaaaggttgcaaagacagttgatgttgaggagctaactgtggaagaaaggaatcttctctctgtagcttacaagaatgtcattggggcccggagggcttcatggaggataatctcttccattgagcagaaggaagagagccggggaaacgaggatcatgtcactatcattaaggactacaggagtaagattgaaacagagctgagcaagatttgtgatgggatcttgaacctgctcgagtcacacctcgtaccctctgcctcatctgctgagtctaaggtgttttatctcaagatgaaaggtgattaccacaggtatcttgctgagttcaagacaggtgctgagaggaaggaagctgctgagagcactttgttagcatataagtctgctcaggatattgctcttgctgaacttgctcctacgcacccgataaggcttggacttgcacttaacttctctgtcttctactatgagatccttaactcacctgaccgtgcttgcaatcttgcaaagcaggcctttgatgaggcaatttcggagctggatacactaggtgaggaatcttacaaggacagtacactcatcatgcaacttctccgggacaatttgactctctggacttctgatatcacggatgaggctggggatgaaatcaaagaagcatcaaaacgtgaatcgggagagggacaacctccgcagtagtaacaatagggatgagttaaaattaagtaatagggattattattatgtacttttaatttgtgactttgcatagttgtcata

SEQ ID NO: 9447 - DNA, 1469 bp, Cycas rumphii
aagatttacgcctagcgacttgcggccttctattgaagtttgcgtcttcctccatttcttcccttccctgtgaatgtttcgtagcgttcaaaactgttgcggacgttctgcggagctgccgaggccttgccttcggatctgatctttgacttgaatacaacatattttctgttggattgaccttctacacctgttcagttgagtctttgcagcggcggcattgaacgagtgtgtaagggcgtggaagaaatgtctcccgtggagtcttcccgcgaagaaaatgtgtacatggctaaattagccgagcaggcggagcgttacgaggaaatggtggagttcatggagaaggttgctaagaccgtggacgttgaagaacttagcgtcgaagaacggaatttgctgtcggtggcgtacaagaacgtgattggggctcggagggcttcgtggaggattatttcgtccattgagcaaaaggaagaaagcaggggaaacgaagaccatgtggtgatgatcagagaatacagaggcaagatcgagtccgagcttagtagcatctgcgatagtattcttcggcttcttgactcgcatcttataccttcgtccacgaccggggaatcaaaggtcttttatcttaagatgaagggggattaccatcggtacctcgcagaattcaagactggcgccgagagaaaagaagccgccgaaagcacgttgcttgcttacaagtctgctcaagatattgcgttggcggagttggctccaacgcatcccatacgtctagggcttgctctgaacttttctgttttctattacgagattctgaattcgccagataaggcatgttcactggccaagcaggcctttgacgaggcaattgcagaattggatacgttaggtgaagaatcttacaaggacagtacgttgataatgcaacttcttcgggacaatttaactttgtggacgtcagacatgcaggaggatgctggagatgagataaaagaagctccttcaaagcgcgaggaaggagacagccaatgacatttccgagcgacttcgaaacaggaaactaatcgcttagaagcgattttagatatgtaaaatcttctgtttaggagatctggtgctctgcatggtatgtagttattttgggcattttctatgcctactgtgtaccatttagctgttttttccccctttttggtagtgaattccagataaggtgcgattatgtgggtacagatcgccatccgaagacgttgcaagtatttggcagtggtcattttattgaaccacggtattcttaaggcttgggacactgcagaattccttaccggctttggactctcttctatcttttctgcatgtagtttgtttcaaatatattaataattgttattcccgatttaggttgtcgtagcaggtgcctgggcacatcactaacccttttaatgaaatatcaatgttccgga

SEQ ID NO: 9448 - DNA, 1080 bp, Vaccinium corymbosum
ctctgcaccagagagagaaagattcgccggcaagacttaggtattagttttagtgttacgaagatggtgccaaccgaggcttcccgtgaagacaatgtttacatggccaaattagccgaacaggccgaaagatatgaagaaatggtcgaattcatggaaaaagtggcaaagacagtggatgctgaggagctgacagtggaggaaaggaatctcctttctgtggcctacaagaatgtgatcggagctaggagggcttcctggagaattatatcctctattgagcagaaggaagagagccgtggaaatgaggaacatgtctccattatcaaggagtatagagggaagattgaggcggagcttagcaagatctgtgatggtattctgggtcttctcgattcgcatcttattccattggcctcaaatgctgagtctaaggttttctaccttaaaatgaagggtgactaccataggtacttggctgaatttaaggcgggggccgagaggaaagaggctgctgaaaacactctgttggcttacaagtctgctcaggatattgctttgactgagttgcctcctactcacccaataaggctgggacttgcacttaacttctctgttttctactatgaaatcctcaactcccctgatcgtgcttgcaatcttgcgaagcaggcttttgatgaggctatttccgagctggatacattgggtgaggaatcatacaaggatagcaccttgatcatgcaacttctcagggacaatctgacgttgtggacttctgatatcacggatgaagctggggatgagatcaaggaagcttcaaaaggcgtgtcaggagagggaccgcagtaacataagtatgtaggatatgtacttgtcaattgtgaaaccctaatatacattatctggtttgttttagaacgactcgatgaattggtatatttagcactgcttggcattcgaatgcttctgtagtataggttataagtttgagtttcttactcaaatggtttggtgcttgatgggtctagtttcttcgaagcagtgattccttattccagtgcctggttttaggtgatt

SEQ ID NO: 9449 - DNA, 1227 bp, Catharanthus roseus
gaatcttcctaattggcccacgcccgtacaagcctcacatctctctttaaattcatacccttgctcgctctcgctccttccctaatttgatcgctgcagcgcctttcggcaattaaattagctccatcgaatcggttttcttcaattagaatctgtatttcattactataattgaaaatggtgcctcctgagtcacgtgaggagaatgtgtacatggccaagctggctgaacaggctgagcgctatgaggaaatggttgaattcatggagaaggttgcaaagactgttgatgttgaggagctgacggtggaggaaaggaatcttctttcagtggcttacaagaatgtcattggggccaggagggcctcatggaggattatctcttccattgagcaaaaggaggagagtcgtgggaatgaagaacatgtgaacattattaaggagtacaggggtaagattgaggctgagctcagcaagatctgtgatgggattttgagccttcttgagtcccatctcattccatcagcatctactgctgagtccaaggtgttttacttgaagatgaagggagattaccataggtacctggctgagttcaagactggtgccgagaggaaagaagctgctgagagcactttgttggcttataagtctgctcaggatattgctttggctgaactggcccccactcacccaatcaggcttggccttgcacttaacttctcagttttctattatgaaatccttaactcacctgaccgtgcatgcaatcttgcaaagcaggcatttgatgaggccatctctgagcttgatacattgggtgaggaatcatacaaggacagtacattgatcatgcaactccttcgcgacaatctgaccctgtggacttctgatatttcggaggaggcgggagatgagatcaaggaagcagcgaaaaccgacaaagcagaaggacagcagtaatgtgccaaatagagtagtagcattgtactccttgtttttgattttagtgtaggacgttctttggagcttatagcaaagatttgatggtttggtagcggtgcttaagattccagtctcaacctatttatgtttcaatacctaaagagaatgttttagtgcttgatgtctcattagggaatgtagtgctttcatgagcgattctatttctgttttttagttttgaaaatgggatgaactaatggcttgccctaatgaaatacttat

SEQ ID NO: 9450 - DNA, 1346 bp, Gossypium hirsutum
atctctgctatccactacttgtcgccgtctcattggaccaccctctctttctcccttactctctttgatactttttttgtttgtgtttttggtgtaatctttgataccctttttataaaaaaaccagccctctagctgttcagagtttagtcttcactccctagaataattttctctttctcacttccaccaacgaaaaagtcgtcgatcggatcacgtattagattgatattgtaaagatgtctccaactgaatcatcacgagaggaaaatgtttacatggccaagctggctgagcaggctgaacgctatgaggaaatggtggagttcatggagaaagttgcaaaaactgttgatgttgaggagctgactgttgaggaacggaaccttctctcagtggcttacaaaaatgtgattggggcaaggagggcgtcttggaggatcatctcttccattgagcagaaggaagagagcagaggaaatgaggatcatgttgcacaactaaaggagtataggggtaagattgaagctgagcttagcaagatctgtgatgggattttgagccttcttgaatctcacctcattcctttggcctcatctgctgagtcgaaggtgttctaccttaagatgaagggtgattatcacaggtatcttgctgagtttaagactggtgctgagaggaaggaagctgccgagagcactttgttggcttacaagtctgctcaggatattgctcttgctgagcttgctcctactcacccaattaggctggggcttgctcttaacttctctgttttctactatgaaatcctcaactcacctgatcgtgcctgcaatcttgcaaaacaggcttttgatgaggctatttctgagttggatactttgggtgaggaatcttacaaagatagtacattgatcatgcaacttctccgggacaacctgaccctttggacatctgacatcacggatgaggctggagatgagatcaaggaagcttcaaagcacgagtcaggcgagggacagcagtgataagttaataaaaattgttctctgtaccttatatttgcaggtttacaatacatagatgcaatgtgagttgttgtagagggttttggttttgttttcaatgcattcaccagcacttggaatcgaaatgatcctctgaaattatatgggttgtattattgaacgagaagaattcggtttgggttggtttggttttcacgtgctagtgctaaaatagtgcgtttgccagtctcattttttttttgaatgttggttcattgctgttgtaaaccaccttatccatgtttctgccatttgcttagtgaattttaatcgtccgga

SEQ ID NO: 9451 - DNA, 1160 bp, Echinochloa colona
cacccttcgtccccagcgcctccactcgcatcgagacgacccgcctccgccgcgcccgtgcgccaccagcccaccacaccgaaagtaactcaatttcttgagcaacatgtcgcgggaggagaatgtttacatggccaagctggccgagcaggcagagcgttacgaggagatggttgagtacatggagaaggtggccaagaccgtagatgtggaagagctcaccgttgaggagcgcaacctcctgtctgttgcctacaagaatgtgattggggctcgccgtgcctcatggcgcattgtctcctccattgagcagaaggaggagtcacgtaagaatgaggagcatgttgctcagatcaaggaataccgtggcaagattgaggctgagttgagcaatatttgtgatggtatcctgaagctccttgactcgcaccttgtgccttcctcaactgctgcagagtcaaaggtgttttacctcaagatgaagggagattatcacaggtaccttgctgagtttaagactggtgctgagaggaaagaatctgcggagagcacaatggtggcttacaaggcagctcaggatattgcactggctgaactggcacctacccatcccataaggcttggacttgcactcaacttctcggtgttccattatgagattctgaactctccagacaaagcttgcaaccttgcaaagcaggcctttgatgaggctatctctgagctggacacccttggagaggagtcatacaaagacagcaccttgatcatgcagctcctgagggacaacttgaccctctggacctctgacctcacggaggacggcattgaggagggcaaagaagcctcaaagggtgacgctggtgagggtgccaactaaaccttgatcgatggttcggcatatttttcaagcccattgtgttggatgctcctgtgctggttgaagccgtgcgctgctgctccatggatttgctgatctagagcttcttccccttacctcgctccatttcatgtagtaggctggtagtggtcggattagtcccattgctctagttggcactgggtccatttggactattgctattgaagtcgtctttctcatcgcggttgcaatttgttgctgtgtatgtcatgttttgctttcttatatcgttattagg

SEQ ID NO: 9452 - DNA, 1365 bp, Gossypium raimondii
aactccaagggaatctctgctatccactacttgtcgccgtctcattggaccaccctctctttctcccttactctctttgatactttttttgtttgtgtttttggtgtaatctttgataccctttttataaataaaaaaaaccagccctctagctattcagagtttagtcttcactccctacaataattttctctttctcacttgcaccaacgaaaaagtcgtcgatcggatcacgtattagattgattgatattgtaaagatgtctccaactgaatcatcacgagaggaaaatgtttacatggccaagctggctgagcaggctgaacgctatgaggaaatggtggagttcatggagaaagttgcaaaaactgttgatgttgaggagctgactgttgaggaacggaaccttctctccgtggcttacaaaaatgtgattggggcaaggagggcgtcttggaggatcatctcttccattgagcagaaggaagagagcagaggaaatgaggatcatgttgcacaactaaaggagtataggggtaagattgaagctgagctcagcaagatctgtgatgggattttgagccttcttgaatctcacctcattcctttggcctcatctgctgagtcgaaggtgttctaccttaagatgaagggtgattatcacaggtatcttgctgagtttaagactggtgctgagaggaaggaagctgccgagagcactttgttggcttacaagtctgctcaggatattgctcttgctgagcttgctcctactcacccaattaggctgggacttgctcttaacttctctgttttctactatgaaatcctcaactcacctgatcgtgcctgcaatcttgcaaaacaggcttttgatgaggctatttctgagttggatactttgggtgaggaatcttacaaagatagtacattgatcatgcaacttctccgggacaacctgaccctttggacatctgacatcacggatgaggctggggatgagatcaaggaagcttcaaagcacgagtcaggcgagggacagcagtgataagttcataaaaattgttctctgtaccttatatttgcaggtttacagtacatagatgcaatgtgagttatcgtagtgggttttggttttgttttcaatgcattcatcagcacttggaatcgaaatgatcctctgaaattatatgggctgtattattgaacgagaagaattcggtttgggttggtttggttttcacgtgctagtactaaaatagtgcgtttgccagtctcatttttttctttgaatgttggttcattgctgttgtaatccatgtttctgccatttgcttagtgaattttaatcgtccggatgttgg

SEQ ID NO: 9453 - DNA, 825 bp, Allium cepa
taaaaacactgtttagttcaaaatgtctgtcacgcgcgaggagaatgtatacatggcaaagctcgcagagcaagctgagcgttatgaagagatggttgagttcatggaaaaggtagcaaaatcagttgatgctgaagaacttactgtagaagagaggaacctcctttcagttgcatacaaaaatgttattggggcgcgccgtgcttcttggagaatcatatcttctattgagcagaaagaagagagcagagggaatgaaaatcatgtggttatgatcaaggaataccgtggtaaaattgaggccgagttaagtaagatctgtgatggaattctgaatttgcttgatactcatcttgtaccttcatcgaccgctgctgagtccaaagtgttttacttgaagatgaagggagattatcataggtatcttgctgagttcaagaccggggcagagagaaaagaggctgctgagagcacacttattgcttacaaatcagcacaggatattgctttgtctgatttgcccccaactcatcctataagacttggactggccctcaacttttcagtgttttattatgagattctcaattcgcctgaccgtgcttgtagtcttgccaaacaggcatttgatgaagcaatatcggaattggatactttgggtgaagagtcctacaaggacagtaccttaatcatgcaacttctccgagataacttgactctttggacatctgacctcactgaggatgctggtgatgaaatcaaagaagctgctccaaagcaagaaggacagtgataagtcgcaattttctggattgctgatttttt

SEQ ID NO: 9454 - DNA, 1377 bp, Populus trichocarpa
aagaaaactaaaatctccacgaaatcaccgccacccaacacctgtcactttcccattggacgctcccctcttgaccgccctttttaataaacccaaaatacccccttttctatcacgcacagggagagagagagagagagagagagatccgtctctgcaaatctctttccacgaagtaacttttagtttgatatataaaggatgtctccaactgaaccatcacgtgaagagagtgtttacatggccaagttggctgaacaggccgaacgttatgaagagatggtggagtttatggagaaagttgcaaagacagtcgataatgaggagctaaccatggaggaaaggaacttgctctccgtggcctacaaaaatgtgattggagctaggagggcttcatggaggatcatctcttccattgagcagaaggaagagagtaggggaaatgaagatcatgtgacaatcatcaaggagtacaggggaaagattgaagctgagctcagcaagatctgtgacggaatcttgagcctccttgagacacatcttgttccctctgcctcagctgccgagtccaaggtattttacctcaagatgaagggtgattatcacaggtatcttgccgagtttaagaccggggctgagaggaaggaagctgctgagagcactttgttgtcttacaagtctgctcaggatattgctctttctgaactggctcctacccacccaataaggctggggcttgcacttaacttctctgtcttctactatgagatccttaactctcctgatcgtgcttgcagtcttgctaagcaggcttttgatgaggctatttccgagctggatactttgggtgaggagtcttacaaggacagcacattgatcatgcaacttctccgcgacaatctgacactctggacttctgatatcacggatgaggctggggatgagatcaaggaagcatcaaaacgtgaatcaggcgatgggccgcagtgatgaagttcagttcataggataatgcactctgtacttctatctcgtgacatttacagacgccatttgcgttattattgtagctggatgttttaatgaatttgatagccttgagtgtcgtgctgagcagtacttgggattgaaaggtaccaacagattatcaagtttttagtatcgatgcctacaatctctgttggtgtttatcatttttttttatatatatatcctcggatctggtttgaatgcatcctgtggccctgccatgtgatgtcattgttcgaccattgttttctatattttaagttgtcataatacctaagtggagcaaattgctggtgcgcatttgctgaaaatcttttttattttaaattatttttttatatttttaaa

SEQ ID NO: 9455 - DNA, 1043 bp, Tabernaemontana elegans
atctcaacactgaaagctggttagttcagtctgtttctttcaatcaatagataagggcaagggttaaatttgaacaagaaaatatggtacctactgaatcatctcgtgaggagaatgtctacatggctaagttggctgagcaggctgagaggtatgaggaaatggttgaattcatggaaaaagttgccaagggagctgatgctgaagaacttactgtggaggaaagaaatctgctttctgtagcttacaagaatgttattggcgctaggagagcttcctggcgaatcatctcctctattgagcaaaaggaagagagccgtgggaatgaagaccatgtggcaattattaaggattataggggaaaaattgaggctgagctcaccagaatatgtgatgggatattgcaacttcttgagacacatcttgtaccctcggcagatactgcagagtcaaaagtgttttatctgaagatgaaaggtgactaccatagatacttagccgagttcaagactggtgctgagaggaaggaagctgctgagaacacgctagttgcttataaatctgctcaggacattgcgttaactgatctgccaccaacacacccgataagactaggtcttgcacttaacttctctgtgttctattatgagatactgaactcacctgatcgtgcttgtgctcttgcaaagcaggcttttgacgaagctatatctgagctggatacattgggtgaagaatcctacaaagacagcaccctcatcatgcaacttctccgcgacaatttaactttgtggacttccgatgtgccggaggattctggtgccgagatcaaggaagcctccactaatgagcctcgtgatggtcagaagtgatttttgtaatcttgctgagggttcaacagattgactaggtttaggacttgggatatagtatgtagtatctcttgtgattctctataaactctgttgaattctgagattatggtttcataagacttggaaccctatgatatgatattgaagtatactatgctttgctttacc

SEQ ID NO: 9456 - DNA, 1137 bp, Nicotiana tabacum
tgtcattcggcacgaggaaggagcgagaatcagtaaccacccgctgcataaccctaggttttttcacaaacaacaaatatggctgagtcatcgcgtgaagaaaatgtgtacatggccaagctagctgagcaggccgagcgatatgaggaaatgattgagtttatggagaaggttgcaaagacaggtgatgtcgaggagctgactgttgaggaaaggaatcttctttctgtggcatacaaaaatgtgattggcgcaagaagggcctcgtggaggataatctcttcaattgagcagaaagaggagagtcgtggaaatgaagatcatgtcaaaactattaaagaatacagagccaaaattgaggctgaactcagcaagatctgtgatgggattttgggtctccttgagtcccatttaataccatcagcctccacagctgagtccaaagttttttacttgaagatgaaaggtgattatcacaggtacctggctgagtttaaaacaggttcagagaggaaagaagctgctgagaacaccttattggcatacaagtctgctcaggatattgctttgactgagctggctcctactcacccaatcaggctgggacttgcccttaacttttctgtgttctattatgagattcttaattcacctgatcgtgcttgtaaccttgcgaaacaggcctttgatgaagctatctcagagttggatacgctgggcgaggaatcttacaaggacagtacattgatcatgcaacttctcagagacaatcttacactttggacttcagataatgcggaggatgctgaggatgatatcaaggaagctccaaagcatgagtcaggcgaggggcagcagtgatgagttagtagcatagtcttttagtctttattttatagggtgctgcatgaggatatagccagatcgtgaattagatacttcaatggctgtgtgtgtcactgtctaaatggttcaatataaaacatgtcgtagtgtgatagaatatgtggtcaagatagtcgcttagtgctatggtgattaaaatttgacatggtggcattacttgtttgtgttgatgactttgctcttatttatagtctcatttgcatgttgtgtgatcgcccatgtattttcaaa

SEQ ID NO: 9457 - DNA, 1264 bp, Avena sativa
gatcccccccctccctcgaacctacatacaacagcgcacacagccccccgagatcggatccgcagacgagagcagaagcccgtgagaaaagccgagcgcccgaggaaaaggtacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagacagctgatgttggtgagctcactgttgaggagcgcaacctgctttctgtggcttacaagaatgtgattggtgcccggagggcttcctggaggatcatctcatccattgagcagaaggaggagagccgtggcaacgaagcttatgtggcttcaatcaaggacgtaccgtaccaggattgaaactgagctgagcaagatctgtgatggcatcctcaagcttctggattcccacctcgtcccctctgccactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccactcacccaataaggcttggacttgcactcaacttctcagtgttctactatgaaatcctgaactcgccagatcgtgcttgcaaccttgccaagcaggcatttgatgaagctattgctgagctggactcccttggtgaggagtcatacaaggacagcaccctgatcatgcagcttctccgtgacaacttgactctctggacctccgataacgcggatgagggtggtgatgagatcaaggaggcctcgaagcctgaggaggggcactaacttgcctacaagtctgctcaaagtttatttcctgagtccatttcgcagctacctgtattattcgaatcataagatgtactagggtcggttgcactatgtgaatcataagaagtagtaggatcgtgctatgcgaggtgtcgagctgaagtacctagtggactacagtcatgagggcatcatgtggacatcgtcgcttcaggaactgcgttactagtcattagcagatttcaaactatttcctgtgttgcagcacattattagtattgctgtattagcaattttcattggcttgttaatgattgaagatgctggtgccttaactcctggttttttgtattcg

SEQ ID NO: 9458 - DNA, 1157 bp, Aquilegia formosa
gaacatcaccaccactaccaagagagagaagaagaagaagagatagacgatcgcaagaaattggtaacaatgtctccaactgaatcatcgcgtgaagaaaatgtttacttggcaaaactagctgaacaagctgaacgatatgaagagatggtagaatttatggaaaatgtagcgaaaactgtagatgtagaagaattgactgtcgaggaaagaaatctgctttctgttgcttataagaatgttattggagcaagaagagcatcatggaggattatttcttcaattgaacaaaaagaagaaaatcgtggaaatgaagagcatgttgttgttattaaggagtataggggaaagattgagactgagcttagtaagatttgtgatgggattttaaatcttcttgattcacatcttgttccttctgctactgcggctgagtcaaaggtgttttatttaaagatgaagggtgattaccataggtatttggccgagttcaagacaggtgcagatagaaaggaagctgctgagagtacattgttggcttataagtctgctcaggatattgctgtagcagagctacctcctactcatccaataagattgggacttgcacttaacttttccgtgttctattacgaaatattgaattcaccagaccgtgcttgcagtttggcaaagcaggcttttgatgaagctatttcagagctggatacattgggagaggagtcctacaaagacagtacattgattatgcaacttttgcgtgacaatctgacattgtggacctctgatattacggatgatgctggggatgagatcaaggaagctcctaaacctgagtaaggtgaagatagatttgattgattcatctcaaatggatcttgtatttcctactataatatagatttcgttggctttgtgtactttaattagttaagttgaaattgggatttgaatggtatgttggccgtacttgtattattcttgaactagttcaaggtttcgttattacatttcattcataatggagttgtgttgaaatcagtatgtttcttctactaaggctgttttaatcagtgctctggtatgtggttcatattgtaagcaataagtgttgcataaacttattgtagctctgcccctctgggggcaattagcag

SEQ ID NO: 9459 - DNA, 1099 bp, Castanea mollissima
cagtttcttcgccaattagagagcaaagatgtcgccaactgactcttcacgtgaggagaatgtctatatggccaagttagccgagcaggctgagcgctatgaggaaatggttgagttcatggagaaagttgcaaagacagtggatgttgaggagttgactgtggaggaaaggaacctcctctctgtggcttacaagaatgtgattggggccaggagggcttcgtggaggatcatctcttccattgagcagaaggaggagagtaggggaaatgaggatcatgttgtgatcatcaaggagtacaggggcaagattgagaatgagctgagcaagatctgtgacggcattttaggtcttcttgagacgcatctcattccatcagcctcagctgctgagtcgaaggtgttttatctcaagatgaagggtgattaccacaggtacttggctgagtttaagactggtgctgagaggaaggaagctgctgagagcaccttgttggcgtacaagtctgctcaggatattgctttggctgaacttcctcctactcacccaataaggctgggtcttgctcttaacttctctgtgttctactatgaaatccttaactcacctgatcgtgcttgcaatcttgcaaaacaggcttttgatgaggctatatctgagttggatacattgggtgaggagtcatacaaggacagtaccttgatcatgcaacttctccgagacaatttgactttgtggacttctgacatcacggatgatgctggggatgagatcaaagaagcatctaagcgtgagtcaggcgagggtcagccacctcagcagcagtgataagttcgtaggatgtactctgtacttttaaatctcgagacctcttacatagatggtatgtggattgttgtagcagaatttctcaatgaactaaggatccatgggtgtttatatagcacctggattgaattgttctgaaagatatgaatgtgcttttattattgatgagaagaatatggtttggtgtttggagtgatgtggaatgtgatatttagtgctgaaattgatgcttttgaagcatcagttgcatggtagtttgatctgatggtt

SEQ ID NO: 9460 - DNA, 996 bp, Cyclamen graecum
tcgccttgtcgaagaaagggctaagtgttagtttataataagaaaatggttcaggctgaggcatctcgagaggacagtgtttacatggccaagctggctgagcaagctgagagatatgaagagatggttgaattcatggagaaagtggtgaagacagtcgatgttgaggagctaactgtggaggagaggaaccttctctcagtggcatacaagaacgtaattggcgctaggagagcctcttggaggatcatctcttccattgagcagaaggaggagagccgtggtaatgaggaccatgtggcgatcattaaggagtacagaggaaagatcgagacagaactcagcaagatctgtgatgggattttgggtctcttggaatcacacctggttccttcggcttcaacggctgagtcgaaggtgttttaccttaagatgaagggtgactattacaggtaccttgcggagtttaaaactggggctgagagaaaggaagctgctgagaataccttgttggcttacaagtctgcgcaggatattgctttggctgacttggctcctactcacccgattaggctggggcttgcactcaatttctccgttttctactatgagatcctcaactctcctgaccgtgcttgcaatcttgcaaagcaggcttttgatgaggctatatccgagttggatacattgggagaggaatcatacaaggatagcacactgatcatgcagcttcttcgagacaatcttacattgtggacttctgatgtcgcggatgaaggtggggacgagatcaaggaagcatcaaaacgggagatgggagatgagtaatggtgatgagatttagcagattgcgtgttgtacccctattttttcggacttatatatagtctgcatttgcatggtttgtagaagtgatgaagatcttgtagtgctgttgtgattggattgtaatactatgctgggtatcagctttgctcttattacacttctatgaat

SEQ ID NO: 9461 - DNA, 1173 bp, Distylium racemosum
cgcgttgctcgtttctgtgagtgtgaaggtcgtggactcgaatctgagagtttgcttttggatttgttgtctggatcggttctttccgagcggaaagtcgattcgctgtttcatttgaggtaagaagaatggctccggtggagtcctcccgagaagaaaatgtgtatatggcaaaactagcagagcaggcggaacgttatgaggagatggtggaatttatggagaaggtcgccaagactgtggatgtggaagagctgactgtggaggagcgtaatttgttgtcagtggcatataagaacgtgatcggcgctcgtagggcatcctggagaattatttcttccattgagcaaaaggaggagagtcgtggaaatgatgagcatgtagccatgataagagaatacagggctaaggtggagtctgagctcagcaatatttgtgacggtattcttcggcttctcgattcccatcttattccttcttctaccactggtgaatccaaggtcttctatctgaagatgaagggagattatcaccgctacctcgcagagttcaagaccggtgcagaaaggaaagaggctgccgaaagcacacttctggcctataaatctgctcaagatattgctttggcagaattagctccaactcatcctatcaggctaggattagctctcaacttttctgtcttctactatgaaattctgaattcacctgatcgagcctgtactctggccaaacaggcctttgatgaagctattgcggagctggataccttaggtgaagaatcttacaaggacagcacacttattatgcaactccttcgggataacctgactttatggacttcggacatgaatgaggatactggagatgaaatcaaagaagccccttcaaaggagggagaagggcaatgacctgaaatagattctaattattcactagaacttgtctgataagtggatttctgtgtaaagtcttgcttagtggatcaaatactttcagggtatagagaatgtgggcatcttttaatgttgtccctgctatacttttaaaagcttcttaggaaagtgatccatataagcagcatttatgttgtattcttagcatttgaggatggcaatgttgttttcgtttcttaaaaattaaaccttttgatgttgtgaaggcttgggttgt

SEQ ID NO: 9462 - DNA, 1057 bp, Carpinus betulus
atttctttctctaatttcacgcgctcagagagacagaggatcttctacgcggaccagagagacttgagtaattgtttggtatagcaaagatgtcaccagctgattcttctcgcgaggagaatgtatacatggccaaactggccgagcaggctgaacgttatgaggaaatggttgagttcatggagaaagttgcaaagacagtggatgtcgaggagttatctgtggaagaaaggaacctcctctctgtggcttacaagaatgttattggggccaggagggcttcatggaggatcatctcttccattgagcagaaggaggagagtaggggaaatgaggatcatgttgcagtcatcaaggactacagaggcaagattgagtcagagctgagcaagatctgtgatggcattctgagccttcttgagtcgcatctcatcccatcagcctcatctgctgagtcgaaggtgttttatcttaagatgaagggtgattaccacaggtacctggctgagtttaagactggatctgaaaggaaggaagctgcggagagcaccttgttggcttacaagtctgctcaggatattgctctggctgaacttgctcctactcacccaataaggctcggtcttgcacttaacttctctgtattctactatgaaatccttaactcacctgaccgtgcttgcaatcttgcaaaacaggctttcgacgaggctatatccgagctggatacattgggtgaagagtcatacaaggacagtacattgatcatgcagcttcttcgagacaatctgactttgtggacttctgacatcacggatgatgctggggatgagattaaggaagcatctaagcgtgagtcagccgacgggcagcagcctccgtcgcagtgataagttcataggatgtgttctttgtacttttaatctcgagacctttacatagatggcatgtgggttgttgtaggatttcataatgaactggtgatcttgagtgcttacatctgcacttagggtcgaattgttccaaaagatatgaatgtgcttttattattgaagac

SEQ ID NO: 9463 - DNA, 1254 bp, Quercus alba
ctccgctccgcaccacgtgtcacgttctcattggactcactctctctttctctctctccgcttttttatttttttgtatttattttaagagcacccttttccatttctgttctcacacttcatttctttctcttacacgcactcacacacagagagagaggaatttcagtttcttcgccaatcagagagcaaagatgtcgccaactgactcttcacgcgaggagaatgtctatatggccaagttagccgagcaggccgagcgctatgaggaaatggttgagttcatggagaaagttgcaaagaccgtggatgttgaggagctgactgtggaggaaaggaacctcctctctgtggcttacaagaacgtgattggggctaggagggcttcatggaggatcatctcttccattgagcagaaggaggagagtaggggaaatgaggatcatgttgtgatcatcaaggagtacaggggcaagattgagaatgagctgagcaagatctgtgacggcattttaggccttcttgagacacatctcattccatcagcctcagctgctgagtcgaaggtgttttatctcaagatgaagggtgattaccacaggtacttggctgagtttaagactggtgctgagaggaaggaagctgctgagagcaccttgttggcttacaagtctgcacaggatattgctttggctgaacttcctcctactcacccaataaggctgggtcttgctcttaacttctctgtgttctactatgaaatccttaactcacctgatcgtgcttgcaatcttgcaaagcaggcttttgatgaggctatatctgagttggatacattgggtgaggagtcctacaaggacagtaccttgatcatgcaacttctccgagacaatttgactttgtggacttctgacatcacggatgatgctggggatgagatcaaagaagcatctaagcgtgagtcaggcgagggtcagccacctcagcagcagtgataagttcgtaggatgtactctgtacttttaaatctcgagacctcttacatagatggtatgtggattgttgtagcagaatttctcaatgaactgaggatccttgggtgtttatagaagcacctggattgaattgttctgaaagatatgaatgtgctttttattattgatgagaagaatatggtttggtgtttggagtgatgtggaatgcgatttagtgctgaaattgatgcctttgaagcatcagttgcatggtagtttt

SEQ ID NO: 9464 - DNA, 1434 bp, Orobanche aegyptiaca
tattttcgttttcttgaatcgatccgaagggataacagtttttcttgctattatttcaaggttgatttctagttatcaaatagaagcatgtcgccagctgattcttctcgtgaagaaaatgtctacatggccaagttggccgaacaggctgaaaggtacgaggaaatggttgagttcatggagaaggttgtgaagactgttgacactgatgagctgactgttgaggagagaaaccttctctctgttgcatacaaaaatgtgattggtgctaggagggcttcttggaggattatctcttccattgagcagaaggaagagggccgtggaaacgaggaccacgtgaacattattaaggattaccggagtaagattgaggctgagctcagcaagatctgtgatgggattttgaaacttttggagtcacatctcattccttccgcctcttctgctgagtcgaaggtgttctacttgaaaatgaagggtgattactacagatatttggctgagtttaaaactggttctgagaggaaggaagctgctgagagcactttgctagcttacaagtctgcacaggatattgcattggctgaattggctcccactcacccgatcaggctgggacttgcacttaatttctcagttttctattatgaaatcctcaactctcccgaccgtgcttgtgccctcgcaaagcaggctttcgacgaagctatctctgagctagatacattgggtgaggaatcatacaaggacagcacattgatcatgcaacttctccgagacaatttaactctgtggacctcggacattgcggatgatggtgatgatatcaaggaagccacaaaacgtgattctggcgagggacagtgatgaatttgtactgttgcagtgtgctcttcactttgttttttagattagaagttatgttctgctgtagcaagatttgaagttctgtggggttggtggtttttacggtttgaagaagtttatactttaagtgtgatttgaccgtaagaaacggaggatggtgtgaagtgttctggttgggggggatgggattttatgaaatttcgtattattgttacatttggttcttgcttatctgatttgatggtttcatcgagtaatacatgtcagttttttcagtgatgtgggttcgcttcgccatattgcaatatattggattctataattttttaatttgccagtaggatttgatcaaatcagagtttgcttgaatgattaaggacttgtttcaagttcaatttgctctcaatttttgagagttatttcagctgtccttgccccattgtaagagtaccagagcaccacatgatgcgaaagagagattatgttggggggatgaactttgtatatacctgaatgtttctttgctataaacattatgaaatgatataaaactggtttcgcggg

SEQ ID NO: 9465 - DNA, 1256 bp, Phalaenopsis aphrodite
ccccaacttggttacaaccccgagaaactctgctggtgcgaaaaggagtcgcgatcattgagacgaagatctagaaaaggttactggttcattataaagcagaagtaaagatgtcgtcttctgagtcttctcgtgaggataatgtttatatggcaaagcttgcagagcaagctgagcgatatgaggaaatggttgagttcatggagaaggtggccaaaacgggaagtgtgaatgagctgtctgtggaggagcgcaacctcctctctgtggcctataaaaatgttatcggagctagacgggcctcgtggaggataatatcttccattgagcagaaagaggaaggccgtggcaatgaggatcgtgtgaccattatcaaggattatcgcggcaaaattgagaacgagctcagcaagatctgtgatggaatcttgaaactgcttgattctcatctgattccctctgctagtgctgctgagtcaaaggttttctacctaaagatgaagggtgattaccacaggtatcttgctgagtttaaaactggagcagagaggaaggaggctgctgagagcacactactggcgtacaaatcagctcaggatattgcattggcggaactggccccaactcatccaataagactggggttggcactgaatttctcagttttctattatgaaatccttaactctccagatcgtgcctgcaatcttgcaaaacaggcatttgatgaggccatctctgaattggacaccctcggcgaagaatcctacaaggatagcacattgatcatgcaacttctccgagacaacttgactctatggacctccgacataacggaggatgctggggatgagatcaaagaatcctcaaaacatgaatcatgaggagctggccttcattttcatttcaaatagatattattgcttcgaaagactttgttgtgtgaaacatcagccctgtatatggtgactggttgtgaagatggctggcgtttttaattggatatattaagcttattgtgtgcatcatattatgctatttagtagggtttcagactaacttttcttgttgaagaatatttagtagatgttagctgctactgttacaagtgttagtctttggtgtgtggtacgatttcaattagtgtttctatcgtttacaaaataaaattttaatatatttgttgatgtgaagtgttggtggtatttttgtatgtgagattaaagattaaattggtatgcatgtgagtatgaaac

SEQ ID NO: 9466 - DNA, 1022 bp, Sorghum bicolor
ctccgctccagcgccactcgcatcgagatcgagacgacccgcgtccgccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaatgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtagcctggtaaaccttgatggatggttcggcatgtttttctagcccatcttgttggacgccctgtgctgatagaaggtgtttgctgctccatgcattccaagattctgtcttctcgttccctccctgctgtagctggtggtagtagtcaaattagcc

SEQ ID NO: 9467 - DNA, 1645 bp, Cannabis sativa
tgggtctgtaattacctttgttcttttgtgctttattattctcttcgtcaaattttattgtatatacgatgttgattcagcgttttatgatacatgatttagaatttcattaaaattaatttttagaaatgatctttaggatattctagtgatgttttcttctactgtcgttttatttattgggcatgtatattttcttcagatctgaattacgaaatatttgtaatccagtaatacataaattatttaaagatgtcgccaactgaatcatcacgggaggagaatgtctacatggccaagttggccgaacaggctgagcgttatgaagagatggttgagtttatggagaaagtagccaaaaccgttgatgttgaggagctcactgttgaggaaagaaacttgctttccgtggcttacaagaatgtgattggagctagaagggcctcatggaggatcatctcctctattgaacagaaggaggaaagtagaggaaatgaggaccatgttaagatcattaaggagtacaggggaaagattgaatctgagttgagcaagatctgtgaaggaattttgaaccttttggagtctcatcttattccctcagcctcatctgccgagtctaaggtattttatcttaagatgaagggtgattaccacaggtacttggctgagtttaagactggatctgaaaggaaggaagctgctgagagcactttgttggcttacaagtcagctcaggacattgctcttgcagaattggctcctactcacccaattaggcttggacttgctcttaacttctctgtgttttattacgaaatcctcaactcacctgatcgtgcttgcaatcttgcaaaacaggcttttgatgaggctatttctgagctagatacattaggtgaggactcgtacaaggacagtacattgatcatgcaacttctccgagacaacctgacactctggacttctgacatcacggatgatgctggggaggagatcaaggaagcatcaaaacgtgaaaccggagaaagcactggacagcagtgatgaccgaagaaaaggttggaactattccgacgtattatatattttgctattttgcttttcatagttggtgagaagtgtctgtttttttttattttttttttcctttttcaaaattatttattttcaaactagcattggaagtattcaattttagttttgaatgaggtgcatgtatgtaataggtcagtgggttgtgtttatttttatatgtttttgtcgtcgttttgtgcacgttcaagttaaacattcttgattcatgaggtcatttgtctcatcggaatcgccagcttctcactttgatttgaacgtgtagatcaaatatattctcttaaaaaagacaactcattcttttttttggtaaattagcaagtgttatttcttaactaaattattggggacagtgtctaccgaaaattatggtaaaggcaaactttttgcttttaatattcttttaaacttgattagttgtattttaatgaggaaaatgggaccgaaaaggattgtaaaacaaacacttgtgtacctcaagtagtgtggggcatagcagcaaggattacttggattttcgcttctatctgaattagtcagcaatgactaa

SEQ ID NO: 9468 - DNA, 1236 bp, Manihot esculenta
acttgtcacctttctactggacccctctcctcgtgacctccacttttaaatatcctattcccttcttgtttccatattcactttgacggacgagtgtgaactcttcatcaattcatcccaattccaaaacatttccaagaaattacgttttagtttgatatatcaaggatgttgcccactgaatcatcacgtgaggaaaatgtctacatggccaagttggctgaacaggctgaacgttatgaggaaatggtggagtttatggaaaaggttgcaaagacagtggatgtggaggagctaactgtggaggaaaggaatcttctctctgtcgcttacaagaacgtcattggggctagaagggcttcatggaggataatctcttccattgagcagaaggaagagagcagaggaaatgaggatcacgtgtcaataattaaggagtacagaggtaagattgaagctgagctgagcaagatttgtgatgggatcttgagcctccttgagtcgcatctcattccctctgcctcatctgctgagtctaaggtattctacctcaagatgaagggtgattatcaccggtatcttgcggagttcaagactgcagctgagaggaaggaagctgctgagagtactttgttggcatacaagtctgcccaggatattgcccttgctgatctcgctcctacccacccaataaggcttgggcttgcccttaacttctccgtgttctattatgagatcctaaattcacctgaccgtgcttgtaatctagcaaagcaggcctttgatgaggctatttctgagctggatacattgggtgaggaatcttacaaggatagtacattgatcatgcaacttctccgagacaatctgacgctctggacttctgatatcacggacgaagctggggatgagatcaaggatgcatcaaaacgggaatcaggcgagggacagccgcaacagtgatgagttaaattcgtaggacgtgtaatgtgtacttctatatcttgtgacttctgagtagatgccatcatctggtggttgtagcttggattgcttgatgaatttggtaattctgagtgctgctgtgcactgaggattgaaatgttctggcaattatcaaccttctactattgattttagaatggaagttggtatttcttattgctcaagttcttccatgtgatgatgttgaaactaggaatttccataccgcataccccacacaattctttatat

SEQ ID NO: 9469 - DNA, 1263 bp, Citrus clementina
atttaactagcccccacccccgctacgctctcactttcgatttctttcttctctaaaattcagatcgaatccgtattcccaaaccttaaaacgctaagatgtcgcctactgattcttctcgcgaggaaaatgtctacatggccaagctggccgagcaggctgaacgttatgaggaaatggttgagttcatggaaaaagttgcaaaaacagttgatgttgaggagctaaccgtggaggaaaggaaccttctctcagttgcttacaagaatgtgattggggccaggagggcttcatggaggatcatctcttcgattgagcagaaggaggagagcaggggaaacgaagaccatgtctcagtaattaaggagtacaggagcaagattgagaatgagctcagcaagatctgtgatgggattcttagcctccttgagtctcatctcattccctctgcctcatcggctgagtctaaggtgttctacctgaagatgaagggtgattaccacaggtatttggctgagttcaagactggagctgagaggaaggaagctgcggagagcactttgttggcctacaagtcagctcaggatattgctttagctgaattggcccctactcaccccataaggctgggacttgcactcaacttctctgtgttctactatgaaatccttaactcaccagatcgtgcatgcaatcttgcgaagcaggcttttgatgaggccatttctgagcttgataccttgggtgaagaatcatacaaggacagtacattgattatgcagcttctccgagataatctgacactttggacttctgatatcactgatgatgctggagatgagattaaggaagcagcatcaaaacgtgaatcaggggagacgcagcagtgatgaataatgagttcagttcataggatatgtatctgtatttttatcttgtggcttttattttacatggatgccatgtgggttgttttagcaggatattctcatgaactgataatcttgagtgttggctgcacttagggttcatgtgttccaacagattgtaaactagatttaattattgatgagaagtatttggtttgggtttcatatgtagtgttttcagtgctatgctaaactttagaattgaaattacccatttttgttatatttaattttaagatttcacatgtttggatgagtccaatgctgttaccattggatggataaatttttttatttccttgcctgaacatgggcgtctgtttatttattcatt

SEQ ID NO: 9470 - DNA, 1169 bp, Hevea brasiliensis
ctctcctttcatcgttttgtcctttggcttgtcatttccgccttcacttcgacggaggaggcttcctgttctgttcttctgtcgatccatatcttaaaatcttggaagaagttactttttagtttgatatagaaagcatgtcacctaccgaatcttcacgtgaggaaaatgtctacatggccaagttggctgaacaggctgaacgttatgaggaaatggtggaatttatggaaaaggttgcaaagaccgtggatgttgaggagctaactgtggaggaaaggaatctcctctctgtggcttataagaatgtcattggggctaggagagcttcatggaggataatctcttccattgagcagaaggaagagagcagaggaaatgaggatcatgtcacaatcatcaaggagtacaggggtaaaattgaatcagagctgagcaagatttgtgatgggatattgagcctcctcgagtcacatctcattccctctgcctcatctgctgagtctaaggtattctacctcaagatgaagggtgattatcaccggtatcttgctgagtttaagaccgcaggtgagaggaaggaagctgctgagagcactttgttggcgtacaagtctgctcaggatattgctctcgctgaccttgcacctactcacccaataaggcttggacttgctcttaacttctctgttttctactatgagatcctgaactcacctgaccgtgcttgcaatctagcaaagcaggcctttgatgaggctatttctgagctggatacgttgggtgaggaatcgtacaaggacagcacattgatcatgcaactgcttcgagacaatctgacactctggacttctgatatcacagacgaagctggggatgaaatcaaagaagcatcaaaacgtgaatcgggtgagggacagccgcaacagtgatgagttaaaattcataggatatatctgctgtgtacttctatcttgtgacctctgcatagatcccatgctggtgggtttaggtggattgctgaatgaatttggtaattctgagtgctgataagcacctggaattgaaatgttctgacagattatcaaccttctactattgatgttcagaatggaagttggtattcctatcgctttaccatgtgatattgttgaatttaggaatttcca

SEQ ID NO: 9471 - DNA, 1146 bp, Allium cepa
gggggaaacaaaactaatcaaaaggcgttgagcttttagggtttctcgttccccattgtttaggttgactatattaagcaaatatgaccacccgggaagaaaatgtgtaccttgcaaaacttgctgagcaggcagagcgatatgaggaaatggttgaattcatggagaaggtggttaaggctgccgatacagaagaactcacagtagaagaaagaaatcttctctcagttgcctacaagaatgtgattggagcacgccgtgcttcttggagaatcatttcatccattgaacaaaaagaggaaagtcgaggaaatgatgatcatgtgtctaagattaaggactataggggaaaagttgaagttgaactcagtaagatttgtgatggaattttaaagttgttggattctcatcttgttccttcttctactaccgcagaaacaaaggtgttttatcttaaaatgaaaggagattatcacaggtatttggccgagtttaagactggagcagagagaaaggatgctgctgagagtacattgatggcatacaaatctgcacaggatattgcacttgcggaattggcttcaactcatcctataaggcttgggttggcacttaacttttcagttttctactatgaaatccttaactctcctgaccgtgcttgtagtcttgcaaaacaggcgtttgatgaggcaatttcagagctagacacacttggtgaagaatcctacaaagatagcacattgatcatgcaacttcttagggacaatttaactttatggacctcagatcttaatgaggctggagatgagatcaaagaagctgctccatcgaagggtgaatcagaaggccagtgatgaattaagcgctatggtcatttaatcctgtgcctgttttttttttttgtccctcctttcattgtcggtgctgaatgtgttcttgaagctgcttaaattaaactttgttgtctttttaatccatgctaatgttatatgggttagaaaaatgtccaagcggttttttcagtcatgtaattgttatggaatttattgaaatgttatacatgttttttgtgatatggataatgatggtattaactattaatatataaagttgcttgaattatatctttagaaaaacacacac

SEQ ID NO: 9472 - DNA, 1263 bp, Citrus sinensis
atttaacagcccccacccccgctacgctctcactttcgatttctttcttctctaaaattcagatcgaatccgtattcccaaaccttaaaacgctaagatgtcgcctactgattcttctcgcgaggaaaatgtgtacatggccaagctggccgagcaggctgaacgttatgaggaaatggttgagttcatggaaaaagttgcaaaaacagttgatgttgaggagctaaccgtggaggaaaggaaccttctctcagttgcttacaagaatgtgattggggccaggagggcttcatggaggatcatctcttcgattgagcagaaggaggagagcaggggaaatgaagaccatgtctcagtaattaaggagtacaggagcaagattgagaatgagctcagcaagatctgtgatgggattcttagcctccttgagtctcatctcattccctctgcctcatcggctgagtctaaggtgttctacctgaagatgaagggtgattaccacaggtatctggctgagttcaagactggagctgagaggaaggaagctgcggagagcactttgttggcctacaagtcagctcaggatattgctttagctgaattggcccctactcaccccataaggctgggacttgcactcaacttctctgttttctactatgaaatccttaactcaccagatcgtgcatgcaatcttgcgaagcaggcttttgatgaggccatttctgagcttgataccttgggtgaagaatcatacaaggacagtacattgattatgcagcttctccgagataatctgacactttggacttctgatatcactgatgatgctggagatgagattaaggaagcagcatcaaaacgtgaatcaggggagacgcagcagtgatgaataatgagttcagttcataggatatgtatctgtattttttatcttgtggcttttattttacatggatgccatgtgggttgttttagcaggatattctcatgaactgataatcttgagtgttggctgcacttagggtttatgtgttccaacagattgtaaactagatttaattattgatgagaagtatttggtttgggtttcatatgtagtgttttcagtgctatgctaaactttagaattgaaattacccatttttgttatatttaattttaagatttcacatgtttggatgagtccaatgctgttaccattggatggataaatttttttatttccttgcctgaacatgggcgtctgtttatttattcatt

SEQ ID NO: 9473 - DNA, 1189 bp, Raphanus sativus
ggacagtccttcatcattttgcgtctcaagacttcgaactcgacaatccctaattcccaaaactcccctctcggatctccaacaagagtgtgattacgaaacgatgtcgtctacaagggaagagaacgtgtacttagccaagttagcggagcaagccgagcgttacgaggagatggttgagttcatggagaaagtcgccaagaccgttgactccgaggagctcaccgtggaagagaggaacctcttgtccgtcgcttacaagaacgtgatcggcgctaggagagcttcctggaggatcatctcttccatcgagcagaaggaagagagcagagggaacgaagaccacgtgtccatcatcaaggactacagagggaagatcgagaccgagctcagcaagatctgcgatgggatcttgaaccttcttgattcgcaccttgtccccgctgcgtctttggctgagtccaaagtgttttatcttaagatgaagggagattaccataggtaccttgctgagtttaagactggtgctgagaggaaggatgctgctgagaacactctcgttgcttacaagtctgctcaggatattgcccttgctgatttacctccaactcatccgattagattgggacttgctcttaacttctctgtcttctactatgagattctcaactcacctgatcgtgcttgcaatcttgccaaacaggcttttgatgaagcaatctctgagctggacacattaggagaagaatcatacaaggacagcacgctcataatgcaacttctccgtgacaatctgaccctctggacttctgacatcaatgacgaggcgggtggtgatgagatcaaggaggcgtcaaaagacgagcctgaagaagggaaacaagcttaaaaccttgaaatgaccaaagcgagcgagggcattacttatgggatttggctgttgtagtttcttaaaaacatatgatatggggtttgttgtttgtagaagcagagagaagatcatcatttgattttctcctttgcaaactctgaaactctgtttggtctttcttgtttggttttttcttctagtgtttttgagtctttggttttactccgttgcttgttattattttgatttcttaggaagcgaagaaacaaaactttcaattattgctttggattcaactctttttttatattgccgcca

SEQ ID NO: 9474 - DNA, 1275 bp, Fragaria vesca
ccattttacgagagcgtatccatcttcttgttcgtcgtcgacccaacccaggtttgagaactttcgcaatacacatcaaagatgtcgccaactgaatctacacgcgaggagaatgtttacatggccaagttggctgagcaagctgagcgttatgaggagatggttgagttcatggagaaggtcgctaagaccgttgatgttgaggagctaactgtggaggaaagaaacctcctttctgttgcctataagaacgtgattggagctaggagagcttcatggaggatcatctcctccattgagcagaaggaggagagcagaggtaatgaagaccatgtgtcgatcattaaggagtacaggagcaagattgagactgaactgagcaagatctgtgatgggatcttgaacctcctcgagtcgcaccttatcccctcagcatcatctgctgagtccaaggtgttttacctcaagatgaaaggtgactaccataggtaccttgctgagttcaagaccggaggtgaaagaaaggaagcagctgagagcacattgttggcttacaagtctgctcaggacattgctctggctgagttggctccaactcacccaataaggctgggacttgctcttaacttctcagtgttctattatgaaatccttaactcaccagaccgtgcttgcaatctggctaaacaggcctttgatgaggccatttctgaacttgacacactgggtgaggaatcatacaaggacagtactttgattatgcaacttctccgagacaatctgacactgtggacttctgacatcacggatgatgctggcgatgaaatcaaggaagcatcaaagcgtgaatcaggcgatgcccccgcacagtgacgagtttggatcgtaggatatgtgctatgtgtacctttatcttcagacctttgtaatagatgccatgtggttgtagccggatttctctatgaacttgacgatctttagtgcgtcagcacttgcagttggtatataccaacagatcgtaaaattgcttttataattggcgagaagaatttggttccgtgctttgattgctcagctatattatttagtgttaaaaaagttagtggtttttgatgtcctatttctttgttcaactgttttgattggtatccagatttgtattgttattgcgctttctattttctttctttatattgtggcaccaattgttatctctatccatcattcattcataaactttgacctcattctaagcagttgatgactatgttgtct

SEQ ID NO: 9475 - DNA, 1521 bp, Malus domestica
cggattcccatttcctccagttttgctttgagcttagatcttctccttcctcgtggaccagagaaggtacggacgcccccaacttctcaagaactacttagggtttcagatttagacttacatagcaaagatgtcgccaactgattcttcacgcgaggagaatgtgtacatggccaagttggccgaacaggctgagagatatgaggagatggtcgagtttatggagaaagttgccaagactgttgatgttgaggagctaacagtggaggaaagaaatctcctctctgtggcttataagaatgtgattggagctaggagagcttcgtggaggatcatatcttccattgagcagaaggaggagagcagagggaatgaggatcatgttgcgattatcaaggaatacaggagcaagattgagactgagctcagcaagatctgtgatgggatcttgaaccttcttgagtcgcacctcattccatctgcctcatctgccgagtccaaggtgttttacctcaagatgaaaggtgattaccacaggtaccttgctgagtttaagactggaggtgaaagaaaggaagcagctgagagcactttgttggcttacaagtctgctcaggatattgccctggctgagctggctccaacccacccgataaggcttggacttgcacttaacttctcagtcttctactatgaaatccttaactcaccagatcgtgcttgcaatctggcaaaacaggcttttgatgaggctatttctgagcttgacacattgggtgaggaatcctacaaggatagcactttgatcatgcagctcctccgagacaatctgacactctggacttctgatatcacggatgatgctggggacgaaatcaaggaagcatcaaagcgcgaatccagtgaagcacagcagtaacgaggcttctggttcgtagaatttgtactatgtacccatttatcttgggacctttgtaatagatgccatgtgggttgtagaaggatttgcctatgaacttgacggtcttgagcgcgtcagcgcttagggttgaaatgttccagcctagggttggaatgttccaacagatcgcaaaattgcgttttataattggtgagaagaatttggttcagtgctttgagtgctgtgctatatgatttagtgttaaaaattagtgtttttcttcactgtttcttcagatttccaatggcttgtgttgtttttttaccagatataacattgtggagcttgtattctttatgcttctctcaaccaggttgtgtttcgggtacatccgattcgctctaccgaagctggtaccttcattgttcgctgcaagtttaactttgcaacattagaattgatcgtttggggcttttacaaatcagtttattgctttgtgcatttgtgatttcttgtatcttgagtatgtatatcttctgaatcgataagtcactgagtccgctgctttatcgtcgcgatttgattcattttgacgttgaaacaatgggtacctcaatcgg

SEQ ID NO: 9476 - DNA, 1342 bp, Cryptomeria japonica
gcgttgccttgaattttaaatcttgctttggatctgttcttcgcatcgattccattccagggcaaagcacgtctcctcattgaagggtacattgtgttcggtgttattgtaacagaggtgcacaaaaatgcctcccgtagagtcatcgcgcgaagaaaatgtgtacatggcgaaattagcagagcaggccgagcgttatgaggaaatggtggagttcatggagaaggtggcgaagactgtggacgtggaggagctgagcgtggaggagcggaatttgttatcagtggcatacaagaacgtgattggagctcggagggcttcctggagaataatttcttcaatcgaacagaaggaagaaagtcgtggtaacgatgatcatgtgacaatgatcagagactacagagcaaaggtcgagtctgagctcagtaatatatgtgacggcattcttcgtcttcttgattcccatctggttccctcttctaccacaggggaatcaaaggtgttctatcttaagatgaagggagattatcaccgctatctggcagagttcaagacgggtgctgacaggaaggaggctgcagaaagcacattgcttgcttacaagtctgctcaagatattgcaatggcagaattggcttcaacccatcctatcaggctggggttagctctcaatttttctgtattctactacgaaattctgaattcacctgatcgagcatgtgctcttgccaagcaggcctttgatgaagcaattgcagagttggatacgttgggtgaagaatcttacaaagacagcacacttatcatgcaactccttcgagacaatttgaccttgtggacatcagatatgaatgaggatacaggagatgaaatcaaggaagccccttcaaagcgtgaggagggagatgggcaatgacatgaaatgaaataatttctgatttatcatcgatgcatctctgacaattgaatttctctgtaaaatcttgcttagtacttcgcactgtaaaagtatagtgattgtgggcatctttttattgtagtccctgctatgctattaagcttgttagtaaggatattctaacaagctgcgtttatgccctattcttgtttatttggcatatcattaaatcaaaacatgcttattgtgggacattggttcagcatgtcaagtttttttattcatgttaatcccctgctattttgatttacagtacattgtttttggtctttagtaggtttcagcactcccttgttggcatgactaactggtaaatgaaaacggattgaatgatgatgttctttgaaagcaattagatctgtgctaatatcgtttgagaagatg

SEQ ID NO: 9477 - DNA, 1107 bp, Nicotiana benthamiana
gaatcaggttttttcacaaacaacaaatatgactgagtcatcgcgggaagaaaatgtgtacatggccaagcttgctgagcaggccgagcgatatgaggaaatgattgagtttatggagaaggttgcaaagacaggtgatgtcgaggagctgactgttgaggaaaggaatctcctttctgtggcatacaaaaatgtgattggtgcaagaagggcctcgtggagaataatctcttcaattgagcagaaagaggagagccgtggaaatgaagatcatgtcaaaactattaaagaatacagagccaaaattgaggctgaactcagcaagatctgtgatgggattttgggtctccttgagtcccatttaataccatcagcctccacagctgagtccaaagttttttacttgaagatgaaaggtgattaccacaggtacctggctgagtttaaaacaggttcagagaggaaagaagctgctgagaacaccttattggcatacaagtctgctcaggatattgctttgactgagctggctcctactcacccaatcaggctgggacttgcacttaacttttctgtgttctattatgaaattcttaattcgcctgatcgtgcttgtaacctggcgaaacaggcctttgatgaagctatctcagagttggatacactgggcgaggaatcttacaaggacagtacattgatcatgcaacttctccgagacaatcttacactttggacttcagataatgcggaggatgctggggatgatatcaaggaagctccaaaacatgagtcaggcgaggggcagcagtgatgagttagtagcatagtctttattttatagggtgctgcatggggatatagcaagatcgtgaattagatacttaaatggctgtgtgtgtagtgtcgaaatggttcaatattaaacgtgtcgcagtgtgatagaatatgtggtcaagctagtcgcatagtgctatgatgattaaaatttgacctggttgcgttgcttgtgttgatgactttgctcgtatttagtctcatttgcatgttgtgtgatcacctttgtattttcaaatcctttgaaatcctggaattaattgttaacatcta

SEQ ID NO: 9478 - DNA, 1785 bp, Olea europaea
cctcataagtcatttgaagagcaagcaatttcagattcaacgacgcctaagagccaatagatttgagtactatttagcatattaaaaatgtcgccagctgatttgtcgcgtgaggagaatgtatacatggccaagttggccgaacaggctgagcgatatgaggaaatggttgagtttatggagaaggtagcaaaggctgtcaatacagaggagttgtctgtggaggagaggaacctcctttctgtggcatacaaaaatgtcattggtgctagaagggcttcatggaggatcatctcttccatcgagcagaaagaagagagccgggggaatgaggatcatgtcaatgtaattaaggagtataggggtaagattgaggctgagctcagcaagatctgtgacgggattttgagccttctcgagtcccacctcgttccctcagcttcatccgccgagaccaaggtcttttacctgaagatgaaaggtgattaccacaggtatttggccgagttcaagacgggggctgagaggaaggaagccgctgagagtactttggtagcatacaagtctgctcaggatattgcattggcagacttggctcccactcacccgattaggctgggacttgctctcaacttctctgttttctattacgaaatcctcaactcaccagatcgtgcttgcaaccttgccaagcaggctttcgatgaagccattgctgagctagacacattgggtgaggaatcctacaaggacagcacattgatcatgcaacttctccgggacaatctgactctttggacttctgatataacggatgatgctggggacgagatcaaggaagctccaaaagcagaccctggcgagggacagcagtgaatctgtggcgctgtagaactgtgagcagccaatttgttgttctaccattgaatttcttcggttgtagcaagatttgatggatttggcatgttaagtgtagtggtcccttaaatcttgaaaatgtttttgttacaagcatgatttcttataagaacatacgattggtataaggcggcgaggtggtgtgcaaacttgatttatttgtcatgtttgattttttgccatcaatttggtggttgcactgaaaaatatggattggattggaagatcaaatttagttcaaaggggtttctatgaatctttggtgtctgtaatacatgatttgggttccaatgtatgccctttgttaaaaattaaaatccaatagaacaaaaaacacacttggctaaatgtaatggtactcttgacatattactaagagcaataacccggctagggatttatcagagtagagtcctttatctgatatcagatggaaagccagttttctggaggcgtcgctctgattggagccaccatattgagtgtctcagctgtggtaagctggcccgaatctgctgctaaacatgccagcatgtagaagcagcaaatatagtagctggttgagtcctgatattatgataaatgcttccaaggtttgtaggcgttttcctctatgtcctcccattataatctgcttgcaaacaagaccaaaagcaaggacagtcgtagcccaagcaagaattgccgatgaagctgcactagcgagactaacactattccacacccgttggtgcaaaaaacccgaaacactgagcatgctccgatcactccagcaattaaagcaaatattaaaaggaaaattgttgagggattccaccaagatggggtgatcctgctcgcctcgatgtattatcgagagaccaacgg

SEQ ID NO: 9479 - DNA, 831 bp, Allium cepa
agaaattaaaaacattgtttagttcaaaatgtctgctacacgagatgaaaatgtatacatggcaaagcttgcagagcaagctgagcgttacgaggagatggttgagttcatggaaaaggtagcaaaaacagttgatgctgacgaacttactgtagaagagaggaaccttctttcggttgcatacaaaaatgttattggggctcgccgtgcttcttggagaatcatatcttctattgagcagaaagaagagagcagagggaatgaaaatcatgtggttatgatcaaggaataccgtggtaaaattgaggccgagttaagtaagatctgtgatggaattctgaatttgcttgatactcatcttgtaccttcatcgaccgctgctgagtccaaagtgttttacttgaagatgaagggagattatcataggtatcttgctgagttcaagaccgggccagagagaaaagaggctgctgagagcacacttattgcttacaaatcagcacaggatattgctttgtctgatttgcccccaactcatcctataagacttggactggccctcaacttttcagtgttttattatgagattctcaattcgcctgaccgtgcttgtagtcttgccaaacaggcatttgatgaagcaatatcggaattggatactttgggtgaagagtcctacaaggacagtaccttaatcatgcaacttcttcgagataacttgactctttggacatctgacctcactgaggatgctggtgatgaaatcaaagaagctgctccaaagcaagaaggacagtgataagtcgcaattttctggattgctgatttttt

SEQ ID NO: 9480 - DNA, 990 bp, Capsicum annuum
atcaggtagctttatagacaacaaaacatggctgattcacgtgaagaaaatgtgtacatggccaagctggctgagcaggctgagaggtatgaggaaatggttgagtttatggagaaggttgcaaagacagtagatgttgaggagctgactgttgaggaaaggaatcttatttctgtggcctacaaaaatgtgattggtgcaagaagagcctcatggaggataatctcttcaattgagcaaaaggaggagagccgcggtaatgaagaccatgtcaacactattaaagaatacagaggcaaaattgaggctgaacttagcaagatctgtgatggaattttgagccttcttgagtcccatttagtaccatcagcctcaacagccgagtccaaagtgttttacttgaagatgaaaggtgattaccataggtacttggctgagtttaagacaggggccgagaggaaagaagctgcagagaacactttattagcctacaagtctgctcaggatattgcattggctgaactggctcctactcacccaatcaggctgggacttgcccttaacttttcagtgttctattatgaaattcttaactcacctgatcgtgcttgtaaccttgcaaagcaggcctttgatgatgccatcgcggagttggatacattgggtgaggaatcttacaaggacagtacattgattatgcagcttctccgagacaatctcacactttggacttctgatgccacggatgatgtcggggatgagatcacggaagcttcaaaacaagagtcgggtgatggacagcagtgacagcttagtaacctagtcttgtactcctgatattgtgattttggatgactctttgtatcactgctgaagttgttagtatgataaagacatgtttggtataattcgttgtgatgcctatttgcatcgtcctttagtaattagagttgaaatatgctatttcttgtgtactgatgtgttggcttg

SEQ ID NO: 9481 - DNA, 1215 bp, Lippia dulcis
ctccaatacaactcgtttcaacgaagcttcattatctgaatcgagaactaattgctccagattgaagaggtttagaatctagaaatctgaaagtatgtcgccagctgattcttcccgcgaggaaagtgtatacatggccaagttggccgaacaggctgaaaggtatgaggaaatggtcgagtttatggagaaggttgtaaagaccgtggacaccgatgagctgactgttgaggaaagaaacctcctatctgtggcatacaagaacgtgattggtgccagaagggcttcatggaggatcatctcttcaattgagcagaaagaagagagtcgtggaaatgaggaccatgtgaacataattaaggaataccgtggtaagattgaggcagagctcagcaagatttgcgatgggattttgaaacttcttgagagccatctcattccttctgccgcttctggtgagtcgaaggtgttttatttgaagatgaagggtgattactataggtacttggctgagttcaagactggggctgagaggaaggaagcagccgagagcactttgctagcttacaagtctgcacaggatattgcattggctgagttggctcccacccacccaatcaggctggggctcgcacttaacttctctgtcttctattatgaaatcctcaactcacctgatcgtgcttgcgcccttgcaaagcaggcttttgatgaagccatagctgagctagatacattgggtgaggaatcatacaaggacagcacattgatcatgcaacttctccgagacaacttgactctttggacttctgacatagcggatgatgccggtgatgagatcaaggaaaccaccaaacgcgaatctggcgagggagcacagtgatgaatttactgtaatagtgtgctttcatttttgttattttagtataaaactactgttgtagcaagatttgatggatgtggaactgggactattggtggctcttccggttggaagaagatttacccagttttttaagtatcaagatttcacctgtatgttgatggtgatggatgtttctgttctggagagctgatgtacgaattttagtattgttatgtttgttattgtatctgggttcatggctgcgtctagtaattcatgtcacagcttgatcaacaatggaggtattattacctacatcatttaatagtgttcttatctttggtgtttca

SEQ ID NO: 9482 - DNA, 1293 bp, Papaver somniferum
aagacttttttaaaggacaagtggaggtgaggtctttatttcggactctcaatttttttctccccttgcgattctcaagagaaaaaggaaaacaaacgccttcttccgagcagtactagctaactgagatgtctacatcacgagaggaaaatgtgtatttggctaaattagctgaacaagctgaacgatatgaagagatggttgaatttatggaaaacgttgcaaaaactgttgatgttgaggagttaacagttgaggaacgaaacctgttgtctgttgcttataagaatgtgattggagctaggagagcttcatggaggattatttcaagtattgaacagaaggaagaaagccgtgggaatgaagatcatgtttctattattaaagaatataggggaaagattgaatctgaacttcataagatttgtcaagggattttagggcttttggattcccatcttattcctttatcaactgctgctgaatctaaggtgttttaccttaagatgaagggtgattatcacaggtatttggctgagtttaaatctggtagtgacaggaaagaagctgctgagagtacattgttggcttacaagtctgctcaggatattgctttggctgaattgagtcccactcacccaataaggcttggacttgctcttaacttctcagtgttctactacgaaatcctaaactcaccagatcgtgcttgcactctagctaagcaggcatttgatgaggccatttctgaattggattccttgggtgaggaatcatacaaagatagtacattgattatgcaacttctccgagacaatttgaccttgtggacttcagacatcggcgaggatgctgacaatgagattaaggaagcttcaaaacatgatgagtccaagggtccagaataacactgatgggtttgaaggaatgaatgttttagtctatacgagtagcggttaggttttgtttgtctaagaatggaccaactcctacttgtgtttgctgtttatgttttatttagtagtttagtgatagattgcttcttagtcttttcttcttgtgatacagtcagaagaaaaagaaaagaaatgcctcacaatattttatggtactgaccaagtttgaaatatatttattttgcatgtgaaattattagctacccgttcatacttttatcatgtgaaattattagcaagctgttcgtgcttttatcatttgaaatgaaagaatttgggtttggtgatatgattatttttgctcaataaagtgattgttagtagtattggttaactt

SEQ ID NO: 9483 - DNA, 1081 bp, Solanum phureja
ttttcattttcccttctcattcaatatccctctattggactcgtcttcttcttcttcgtcagagacatcaatcaccaggtaactttacagacaacaaacatggccgattcacgtgaagaaaatgtgtacatggccaagttggctgagcaggctgagaggtatgaggaaatggttgagtttatggagaaggttgcaaaggtagatgttgaagagctgactgtggaggaaaggaatcttctttctgtggcttacaagaatgtcattggtgcaagaagggcttcgtggaggataatatcttcaattgagcagaaagaggagagccgaggaaatgaagaccatgttagcagcattaaagaatatagagccaaaattgaggccgagctcagcaagatctgtgatgggattttgagccttctcgagtctcatttagtaccatcagcctcaacagccgagtccaaagtgttttacttgaagatgaaaggtgattaccataggtacttggctgagttcaagacgggggcagagaggaaagaagctgcagagaacactttattagcctacaagtctgctcaggatatagcattggctgaactgactcctactcatccaatcagactgggacttgcccttaacttttcagtgttctattatgaaattcttaactcacctgatcgtgcttgtaaccttgcaaagcaggcctttgatgatgccatcgcagagctggatacattgggtgaggaatcttacaaggacagtacattgattatgcagcttctccgagacaatctcacactttggacctctgataccacagatgatgccgaggatgagatcagggaagcttcaaaacaagagtcgggtgatgggcagcagtgatacctaagtagcctagtcttgtactccttattttgtgattttcgacgactcgtcgtatcactgctgaagttgtttgatataaaaacaggttttagtctgataaaagaaacatgtttagtacaatttgtttgtgatgctattggcatcgccatttaataattagagttggaatactgctatttcttgtgtactgatgtgttggctt

SEQ ID NO: 9484 - DNA, 1155 bp, Nicotiana tabacum
aggagcgacaatcagaaaccacccgctgcataaccctaggtttttcacaaacaacaaacatggccgattcatcgcgtgaagaaaatgtgtacatggccaagctagctgagcaggccgagcgatatgaggaaatgattgagtttatggagaaggttgcaaagacaggtgatgtcgaggagctgactgttgaggaaaggaatcttctttctgtggcctacaaaaatgtgattggtgcaagaagggcctcgtggaggataatctcttcaattgagcagaaagaggagagtcgtggaaatgaagatcatgtcaaaactattaaagaatacagagccaaaattgaggctgaactcagcaagatctgtgatgggattttgggtctccttgagtcccatttaataccatcagcctcagcagctgagtccaaagttttttacttgaagatgaaaggtgattaccacaggtacctggctgagtttaaaacagggtcagagaggaaagaagctgctgagaacaccttattggcatacaagtctgctcaggatattgctttgactgagctggctcctactcacccaatcaggctgggacttgcccttaacttttctgtgttctattatgaaattcttaattcacctgatcgtgcttgtaaccttgcaaaacaggcctttgatgaagctatctcagagttggatacacttggcgaggaatcttacaaggacagtacattgatcatgcaacttctccgagacaatcttacactttggacttcagataatgcggaggatgctggggatgatatcaaggaagctccaaaacatgagtcaagcgaggggcagcagtgatgagttagtagcatagtcttgtagtctttattttatagggtgctgcatggggatatagcaagatcgtgaattagatacttcaatggctgtgtgtgtcactgtcgaaatggtttaatataaaacatgtagtgtgatagaatgtggtcaagctagtcgcatagtgctatggtgattaaaatttgatatggtggcagtatttgcttgtgttggtgactttgctcgtatttatagtcttatttgcatgttgcgtaatcatctttgtattttcaaattctttgaaatccttgaattaattgttaacatctaaaaaaaa

SEQ ID NO: 9485 - DNA, 1163 bp, Solanum lycopersicum
acttcaatttttttcatttttccttctcattcaatatccttctaattggagtttcttcttcttcgttagagacatcaatcaccaggtaactttatagacaacaaaaatggccgattcacgtgaagaaaatgtgtacatggccaagctggctgaacaggctgagaggtatgaggaaatggttgagtttatggagaaggttgcaaaggtagatgttgaagagctgactgtggaagaaaggaatcttctttctgtggcttacaagaatgtcattggtgcaagaagggcttcgtggaggataatatcttcaattgagcagaaagaggagagccgtggaaatgaagaccatgttagcagcattaaagaatatagagccaaaattgaggctgagctcagcaagatatgtgatgggattttgagccttctcgaatcccatttagtaccatcagcctcaacagccgagtccaaagtgttttacttgaagatgaaaggtgattaccataggtacttggctgagtttaagacgggggcagagaggaaagaagctgcagagaacactttattagcctacaagtctgctcaggatattgcattggctgaactggctcctactcacccaatcaggctgggacttgcccttaacttttcggtgttctattatgaaattctaaactcacctgatcgtgcttgtaaccttgcaaaacaggcctttgatgatgccatcgcagagctggatacattgggtgaggaatcttacaaggacagtacattgattatgcagcttctccgagacaatctcacactttggacttctgataccacggatgatgccggggatgagatcagggaagcttcaaaacaagagtcgggtgatggacagcagtgacaacttagtagcctagtcttgtactccttattttgtgattttcgactactcttcgtatttactgctgaagttgtttgatattaaaacaggttttagtctgataaaagaaacatgtttagtacaatttgttgtgatgctatttccatcgccatttaataattagagttggaatacagctatttcttgtatactgatgtgttggcttgtgtcgatgagctttgtatttttgaataattcagagtatttaacaaatcaattatcttttagcctccttttatca

SEQ ID NO: 9486 - DNA, 1262 bp, Vinca minor
gctttcaatcaatagaaaaaaggttaggaatttaatttgaactagaaaatatggtgcccactgattcacctcgcgaggagaatgtttacatggccaagctggctgagcaggctgagaggtatgaggaaatggttgaattcatggaaaaagttgccaagggggcagatgctgaagaactcactgtggaggaaaggaatctgctctctgtagcttacaagaatgttattggcgctaggagagcttcgtggcgaatcatctcctctattgagcaaaaagaagaaagccgtggtaatgaggaccatgtggcaattattaaggactataggggaaaaattgaggccgagctcactaaaatatgcaatgggatattgcaacttcttgaaggacatcttgtaccctcagccaatactggagagtcaaaagtgttttatctgaagatgaaaggtgattatcatagatacttagccgagttcaagactggagctgagaaaaaagaagctgctgagaacactctagttgcttacaaagctgctcaggatatcgccctggctgagctggccccgacacacccaataagactaggtcttgcgctcaacttctctgtgttctactatgagatactgaactcacctgaccgtgcttgcactcttgctaagcaggcttttgacgaagccatatctgagctggatacactcggcgaagaatcctacaaagacagcacccttatcatgcaacttcttcgcgacaacttgactttatggacttctgatgtgccggaggatgctggtgctgagatcaaggaagcttccgctaatgagccggggaatggtgagaagtgaaatttgtaatcttgctggagggttcaatagattgactaggtttaggacttgggatgatgtaatatctatcgcttttattctaataatcaaactctgagattaagattatgtgcttcggtaatacttggaagtttgaaccatatgataactaatgctgtaatgcttaccttttgagtgtatcagcactcaatctttccagtatatttcctagttgtagctcttacctggggcaaaatggtgatggaccggtccattgcttctggtgctacactttccactcacaatacttgctgcttgccgactttatatgcaatgtagggttctattgagtaaatattgtgagtgagaagtgagaccaaaaccaatagatcggttgccccaccttcctggggtgtatcagggttctatgcttatgaagagcta

SEQ ID NO: 9487 - DNA, 1055 bp, Fraxinus spp
gacaggccagcagcagaacaaaaatttccgattcaaagacacccaagagatttgagtattatatagcacattaaaaatgtcgccagctgattcgtcacgcgaggaaaatgtatacatggccaaattagcagaacaggctgagcgctacgaggaaatggttgagtttatggagaaggtagcaaagacagtcaatatagaggagttgactgtcgaggaaaggaacctcctatctgtggcatacaaaaacgttattggtgctagaagggcttcatggagaatcatctcttccatcgagcagaaagaagagagtcgtgggaatgaggatcatgtcaatgtaattaaggagtataggggtaagattgaggctgagctcagcaagatctgtgatgggattttgagccttctcgaatcccacctcattccctcagcttcatctgccgagtccaaggtgttttacctgaagatgaaaggcgattaccacaggtatttggctgagttcaagacaggggctgagaggaaggaagccgctgagagtactttggtagcatacaagtctgctcaggatattgcattggcagacttggctcccactcatccaatcaggctgggacttgcactcaacttctctgtttttattacgaaatcctcaactcaccagatcgtgcttgcaaccttgccaagcaggctttcgatgaagccattgctgagctagacacattgggtgaggaatcctacaaggacagcacattgatcatgcaacttctccgagacaatctgactctctggacttctgatataacggatgatgctggggatgagatcaaggaggcttcaaaacccgaaactggcgagggacatcagtgaatctgaagtgttgtagaattgtgagcaccccatttgttgttctacctttgaatttctcccgttgtagcaagatttgatggatttggcatgttaagtgtagtggtcctttaaatattgaaaatgtttttgttacaagcaaggtttgtcatgagaacatacgattgtttataaggaggcgtggtggtagtaac

SEQ ID NO: 9488 - DNA, 1118 bp, Panax ginseng
gaaagtgaccggttggctgtttccaaaagagaactaaggtactgctaaactgtattaaagatgttgccacctgagtcatctcgtgaggacaatgtttacatggccaagctcgccgaacaggctgaaaggtatgaggaaatggttgagttcatggaaaaggttgctaaaactgtagatgttgaagagttgactgtggaggagaggaatctcctctctgtcgcctacaagaatgtcattggagcgagaagggcttcgtggaggattatatcctccatagagcagaaggaagagagccgtggaaatgaagatcatgtcaccattatcaaggagtataggggtaagattgaggctgaactcagcaagatctgtgatgggattctgaaccttcttgagtctcatcttgttccctcggcgtcatctgctgagtccaaggtgttttacttgaagatgaaaggtgattaccacaggtacctggctgagtttaagactgggtctgagaggaaagaagctgctgagagcaccttgctagcttacaagtctgctcaggatattgcattggctgaacttgcttccactcacccaataaggctgggacttgcactcaacttctctgtcttctattatgaaattctcaactccccagatcgtgcttgcaaccttgcgaagcaggcttttgatgaagccatctctgagctggatacttttgggggaggaatcttacaaggacagcacactgatcatgcaacttctccgagacaatctgacattgtggacatctgatataacggatgaagccggggatgagatcaaagaagcagctcccaagccgtcgggtgaaatcatagaatagcattctgtactttgcatttgtgcctggctataaatctttatatggtagttgtagcaagacataatggatttgaagatctcgagtccttgttggtgcttgggtttgtgacgtttcaacaaattacaagcttgttttaatactgaaggaagaatatggtgtggtgattaatgtctcccttcccttatgtggtgcggtagtttcaaattattagttgttctattgtttgtttgggaattaaagagattgagattattggaagtatttgttt

SEQ ID NO: 9489 - DNA, 1218 bp, Avena sativa
cccctccctccctcgaacctacatacaacagcgcacacagccccccgagatcggatccgcagacgagagcagaagcccgtgagaaaagccaagcgcccgaggaaaagatacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagacagctgatgttggtgagctcactgttgaggagcgcaacctgctttctgtggcttacaagaatgtgattggtgcccggagggcttcctggaggatcatctcatccattgagcaggaaggaggagagccgtggacaacgaagcttatgtggcttcaatcaaggagtaccgtaccaggattgaaactgagctgagcaagatctgtgatggcatcctcaagcttctggattcccacctcgtcccctctgccactgcagcagagtccaaggtgttctacctgaaaatgaagggtgattaccacaggtaccttgcggagttcaaggcgggagctgagaggaaagaagcagccgagaacactcttgtagcatacaaggcagcccaggacattgcacttgctgacttgcctaccactcacccgataaggcttggacttgcactcaacttctcagtgttctactatgaaatcctgaactcgccagaccgcgcttgcaaccttgccaagcaggcatttgatgaagctattgctgagctggactcccttggtgaggagtcctacaaggacagcactttgatcatgcagcttctccgtgacaacttgactctctggacctctgataacgcggacgagggtggtgatgagatcaaggaggcctcgaagcctgaggaggggcactaacttgcccgcaagtctgctcaaagtttatttcaagagtccatttcgcagctacctgtattattcggatcataagatgtactagggttggttgcactatgtgaatcataagaagtagtaggatcgtgctatgcgaagcgtgtcgagctgaagtacctagtggactacagtcatgagggcatcatgtggacatcgtcgcttcaggaactgcgttattagccattagcagatttcaaactatttcctgtgttgcagcacattattagtactgctgtattagcaattttcattggcttgtt

SEQ ID NO: 9490 - DNA, 1141 bp, Secale cereale
ccgaacacgagtacgactagggaggtacgcgcgacccgacgatacgccagccgaagcccgtcgagagcagcgaagcgcgagaggaaaggaactgaactaagtttgtaacaaagaaagagggaaaatgtagtctaccgctgaggcaacccgtcgaggagaatgtgtacatggccaagctcgccgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacattgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggatagcaccttgatcatgcaacttcttcgtgacaacttgactctctggacctccgataacgcagaggagggcggtgatgagatcaaggaagctgcctcaaagcctgagggagagggggcactgattggctggccctcgagcgtgcccaagttatttctgagtccatttacgcagctacctgtatcattcggatcataagatgtactagggtcggttgcactatgtgatcataagatgtggtaggatggtgctatgcgaagcgtgtcgagctgaagtacctagtggactacagtcatgagggcggtcatgtggacatcgtcgcttcttagttcattagcagatttcaaact

SEQ ID NO: 9491 - DNA, 1188 bp, Amaranthus tuberculatus
tcaattcgtcttttcttcacttcctatttcttactttttcctaaattcaaacttgaaaccgtgatcaatacccatttccagtgaggaaagatgtcaacagctgaaggatctcgggatgagaatgtttacctagccaaattggccgaacaagccgaaagatatgaggaaatggtggagttcatggagaaggttgcgaagacagtcgatgttgaggagttaacagtggaggagaggaaccttctatctgtggcttacaagaatgtgattggagctaggagagcttcttggagaattatctcttccattgaacaaaaggaagagagtcgtggaaacgacgatcatgtagctaatattaaacagtacagagcgaaaattgagactgaactaagcaagatttgtgatggaatattgaaacttcttgactcacatcttgtcccatcagcaaccgctgctgagtcgaaggtgttctatttgaagatgaagggtgactaccacaggtatttggctgaatttaaggctggagccgagagaaaggaagctgctgagcacactttgttggcttataagtctgctcaggacattgcgctcgctgaattgcctcctactcacccaataaggttggggcttgctcttaatttctctgtgttctactatgagatcttgaattccccggaccgtgcttgtgctcttgctaagcaggcttttgatgaagccatttcagagctggacactctcggtgaggaatcctacaaagatagcaccttgattatgcagctcctccgtgacaacttgacattatggacctctgacaatacggatgatgttgatgagatcaaggaagcctacaaaagatgaagcagctccagggcagtaatgaaatatttaccaagtcggaggagttaagtgaaatgtatttatgtaacttggttatttgttgtgttttaggcgtttactatacttggtttgtttgtttgtcgtatgcagcgtcaatgagacgctcaatataagtgaccattattgtctacttcgtcaaagtctttgcatttcaggctgtcgtcctcggatgcatcaactaaaaccaatgtagtagtcagtgattgtttggatgaagttgtacttctctcaactggaactggtattctttcagtttatcaagaaaattcttgtgtattttgggtatcattaaga

SEQ ID NO: 9492 - DNA, 1104 bp, Persea americana
tgggtcttgttcctcgaactcgagaaaagcgagcgagcgagcgagcgagagaaagggcaaaaccaaagacaaagagaaaggccagtaggaagcgaaagcaatcaaaccatgtcgcctgtcggatcttctcgagaggaatacgtctacctggcgaagcttgcagagcaagctgagcgatacgaagagatggtggaatacatggggaaagttgcaacgactggtgattcagaagagctcacggtcgaggagcgaaatctcttctccgtggcctacaagaacgcgattggagcgaggcgagcctcgtggaggatcatctcctcgatcgagcagaaggaggagagccgtgggaacgacgatcatgtagcgattatcaaggagtacaggggaaagatcgaggcggagctgagcaagatctgcgatgggatcctgcagctgctggagtcgcatctcattccgtcgtccaactcggccgagtcaaaggtgttttacttgaagatgaagggcgattaccataggtaccttgccgagttcaaggcgggagctgagaggaaggaggctgctgagaacactctgttggcttacaaatctgctcaggatattgcactggcagaactggctccgactcatcccataaggctgggacttgcacttaacttttcagttttctattacgagatcctcaactcaccagatcgtgcctgcagtcttgcaaagcaggcttttgatgaggcaatttcagaacttgacactttgggtgaggaatcttacaaggacagtacactgatcatgcaacttctccgggacaatttgacgctgtggacctcagatatcacggaggatgctggggatgagatcaaagaagccccaaaacgtgaaggagatggacagtaatgaaatcgctaatttgtcactggacaaaggttttaaatgttgagctcaccatgcatgtgagaatgttctcacctgccattgtgatctcttggcagagagatcttattaggttagttgtaccaaagattcataaagtactactcagtatacctacaccatgacgtgtatggtgtcaacttgcttatttttaagcttatcaatgaaagtacttga

SEQ ID NO: 9493 - DNA, 1276 bp, Brachypodium distachyon
cttcctatccccccacgaacctgcagcgcacacacgagatccgcagccgagaggggagcccgtgaggaagttccaagcgccggaggaaaggtaccgagcaagttcgtgtaacaaaggagaggaaaaatgtctactgctgaggcaacccgtgaggagaatgtctacatggccaagctcgccgagcaggctgagcgttacgaggaaatggttgaattcatggagaaggtggccaagactgccgatgtcggtgagctcactgttgaggagcgtaacctactttctgtggcttataagaacgtgattggtgcccggagggcatcatggaggatcatctcatccattgagcagaaggaggagagccgtgggaacgaggcctatgtcgcttcaatcaaggagtaccgtaccaggattgaaaccgagcttagcaagatctgtgatggcatcctcaagcttctggactcccaccttgtcccctcagccactgcagctgagtccaaggtgttctatctgaaaatgaagggtgactaccacaggtaccttgcggagtttaaggccggtgctgagaggaaagaagcagcagagaacactctcgttgcatacaagtcagcccaggacattgcactcgccgacttgcctacaacccacccgataaggcttgggcttgcgcttaacttctcagtgttctactatgaaattctgaactcgcccgaccgtgcttgcaatcttgccaagcaggcatttgatgaagctattgctgagctggactcccttggcgaggaatcttacaaagacagcaccttgatcatgcaacttctccgtgataacttgactctttggacctccgataacgctgatgagggtggagatgagatcaaggaagcatcgaagcctgaaggagagggtcactaactgggcctcaaccctgcacaagtttatttctgagtccatttacgcagctacctgtattattcagatcataagatgtactagggtcggttgcactatgtgaatcataagatgttttaggatcgtgttatgcgaagcgggtcgagctgaagtgactagagtcaacatcatgtggacatcttcgcttcaggagctgcgttattagtccattagcagatttcaaactatttcctgtattgcagcacattattagtattgctgtattagcaattttcattggcttgttatgattgaacatactggcgtgaatcactgcagagttgctgcctttcgtttttgttgatccggaagctattaaggaattgcagta

SEQ ID NO: 9494 - DNA, 1164 bp, Festuca arundinacea
cacacacccgagatccgatcccgcagccgagcccgtgaggaaaagccgagcgccagaggaaaggtactgagcaggcttctgtaacaaactagagggaagatgtctaccgctgaggcaacccgcgaggagaatgtgtacatggccaagctcgccgagcaggccgagcgttacgaggagatggtagagttcatggagaaggtggccaagaccgctgatgttggcgagctcactgttgaggagcgcaacctgctctctgtggcttacaagaacgtgattggtgcccggagggcctcctggaggatcatctcatccattgagcagaaggaggagagccgtggcaacgaggcctatgttgcctcaatcaaggagtaccgtaccaggattgagactgagctgagcaagatctgcgatggcatcctcaagcttctggattcccacctcgtcccctctgccaccgcagctgagtccaaggtgttctacctgaaaatgaagggtgattaccacaggtacctcgccgagtttaaggcaggagctgagaggaaagaagcagccgagaacactcttgtagcatacaagtcagcccaggacattgccctcgccgacttgcctaccactcacccgataaggcttggactcgcactcaacttctctgtgttctactatgaaatcctgaactctccagaccgtgcttgcaaccttgccaagcaggcatttgatgaagctattgctgagctagactcccttggtgaggagtcttacaaggacagcaccttgatcatgcagcttcttcgtgacaacttgactctctggacctcagataacgcggatgagggtggtgatgagatcaaggaagcctccaagcctgaaggagagggacactaactctcccttgtgtctgcacaagtttatttctgagtcaatttcgcagctacccgtattgttcgaatcataagatgtactagggtcagttgcactatgtgaatcataagctgtagtaagatcgtgctatgcgaagcgtgtcgagctgaagtacctagtggactacagtcatgagggtatcatgtgggcatcgttgcttcaggaacgcgttattagttcattagcagatttcaaactatttcctgtattgcagcacattattagtattgctgtactagcaatttt

SEQ ID NO: 9495 - DNA, 1267 bp, Festuca arundinacea
cagccaccgcgcacacacccgagatccgatcccgcagcccagcccgtgagagaaagccgagcgccggaggaaaggtactgagcgagtttctgtaacaagaacgtgagggaggatgtctaccgctgaggcaacccgcgaggagaatgtgtacatggccaagctcgccgagcaggccgagcgttacgaggagatggtggagttcatggagaaggtggccaagaccgccgatgttggtgagctcaccgttgaggagcgcaacctgctctccgtggcctacaagaacgtgattggtgcccggagggcgtcctggaggatcatctcctccattgagcagaaggaggagagccgtggcaacgaggcctatgttgcctccatcaaggagtaccgtaccaggatcgagaccgagctgagcaagatctgcgatggcatcctcaagcttctggattcccacctcgtcccctctgccaccgcagctgagtccaaggtcttctacctgaaaatgaagggtgattaccacaggtacctcgctgagtttaaggctggagctgagaggaaagaagcagccgagaacactcttgtagcatacaaatcagcccaggacattgccctcgctgacttgcctaccactcacccgataaggcttggacttgccctcaacttctctgtgttctactatgaaatcctgaactctccagaccgcgcttgcaaccttgccaagcaggcatttgatgaagctattgctgagctggactcccttggtgaggagtcatacaaggacagcaccttgatcatgcagcttcttcgtgacaacttgactctctggacctcagataacgcggatgagggtggtgatgagatcaaggaagcctcgaagcctgaaggagagggacactaactctcccttgtttctgcacaagtttatttctgagtcaatttcgcagctacctgtattattcgaatcataagatgtactagggtcagttgcactatgtgaatcataagctgtagtaggatcgtgctatgcgaagcgtgtcgagctgaagtacctagtggactacagtcatgagggcatcatgtgggcatcgttgcttcaggaacgcgttattagttcattagcagatttcaaactatttcctgtattgcagcacattattagtattgctgtattagcaattttcattggcttgttaatgattgatgatgctggcgtctaaactcctcaaaagttaacatatttttgtttttttgtcaaaaaaaaaaaaaaaaa

SEQ ID NO: 9496 - DNA, 1152 bp, Festuca arundinacea
cacacacccgagatccgatcccgcagccgagcccgtgagaaaaagccaggcgccagaggaaaggtactgagcaagtttctgtaacgaacgagacggaagatgtctaccgctgaggcaacccgtgaggagaatgtgtacatggccaagctcgccgagcaggccgagcgttacgaggaaatggtagagttcatggagaaggtggcgaagactgccgatgttggcgagctcactgttgaggagcgcaacctgctctctgtggcttacaagaatgtgattggtgcccggagggcgtcctggaggatcatctcatccattgagcagaaggaggagagccgtggcaacgaagcctatgttgcctcaatcaaggagtaccgtaccaggattgagactgagctgagcaagatctgtgatggcatcctcaagcttctcgattcccacctcgtcccctctgccactgcagctgagtccaaggtgttctacctgaaaatgaagggtgattaccacaggtacctcgccgagtttaaggcaggagctgagaggaaagaagcagccgagaacactcttgtagcatacaagtcggcccaggacattgccctcgctgacttgcctaccactcacccgataaggcttggtcttgcactcaacttctctgtgttctactatgaaatcctgaactcgccagaccgcgcttgcaaccttgccaagcaggcatttgatgaagctattgctgagctggactcccttggtgaggagtcctacaaggacagcaccttgatcatgcagcttcttcgtgacaacttgaccctctggacctcagataacgcggatgagggtggtgatgagatcaaggaagcctcgaagcctgaaggagaggggcactaacttgccctctgagtctgcacaagtttatttctgagtccatttcgcagctacctgtattattcggatcataagatgtactagggtcagttgcactatgtgaatcataagatgtagtaggatcgtgctatgcgaagcgtgtcgagctgaagtacctagtggactacagtcatgagggcatcatgtggaaatcgtcgcgtcgcttcaggagctgcgttattagttcattagcagatttcaaactatttcctgtattgcagcacattattagta

SEQ ID NO: 9497 - DNA, 1192 bp, Festuca arundinacea
cctccgcgagatcccgatcccgcagcagccgagcccgtgagaaaagccaagcgccagacgaaaggtactgagcaagtttctgtaacaaacaagagggaaaatgtctacggctgaggcaacccgtgaggagaatgtgtacatggccaagctcgccgagcaggctgagcgttacgaggagatggtagagttcatggagaaggtggcaaagaccgccgatgttggtgagctcactgttgaggagcgcaacctgctttctgtggcttacaagaatgtgatcggtgcccggagggcgtcctggaggatcatctcatccattgagcagaaggaggagagccgtggcaacgaagcctatgtggcctccatcaaggagtaccgtaccaggattgagaccgagctgagcaagatctgtgatggtatcctcaagcttctggattcccacctcgtcccctctgccactgctgctgagtccaaggtcttctacctgaagatgaagggtgactaccacaggtacctcgctgagttcaaggccggagctgagaggaaagaagctgccgagaacactcttgtagcatacaagtctgcccaggacattgccctcgctgacttgcctaccactcacccgataaggcttggacttgcactcaacttctctgtcttctactatgaaatcctcaactcgccagaccgcgcttgcaaccttgccaagcaggcatttgatgaagctattgctgagcttgactcccttggcgaggagtcctacaaggacagcaccttgatcatgcagcttcttcgtgacaacttgactctctggacctccgataacgcggatgagggtggtgatgagatcaaggaagcctcgaagcctgaaggagaaggacactaactctcccttgagtccgcacaaatttatttccgagtccatttcgcagctacctgtattattcggatcataagatgtactagggtcagttgcactatgtgaatcataagatgttagtaggatcgtcgtgctatgcgaagcgtgtcaagctgaagtacctagtggactacagtcatgagggcatcatgtggaaatcgtcgcgtcgcttcaggaactgcgttattagttcattagcagatttcaaactgtttcctgtattgcagcacattatttgtattgctgtattagcaattttcattggcttgttaatga

SEQ ID NO: 9498 - DNA, 1467 bp, Lolium multiflorum
cttcctcccacgaacctcctctacatacatacaccagccaccgcgcacacccgagagagcccgtgagagaaagcagagcgccacaggaaaggtactgagcaggtttctgtaacaaacaagagggaggatgtctaccgccgaggcaacccgcgaggagaatgtgtacatggccaagctcgccgagcaggccgagcgttacgaggagatggtggagttcatggagaaggtggccaagaccgccgatgttggcgagctcactgttgaggagcgcaacctgctctccgtggcctacaagaacgtgattggtgcccggagggcgtcctggaggatcatctcctccattgagcagaaggaggagagccgtggcaacgaggcctatgttgcctccatcaaggagtaccgtaccaggatcgagactgagctgagcaagatctgcgatggcatcctcaagctcctggactcccacctcgtcccatctgccaccgctgctgagtccaaggtcttctacctgaaaatgaagggtgattaccacaggtaccttgccgagttcaaggcaggagctgagaggaaagaagcagctgagaacactcttgtagcatacaagtcagcccaggacattgccctcgctgacttgcctaccactcacccgataaggcttggacttgccctcaacttctctgtgttctactatgaaatcctgaactctccagaccgcgcttgcaaccttgccaagcaggcatttgatgaagctattgctgagctggactcccttggtgaggaatcttacaaggacagcaccttgatcatgcagcttctgcgtgacaacttgactctctggacctcagataacgcggatgagggtggtgatgagatcaaggaagcctcaaagcctgaaggagagggacactaactctcccttgtctgcacaagtttatttctgagtcaatttcgcagctacctgtattgttcgaatcataagatgtactagggtcagttgcactatgtgaatcataagctgtagtaggatcgtgctatgcgaagcgtgtcgagctgaagtacctagtggactacagtcatgagggcatcatgtgggcatcgttgcttcaggaacgcgttattagttcattagcagatttcaaactatttcctgtattgcagcacattattagtattgctgtattagcaattttcattggcttgttaatgattgatgatgctggcgtctaaacacctcaaaagtttacctatttttatttcttttgtcaacttggtgagatgttctattgtggtgagctctgttctggaacggagcctccagctatataccttctccaataacagtaccaaatctaagaaaatttggtggcatggttacttcgtattttacaagaagagacgttatgtttataatcgttacttctgctgaactcaaaccctcatttctgattccaccatctagcattttaa

SEQ ID NO: 9499 - DNA, 1425 bp, Avena sativa
gcagacgagagcagaagcccgtgagaaaagccaagcgcccgaggaaaagatacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagacagctgatgttggtgagctcactgttgaggagcgcaacctgctttctgtggcttacaagaatgtgattggtgcccggagggcttcctggaggatcatctcatccattgagcagaaggaggagagccgtggcaacgaagcttatgtggcttcaatcaaggagtaccgtaccaggattgaaactgagctgagcaagatctgtgatggcatcctcaagcttctggattcccaccttgtcccctctgccactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccactcacccaataaggcttggacttgcactcaacttctcagtgttctactatgaaatcctgaactcgccagaccgtgcttgcaaccttgccaagcaggcatttgatgaagctattgctgagctggactcccttggtgaggagtcatacaaggacagcaccttgatcatgcagcttctccgtgacaacttgactctctggacctctgataacgcggatgagggtggtgatgagatcaaggaggcctcgaagcctgaggaggggcactaacttgcccacaagtctgctcaaagtttatttcctgagtccatttcgcagctacctgtattattcgaatcataagatgtactagggtcggttgcactatgtgaatcataagaagtagtaggatcgtgctatgcgaaagtgtcgagctgaagtacctagtggactacagtcatgagggcatcatgtggacatcgtcgcttcaggaactgcgttactagtcattagcagatttcaaactatttcctgtgttgcagcacattattagtattgctgtattagcaattttcattggcttgttaatgattgaagatgctggtgccttaactcctggttttttgtattctcttagctgttgttttgagatgttcttctgttgtgatcccgccagaagacgacgatggcgcggatctcttcgccgcagcgtcctctgctggccgtggccgtggggagtccgcgatcccgccctcccccaccatcccgcccttctcctccttctccggcgctggccgcggtcgtggatcgcctttgcccccgccgccgtccgtcgaagatgcccccaagcaacc

SEQ ID NO: 9500 - DNA, 1275 bp, Avena sativa
ctcgaacctacatacaacagcgcacacagccccccgagatcggatccgcagacgagagcagaagcccgtgagaaaagccaagcgcccgaggaaaaggtacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagaccgctgatgttggtgagctcactgttgaggagcgcaacctgctttctgtggcttacaagaacgtgattggtgcccggagggcatcctggaggatcatctcatccattgagcagaaggaggagagccgtggcaacgaagcttatgtggcttcaatcaaggagtaccgtaccaggattgaaactgagctgagcaagatctgtgatggcatcctcaagcttctggactcccacctcgtcccctctgccactgcagcagagtccaaggtgttctacctgaaaatgaagggtgattaccacaggtaccttgcggagttcaaggcgggagctgagaggaaagaagcagccgagaacactcttgtagcttacaaggctgctcaggacattgcacttgctgacttgcctaccactcacccgataaggcttgggcttgcactcaacttctcagtgttctattatgaaatcctgaactctccagaccgtgcttgcaaccttgccaagcaggcatttgatgaagctattgctgagctggactcccttggtgaggagtcatacaaggacagcaccttgatcatgcagcttctccgtgacaacttgactctctggacctctgataacgcggatgagggtggtgatgagatcaaggaggcctcgaagcctgaggaggggcactaacttgcccacaagtctgctcaaagtttatttcctgagtccatttcgcagctacctgtattattcgaatcataagatgtactagggtcggttgcactatgtgaatcataagaagtagtaggatcgtgctatgcggaagtgtcgagctgaagtacctagtggactacagtcatgagggcatcatgtggacatcgtcgcttcaggaactgcgttactagtcattagcagatttcaaactatttcctgtgttgcagcacattattagtattgctgtattagcaattttcattggcttgttaatgattgaagatgctggtgccttaaaaaaaaaaaaaaagggcggccgcccttttttttttttttttgtag

SEQ ID NO: 9501 - DNA, 1249 bp, Avena sativa
ccccctcccacgaacctacatacaacagcgcacagaccccccgagatcggatccgcagacgagagccgaagcccgtaagagaagcgaagcgcccgaggaaaaggtacttgtcaagttcctgtaactaacgagagggaagatggctgctgaggcaacccgtgaggagaatgtttacatggccaagctcgccgagcaggctgagcgttacgaggagatggtagaattcatggagaaggtggccaagactgctgatgttggcgagctcactgttgaggagcgcaacctgctctctgtggcttacaagaatgtgattggtgcccggagggcttcctggaggatcatctcatccattgagcagaaggaggagagccgtggcaacgaagcttatgtggcttcaatcaaggagtaccgtaccaggattgagactgagctgagcaagatctgtgatggcatcctcaagcttctggattcccacctcgtcccctctgcaactgcagcagagtccaaggtgttctacctgaaaatgaagggtgattaccacaggtaccttgcggagtttaaggcgggagctgagaggaaagaagcagccgagaacactcttgtagcatacaaggcagcccaggacattgcacttgctgacttgcctaccactcacccgataaggcttggacttgcactcaacttctcagtgttctactatgaaatcctgaactcgccagatcgtgcttgcaaccttgccaagcaggcatttgatgaagctattgctgagctggactcccttggtgaggagtcatacaaggacagcaccctgatcatgcagcttctccgtgacaacttgactctctggacctctgataacgcggacgagggtggtgatgagatcaaggaggcctcgaagcctgaggaggggcactaacttgcccgcaagtctgctcaaagtttatttcaagagtccatttcgcagctacctgtattattcggatcataagatgtactagggttggttgcactatgtgaatcataagaagtagtaggatcgtgctatgcgaagcgtgtcgagctgaagtacctagtggactacagtcatgagggcatcatgtggacatcgtcgcttcaggaactgcgttactagtcattagcagatttcaaactatttcctgtgttgcagcacattattagtatttctgtattagcaattttcattggcttgttaatgattgaagatgctggtgccttaactcctgttttt

SEQ ID NO: 9502 - DNA, 1212 bp, Avena sativa
gcacagaccccccgagatcggatccgcagacgagagccgaagcccgtaagagaagcgaagcgcccgaggaaaaggtacttgtcaagttcctgtaactaacgagagggaagatggctgctgaggcaacccgtgaggagaatgtttacatggccaagctcgccgagcaggctgagcgttacgaggagatggtagaattcatggagaaggtggccaagactgctgatgttggcgagctcactgttgaggagcgcaacctgctctctgtggcttacaagaatgtgattggtgcccggagggcttcctggaggatcatctcatccattgagcagaaggaggagagccgtggcaacgaagcttatgtggcttcaatcaaggagtaccgtaccaggattgaaactgagctgagcaagatctgtgatggcatcctcaagcttctggattcccacctcgtcccctctgcaactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccactcacccaataaggcttggacttgcactcaacttctcagtgttctactatgaaatcctgaactcgccagatcgtgcttgcaaccttgccaagcaggcatttgatgaagctattgctgagctggactcccttggtgaggagtcctacaaggacagcactttgatcatgcagcttctccgtgacaacttgactctctggacctctgataacgcggacgagggtggtgatgagatcaaggaggcctcgaagcctgaggaggggcactaacttgcccacaagtctgctcaaagtttatttcctgagtccatttcgcagctacctgtattattcgaatcataagatgtactagggtcggttgcactatgtgaatcataagaagtagtaggatcgtgctatgcgaggtgtcgagctgaagtacctagtggactacagtcatgagggcatcatgtggacatcgtcgcttcaggaactgcgttactagtcattagcagatttcaaactatttcctgtgttgcagcacattattagtattgctgtattagcaattttcattggcttgttaatgattgaagatgctggtgccttaactcct

SEQ ID NO: 9503 - DNA, 1325 bp, Avena sativa
ccctccctcgaacctacatacaacagcgcacacagccccccgagatcggatccgcagacgagagcagaagcccgtgagaaaagccgagcgcccgaggaaaaggtacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagaccgctgatgttggtgagctcactgttgaggagcgcaacctgctttctgtggcttacaagaatgtgattggtgcccggagggcatcctggaggatcatctcatccattgagcagaaggaggagagccgtggcaacgaagcttatgtggcttcaatcaaggagtaccgtaccaggattgaaactgagctgagcaagatctgtgatggcatcctcaagcttctggattcccacctcgtcccctctgccactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccactcacccaataaggcttggacttgcactcaacttctcagtgttctactatgaaatcctgaactcgccagaccgtgcttgcaaccttgccaagcaggcatttgatgaagctattgctgagctggactcccttggtgaggagtcatacaaggacagcaccctgatcatgcagcttctccgtgacaacttgactctctggacctccgataacgcggatgagggtggtgatgagatcaaggaggcctcgaagcctgaggaggggcactaacttgcccacaagtctgctcaaagtttatttcctgagtccatttcgcagctacctgtattattcgaatcataagatgtactagggtcggttgcactatgtgaatcataagaagtagtaggatcgtgctatgcgaagcgtgtcgagctgaagtacctagtggactacagtcatgagggcatcatgtggacatcgtcgcttcaggaactgcgttactagtcattagcagatttcaaactatttcctgtgttgcagcacattattagtactgctgtattagcaattttcattggcttgttaatgattgaagatgctggtgcctaaacgccttttttgtaatttcttagttgtcgttttgatattttctattgttgtgatccctgtctccaggacctggagagttgttccttggc

SEQ ID NO: 9504 - DNA, 1131 bp, Avena sativa
tacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggccaagacagctgatgttggtgagctcactgttgaggagcgcaacctgctttctgtggcttacaagaatgtgattggtgcccggagggcttcctggaggatcatctcatccattgagcagaaggaggagagccgtggcaacgaagcttatgtggcttcaatcaaggagtaccgtaccaggattgaaactgagctgagcaagatctgtgatggcatcctcaagcttctggattcccaccttgtcccctctgccactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccactcacccaataaggcttggacttgcactcaacttctcagtgttctactatgaaatcctgaactcgccagatcgtgcttgcaaccttgccaagcaggcatttgatgaagctattgctgagctggactcccttggtgaggagtcctacaaggacagcactctgatcatgcagcttctccgtgacaacttgactctctggacctccgataacgcggacgagggtggtgatgagatcaaggaggcctcgaagcctgaggaggggcactaacttgcccgcaagtctgctcaaagtttatttcaagagtccatttcgcagctacctgtattattcggatcataagatgtactagggttggttgcactatgtgaatcataagaagtagtaggatcgtgctatgcgaagcgtgtcgagctgaagtacctagtggactacagtcatgagggcatcatgtggacatcgtcgcttcaggaactgcgttattagccattagcagatttcaaactatttcctgtgttgcagcacattattagtactgctgtattagcaattttcattggcttgttaatgattgaagatgctggtgcct

SEQ ID NO: 9505 - DNA, 1186 bp, Allium cepa
atcattcagacccatgctttcttcacgtgtcggaatcactacagttaaaagcgatcctctttatgctctttttcatcgatccatttcgccctaatttgaatccagataacattttcagagctcaaagaggaagctgaagaatatttcaaactaaaaaaagcaaggagaaatgtcttcatctcgtgaggaaaacatatacatggctaagctggcagaacaggcagagagatacgaagagatggtagaattcatggaaaaagttgtaaaaacagttgataccgaggagctcagtgtagaggagaggaaccttctctcagtcgcctacaaaaatgtgattggcgcgcgtcgtgcttcttggcgtatcatatcctcaattgagcaaaaggaggagagccgtggtaatgaggatcatgtgaatataatcaaggagtatcgtgcaaaaattgaggctgagctcaccaagatttgtgatgggatccttaagctgttggactctcacctagtcccttcctctactactgcagagtccaaagtattttacctcaagatgaagggtgactaccataggtaccttgctgagtttatgactggtgatgctagaaaagaggcagctgagagtacactcactgcatacaagtctgctcaggatatcgcccttgctgagatgacttctactcatccaataagactgggattggcactcaacttctctgtgttctattatgagattctaaactcacctgatcgtgcttgcagccttgccaaacaggcgttcgatgatgctatctcagaacttgacagtctgggcgaggaatcatacaaagatagcacattgatcatgcaacttctccgagacaatttgactctatggacctctgacattacggatgaggcaggagatgagattaaggaggcaccaaagaaagagggagagggtcagtgagacagtaaatcctttatcaatatgcaagcaggtgtcggcttatattcatttgcatctgctcctgcgcttgtgctttcctatttatagatttagttgtattttttctgctttgtgataagatgctcaccactattttgagcttgttggcatacttttaaactaatatgttttattatcgctcttattttcttattgctgtttccagtgctgcaattgaaacttctgtaaggttatttcctccta

SEQ ID NO: 9506 - DNA, 1109 bp, Linum usitatissimum
gccactctatttcctctcttcaatcttcatctccgcctcttcctttcttattggttgttgtataatttatactgaataaagatgtcgccgtctgaagcttcccgcgaggacaatgtctacatggcaaagttggccgagcaggctgaacgttacgaggaaatggttgagtttatggagaaagttgccaagacagttgacgttgaggagctaaccgtggaggaaaggaacctactttctgtggcttacaagaacgtgattggggccagaagagcttcatggagaattatctcttccatcgagcagaaagaagaaagcaggggaaatgaggaccatgtttctattatcaaggagtacaggtccaagattgaaactgagttgagcaagatttgtgatggcatcctgaaccttcttgagtctcatctcattcctgctacctccgccgctgagtctaaggtcttttaccttaaaatgaagggtgactaccataggtatcttgcagagtttaaaactggagctgagaggaaggaagctgctgagagcaccttgttggcttacaagtccgctcaggatattgcccttgctgatttggctcctacacacccaatccgtttgggactggcgcttaacttctccgttttctactatgagatcctcaactcgcctgatcgggcatgcaatcttgcaaaacaggcttttgatgaggccatctccgagctggacacactaggggaagaatcatacaaggacagcacattgatcatgcaattgctccgtgacaatttgacactgtggacttctgatatcactgatgatgctggagatgagatcaaggaagcatcaacgaagcgtgattcaggagagggacaacaatagttgagcatcctttagggattacgcgtgtaatctattgtgtactatttgtcgtttgatgcacaagtgcaatggattagaagaaagtatgatgatggggtgggattggagtagggtctgtttacatggatcgatgtgtcttttttttcgtggccgacgcctgtgtttgcaatggctttggttagtccagttgagaatgttggattgttgttagaatcctaatggtaatgcaatggttt

SEQ ID NO: 9507 - DNA, 1067 bp, Tropaeolum majus
tcgatcgctttctagatctatatagttaagatgtcgccagcagatgcaccacgagaggacaatgtatatatggctaagttggccgagcaggctgaacgttacgaggagatggtagagttcatggagaaagttgcaaagactgtggatgttgaggagcttacagtggaggaaaggaacctcctctcagtggcttacaagaatgtcataggagctagaagggcttcgtggaggataatctcttccattgaacagaaggaagaaagcaggggaaatgaggatcatgtttcaatcatcaaggagtacagaggcaagattgaggctgaactcagcaagatctgtgaaggaattttaagccttctcgagtcacatctagttccctcagcctcttctgctgagtccaaggtcttctaccttaaaatgaagggtgattaccacaggtatcttgctgagtttaagactggtgcagaaaggaaggaagctgctgaaagcactcttctggcatacaagtctgcccaggatattgctcttgctgaattggctcccactcaccctatcaggcttggacttgcacttaacttctcagtattctattatgaaattcttaattcacctgatcgtgcatgcaatctcgcaaaacaggcttttgatgaagctatctctgagctagatacattggggggagagtcatacaaggacagtacattgatcatgcaactccttcgcgacaatttgacactttggacttcagacatcacggatgacgccggggatgagatcaaggaagcatcaaagcgtgactcgggtgagggacaaccacagtgatgagctgaattaataggatatgtactctgtacttttatcttgtgacatttaatagatcccatgtgggttttctgtatcagaatcctcaaaagattgataaacccagtggactatatttggctttattattgatgagtttgatcttgtttggtgttttaagcttattactgctcctctatttgatcttgtgctgaagtcaatgttttgctttctaaatgtaacttggtgcttgaatgcactgatct

SEQ ID NO: 9508 - DNA, 971 bp, Lippia dulcis
atcgaatcggttcgtcaaaggctggcatttcccgaatcaaactccagatctatttctacaggtgttatactattttagcacattaaaatgtcaccagccgagtcatcccgggaggagaatgtttacatggccaagttggctgaacaggctgaacgttatgaggaaatggttgagtttatggaaaaggtggcaaaggctgttgatagtgatgagctgactgtggaggaaaggaatctcctctcagtggcatacaagaatgtgattggtgctcggagggcttcatggaggattatatcttccatcgaacagaaggaagagagtcgtggtaatgaggatcatgttagcattattaaagaataccggggtaagattgaggcggaactaagtaagatatgtgatgggattttggggctccttgagacccatctcattccatctgcctcttctgcggaatcaaaggtgttttacttgaagatgaagggtgattatcatcggtacttggctgaatttaagactggggctgaaaggaaagaagcagctgagagcactctgcttgcttacaagtcagcgcaggatattgcacttgcagagttggctcctactcaccctataagactgggacttgctcttaatttctctgttttctattatgaaatccttaactctccggatcgtgcttgcaaccttgcgaagcaggcttttgatgaagctattgctgagctagatacgctgggcgaggaatcatacaaggacagcacattgatcatgcaacttcttcgagacaatttgactctttggacatctgatatagcggacgaagctggggatgagattaaggaaactgcaaaaggtgaatctggcgagggaggacaacagtgatagcattgtattgtgttggatgtattctggaatatgtttttagtatagaaatccttgtgccgtagtaagacttgaatggttatcttatgtgt

SEQ ID NO: 9509 - DNA, 1288 bp, Hordeum vulgare
aggcactgaactaggttgtaacaaggaacagggaagatgtctaccgctgaggcaacccgtgaggagaatgtgtacatggccaagctcgctgagcaggctgagcgttacgaggaaatggtcgaattcatggagaaggtggcaaagaccgctgatgtcggtgagctcactgttgaggagcgcaacctgctgtctgtggcttacaagaatgtgattggtgcccggagggcatcctggaggatcatctcctccattgagcagaaggaggagagccgtgggaacgaggcctatgtcgcttcgatcaaggagtaccgtaccaggattgaaactgagctcagcaagatctgcgatggcatcctcaagcttctggactcccacctcgtcccctctgccactgcagcagagtccaaggtgttctatctgaaaatgaagggtgattaccacaggtaccttgcggagttcaaggccggtgctgagaggaaagaagcagctgagaacactcttgttgcgtacaagtcagcccaggacattgctcttgctgacttgcctaccactcacccgattaggcttgggcttgcactcaacttctcagtgttctactatgaaatcctgaactctccagaccgtgcttgcaaccttgccaagcaggcatttgatgaagctattgctgagctggactccctcggcgaggaatcctacaaggacagcaccttgatcatgcaacttcttcgtgacaacttgaccctctggacctccgataacgcagaggagggtggtgatgagatcaaggaagctgcctcaaagcctgagggagaggggcactgattggccctcaagagtgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttcgcgtaaggcgcccccaaagcttgtgcctttcttatgaggcaacaactgagattttcttgtctactttccctctcaaaataattgaagttctaggattcttcccttagcttaattatgaaatgtattttcgtattattatatcgatcaacatgttcaacatcaa

SEQ ID NO: 9510 - DNA, 1358 bp, Pinus taeda
gttgattgtatgtgttgcacagcctttcaggaggaggagaagctagcgggaaaaggcgcgccgttgctgccgaggtttggccttttggaaacacggatctctgcgtcccttgacgccattgaggattttgatctttcggtttaggttttcttttcagggaaaatgtcgcctgcggagtcttctcgtgaagaaagtgtgtatatggccaagcttgctgaacaggcagagcgctatgaggagatggtagagtacatggagaaagttgccaagacagtagatgtggaggaacttactgtcgaggaaaggaatctgctgtcagtggcttataagaatgtaattggagctcgcagggcttcatggaggataatttcctccattgaacaaaaggaagagagtaggggaaatgaagaacacgttactatgataagagaatacagaggcaaggttgagtctgagctcagtaatatttgtgatggcattctacgtcttctggatacacatcttatcccgtcatccacatctggtgagtccaaggtattttatcttaagatgaagggtgattaccatcgatatcttgcagaatttaaaactggtgctgagaggaaggaagctgctgaaagtacattgcttgcatacaaggcagcccaggacatcgcgactgcagagttggctccaactcaccctatcagactgggactggcccttaacttttctgtattctattatgagattttgaattcaccagatcgtgcctgtacacttgccaagcaggcctttgacgaggcaattgcagagcttgatacgttaggtgaagaatcttacaaggatagcactttgatcatgcagctccttcgtgataacctcacgttatggacttcagacatgcaggaggagactggaggagatgaaatcaaagaagcaccgaagaaagaagaaggtgatggacactgaaggtgatggacgctgacatcttttttatgaatgaaatcgattaggatggtgaaggggatgaacgtcaatgtttatccgtaaatgactgtcaagtaggttagattcatgagatatggtcaaatatgttgtattagaggttttagagtgtttttgtggttttctgcacgattgtgtgctaagggggatctttcagcaaattctcctataaaatctgctgccctgcaagattttattgttgcagggtactgctttgtactccaatcataccatggagggcacacttaaagttgttatttaagtgttattgatgtcatttggaaggatccctgcttgtcagtggatggatatggtaccctgcagacctgggattgtaataacatagtggataaattactgcaagttctaat

SEQ ID NO: 9511 - DNA, 1256 bp, Amaranthus tuberculatus
tcttttcttcacttcctatttcttactttttcctaaattcaaacttgaaaccgtgatcaatacccatttccagtgaggaaagatgtcaacagctgaaggatctcgggatgagaatgtttacctagccaaattggccgaacaagccgaaagatatgaggaaatggtggagttcatggagaaggtagcgaaaactgttgatggtgaggagttaacagtagaagagaggaaccttctttctgtagcttacaagaatgtgattggtgctaggagagcttcttggagaattatctcttccattgaacaaaaggaagagagtcgtggaaacgacgatcatgtagctaatattaaacagtacagagcgaaaattgagactgaactaagcaagatttgtgatggaatattgaaacttcttgactcacatcttgtcccatcagcaaccgctgctgagtcgaaggtgttctatttgaagatgaagggtgattaccataggtatttggccgaatttaagactggaacagagagatcggaagctggtgagcataccttgttggcttacaagtctgctcaggatgttgcgctggctgaattagctcctactcacccaataaggttggggcttgctcttaacttttcagtgttctactacgagatcttgaattctcctgatcgtgcttgtgctcttgctaagcaggcttttgacgaagccatttcggagctggacacacttggtgaggaatcatacaaagatagcaccttgattatgcagcttctccgtgataatctgacattatggacttccgatactacggatgatgtcggggatgagatcaaagaagcttcaaaagacgaagcagctcccgtgcagtaatgaaatggttattatttcctaaactaagtaggaggcgttggatgaaatgtatttatttaaccgtaggctcttactatactcgatatgtttgtttgtcattggcagcctcaatcagacgcttaatatcttaccaagataccgtggttcgttttttctgtctacttcatcggtttgaactatttgaggttaagtgtcctcttctcaagatgcatcgactaataccaatgcagtcaataatttttcgattgtattttgcactttccacagttggagttcttttagtttatcactaaaattctgtattttcgcaatctaagatcgaatacttttgtccttgtattgtctgtttctggagcttacatttgttttggtgtttagaaaagaaaaa

SEQ ID NO: 9512 - DNA, 1412 bp, Hordeum vulgare
cgaacccaccccacagccagcgcccactcgcccgagatccgctgccgaggcccgtgagaactccgccgcgccagaggaaaaggcactgaactaggttgtaacaaggaacagggaagatgtctaccgctgaggcaacccgtgaggagaatgtgtacatggccaagctcgctgagcaggctgagcgttacgaggaaatggtcgaattcatggagaaggtggcaaagaccgctgatgtcggtgagctcactgttgaggagcgcaacctgctgtctgtggcttacaagaatgtgattggtgcccggagggcatcctggaggatcatctcctccattgagcagaaggaggagagccgtgggaacgaggcctatgtcgcttcgatcaaggagtaccgtaccaggattgaaactgagctcagcaagatctgcgatggcatcctcaagcttctggactcccacctcgtcccctctgccactgcagcagagtccaaggtgttctatctgaaaatgaagggtgattaccacaggtaccttgcggagttcaaggccggtgctgagaggaaagaagcagctgagaacactcttgttgcgtacaagtcagcccaggacattgctcttgctgacttgcctaccactcacccgattaggcttgggcttgcactcaacttctcagtgttctactatgaaatcctgaactctccagaccgtgcttgcaaccttgccaagcaggcatttgatgaagctattgctgagctggactccctcggcgaggaatcctacaaggacagcaccttgatcatgcaacttcttcgtgacaacttgaccctctggacctccgataacgcagaggagggtggtgatgagatcaaggaagctgcctcaaagcctgagggagaggggcactgattggccctcaagagtgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttcgcgtaaggcgcccccaaagcttgtgcctttcttatgaggcaacaactgagattttcttgtctactttccctctcaaaataattgaagttctaggattcttcccttagcttaattatgaaatgtattttcgtattattatatcgatcaacatgttcaacatcaattttattcccttattttaattttgaaatgtatttctgtattttt

SEQ ID NO: 9513 - DNA, 1100 bp, Cucurbita pepo
ttatttcctgctaattcccaatccttttctctgtgctccattttctcgagagaattagtagtttgttaaattgaggatgtcgcgggaggaaaatgtttacatggccaagttggccgaacaggcagaacgatatgaggaaatggttgagttcatggagaaagttgcaaagacagtggatgtcgaggagatgaccgttgaggagaggaatctcctctctgttgcttacaagaatgtcattggggctcgaagggcctcatggaggattatttcttccattgagcagaaggaagagagtcgaggaaatgaggaccatgtcgcaattatcaaggattaccgtagcaaaattgagactgaactgagcaagatctgtgatgggattttgagcctacttgagtctcatctcatcccatcagcctcatctgctgagtccaaggtgttttatctcaaaatgaagggtgattaccacaggtaccttgctgagtttaagactggagctgaaaggaaagaagcagctgagagcacactgttagcctacaagtctgctcaggatattgctcttgctgaattggctcctactcatccaattaggctcggtcttgctcttaacttctcagtgttttattatgagatccttaattcgccagaccgtgcttgcaatttggcaaagcaggcttttgacgaagcaatttctgagctcgacacattgggtgaagaatcatacaaggatagcaccttgatcatgcaactcctccgagacaacttgaccctttggacttctgatattggggatgaagctggcgatgagattaaggaagcatcgaaacgtgaatcaggggagggcggacagtagtttgggttgttagttgatacttgataggtgttgtactctgtactcttttcattgttcccctgttctttagtgttgttgttgttgttgttagtagttctgaatgaaatgttcttgattgatagctttggcttttgagtgcaagatctggatgcacttttagggcctttgaatactcctacacaagtaatgtggttttattattcacgagaagaaattggtgtttggtgttcgaatgtcatggaatatcaac

SEQ ID NO: 9514 - DNA, 1239 bp, Curcuma longa
gcaccctttaagaaccctaattttggaaggaggcaggaatctgccttcaaggtctagcaaaatgcctcccatggaatcctcacgcgagaataatgtgtatttggccaaacttgccgagcaggcagagaggtacgaggagatggtggagttcatggaaaaggtggtgagaacgatcaacggggaggagcttagcgtggaggagcgcaacctcctctcagtggcctataagaacgtgatcggggctagacgtgcctcttggcgtattatctcttccattgagcagaaggaggagagtcgcggcaacgaggaacacgtcacagtcatcaaggagtatcgtgggaaggtggaggcggaactcggcaagatctgtgatgggattcttaagctgctggattcccatcttgtaccatctgccagttctgctgaatccaaggtgttttaccttaagatgaaaggtgactatcacaggtaccttgcagaattcaagactggagctgagaggaaagaagctgctgagagcaccatgttggcttacaaatctgcccaggatactgctttagctgatctagctccaactcatcccataaggcttgggctggcacttaacttctccgtgttctattatgagattcttaattcacctgatcgcgcttgtagccttgcaaagcaggcatttgatgaggctatctctgagcttgataccttgggtgaagaatcatacaaggacagtacattgattatgcagcttctccgagacaatttgacattatggacctcagatattatggaggatggaggtgatgagattaaggaaggcccaaagaaggagtcaggagacgaccagtgatcttcatttagttcctctttattttgcagtagaatggattgttgtttaagtgggtttagatgctaagtttcatatgcttgtcgactagtattgccaaaaaaattggatatctagttatcttgagtgtttttatgtagtcgatccgaaactatttgaagttgcggcttgttggtgccgcgagatctgcaagcttgcgacggaaaaatctaggagtgcagagaaaacaatcttgcttgcttagttgatcttcctacagcagcattggagaagatttcatcatggattttttccatcttaactttatgatggatgtggcttggcttcatggcaattatttgtatcaaacttcgtaatgtgggaagtagaacgatgcacttgcgtgtggcaattat

SEQ ID NO: 9515 - DNA, 1141 bp, Fagopyrum esculentum
gggcacaccttaccaatacctatctacggagctccaactcgctgagaaacacagagatccctattttcaggagaaagattaagaatctgtgaggaaacatgtcggctgagggatccagggaagagaatgtgtatctagccaaactagccgagcaggctgagaggtacgaggagatggttgagttcatggagaaggtagccaagacggttgacgttgaggaattgaccatagaggaaagaaatcttctttctgttgcttacaagaatgtgataggtgcaaggagggcggcttggagaatcatttcatcaattgaacaaaaggaagagagtcgtggaaatgatgatcatgtttccaccattagagattacagggctaagattgaggatgaactcagcaagatctgtgaagggatactcaagcttctggattcacaccttgtacctgctgccacagctgcagaatcaaaggtcttctatttgaagatgaagggtgactaccacagatatttggctgagtttaagacaggagctgagaggaaagaagctgctgaaagcactttggtggcttacaaggctgcacaggacattgctcttggcgatttagctcctactcacccaataaggctgggacttgctcttaatttttcagtgttctactatgaaatcttgaactcgcctgatcgtgcttgcaatctcgctaaacaggcattcgacgaggccatatcagagcttgataccctaggagaggaatcctacaaggacagcacactgatcatgcagcttctccgtgacaacttgacactctggacatctgataccgcggatgaaactggtgaagagatcaaggaagctgctcccggggaaggagctgatggaaaatgattattggattctaaagaaatttaagcaaatggatgttgttttctttgtttacaacccttctttctagtgtttggcttaatggattgccttaatgtattatggcttcttattctcagacactactttaatttactgctcaagtttaaagcttacacttatctcctgctatggattcgttcttcaagttaatctaggctcgaaggcgacgactgctggaaataagacatttaatcaaaaattggttttgtgattggagtata

SEQ ID NO: 9516 - DNA, 1021 bp, Vitis vinifera
attcactccccgtgctttcctttcccaactcacatttgaattaggtcttaatttgtcataacaaagatgttgttgaccgaatcatctcgggaggaaaatgtttacatggccaagttggctgaacaggctgaacgatatgaggaaatggtagagttcatggaaaaagttgcaaagacagttgaagtcgaggagctgacagtggaggaaaggaacctcctctctgttgcttacaaaaatgtgattggggctaggagggcttcatggagaattatctcgtccattgagcagaaggaagagagcaggggaaatgaagatcatgtagcgattattaaggattatagggcaacaattgaagcagagctcagcaagatttgtgatgggattctaagccttctagaatcacatcttattccctcagccgtaattgctgagtctaaggtgttttacctcaagatgaaaggtgattaccacaggtacctagctgaatttaagactggacctggtaggaaagaggctgcagagagcactttgttggcttacaaatctgctcaggacattgctcttgctgaactagctcctactcacccaataaggctggggcttgctcttaacttctctgtcttctattatgaaatccttaactcaccagaccgtgcttgcaatcttgcaaagcaggcttttgatgaggctatctctgagctggatacgttaggtgaagagtcatacaaggacagtacattgatcatgcaacttctccgagacaacttgactctgtggacttctgatatcacggatgatgctggagatgacatcaaggaagcatcaaagcgtgaatcaggggaagggcagccgtgatgaattcatcatagaagatgtgctctgtactattcagtctgtgaccctaatatagatgccatttgggttgttgtataagtatttgcttaatgaagtcgaacatctttagtgcgggtggtgctcagggttgaaatgttcccaaattataatttgctttgtttcaatc

SEQ ID NO: 9517 - DNA, 870 bp, Heritiera littoralis
gaaacaaatcaaaataaaacagaatcgtcgattggatcaggtattagattgatatagtaaagatgtcgccgactgaatcaacacgagaggaaaatgtttacatggccaagttggctgagcagactgaacgctacgaggaaatggtggagttcatggagaaagttgcaaaaactgttgatgttgaggagctgactgttgaggaacggaaccttctctctgtggcttacaaaaatgtgattggggctaggagggcttcatggaggatcatctcttccattgagcagaaggaagagagcagaggaaatgaggatcatgttgcaatcataaaggagtataggggcaagattgaggctgagctcagcaagatctgtgatgggattttgagccttattgaatctcacctcatcccgtcagcctcgtctgctgagtccaaggtgttttaccttaagatgaagggtgattatcacaggtatcttgctgagtttaagactggtgctgagaggaaggaagctgctgagagcactttgttggcttacaagtctgctcaggatattgctcttgctgaacttgctcctactcacccaattaggctgggtcttgctcttaacttctctgttttctactatgaaatcctcaactcacctgatcgtgcctgcaatcttgcaaaacaggcttttgatgaggctatttctgagttggatacattaggcgaggaatcttacaaggatagtacattgatcatgcaacttctccgggacaatcttaccctttggacgtctgacatcacggatgaaggtggagatgagatcaaggaagcttcaaagcgtgagtcaggcgagggacagcagtgatgagctaagttcataggat

SEQ ID NO: 9518 - DNA, 1407 bp, Leymus cinereus x Leymus triticoides
ccgttgctgtcgactattcctatcccccccgcctccccccttccacgaacccacagcgcacacccgagatccgcagccgaagcccgtgagaaaagcgaagcgcgcgaggaaaggcactgaacaagtttgtaacaaggaacagggaaaatgtctaccgctgaggcaacccgtgaggagaatgtgtacatggccaagctcgcagagcaggctgagcgttatgaggaaatggtcgaattcatggagaaggtggcaaagaccgctgatgttggtgagctcactgttgaggagcgtaacctgctctctgtggcttacaagaatgtgattggtgcccggagggcatcctggaggatcatctcctccattgagcagaaggaggagagccgtgggaacgaggcctatgtcgcttcaatcaaggagtaccgtaccaggattgaaactgagctcagcaagatctgtgatggcatcctcaagcttcttgactcccacctcgtcccctctgccactgcagcagagtccaaggtgttctatctgaaaatgaagggtgattaccacaggtaccttgcggagttcaaggcgggtgctgagaggaaagaagcagctgagaacactcttgtagcatacaagtcagcccaggacattgctcttgctgacttgcctaccactcacccgataaggcttggacttgcactcaacttctcagtgttctactatgaaatcctgaactctccagaccgtgcttgcaaccttgccaagcaggcatttgatgaagctattgctgagctggactcccttggcgaggaatcctacaaggacagcaccttgatcatgcaacttcttcgtgacaacttgactctctggacctccgataacgcagaggagggcggtgatgagatcaaggaagccgcctcaaagcccgagggagaggggcactgattggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcattggcttgttgatgattgatcatacttggcgtcaagtaccccaaagctcgcctttcttaagagggagcaattgagtttttcttgtctactccctctcaaaataatttgagttataataggattctctcaagtgtttgaccaagtctatataaaaatatatcagcatctataaaatcaattttattccattactttaatta

SEQ ID NO: 9519 - DNA, 1452 bp, Leymus cinereus x Leymus triticoides
gccacctctctcccacgaacccacagcgcacatccgcgagatccgcagccgaggcccgtgaagaaaagcgaggcgcgagaggaaaggcactggacaagttcgtcacaaagagcagggaaaatgtctaccgctgaggcaacccgtgaggagaatgtgtacatggccaagcttgccgagcaggctgagcgttatgaggagatggtcgaattcatggagaaggtggcaaagaccgctgatgtcggtgagctcactgttgaggagcgtaacctactctctgtggcttacaagaatgtgattggtgcccggagggcatcctggaggatcatctcgtccattgagcagaaggaggagagccgtggtaacgaggcatatgttgcttcaatcaaggagtaccgtaccaggatcgaaaccgagctcagcaagatctgtgatggcatcctcaagcttctggactcccacctcgtcccctctgccactgcagcagagtccaaggtgttctatctgaaaatgaagggtgattaccacaggtaccttgcggagttcaaggcgggtgctgagaggaaagaagcagctgagaacactcttgtagcatacaagtcagcccaggacattgctcttgctgacttgcctaccactcacccgataaggcttggacttgcactcaacttctcagtgttctactatgaaatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggagatgagatcaaggaagccgcctcaaagcctgagggagaggggcactgattggccctcaagagagtgtgcccaagtttatttctgagtccatttacgcagctacctgtatcattcggatcataagatgtactagggtcggttgcactatgtgaatcataagatggtagtaggatcgtgctatgagaagcgtgtcgagctgaagtgcctagtggactacagtccagtcatgaggacgtattgtggacatcgtcgcttcaggaactgcgttattagttcattagcagatttcaaactatttcctgtattgcagcacattgttagtattgctgtattagcaattttcattggcttgttgatgattaattctggcgtgatgcacccccaaaatttgcctttggtgatatgttgagcctcaactttggttatacagaccctgttcaaactcgttgagagtagctcccgtagactaccgaaaacactttcccctattcttgttacggggataatccgaataaatgttctatacgttttggctcccttaatgtatctatatctatacctactaataaagtacggagtgcttctgtccgttca

SEQ ID NO: 9520 - DNA, 1453 bp, Pinus pinaster
agcctccctcgttctttagcccttttgttgattgtatgtgttccacagcctttcaggaggaggagaagctagcgggaaaaggcacgccgttgctgccgaggtttggccttttggaaacacggatctctgcgtcccttgacgccattgaggattttgatctttcggtttaggttttcttttcagggaaaatgtcgcctgcggagtcttctcgtgaagaaagtgtgtatatggccaagctcgctgaacaggcagagcgctatgaggaaatggtagagtacatggagaaagttgccaagacagtagatgtggaggaacttactgtcgaggaaaggaatctgctgtcagtggcttataagaatgtaattggagctcgcagggcttcatggaggataatttcctccattgaacaaaaggaagagagcaggggaaatgaagaacacgttactatgataagagaatacagaggcaaggttgagtctgagctcagtaatatttgtgatggcattctacgtcttctggatacacatcttatcccttcatccacatctggtgagtccaaggtattttatcttaagatgaagggtgattaccatcgatatcttgcagaatttaaaaccggtgctgagaggaaggaagctgctgaaagtacattgcttgcatacaaggcagcccaggacattgcgactgcagagttggctccaactcaccctatcagactgggattggcccttaacttttctgttttctattatgagattttgaattcaccagatcgtgcctgtacacttgccaagcaggcctttgacgaggcaattgcagagcttgacacgttaggtgaagaatcttacaaggatagcactttgatcatgcagctccttcgtgataacctcacgttatggacttcagacatgcaggaggagactggaggagatgaaatcaaagaagcgccgaagaaagaagaaggtgatggacactgacatcttttttctgaatgaaatcgattaggatggtgaaggggatgaacgtcaatgtttatccgtaaatgactgtcaagtaggttagattcatgagatatggtcaaatatgttgtattagaggttttagagtgtttttgtggttttctgcacgattgtgtgctaatggggatctttcagcaagttctcctataaaatctgctgccctgcaagattttattgttgcagggtactgctttgtactccaatcataccatggagggcacacttaaagttgttatttaagtgttattgatgtcatttggaaggatccctgcttgtcagtggatggatatggtagcctgcagacctgggattgtaataacatagtggataaattactgcaaggtctaatattatactgtgatgtacgccattttttctgctcaccattatcgtcttttcaaagtggagatcacagattgttagtagtagttcat

SEQ ID NO: 9521 - DNA, 1179 bp, Avena sativa
actccttcctatcccccccctccctcgaacctacatacaacagcgcacacagccccccgagatcggatccgcagacgagagcagaagcccgtgagaaaagccaagcgcccgaggaaaaggtacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctgagggagaggggcactgattggctggccctcgagcgtgcccaagttatttcttgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattg

SEQ ID NO: 9522 - DNA, 1536 bp, Allium cepa
cttgggtcactagcctccgtttctcagttgggttttctcatttcactgtttctcaattccattttgccctaattcgatttacaagacataaaaggaaagatgtctccagctgagttgacccgtgaagaaaacatattcatggccaagttggcagaacaagctgagcgatacgaagagatggtcgaattcatggaacacgtggtaaaatcagttaatgctgaggagctctcggttgaggaacgtaaccttctatcggttgcttacaaaaatgtgattggggcccgccgtgcctcatggcgcataatctcctcaatcgagcagaaagaggagagccgtggaaatgatgatcacgtcaaattgatcaaggagtatcgtgcaaatgtcgaggcggaactcagcaagatatgcggtggtattttgaatcttttagaatctcacctaattccttcttctgtggctgccgagtctaaggttttctattacaagatgaaaggagattattacaggtaccttgctgagtttaagagtggcgacgagaggaaggaggcagctgagaatacgctcactgcttacaagactgctcaggacattgctcttgctgagatgcctccaactcatcccataagattgggcttagctctcaatttctcggtgttttactacgagattctgaactcgcctgaccgtgcctgtaaccttgcaaaacaggcgtttgatgaagccatctccgaacttgataatttgggtgaggaatcatacaaggatagcacgttgatcatgcaacttctgcgcgacaacttgactttatggacttctgacctcacggaggacgcaggagatgagatcaaggaggctccgaaaggcgagggtcagtgactttttaactgattccgagaccattagactatgtgtgcagatcatctgctgatctgcttagttgtagtagtcttggacataaattgctcaggcttgtactgagcttttttagtggtttgattactttctattgaagtatgtctaaccaatggatatttttccttgttctgtatctgtcattttctgaaatttgtagctcatgtaaaatgacgtatccatgctgtatcctgcaagtttatgtgcccttcaatccatcatggtagttagatttagcggaagatacagtaaatgttttttaagaatgttgcaactcaatttggaccgatacagtattgtcgtcagctttatgctacgcaatatgttatatttgtttgtatgttgcatgcttgatgaaaaagtaagttgcaactgcaaaatggattttaggtgatctcagtagatataaacttcgaagcatgaaatctgttatttgggaaggttggcctttatgaatagtatctatactagaatatttatttcggttcctatttgataattataatatagagcggattctattgtataattctatgtagcctaggtatttgttgcgttaataccacgttctactgttattgtcatgtatcaaaaatgaatttactgaatttcggtcttttaaat

SEQ ID NO: 9523 - DNA, 1195 bp, Papaver somniferum
tttgcgattctcaagagaaaaggaaaacaaacgccttcttccgagcagtctagctaactaagatgtctacatcacgagaggaaaatgtgtatttggctaaattagctgaacaagctgaacgatatgaagagatggttgagtttatggaaaacgttgccaaaactgttaatgtacaggaattaacagttgaggaacggaacttgttgtctgttgcttataagaatgtgattggagctaggagagcttcatggaggattatttcaagtattgaacagaaggaagaaagccgtgggaatgaagatcatgtttctattattaaagagtataggggaaagattgaatctgaacttcataagatttgtcaagggattttagggcttttggattcccatcttattccttcatcaactgctgctgaatctaaggtgttctaccttaagatgaagggtgattatcacaggtatttggctgagtttaaatcaggtagtgacaggaaagaagctgctgagagtacattgttggcttataagtctgctcaggatattgctttggctgaattgagtcccactcacccaataaggcttggacttgctcttaacttctcagtgttctactacgaaatcctaaactcaccagatcgtgcttgcactctagctaagcaggcatttgatgaggccatttctgaattggattccttgggtgaggaatcatacaaggatagtacattgattatgcaacttctccgagacaatttgaccttgtggacttcagacatcggcgaggatgctgacaatgagattaaggaagcttcaaaacatgatgagtccaagggtccagaataacactgatgggtttgaagtaatgaatgttttagtctatacaagtagcggttaggttttgtttgtctaagaatggaccaactcctacttgtgttgctatttatgttttatttagtagtttagttatagattgcttcttagtcttgtgtgcttgtggtttaatggcatttcttcttgtgatacagtcagaagaaaaagaaaagaaatgcctcacaatattttatggtactgaccaagtttgaaatatatttatttttgcatgtgaaattattagctagccgttcatacttttatcatgtgaaattattagcaagctgttcgtgcttttatcatttgaaatgaaagaatttgggttt

SEQ ID NO: 9524 - DNA, 1036 bp, Solanum tuberosum
cattcatatccctctattggagtcgtcttcttcttcttcttcttcgtcagagacatcaatcaccaggtaactttacagacaacaaacatggccgattcacgtgaagaaaatgtgtacatggccaagttggctgagcaggctgagaggtatgaggaaatggttgagtttatggagaaggttgcaaaggtagatgttgaagagctgactgtggaggaaaggaatcttctttctgtggcttacaagaatgtcattggtgcaagaagggcttcgtggaggataatatcttcaattgagcagaaagaggagagccgtggaaatgaagaccatgttagcagcattaaagaatatagagccaaaattgaggccgagctcagcaagatctgtgatgggattttgagccttctcgagtctcatttagtaccatcagcctcaacagccgagtccaaagtgttttacttgaagatgaaaggtgattaccataggtacttggctgagttcaagacgggggcagagaggaaagaagctgcagagaacactttattagcctacaagtctgctcaggatatagcattggctgaactgactcctactcatccaatcagactgggacttgcccttaacttttcagtgttctattatgaaattcttaactcacctgatcgtgcttgtaaccttgcaaagcaggcctttgatgatgccatcgcagagctggatacattgggtgaggaatcttacaaggacagtacattgattatgcagcttctccgagacaatctcacactttggacctctgataccacagatgatgccgaggatgagatcagggaaggttcaaaacaagagtcgggtgatggacagcagtgatatctaagtagccaagtcttgtactccttattttgtgattttcgacgactcttcgtatcactgctgaagttgtttgatataaaaacaggttttagtctgataaaagaaacatgtttagtacaatttgtttgtgatgctattgcatcgccatttaataattagagttggaata

SEQ ID NO: 9525 - DNA, 1102 bp, Primula obconica
aaccagaactcactctgcttagagagagaaacaaaatattcttcttatctacaaagagaaaagtactgttatactaacgaaaatggtatcaactgaggcatctcgtgaagataatgtttacatggccaaattagccgaacaagctgagagatacgaagagatggttgaattcatggaaaaagtcgcaaaaacagttgatgtagaggaattaaccgtggaggagaggaaccttctctcagtagcttacaagaacgtgattggtgctcgaagggcctcttggagaatcatctcttcaattgagcaaaaggaggagagtcgtgggaacgatgaccatgtggcaattatcaaggattataggggaaagattgagacggaacttagtaagatttgtgaagggattttgagtctcttagataagcatcttgtcccttgtgcttcctcgggtgagtctaaggtgttttacctgaagatgaagggtgattatcataggtacctggctgagtttaagaccggggctgaaagaaaagaggctgcagagaataccctcttggcttacaagtctgctcaggatattgctttggctgacttggctcctactcaccctataaggctggggcttgcgctcaatttctctgttttctattatgaaatcctcaactctcccgaccgtgcttgcaatcttgcaaagcaggctttcgatgaggcgatatctgagttggatacattgggtgaggaatcatacaaggatagcacgttgatcatgcaacttcttcgagacaatctgactttgtggacttctgatgtcgcggatgacggggatgagatcaaagaagcttcaaaaaaagaggcaggagatgagtagattcgatgatgaaatcgtatgtttgtattcttatttttgagtcgatttatgtgtaggctccattcgcatgcatggtttgtaggagtgatcatatgaagatttttagttctgttgtgcttgggattgtgatactcttgttggcatacatttgctattattctcattatgaatttgctcccacagtttgtggctttgtgatatgagttcagtcttggtatcagtgatttgttttgttttgtg

SEQ ID NO: 9526 - DNA, 1673 bp, Prunus mume
aacgcacgcagcagcaataatatcaacgacacgacgataatcaacgaaatgcaaggttagggattgcgttgaccgtcaacgccagcgtggtccctccaaaacaaagactccacggaatctccgccacccaccacgtgtctcgttcccattggacctacttctctccccttcctcgtcgcgaccatttttaagcccccaaccggattcccatcttccattttacgagcttagattagatcttcttccttgtggaccagaaaggtttgataattacttacacatagcaaagatgtcgccaactgattcttcacgtgaggacaatgtgtatatggccaagttggccgaacaggctgaacgctatgaggaaatggttgaatttatggaaaaagttgcaaagaccgttgatgtcgaggaactaactgtggaggaaagaaacctcctttctgtggcctataagaatgtgattggggctaggagagcttcatggagaatcatttcttccattgagcagaaggaggaaagcaggggtaatgaggatcatgttgcaattatcaaggaatataggagcaagatcgagaccgagctgagcaagatctgtgatggtatcttgaatcttcttgagtcacacctcattccatctgcctcatctgctgagtccaaggtcttctatttgaagatgaaaggtgattaccacaggtatctagctgaatttaagactggaggcgagagaaaggaagcagctgagagcaccctgttggcttacaagtctgctcaggacattgcccttgctgagctggctccaacccacccaataaggcttgggcttgcacttaacttctcagtcttttactatgaaatccttaactcaccagaccgtgcgtgcaatctggcaaaacaggctttcgatgaagcaatttccgagcttgacacattgggtgaggaatcatacaaggacagcactttgatcatgcaacttctccgagacaatctgacactctggacttccgatatcacggatgatgccggggatgaaatcaaggaagcatcaaagcgtgaatcagctgaagctcagcagtaacaaggctctgtttcataggatttgtattgtgtacctttatcttgggacctttgtaatagatgccatgtggttgtagcagaatttctctatgaacttgacgatcttgagtgctgctgcactcaaagttgaaatattccagcttagggttggagtgttccaagggatcgcaaaattgtttttcttataactggcgagaagaatttgcttcagtgctttgcgtgctgcgctatatgatttagtgttaaaaagtagtggtttaaaatgtttcttctgatttgcaattttgcgaagatgtgatgctgtgtttttgcctctattgtagtgtgttttggtgcgataggattgtgccaaagctaaatccgattcacttgacaaacaagtgccggcaagtacttcgaatttgaaaaggaaaagaaattcaaataaattgttttttcttggattaagtggggggttttttccttcttttgttactagattaaggggcctcatgcctaatttgttggagtttaattaatactactaagctccttccatctccaacagaaaatgattgtaagctgtaagccaatgaaaaagaggagatttactactt

SEQ ID NO: 9527 - DNA, 1297 bp, Prunus persica
ccattttacgagcttagattagatcttcttccttgtggaccagaaaggtttgataattacttacacatagcaaagatgtcgccaactgattcttcacgtgaggacaatgtgtacatggcaaagttggccgaacaggctgaacgctatgaggaaatggttgaatttatggaaaaagttgcaaagaccgttgatgttgaggaactaactgtggaggaaagaaacctcctttctgtggcctataagaatgtgattggggctaggagagcttcatggagaatcatttcttccattgagcagaaggaggaaagcaggggtaatgaggatcatgttgcaattatcaaggaatataggagcaagatcgagaccgagctgagcaagatctgtgatggtatcttgaatcttcttgagtcacatctcattccatctgcctcatctgctgagtccaaggtcttctatttgaagatgaaaggtgattaccacaggtaccttgctgaatttaagactggaggcgagagaaaggaagcagctgagagcaccctgttggcttacaagtctgctcaggacattgcccttgctgagcttgctccaacgcacccaataaggcttgggcttgcacttaacttctcagtcttttactatgaaatccttaactcaccagaccgtgcgtgcaatctggcaaaacaggctttcgatgaggctatttccgagcttgacacattgggtgaggaatcatacaaggacagtactttgatcatgcaacttctccgagacaatctgacactctggacttctgatatcacggatgatgccggggatgaaatcaaggaagcatcaaagcgtgaatcagctgaagctcagcagtaacaaggcgctgtttcataggatttgtattgtgtacctttatcttgggacctttgtaatagatgccatgtggttgtagcagaatttctctatgaacttgacgatcttgagtgctgctgcactcaaagttgaaatattccagcttagggttggagtattccaagggatcgcaaaattgtttttcttataattggcgagaagaatttgcttcagtgctttgcgtgctgcgctatatgatttagtgttaaaaagtagtggtttcaaatgtttctttcttctgatttgcaatgttgcgaagatgtgatgttttgtatttttgcctctattggagtgtgttttggtgcgataggattgtgccaaagctaaatccgattcacttgacaatcaagtgccgccaagtacttcgaatttgaaaaggaaaagaaattcaaataaa

SEQ ID NO: 9528 - DNA, 1299 bp, Pseudoroegneria spicata
atcccccacccctcccctcctattcctatcccccccgcctcctcacgaacccacagcgcgcacccgagatccgcagccgaagcccgtgagaaaagcgaagcgcgagaggaaaggcactgatcgagtctgtaacaaagaagagggaaaatgtctaccgctgaggcaacccgtgaggagaatgtgtacatggccaagctcgccgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcatcctggaggatcatctcctccattgagcagaaggaggagagccgtgggaacgaggcctatgtcgcttcaatcaaggagtaccgcaccaggatcgaaaccgagctcagcaagatctgtgatggcatcctcaagcttctggactcccacctcgtcccctctgccactgcagcagagtccaaggtgttctatctgaaaatgaagggtgactaccacaggtaccttgcggaattcaaggcgggtgctgagaggaaagaagcagctgagaacactcttgtagcatacaagtcagcccaggacattgctcttgctgacttgcctaccactcacccgataaggcttggacttgcactcaacttctcggtgttctactatgaaatcctgaactctccagaccgtgcttgcaacctcgcgaagcaggcatttgatgaagctattgctgagctggactccctcggcgaggaatcctacaaggacagcaccttgatcatgcaacttcttcgtgacaacttgactctctggacctccgataacgctgaggagggtggtgatgagatcaaggaagccgcctcaaagcccgagggagaggggcactaattggccggcccttgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttggcgtcaagcaccccgaaagcttgcctttcttatgaggcaacaactgagtttttcttgtcca

SEQ ID NO: 9529 - DNA, 1451 bp, Secale cereale
aggaacccacagcgcgcacccgacgatacccgcagccggaagacccggtcgaggaacaagcgaagcgcgagaggaaaggtactgaactagtttgtaacaaagaagagggaaaatgtctaccgctgaggcaacccgtgaggagaatgtgtacatggccaagctcgctgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggatagcaccttgatcatgcaacttcttcgtgacaacttgactctctggacctccgataacgcagaggagggcggtgatgagatcaaggaagccgcctcaaagcctgagggagaggggcactgattggctggccctagagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattgatcatacttggcgtcaagccaccccaaagcttgcctttcttatgaggcaacatctgagtttttcttgtctacttccttctcaaaataattgagttctaggctcctaaaagttatatcagcatctacaaaattgattttattcccttgttcaaatatgaaatgtattttcgtattataataaaaaaaaaaaaagaaaaaaaaaaaagaaaaaatactgtgtcgtatactacgcgtctcttcgtagacgacgctaccgga

SEQ ID NO: 9530 - DNA, 1258 bp, Secale cereale
cccgtgagagcagcgaagcgcgagaggaaaggtactgaactagtttgtaacaaagaagagggaaaatgtctaccgctgaggcaacccgtgaggagaatgtgtacatggccaagctcgctgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggtgatgagatcaaggaagccgcctcaaagcctgagggagaggggcactgattggctggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattgatcatacttggcgtcaagcaccccaaaagcttgcctttcttatgaggcaacatctgagtttttcttgtctacttccttctcaaaataattgagttctaggctcctaaaagtt

SEQ ID NO: 9531 - DNA, 1566 bp, Secale cereale
tcggacgaggttccctcaaagggaacgaccgaagggttagggttaactaaccggaaacccggacgaaagggtaacgttaaacctaggggttaaacgggggtaaaaaggttaggggttagggttactaaccgaaaccggacaagggtaacgtaacctaggtaaagggaaacgacgtagggttaggttataaccgaaccgacgaaggtacgtaactgtaagggaaacgacagggtaggttatacaacgacagaagtagacaggtaggtatacacgcagacgacagtggggcgcacccgagatccgcagccgaagcccgtgagagcagcgaagcgcgagaggaaaggtactgaactagtttgtaacaaagaagagggaaaatgtctaccgctgaggcaacccgtgaggagaatgtgtacatggccaagctcgctgagcaggctgagcgttacgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggtgatgagatcaaggaagccgcctcaaagcctgagggagaggggcactgattggccggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattgatcatacttggcgtcaagcacccccaaagcttgcctttcttatgaggcaacatctgagattttcttgtctacttccctctcaaaataattgagttctagatttcttga

SEQ ID NO: 9532 - DNA, 939 bp, Secale cereale
gtacacgtcttcgacgaaagacgacgttgggtaagtcaaacgcaacgcggtaactacgggacgcggccgacaccccgagactccgcagccgaagcccgtgagaacagcgaagcgcgagaggaaaggtactgaactagtttgtaacaaagaagagggaaaatgtctaccgctgaggcaacccgtgaggagaatgtgtacatggccaagctcgccgagcaggctgagcgttatgaggaaatggtcgaattcatggagaaggtggcaaagactgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggtgatgagatcaaggaagccgcctcaaagcctgagggagagggg

SEQ ID NO: 9533 - DNA, 910 bp, Secale cereale
cccctccccacgaacccacagcgcgcacccgagatccgcagccgaagcccgtgagaacagcgaagcgcgagaggaaaggtactgaactagtttgtaacaaagaagagggaaaatgtctaccgctgaggcaacccgtgaggagaatgtgtacatggccaagctcgctgagcaggctgagcgttacgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggatagcaccttgatcatgcaacttcttcgtgacaacttgactctctggacctccgataacgcagaggagggcggtgatgagatcaaggaagccgcctcaaagcctgagggagaggggcactgattggctggccct

SEQ ID NO: 9534 - DNA, 1440 bp, Secale cereale
tattcctatcccccctccccacgaacccacagcgcgcacccgagatccgcagccgaagcccgtgagagcagcgaagcgcgagaggaaaggtactgaactagtttgtaacaaagaagagggaaaatgtctaccgctgaggcaacccgtgaggagaatgtgtacatggccaagctcgccgagcaggctgagcgttatgaggaaatggtcgaattcatggagaaggtggcaaagactgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggtgatgagatcaaggaagccgcctcaaagcctgagggagaggggcactgattggctggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattgatcatacttggcgtcaagcaccccaaaagcttgcctttcttatgaggcaacatctgagtttttcttgtctacttccttctcaaaataattgagttctaggctcctaaaagttatatcagcatctacaaaattgattttattcccttgttcaaatatgaaatgtattttcgtattatatatgtttggtattatgtcgtgattttactggtgaaattccctttatgtttctactgtgg

SEQ ID NO: 9535 - DNA, 1461 bp, Secale cereale
gaggacgcgcgtattattgtagagacggcgcgacgatagagaggagcgcgctactgcccgttaattaaccccttacccggtttacggtggtacccgtttcgggtccgtaacggtaccgttccgtaaccggaaaggaaccaacggtacgggttaacgttacgtaaaccggaccgaacggaagtaaccgaacttacggggacggaaaccccgtaaccgaacgacgacggcacccgaccggaagtaccgccagtacccgaagacccgtgagaacagcgaagcgcgagaggaaaggtactgaactagtttgtaacaaagaagagggaaaatgtctaccgctgaggcaacccgtgaggagaatgtgtacatggccaagctcgccgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgctgaggagggcggtgatgagatcaaggaagctgcctcaaagcctgagggagaggggcactgattggctggccctagagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattgatcatacttggcgtcaagcacccccaaagcttgcctttcttatgaggcaacatct

SEQ ID NO: 9536 - DNA, 1332 bp, Secale cereale
ttcctatcccccctccccacgaacccacagcgcgcacccgagatccgcagccgaagcccgtgagagcagcgaagcgcgagaggaaaggtactgaactagtttgtaacaaagaagagggaaaatgtctaccgctgaggcaacccgtgaggagaatgtgtacatggccaagctcgccgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggatagcaccttgatcatgcaacttcttcgtgacaacttgactctctggacctccgataacgcagaggagggcggtgatgagatcaaggaagccgcctcaaagcctgagggagaggggcactgattggctggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattgatcatacttggcgtcaagcaccccaaaagcttgcctttcttatgaggcaacatctgagtttttcttgtctacttccttctcaaaataattgagttctaggctcctaaaagttatatcagcatctacaaaa

SEQ ID NO: 9537 - DNA, 1345 bp, Sequoia sempervirens
cttcatttgccagtatattttcagaactttctttatgctttgcagatatcttaaattttaaatatcgctttggatttgttcttctagttgattcgtttcgagggcaaagcaggtctcctcattgaaaggatacattgtgtttggtgttgttgtaatagaggtgcacggaaatgcctcccgtagagtcatcgcgcgaagaaaatgtgtacatggcgaaattagcagagcaggcggagcgttatgaggaaatggtggagttcatggagaaggtggcgaagactgtggacgttgaggagctgagcgtggaggagcggaatttgttatcagtggcatacaagaacgtgattggagctcggagggcttcctggagaataatttcttcaatcgaacagaaggaagaaagccgtggtaatgatgagcatgtgacaatgatcagagactacagggcaaaggtcgagtctgagctcagtaatatatgtgacggcattcttcgtctccttgattcgcatctggtgccctcatctaccacaggggagtcaaaggtgttttatcttaagatgaagggagattatcaccgctatctggcagagttcaagacgggtgctgacaggaaggaggccgcagaaagcacattgcttgcctacaagtcggctcaagatattgcaatggcagaattggcttcaacccatcctatcaggcttgggttagctctcaatttttctgtattctactacgaaattctgaattcacctgatcgagcatgtgctcttgccaagcaggcctttgatgaagcaattgcagagttggatacattgggtgaagaatcttacaaagatagcacacttatcatgcaactccttcgagacaatttgaccttatggacatcagacatgaatgaggatacaggagatgaaatcaaggaagccccttcaaagcgcgaggagggagatgggcagtaacatgaaatgaaataatttcagatttatcattgtcgcttgtctgacaattgaatttctctgtaaagtcttgcttagtacttctagtatcgtaaaagtatagtgattgtgggcatctttttattgtagtccctgctatgctattgagcttggtaggaaggggattctaacaagctgcatttgtgccttattcttattatttatttggcaccattaaattaaaacatgcttattgtgggacagcagttcagcatgccagaagtgttttattcattttaatcccctgctattttgatttagagtccattgtttttggccctttggcaggtatcagcactctcttgttggcttgactaactggtaaatttataatataatgtcttttggct

SEQ ID NO: 9538 - DNA, 1445 bp, Picea glauca
ttaattaaattaatccccccccccccccgaggctccctcgttctttagcccctttgtcgattgtatgtgctgcaggccctttcagaaggacgagaagctagcgggaaaaggtgcgcctttgctgccgaggttttgtcttttggaaacacggatctctgcgttcgttgacgctgttgaggattttgatcgttcggtttaggttttcttttcagggaaaatgtcacctgcggagtcttctcgtgaagaaagtgtgtatatggccaagcttgctgaacaggcagagcgctatgaagagatggtagagtacatggagaaagttgccaagacagtagatgtggaggaacttactgttgaggaaaggaatctgctgtcagttgcttataaaaatgtaattggagctcgcagggcttcatggaggataatttcctccattgaacaaaaggaagagagcaggggaaatgaagaacatgttactatgataagagaatacagaggcaaggtggagtctgagcttagtaatatttgtgatggcattctacgccttctggacacacatcttatcccttcatcgacatctggtgagtccaaggtattctatcttaagatgaagggtgattaccatcgatatcttgcagaatttaaaactggtgctgagaggaaggaagctgctgaaagcacattgcttgcatacaaggcagcccaggacattgcaattgcagagttggctccaactcaccctatcagactgggactggcccttaacttttctgtattctattatgaaattttgaactcaccagatcgtgcctgtacgcttgccaagcaggcatttgatgaggcaattgcagagcttgatacattaggtgaagaatcttacaaggatagtactctgattatgcagctgcttcgtgataacctcacattatggacttcagacatgcaggaggagactggaggagatgaaatcaaagaagcgccgaagaaagaggaaggggatgggcattgacatcttttttctgaatgaaatcaagtaggatggctgaaggggatgaacatcaatgtttatccgtaaatgactgtcaagtaggttagattcatgagatatggtcaaatatgttgtgttagagattttagagtgctttttttggttttctgcacgattgtgtgcgaatggggatctttcaacaaattctcctattacatcttgctgccctgcaagattttattgttgcagggtattggtttgcgagttctgtactcctataataccatggagggtacacttaaagttgttatataagtgtcatagtgtcatttggaaggatccctgcttgttggcaatggatggatatggttccctcgagacctgggattgtaataacatagtggcttagttactgcaagatctaatattatactttgatgtgcaccattttttctgctca

SEQ ID NO: 9539 - DNA, 1305 bp, Triticum aestivum
ccgaacccacagcgcgctcccgagatccgcagccgaagcccgtgagaaaagcgaagcgcgagaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctgagggagaggggcactgattggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttggcgtcaagcacccccaaagcttgcctttctaatgaggcaacagctgagtttttcttgtctacttccctctcaaaataattgacttctaggattcttctaattcaaaaagtttgat

SEQ ID NO: 9540 - DNA, 1326 bp, Triticum aestivum
cgaacccacagcgcgcacccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttatgaggaaatggtcgaattcatggagaaggtggccaagaccgctgatgtaggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcagagtccaaggtgttctatctgaaaatgaagggtgactaccacaggtaccttgcggagttcaaggcgggtgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagccagagggagaggggcactgattggccggcccttgagcgtgcccaagtttatttctgagtccatttacgcagctacctgtatcattcggatcataagatgtactagggtcagttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattgatcatacttggcgtcaagcacccccaaagcttgcctttctaatgaggcaacagctgagtttttcttgtctacttccctctcaaaataattgagttctaggattcttctaagtcaataagtttgataaatttgatatgaaatta

SEQ ID NO: 9541 - DNA, 919 bp, Nicotiana benthamiana
caacaaacatggccgagtcaacacgtgaagtaaatgtgtacatggccaagctggctgagcaggctgagcggtatgaagaaatggttgagtttatggagaaggttgcaaagacggtagatgttgaagaactgaccgtggaggaaagaaatcttctttctgtggcttacaagaatgtgattggtgcaagaagggcttcctggaggacaatctcgtcaattgagcagaaggaagagagccgtggaaatgaagaccatgttagcagcattaaagaatacagaggcaaaattgaggctgaactcagcaagatatgtgatgggattttgaacctcctcgagtcccatttaataccagttgcctcaacagccgagtccaaagttttttacttgaagatgaaaggtgattaccacaggtacttggctgagtttaagacaggggcagaaaggaaagaagccgcagagaacactttattagcctacaagtctgctcaggatattgctttggctgaactggctcctactcacccaatcaggctgggacttgccctcaacttttcagtgttctactatgaaattctcaactcgtcggatcgtgcttgtaatcttgcaaagcaggcctttgatgatgccattgccgagctggatacactgggtgaggaatcttacaaggacagtacattgattatgcagcttctccgagacaatcttacactttggacttctgataccacggatgatgccggagatgagatcaaggaagcttcaaacgcgagtcaggcgacggagagcagtaacaacatagcatcatagtctttcctctttattttgtttgattttaatataggactactgtgtgaaagctagactggatatggttatttgatgattcttcgtatcactgctgaaatggtttgttataaaaa

SEQ ID NO: 9542 - DNA, 1313 bp, Avena sativa
ggcagacgagagcagaagcccgtgagaaaagccgagcgcccgaggaaaaggtatcgccctcctctgcctctcgccaaggccctcacccccatctacctttctcttcttccctttgcggttgtagctggtgcgagaaccagattgttgtttccggttgcgggaatccgaggtacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagaccgctgatgttggtgagctcactgttgaggagcgcaacctgctttctgtggcttacaagaatgtgattggtgcccggagggcatcctggaggatcatctcatccattgagcagaaggaggagagccgtggcaacgaagcttatgtggcttcaatcaaggagtaccgtaccaggattgaaactgagctgagcaagatctgtgatggcatcctcaagcttctggattcccacctcgtcccctctgccactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccgacctcacccactaaggcttggacttgcactcaacttctcagtgttctactatgaaatcctgaactcgccagaccgtgacttgcaaccttgccaagcaggcatttgatgaagctattgctgagctggactcccttggtgaggagtcatacaaggacagcaccctgatcatgcagcttctccgtgacaacttgactctctggacctctgataacgcggacgagggtggtgatgagatcaaggaggcctcgaagcctgaggaggggcactaacttgcccgcaagtctgctcaaagtttatctcaagagtccatttcgcagctacctgtattattcggatcataagatgtactagggttggttgcactatgtgaatcataagaagtagtaggatcgtgctatgcgaagcgtgtcgagctgaagtacctagtggactacagtcatgagggcatcatgtggacatcgtcgcttcaggaactgcgttactagtcattagcagatttcaaactatttcctgtgttgcagcacattattagtatttctgtattagcaattttcattggcttgttaatgattgaagatgctggtgccttaactcctg

SEQ ID NO: 9543 - DNA, 1058 bp, Avena sativa
gctgaggcaacccgtgaggagaatgtgtacatggccaagctcgccgagcaggctgagcgttacgaggaaatggttgagttcatggagaaggtggcaaagaccgctgatgttggtgagctcactgttgaggagcgcaacctgctctctgtggcttacaagaatgtgattggtgcccggagggcttcctggaggatcatctcatccattgagcagaaggaggagagccgtggcaacgaagcttatgtggcttcaatcaaggagtaccgtaccaggattgagactgagctgagcaagatctgtgatggcatcctcaagcttctggattcccacctcgtcccctctgcaactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccactcacccaataaggcttggacttgtcactcaacttctcagtgttctactattgaaatacctgaactcgccagaccgtgcttgcaaccttgccaagcaggcatttgatgaagctattgctgagctggactcccttggtgaggagtcatacaaggacagcaccttgatcatgcagcttctccgtgacaacttgactctctggacctctgataacgcggatgagggtggtgatgagatcaaggaggcctcgaagcctgaggaggggcactaacttgcccacaagtctgctcaaagtttatttcctgagtccatttcgcagctacctgtattattcgaatcataagatgtactagggtcggttgcactatgtgaatcataagaagtagtaggatcgtgctatgcgaaagtgtcgagctgaagtacctagtggactacagtcatgagggcatcatgtggacatcgtcgcttcaggaactgcgttactagtcattagcagatttcaaactatttcctgtgttgcagcacattattagtattgctgtattatcaattttc

SEQ ID NO: 9544 - DNA, 899 bp, Secale cereale
tccccatccccacgaacccacagcgcgcacccgagatccgcagccgaagcccgtgagaacagcgaagcgcgagaggaaaggtactgaactagtttgtaacaaagaagagggaaaatgtctaccgctgaggcaacccgtgaggagaatgtgtacatggccaagctcgctgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggacctccctcggcgaggaatcctacaaggacagcaccttgatcatgcaacttcttcgtgacaacttgactctctggacctccgataacgcagaggagggcggtgatgagatcaaggaagccgcctacaaagcctggagggaggaggggc

SEQ ID NO: 9545 - DNA, 1156 bp, Secale cereale
ccgcagccgaagcccgtgagagcagcgaagcgcgagaggaaaggtactgaactagtttgtaacaaagaagagggaaaagtagtctaccgctgaggcaacccgtgaggagaatgtgtacatggccaagctcgccgagcaggctgagcgttatgaggaaatggtcgaattcatggagaaggtggcaaagactgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggtgatgagatcaaggaagccgcctcaaagcctgagggagaggggcactgattggctggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatg

SEQ ID NO: 9546 - DNA, 1155 bp, Sarracenia psittacina
gggggggggggggagggagagagagagaggaatcgcagttgcagggaggaagtaggtattagtttagcataacaaagatggtgtcaactgattacgccacgagaggaaaatgtttatatggccaaattggctgaacaggctgaaagatatgaagaaatggttgaattcatggagaaagtggtgaagaccgtggaggtcgaggagctgaccgtggaggaaaggaacctactttctgttgcttacaagaatgtgatcggagctaggagggcttcttggaggattatctcttccattgaacagaaggaagagagccgtggtaatgaagatcatgtctcaatcatcaaggagtacaggggaaagattgaggcagaacttagcaagatctgtgatgggattctgagccttcttgattcacatctcattccttctgcttcaactgcagagtccaaggtgttctaccttaagatgaaaggagattaccacagatatctggctgagtttaagacgggggctgagaggaaggaagctgctgagagcactttgctagcttataagtctgctcaggatattgctttggctgagttggctcctactcaccctattaggcttggacttgcacttaacttctctgttttctactttgaaatcctcaactcgcccgatcgtgcttgcagtcttgcaaagcaggcttttgatgaagctatttctgaactggatacattgggagaggaatcatacaaggatagcacattgattatgcaacttcttcgagacaatctgacattgtggacttcagatatcacggatgaaggcgatgagatcaaggaaactgcgaagtcaggggacggacagccgtgacgaggctgtcggagatgtgtactttgtacttgttatttgctttgggatggttgtagaacctggatgaatttgaagaccccgagcactgacatgatcagggttgcaatggttatgtagccggtgcttggggtcctaatggtcctgtaggttatatataaactcgctcatctttattactgattaaaacaaattggcgttgttgttgatggctctgttgtttgagatagttttttggtaagtgatttcttgttccaatactgactgcttgaactgattgatcgcgcctttgatcttatt

SEQ ID NO: 9547 - DNA, 985 bp, Fagus grandifolia
cttggtgaaacactgagacttttaagtaatttattttggtatagcaaagatgtcgcccgctgactcttcacgcgaggagaatgtgtatatggctaagttggccgagcaggccgaacgttatgaggaaatggttgagttcatggagaaagttgcaaagacagtggatgttgaggagttgactgtggaggaaaggaaccttctgtctgtggcttacaagaacgtgattggggcaaggagggcgtcatggaggattatctcttccattgagcagaaggaggagagtaggggaaatgaggatcatgtcgtgatcatcaaggagtacaggggcaagattgagtccgagctgagcaagatctgcgacggcattttgggccttcttgagacgcatctcatcccatcagcctcatctgctgagtcaaaggtgttttatctcaagatgaagggtgattaccacaggtacttggctgagtttaagactggtgctgagaggaaggaagctgctgaaagcaccttgttggcttacaagtctgctcaggatattgccctggctgacctcccccctactcacccaataaggctgggtcttgcacttaacttctctgtcttctactatgaaatccttaactcacctgatcgtgcttgcaatcttgcaaagcaggcttttgatgaggctatatctgagttggacacattgggtgaagaatcatacaaggacagtaccttgatcatgcaacttctccgagacaatctgactttgtggacttctgacatcacggatgatgctggcgatgagattaaggaagcatctaagcgtgagtcaggcgaggcgccgccgccgcagcagtgataaattcataggatgtactctgtacttttaatcttgaaaccccttacatagatggcatgtgggttgttgtagcaggatttcttaatgaactgatgatccttgtgtgcttatagaagcacttggattgaattgttctga

SEQ ID NO: 9548 - DNA, 1345 bp, Beta vulgaris
tcattttctctctcctctcaaatctcaataataaattctccaccatttttaacctcttttttcttcctccattttcgcaccttcaatctatctctttctctctcttctgtctttccgtaacactcgttttgatatctgttctgtttagtgaaaatgtcggctgaagcttcaagggaagaaaatgtttacatggccaagttagccgagcaggctgagcggtatgaggaaatggtggaattcatggaaaaagttgcaaagatgacagacgctgaggagctcactgtggaggagaggaacctcttgtctgtggcttacaagaatgtgattggagcaaggagagcttcgtggaggatcatctcctctattgagcagaaggaggaaagcagggggaatgaggatcatgttgcgaccatcaaggagtacagaagtaagattgagactgagctaagcaagatttgtgatgggattttgaacctccttgagtcacacctcatcccttcagcttccgctgccgagtctaaggtcttttacctcaagatgaagggtgactattacaggtaccttgctgagttcaagacgggacctgagcgcaaagaggctgctgagaacaccctgctggcttacaagtctgctcaggacattgctctagctgaattggcccccactcatccgattaggcttggtcttgctcttaacttctccgtcttctattacgaaattttgaattcacctgaccgtgcctgcaatcttgcaaaacaggcttttgacgaggctatctctgagctggacactttgggtgaggagtcatacaaggacagtactttgatcatgcagcttctgcgagacaatctgaccctctggacctcagacaatgcggaggaaggcggtgatgagattaaggaagctcctggaggaaaacgtgaatcaagcgaaggtcagccgcagcagtgataagttgaagaatggtgctctgtattcgtagcatgaaatatcagtatagttgtcattttggttcgcagtagttaggatttattagaattatttggtcttgttagtgtcctgggtgctggcagtactcagatttagtatttatcatcttttcgtcttagactatctgtaaacggggcgctgtggccgagtttattatatgttccaatggtgtgaaatgcagtttgcatatttaaccttgcatggttagagggagtatttgatttttgtgatccttaagggtttgtgtactctctgattgtttgtcaatgttaaaagttttatatgctttctattaacgtttgtcttgtttacaagctaaagtggagaagaaagtcctctttttatggataagtac

SEQ ID NO: 9549 - DNA, 1270 bp, Manihot esculenta
gtcgcctttctattgcaccccccctcctcgtgacctgtcgttttttgaaactctcctctcctctccgctctccttccgcttgtcatttacgccttcacttcgacggaggaggcttctttcttccgttcttctgtcgatccatagtccaaaatcttgtaaggaagttacttttttagtttgatatagcaaggatgtcaccttcagaaccttcacgcgaggaacatgtctacatggccaagttggctgaacaggctgaacgctatgaagaaatggtggagtttatggaaaaggttgcaaagaccgttgatgtcgaggagttaacagtggaggaaaggaatctcctctctgtggcttataagaatgtcgttggggctaggagggcttcatggaggataatctcgtccattgagcagaaggaagagagcagaggaaatgaagatcatgtcacaatcatcaaggagtacagaggtaaaattgaagcagagctgagcaagatttgtggtgggattttgagcctcctcgattcacatctcattcctgctgcatcatctgctgagtctaaggtattctaccttaagatgaagggtgattattaccgatatcttgctgagtttaagactgcatctgagaggaaggaagctgctgagagcaccttgttggcttacaagtctgctcaggacattgctatcgctgaacttgctcctactcacccaataaggcttggacttgcccttaacttctctgtgttctactatgagatcctgaactcacctgaccgtgcttgcaatctagctaagcaggcctttgatgaggctatttctgagctggatacattgggtgaggaatcttacaaggacagtacattgatcatgcaacttctccgagacaaccttacactgtggacatctgatatcacggatgaagctggggatgagattaaggaagcatcaaaacgtgaatcaggtgaggggcagccgcaacagtgatgagttaagattcacaggatacatgtactatgtacttcttctatcttgcgacctctgcaaagatcccatgctggttgttgtagcggattgcctaatgaatttggtaattctgagtgttgttgagcacttggaactgaaatgttgacagattatcaattctagtattttttttgcttagcatgtgatagttttgaaattaggaaattcccatttttcaaattaaatatgttaagtgcaagacattgttgggtgttaattatccagttcccatcgttttagttttc

SEQ ID NO: 9550 - DNA, 1135 bp, Panax ginseng
ggtctcagttttctacgcgaaagtgaccggttggctgtttccaaaagagaactaaggtactgctaaactgtattaaagatgttgccaccagagtcatctcgtgaggacaatgtttacatggccaagctcgccgaacaggctgaaaggtatgaggaaatggttgagttcatggaaaaggttgctaaaactgtagatgttgaagagttgactgtggaggagaggaatctcctctctgtcgcctacaagaatgtcattggagcgagaagggcttcgtggaggattatatcctccatagagcagaaggaagagagccgtggaaatgaagatcatgtcaccattatcaaggagtataggggtaagattgaggctgaactcagcaagatctgtgatgggattctgaaccttcttgagtctcatcttgttccctcggcgtcatctgctgagtccaaggtgttttacttgaagatgaaaggtgattaccacaggtacctggctgagtttaagactgggtctgagaggaaagaagctgctgagagcaccttgctagcttacaagtctgctcaggatattgcattggctgaacttgcttccactcacccaataaggctgggacttgcacttaacttctctgtcttctattatgaaattctcaactccccagatcgtgcttgcaaccttgcgaagcaggcttttgatgaagccatctctgagctggatacattgggggaggaatcttacaaggacagcacactgatcatgcaacttctccgagacaatttgacattgtggacatctgatataacggatgaagctggggatgagatcaaagaagcagctcccaagccgtcgggtgaaatcatagaatagcattctgtacttttgcatttgtgccttgctataaatctttatatggtggttgtagcaagacataatggatttgaagatctcgagtccttgttggtgcttgggtttgtgacacgtttcaacaaattacaagcttgttataatactatggtgtggtgattaatgtctcccttcccttatgtggtggggtggtttcaaaattattagttgttctattgtttgggtattaaagagattgagattattggaagtatttgttttgacctgtcaa

SEQ ID NO: 9551 - DNA, 1209 bp, Panax ginseng
aagcagtggtatcaacgcagagtacatggggggtctcagttttctacgcgaaagtgaccgatttgctgtttccaaaagagaactaaggtactgctaaactgtattaaagatgttgccacctgagtcatctcgcgaggacaatgtttacatggccaagcttgccgaacaggctgaaaggtatgaggaaatggttgagttcatggaaaaggttgctaaaactgtagatgttgaagagctgactgtggaggagaggaatctcctctctgttgcctacaagaatgtcattggagcgagaagggcttcgtggaggattatatcctccatagagcagaaggaagagagccgtggaaatgaagatcacgtcaccattatcaaggagtataggggtaagattgaggctgaactcagcaagatctgtgatgggattctgaaccttcttgagtctcatcttgttccctcggcgtcatctgctgagtccaaggtgttttacttgaagatgaaaggtgattaccacaggtacctggctgagtttaagactgggtctgagaggaaagaagctgctgagagcaccttgctagcttacaagtctgctcaggatattgcattggctgaacttgcttccactcacccaataaggctgggacttgcacttaacttctctgtcttctattatgaaattctcaactccccagatcgtgcttgcaaccttgcgaagcaggcttttgatgaagccatctctgagctggatactttgggggaggaatcttacaaggacagcacactgatcatgcaacttctccgagacaatctgacattgtggacatctgatataacggatgaagccggggatgagatcaaagaagcagctcccaagccgtcgggtgaaatcatagaatagcattctgtacttttccatttgtgcctggctataaatctttatatggtagacataatggatttgaagatctcgagtccttgttggtgcttgggtttgtgacgtttcaacaaattacaagcttgttataatactgaaggaagaatatggtgtggtgattaatgtctcccttcccttatgtggtgcggtagtttcaaaattattagttgttctattgtttgtttgggaattaaagagattgagattattggaagtatttgttttgacctgtcaattgtcgttgtttttcttattaatttttcttttatgtttaa

SEQ ID NO: 9552 - DNA, 1042 bp, Humulus lupulus
ttttttctctctcgcgtgcggttacgcgcttactcttattttcttactcttaactcttaagagatttcagtaatacataaatattctaaagatgtcgccaactgaatcatcacgggaggagaatgtttacatggccaagttggccgaacaggctgagcgttatgaagaaatggttgagtttatggagaaggtagctaaagccgttgatgttgaggagctcactgttgaggaaagaaacttgctttccgtggcttacaagaacgtgattggagctagaagggcctcatggaggatcatctcctctattgaacagaaggaggaaagtagaggaaatgaggaccatgtcaagataattaaggagtacaggggaaagattgagtctgagctgagcaagatctgtgaaggaattttgaaccttttggagtcacatcttattccctcagcctcatctgccgagtctaaggtcttctatcttaagatgaagggtgattaccataggtacttggctgaatttaagactggagctgaaagaaaggaagctgctgagagcactttgttggcttacaagtcagctcaggacattgctcttgcagaattggctcctactcacccaattaggcttggacttgctcttaacttctccgtgttttattacgaaatcctcaactcgcctgatcgtgcttgcaatcttgcaaaacaggcttttgatgaggctatttctgagcttgatacattaggcgaggactcgtacaaggacagtacattgatcatgcaacttctccgagacaatctgacactctggacttctgacatcacggatgatgctggggacgagatcaaggaagcatcaaaacgtgaaacaggggaaagcaccggacagcagtgatgactgaagagcttggataaagaaggatgtgaactctgtattatgatttttaagtagatcccccatggttgtagttgcacattttcttaatgaatgaactcgatgtccctgatgtcttcaggattggaaatattccaacgtattatatattttgct

SEQ ID NO: 9553 - DNA, 1152 bp, Tripterygium wilfordii
gttaacggatcaaactccaaggaatctccgtcaccgaaaacctgtcggcttgtcgttggacctctccaaccctgtacttctctctattttttttttaaacgagtcctcttcgatctcgctcttctcgtcaccaacatctcacacttcgagtcttgatagatagtctgctgaagcaaagatgtcgcccgactcatcacgagaggaaaatgtctacatggccaagttggctgaacaggctgagcgatacgaggaaatggtggagttcatggagaaagttgcaaagacagtggatgttgaggagttgactgttgaggaacgaaacctcctttctgtagcttacaaaaatgtgataggggcgaggagggcctcatggaggattatctcttccattgagcagaaggaagagagcaagggaaatgaggaccatgttaatatcatcaaggagtaccggagcaagattgagtctgagctaagcaagatctgtgatgggattttaaacctcctagagtcacatctcgtcccctcagccagcgccgctgagtccaaggtgttttatcttaagatgaaaggagattatcacaggtacctggctgagtttaagactggacctgagaggaaggaagctgcagagagcacgttgctagcttacaagtctgcccaggacattgcgctggctgaactagcccctactcaccctataaggctgggacttgcattgaacttctctgttttctattatgaaattcttaattcccctgatcgtgcttgcaatcttgcgaagcaggcttttgatgaggctatctctgagctggataccttgggtgaggaatcatacaaggacagtacattgatcatgcaacttctccgagacaatctgacactttggacttctgatatcacggatgatgctggggatgaaataaaggaggcatcatcaaaacgagaatctagcgaggggccgcagtcatgaattttgatctcatagaatatcatattctgtactctctctttttttaatcttgcgacctttacttagctttagatgctttatgggttgttctagcaggatttcttaatgtatttggtgatcttgattgcagacagctcctaggttttaaatgttccggtagatcatgaatgtgcttttactta

SEQ ID NO: 9554 - DNA, 1141 bp, Tripterygium wilfordii
cttctcggtttctcattggacctctccgacccacttctctctcatttttctaagcagccatcgccgctctcgcgtttctcgcaccaacaatctaacacttcaaatctctctcatttcgacgaatcttgatagatagtctgctgaagaaaagatgtcgcccgactcatcacgagaggaaaatgtctacatggccaagttggctgaacaggctgaaagatatgaggaaatggtggagttcatggagaaagttgcaaagacagtggatgttgacgagctgactgttgaggaacgaaacctcctttctgtagcttacaaaaatgtgataggggcaaggagggcctcatggaggattatctcttccattgagcagaaggaagagagtaggggaaatgaagaccatgttaatatcatcaaggagtaccggggcaagattgagtctgagctaagcaagatctgtgatgggattttgaacattctagagtcgcatctcatcccctcagtcagttccgctgagtccaaggtgttttatcttaagatgaaaggtgattatcacaggtacctggctgagtttaagactggagctgagaggaaggaagctgcagagagcactttgttggcttacaagtccgcccaggacattgctctggctgaactagcccctactcaccctataaggctgggacttgcattgaatttctctgttttctattatgaaatcctcaattcccctgatcgtgcttgcaatcttgcgaagcaggcttttgatgaggctatctctgagctggataccttgggtgaggaatcatacaaggacagtacgttgatcatgcaacttctccgagacaatctgacactttggacttctgatatcacggatgatgctggagatgaaataaaggaggcatcatcgaaacgcgaatctggcgaggggcagcagtcgtgattttagatatcgcagactatcctatcctgtactttttttttaatcttgcgacatttacttagttttagatgccttgtgggttgttgtttctggatttctttatgtatttggtgatcttgattgcagacagctcctaggttttaaatgttccaggtagatcataattgtgcttttatatttttgatgaagctttgaatt

SEQ ID NO: 9555 - DNA, 1081 bp, Phaseolus vulgaris
attcattttcattctctctctctctgcttcaggattacgtggtgaagttcgcgaatcagagaaatggcagattcttctcgggaggagaacgtttacatggcgaagttggccgagcaggctgagcggtacgaggagatggttgagttcatggagaaggttgcgaagactgtggaggttgaggagttgactgtggaggagaggaatcttctctctgtggcatacaagaacgtgattggggcgaggagggcttcgtggaggatcatatcctccattgagcagaaggaggagagcagaggcaatgaggaccacgttgctattataaaggagtacaggggaaagattgagaccgaactcagcaagatctgtgatgggattttgaacctcctcgagtccaacctcatcccttctgctgcatctcccgaaagtaaagtcttttacctcaaaatgaagggtgattaccacaggtaccttgctgagtttaagactgggacagagaggaaagatgctgcagaaagtactttgcttgcttacaaatccgctcaggatattgctcttgctgacctggcccccacccaccctattaggcttggacttgctctcaacttttcagtgttctattatgaaatccttaactcaccagatcgtgcttgtaatcttgccaagcaggcatttgacgaggcaatttccgagctcgacacattgggtgaagagtcatacaaagacagcacattgatcatgcaacttctccgtgacaatctgactttgtggacatcagacatcacggacgatgctggggatgagatcaaggagacaacgaagcaaccaggtgaataggccatgagagtattgatgtggtagttgatgggatatgtattaccctaaattaatatagatccaatgtggcttgccatagtaggattgtattaatgaatttcataatttcaagtgagttgcgcttggaatttacaatgtttcagtgcttctgtatgtgttttattcatcaggtgaatgtggcttgctggtttagtcatttataaattttttattgttgctgttatatgaatcttcaaattcatttttg

SEQ ID NO: 9556 - DNA, 1108 bp, Rosa hybrid cultivar
ccgagacaggtttgagaattttcttactacactgcaaagatgtcgccaactgattctacacgcgaggagaatgtttacatggccaagttggctgagcaagctgagcgttatgaggagatggttgagtttatggagaaggtcgcaaagactgttgatgttgaggagctaactgtggaggaaagaaacctcctctctgttgcttataagaatgtgattggagctaggagagcttcgtggagaattatctcttccattgagcagaaggaggagagcaggggtaatgaagatcatgtgtcaatcatcaaggagtacaggagcaagatcgagaccgaactgagcaagatctgtgatgggatcttgaaccttctcgagtcccaccttatcccctcagcatcatctgctgagtccaaggtgttctacctcaagatgaaaggtgactaccataggtaccttgctgaatttaagactggaggtgaaagaaaggaagcagctgagagcacattgttggcttacaaatctgctcaggacattgctctggctgagttggctccaactcacccaataaggctgggacttgctctcaacttctcagtgttctactatgaaatccttaactcaccagaccgtgcttgcaatctggctaaacaggctttcgatgaggctatttctgaacttgacacactgggtgaagaatcatacaaggacagtactttgatcatgcaactcctccgagacaatctgacactgtggacctctgacatcacggatgatgctggggatgaaatcaaggaagcatcaaagcgtgaatcaggcgaagcccccgcacagtgatgaatttggatcgtaggatatgtgctatgtgtacctttatcttcagacctttgtaatagatgccatgtggttgtagcaggatttctctatgaacttgacgatctcgagtgcgtcagcacttagagttggaatattccaacagatcgtaaaattgcttttataattggcgagaagaatttggttcagtgctttgattgctctgctatatgatttagtgttaaaaaattagtggtttatgatgcccttttcgatgttcaactgttctgattgttatcca

SEQ ID NO: 9557 - DNA, 1280 bp, Secale cereale
ccctatccccacgaacccacagcgcgcacccgagatccgcagccgaagcccgtgagaacagcgaagcgcgagaggaaaggtactgaactagtttgtaacaaagaagagggaaaatgtctaccgctgaggcaacccgtgaggagaatgtgtacatggccaagctcgccgagcaggctgagcgttatgaggaaatggtcgaattcatggagaaggtggcaaagactgctgatgttggtgagctcactgttgaggagcgcaacctgctctctgtggcttacaagaatgtgattggtgcccggagggcttcctggaggatccatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggacctccctcggcgaggaatcctacaaggacagcaccttgatcatgcaacttcttcgtgacaacttgactctctggacctccgataacgcagaggagggcggtgatgagatcaaggaagaccgccttcaaagacctgagggagagggcgactgattggctggccctccgagcggtgcccaacgtttaatttcttgagtccatttacgtcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttctatggcttgttgatgattgatcatacttggcgtcaagcacccaaccaaagtgtctcctttacttatggacggacaactattcgtgtttagttt

SEQ ID NO: 9558 - DNA, 1258 bp, Cycas rumphii
aaacctatcgttgccgtcgtccatcattctggtgtcgttgggcatcgttctggacagatcctcggcttcgatcctgcatttcgacggatcgattgttcgttccaaattcgctcggctccgttttctacatcgatagagatgtcgcccgtggagtcttctcgagaagaaaatgtgtacatggcgaagctggcggagcaggcagagcgttacgaggagatggtggagttcatggagaaggtgaccaagactgtggatgtcgaggagcttacagtcgaggagcgcaatctgctatccgtagcgtacaagaacgttattggtgctcgcagggcttcgtggaggatcatttcttccattgaacagaaggaagagagcagaggtaacgacgatcatgtcgccaccattcgagaatacagagccaaggtcgagtctgagcttaccaatatttgtgatagcattctgcgcttgcttgattcccatctaatcccctcctccaccactggcgagtccaaggtattttatctgaaaatgaagggtgattaccatcgctatctggccgagttcaaaacaggcgccgagaggaaggaagccgccgagaatacattactcgcatataagtctgcccaggacattgcggcttcagacctggctccgacgcatcctattagattgggattggctctcaacttctccgtcttttactatgagattttgaattcacccgatcgagcctgtacgcttgccaagcaggcatttgatgaggcaattgcagagttagatactttaggtgaagaatcatacaaagacagcactctgatcatgcagcttcttcgtgacaatctcaccttatggacttcagacatgcaggaggatgctggagatgagattagagaagctcccaaacgtgaggaaggggatgaacaatagcaaaatttggtcacatattacctgtaatagggattttagattatctggcttccctgtataatttggtgatgggtgcctttgtgcacaattttagtatgttagatgtgctggtctcggtatttagttgttgcagggaagttaatcttctttgttagctgcaattatgttagtaatttaaactatccatactgttctccaatggtttggataatggtggcttgtggctgtaatagcagattggtaagtgagttgagcaatatatttttgtactctgattcatgtttgcgctgaataatacttgttataccagtttaattgttcatgctttggttat

SEQ ID NO: 9559 - DNA, 1594 bp, Abies balsamea
atttttgtcgatcgtatatactgcacgccctttcaggaggacgggaagctaagtgtaaaaggcgcgacgcagctgcggaggttgcctttcggaaacacggatctttgagttccttgacgcgtttgaggattttgctctttcggcttaggttttcttttcagggaaaatgtcgccggtggagacttctcgtgaagaaagtgtgtatatggccaaacttgctgaacaggcagagcgatatgaggagatggtagaatacatggagaaggttgccaagacagtagatgtggaggaacttactgtcgaggaaaggaatctgctgtcagtggcgtataaaaatgtaattggagctcgcagggcctcttggaggataatttcttccattgaacaaaaggaagagagcaggggaaatgaggatcatgttactatgataagagaatacagaggcaaggttgagtctgagctcagcaatatttgtgatggtattctacgccttctggacacacatcttatcccttcatccacatctggtgagtcgaaggtattctatcttaagatgaagggtgattaccatcgatatctcgcagaattcaaaactggtgctgagaggaaggaagctgccgaaagcacattgcttgcatacaaggcagcccaggacattgcaattgcggagttggctccaactcaccctatcagattgggactggcccttaacttttctgtattctattatgaaattttgaattctccagaccgtgcctgtgcacttgccaagcaggcctttgatgaggcaattgcagagcttgatacattaggtgaagaatcatacaaggatagcactctgatcatgcagctgcttcgcgataacctcacattatggacttcagacatgcaggaggagactggaggagatgaaatcaaagaagccccgaaaaaagaggaagtggacgggcattgacatccttttctgaatgaaatcaaatagtattgctgaaggggatgaacatcaatgtttatccgtaaaagactgtcaagtaggttagattgatgggatatggtcaaatatgttgttgtagggggttttagagtgcttttttttggtttttttgcacgattgtgtgctaacggggatccttccatattttctcatattaaatctgctgccctgcaagattttattgttgcatggtattcttttggaagttctgtactcctatattaccatggagggtacacttcaggtttttattaagtgttattcatgtcatttggaaggatccctgcttgttggcaatggatggatatggtactctcgagacctggagttgtaataacatatggctaaattactgcaagatctaattttatactttgtctgtgctccgatttttcttcttacctttatcatcttttcaagggagagcacagattgattagtggtactttcttttattctgggggaaagtttattcgtgttaatgcttgttacttgcatttacacgatcagtttctttaccaggagctaacatgcattttgttgcaaagagcgtattatactgcaattttgttggcaagtctcctttcccttgtcgaattt

SEQ ID NO: 9560 - DNA, 846 bp, Antirrhinum majus
attcggcacgagcggcacgagcggcacaacgcaaccttcgaacaggcttgattactagaaagcacataagaaatggcttcagctgattcgtcgcgagatgagagtgtgtacatggccaagttggccgaacaggctgaacgttacgaggagatggtggagtttatggagaaagttgcaaagactgtggacactgatgagttgactgtggaggaaaggaaccttctctctgttgcatacaagaatgtgattggtgctaggagggcttcgtggaggatcatctcttccattgagcagaaggaagaaagccgtgggaatgaggatcatgtcaaaattattaaggattacagggctaagattgagactgagctcagcaagatatgtgatgggattttgggccttcttgattctcatctcgttccttctgcctcttctgcagagaccaaggtgttttacttgaagatgaaaggtgattatttcaggtatttggccgagttcaagactggggctgagaggaaagaagctgccgagagcactttggtcgcttacaaggcagcgcaggatattgcattggctgaactggcacctacccacccaatcaggctaggtctagcacttaacttttctgttttctactacgaaatcctcagttcaccagatcgtgcttgcaacctagcgaagcaggcatttgatgaagccattgccgagttagatacattgggtgaggaatcgtacaaggacagcacactgatcatgcaacttctcagagacaacttgactctttggacctctgatttagcggatgacgctggagatgagaacaaggagcctccaaagtgattcatgcac

SEQ ID NO: 9561 - DNA, 1047 bp, Arnica chamissonis
agaaacaacacacataaacccttggatacgcactcgcaagtcttgcccctttcgatcgaggatcagccataattgattgtaaaaaatggtgcaaactgaagcttctcgtgaagaaaatgtgtacatggccaaattagcagagcaggcagaaaggtatgaagaaatggtagagtttatggagaaggtcgtgaagattgtggattctgaagagttgacagtggaggaaagaaatcttctttctgtggcttacaagaatgtaattggtgctaggagagcttcgtggaggatcatttcttccattgaacagaaagaagaaagccgtgggaatgaagatcatgttaccattatcaagaactacaggggtaagatcgagattgaattgagcaaaatctgtgatggcatcttgagccttcttgagtctcatcttgttccctccgcatcctctgctgagtctaaggttttttacttgaagatgaaaggtgattactacagatacctagctgagtttaagacaggagccgagaggaaggaggctgctgagaatactttattaggatacaaatctgctcaggatattgctttagttgatttggctcccacccaccctataaggctgggtcttgcactcaacttctcggtgttctattatgaaattctcaactcacccgaccgagcttgcagccttgctaagcaggcatttgatgaagccatctctgagctagacacacttggtgaggattcatacaaagatagcacattgatcatgcaacttctgagggacaatctaactttgtggacatctgatgctgcggacgaggcaggggacgagatcaaggaagcttcaaatcctgaggcaaaacaatgatatttataggccagatggtgatagctgtgtactagtagtacttggtggtccgttttaggttttcttttagtgcttatatttggaacataatggatttttgcatattttctatggttggtatttactagtttctcatatatttggacgattggttttgttaattgcaactttggatgtctagg

SEQ ID NO: 9562 - DNA, 1325 bp, Cedrus atlantica
aaaaggcgcgccgctgctgctaaggttttgccttttggatacacggatctctgagttctttggcgtcgttgaggattttgatctttccgtttaggttttattttatctgggaatatgtcgcctgtggagacttctcgcgaagaaagtgtgtatatggccaagcttgctgaacaagcagagcgctatgaggagatggtagagtacatggagaaggttgccaagacagtagatgtggaggaacttacggttgaggagaggaatcttctgtcagtggcttataaaaatgtaattggagctcggagggcttcttggaggataatttcttccattgaacaaaaggaagagagcaggggaaatgaagagcatgttactatgataagagaatacagaggcaaggttgagtctgagctcagcaatatttgtgatggcattcttcgccttctggacacacatcttatcccttcatccacatccggtgagtccaaggtattctatctgaagatgaagggtgattaccatcgttatcttgcagaatttaaaactggtgctgagaggaaggaagctgctgaaagcacattgcttgcatacaaggcagcccaggacattgcagttgcagagttggctccaactcatcctatcagattgggactggcccttaacttttctgtattctattatgaaattttgaattcaccagatcgtgcctgtgcacttgccaagcaggcctttgatgaggcaattgcggagcttgatacattaggtgaagaatcatacaaggatagcactctgatcatgcagctgcttcgtgataacctcacattatggacttcagacatgcaggaggagactggaggagatgaaatcaaagaagccccgaagaaagaggaaggggatgggcattgaaatctttttcgaaaagcaagtaggattgctgaaggggggatgaacatcaatgtttatccgtaaatgactgtcaagtaggttagattgatgagatatggtcaaatatgttgtattaggggttttagagtgcttttgtggttttctgcatgattgtgctaatggggatctttccacaaattctcgtattaaattgctgccctgcaagattttattgttgcagggtatttttttgcgagtgctgtactcctatattaccatggagggtacacttaaaagttgttcttaagtgttattgatgtcatttggaaggatcccctgcttgttggttggcaagggatggatatggtactctcaataccagggattgtaataacatactggctaaattactgcaagatctaatattatacttttgctgtgct

SEQ ID NO: 9563 - DNA, 1129 bp, Cephalotaxus harringtonia
cgagtcttgtatgctttgcaggcatctgaaattataaatctctgttggccttatatacgttgtctggatctattttttttcaagcgtaaagccgtctgattcaagaggtgggaaagaatgcctccaatggagtcatcgcgtgaagaaaatgtatatatggcgaaattagcagagcaggcggagcgttatgaggaaatggtggagttcatggagaaggtggcgaagactgtggatgtggaggagctgagtgtggaggagcggaatttgttgtcggtggcatacaagaatgtgatcggagctcggagggcttcgtggagaatcatttcttccatcgaacagaaggaagaaagccgtggtaacgatgagcatgtgactctaattagagactacagggctaaggttgaatctgagctcagcaatatctgtgacggtatacttcgtcttcttgattcgcatctggtaccctcatctaccacaggggagtcgagggtgttttatctgaagatgaaaggagattaccaccgttatctggcagagttcaagacgggtgctgacaggaaagaggccgccgaaagtacattgctagcctacaagtcagcccaagatattgccatggcagaattggcttcaacccatcctatcaggctagggttagctctcaatttttctgtcttctactacgaaattctgaattcacccgatcgagcctgtgctcttgccaagcaggcctttgatgaagcaattgcagagttggatacattgggtgaagagtcttacaaagacagcacgcttatcatgcaactccttcgagacaatttgaccttatggacatcagacatgaatgaggatactggagatgaaatcaaggaagccccttcaaagcgcgaggatggagagggtcaatgacgtgaaatgaaatagtttttaatttattattgatacatgtgtgactattgaatttctttgtaaagtcttgtttagtagttcaagtactgtaagagtatagtgattgtgggcatccttttattgttgtccctgctgtactattaagcttgttaggaacgagttccagaccagctgcatttatgctgtattcttagtatatacgctatttagcacccttgttttg

SEQ ID NO: 9564 - DNA, 1065 bp, Chelidonium majus
aggtatacgagatgtctccggtagaagcttcacgggaggaaaatgtttatatggcgaaattagcggaacaagctgaacgatatgaagaaatggttgagttcatggagaacgtggcaaagactgtagatgttgaggaactaactgtggaggaacggaatttactttctgttgcttacaagaatgtgatcggagcgaggagagcttcatggaggatcatctcgtctatcgaacagaaggaagagagccgtggaaatgaagataatgtgaaagttatcaaggaatacagggcaaagattgaaacagaacttagcaagatctgtgaaggaattctagggcttttggatgcacatctaattccttcatcatctgctgctgaatctaaggtgttttaccttaagatgaagggtgattaccataggtacttggctgagttcaagactggttctgataggaaggaagctgctgagagtacattgttggcttacaagtctgctcaggatattgctatgactgaactgactcctactcatcccataaggctggggcttgcgcttaacttttcagtgttctattatgaaatcctgaactcaccagatcgcgcttgcaatctcgcaaagcaggcttttgatgaagctatttctgaattggataccttgggtgaggaatcttacaaggatagtacgttgattatgcaacttctccgagacaatttgaccttgtggacttcagatattacggaggatgctggtgatgagatcaaggaagcctcaaagcgtgagggagcagcttaacattaatgatcttatatctgggatttggaagagtgtttagttaattaattagtagtagttttttttttttaatgtcaagaaaggaccaacttcaacttgtatttgctatttgtgttgctttttagttatagtatagattgcttctcagtcttcgtgtttgtggtagtgaaatctcttcatatgttgtagtaaaagaccttgaatgtgccgaggtacttggtgtttgaaatatatctgtatgggtgaagattactagccgcctttttactaattt

SEQ ID NO: 9565 - DNA, 1668 bp, Cicer arietinum
ttaatataaaaggttaacattttcataattttgctttcactctcattcgaattctcatcctctcttcacacacacaacgcaacccaataggattattatcgaatcgaaaaatggcggcatcggattcatctcgcgaagagaatgtttacatggcgaaattagcggaacaagccgaacgatacgaagagatggttgaattcatggaaaaagttgcaaaaacagttgaggttgatgaactaacagttgaagaaaggaatcttctttcagttgcttacaaaaatgtgataggtgcaagaagagcttcgtggagaataatttcttcaatcgaacagaaagaagagagtagaggaaatgaggatcatgttgctgttataaaggaatataggtctaaaattgagactgaacttagcaaaatttgtgatggaattttgagcctacttgaatctaatcttgttccttcagctggtacacctgagtctaaagttttttatcttaagatgaaaggtgattatcataggtatcttgctgagtttaagactggtgttgagagaaaagatgctgctgagagtactttgttagcttacaaatctgctcaggatattgctcttgctgacctagcccccacccacccgatcaggctgggtcttgcgctcaacttttcggtgttctattatgaaatccttaactcaccggatcgtgcgtgtaaccttgccaagcaggcatttgatgaggcaatctctgagcttgacacattaggtgaagagtcatacaaggacagcacattgatcatgcagcttctccgagacaatctgactttgtggacgtctgacatcacggacgaggctggagatgagatcaaggaaacatcaaagcaacaatccggcgagcaggagtgatgttagagttaattggatgtgtattacccttaatatagattccatgtgggtctctctagtagagattgtagtaaatgatttcaagtgtgttttccatgggatttagatggtttttcaaaggatcgtttgtgttttattattgatgagaaagaatatggcttgttggtcaagtgatttacatattttttattgtttacaattgatttattgtttacaattgatttattggctatgtaatctgagttgtctgatttcaaattaattgtcaaattaattgtcgagatctattagtgtgtaactgtgtgtaaattttacagcagtgaatctgagtcctatggagtggtaggtcatgaaagaccactggctagttgtcgtgatctgcaaagaagtccacacgcaagttatcctctaataagatgcggtgacgttcaaaatgtcatttcttagccatgaaatttctcatgagctctatctcattggcgcgaagattataggtttgcttcttccctcaccgaattaattgtatgcacggagtcaaaataatgacaaatcacattcgttctttttataggtaaatgtcaggaatcgaatcctagacatcagtcttgaagacagtttttttagtttggattaaaaatggtaccaacaaaaaaaaaacatttatgccttattagtttttctccggggtcaaactaataaggcatgtgtttaaaaagtgacattgccattacaaaatgaagttttttattatcacttaactgccctggttttg

SEQ ID NO: 9566 - DNA, 1001 bp, Coffea canephora
gtccttctcacgccacggcctcttcacttctctccatctattgtttacttccttgatccttccaaccattccaccccttcgcgcagcataatttcgtcgctgcatcgtctagagattttgcttttgatcagtatacaagggaaaatgttgcctcctgcgtctcgcgatgaaaatgtttacatggccaagttggccgaacaggctgagcggtacgaggaaatggttgagtttatggaaaaggttgcaaaggctgttgatactgaggagctaactgtggaggaaaggaaccttctctctgtggcttacaagaatgttattggttccaggagggcttcctggaggatcatctcttccactgagcagaaggaagagagccgtgggaatgaagatcatgtgaacatgattaaggaatatagaggaaaaattgaggctgagcttaccaagatctgtgatggaattttggggcttctcgagtcccatttgattccttcagcctctgctgctgagtcccaggtgttttacctgaagatgaaaggtgattaccataggtacctggctgaatttaagactggtgctgacagaaaagaagctgcagagaacactttggttgcttataagtctgctcaggatattgctttggctgaattgcctcccactcacccaattaggcttggccttgctcttaacttctccgtgttctactatgaaattcttagcgcacctgaccgtgcttgtaaccttgcaaagcaggcctttgatgaggccatctctgagcttgatacactgggtgaggaaacatacaaggatagtacattgatcatgcaactcctcagagacaatctaactctgtggacttctgatattcaggaggacgctggggatgagatcaaggaaccatcaagacttgacacaggggaggggcagcagtaatgaatttgttatgttagagtaggactttctttgggagattactgcaagacatgatgatttggtggtggatc

SEQ ID NO: 9567 - DNA, 1066 bp, Gossypium hirsutum
aaaaagttctctatcagatcaagtattagattgatatagtaaagatgtcgccaaccgaatcatcacgagaggaaaatgtttacatggccaagctggctgagcaggccgagcgctatgaggaaatggttgagttcatggaaaatgtagcaaaaactgtagatgttggtgagctgactgtggaggaaaggaaccttctttctgtagcttacaaaaatgtgattggggctaggagggcttcttggaggattatctcttctattgagcagaaggaagagagcagaggaaatgaggatcatgttgcaaccatcaaggagtataggagcaagattgaagctgagctcagcaagatatgtgatgggattttgagcctccttgagtctcacctcattccttcagcttcatctgccgagtccaaggtgttttaccttaaaatgaagggtgattatcataggtatcttgctgagttcaagactggtgctgagaggaaggaagctgctgagagcactttgttggcttacaagtctgcacaggatattgctctcggtgacctagcgccaactcacccaattaggctgggacttgctcttaacttctctgttttctactatgaaattcttaactcacctgatcgtgcttgcaatcttgcaaaacaggcttttgatgaggctatttctgagttggatacattgggtgaggaatcctacaaggatagtacattgatcatgcaacttcttcgggacaacctaaccctttggacatctgatatcacggacgaagctggagacgagatcaaggaagcttccaaacccgagtcaggggagggacagcagtgatgagttaagttcatatgatatgtactctgtaatttatgttgcaggttgtacttttacgtacatgcaatgtgggctgttgtagaaggtttttttttttttaacatttatcagtacttggagttgaaattttacattccaatggattattattatcattcggacatgaatttggttttgtttggtatcaatgttgtaatgctaaattcgagtttattgaatgttaattcagtcct

SEQ ID NO: 9568 - DNA, 1201 bp, Vigna unguiculata
gcaactctagacattcacattcttcaacaccggtcaactcttcccaccccccacggaatctccgccacctgccacgtgttcgattctcattggacctctaccctcctatatcaacgccttcatctctggaacttttctccctttattcattcttcatctctctctccttcaggattacgtggtgaggttcgcatatctgagaaatggcagattcttctcgggaggagaatgtttacatggcgaagttggccgagcaggctgagcggtacgaggagatggttgagtttatggagaaggtagcgaagactgtggaggttgaggaattgactgtggaggagaggaatcttctctctgtggcatacaagaacgtgattggggcgaggagggcttcatggaggattatatcctccattgagcagaaggaggagagcagaggcaatgaggaccacgtggctattataaaggagtacaggggaaagattgagaccgaactcagcaagatctgtgatgggattttgaacctcctcgagtccaacctcatcccttctgctcaatctcccgaaagtaaagtcttttaccttaagatgaagggtgattaccacaggtaccttgctgagtttaagactggggcagagaggaaagatgctgcagagagtactttgcttgcttacaaatccgctcaggatattgctcttgctgacctggcccccacccaccctattaggcttggacttgctctcaacttttctgtgttctattatgaaatccttaactcaccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagaagagatcaaggagacaaccaagcaaccagctgaataggccatgacagtagtgatgtggtagttgatgggatatgtattaccctaaattaatatagatccaatgtggcttgccatagtaggattgtattaatgaatttcataatttcgagtgcgagttgcgcttgggatttacaatgtttcagtggttctgtatgtgttttattgatgagatgaatgtggcttggtggttttgtgatttataaattttttattgttgcgggtata

SEQ ID NO: 9569 - DNA, 1137 bp, Cycas rumphii
gctggacagatcctcggcttcgatcctgcatttcgacggatcgattgttcgttccaaattcgctcggctccgttttctacatcgatagagatgtcgcccgtggagtcttctcgagaagaaaatgtgtacatggcgaagctggcggagcaggcagagcgttacgaggagatggtggagttcatggagaaggtgaccaagactgtggatgtcgaggagcttacagtcgaggagcgcaatctgctatccgtagcgtacaagaacgttattggtgctcgcagggcctcgtggaggatcatttcttccattgaacagaaggaagagagcagaggtaacgacgatcatgtcgccaccattcgagaatacagagccaaggtcgagtctgagcttaccaatatttgtgatagcattctgcgcttgcttgattcccatctaatcccctcctccaccactggcgagtccaaggtattttatctgaaaatgaagggtgattaccatcgctatctggccgagttcaaaacaggcgccgagaggaaggaagccgccgagaatacattactcgcatataagtctgcccaggacattgcggcttcagacctggctccgacgcatcctattagattgggattggctctcaacttctctgtcttttactatgagattttgaattcacccgatcgagcctgtacgcttgccaagcaggcatttgatgaggcaattgcagagttagatactttaggtgaagaatcatacaaagacagcactctgatcatgcagcttcttcgtgacaatctcaccttatggacttcagacatgcaggaggatgctggagatgagattagagaagctcccaaacgtgaggaaggggatgaacaatagcaaaatttggtcacatattacctgtaatagggattttagattatctggcttccctgtataatttggtgatgggtgcctttgtgcacaattttagtatgttagatgtgctggtctcggtatttagttgttgcagggaagttaatcttctttgttagctgcaattatgttagtaatttaaactatccatactgttctccaatggtttggataatggtggcttgaggttgtaatatgacagattggtaagtgagttgagcaata

SEQ ID NO: 9570 - DNA, 988 bp, Solanum melongena
ccgtcagtgccgagaatcagagaccatacgctacatcaaccaggtgttatttcacgtacaacaaaaatggccgagtctttgcgcgaagaaaatgtgtacttggccaagctggctgagcaggctgagcgatacgaggaaatgattgaatttatggagaaggttgcaaagacagtagatgttgaggagctaactgttgaggaaaggaatcttctttcagtagcctacaaaaatgtgattggcgcaagaagagcctcatggaggataatctcttcaattgagcaaaaggaggagagccgtggaaatgaagaccatgtcaacactattaaagaataccgaagcaaaattgaggctgagcttagcaagatctgtgatgggattttgagcctccttgactccaatttgatactgtcggcctcaacagcagagtccaaggttttttacttgaagatgaaaggtgattaccacaggtacctggcggagtttaaaacaggagcagagaggaaagaagctgctgagaacactttattggcatacaagtctgctcaggatattgctttggctgaactggctcctactcacccaatcaggctgggacttgcccttaacttctctgttttctattatgaaattctcaactcacctgatcgtgcttgtaaccttgcaaaacaggcatttgatgaagccatctcagagttggatacactgggggaggaatcttacaaggacagtacattgatcatgcaacttctccgagacaatcttaccctttggacttcagacaatgcggatgatgctggggatgatatcaaggaagcttcaaaacctgagtcaggtgaggggcagcagtgatgagatagtagcatagtcttgtagtctttatctctgtagggatgttggtagaagatatagcaagatgatgaatttagatactccaatggctgtgtcactgttgaaatggttcaatataaaaacatgtcagtgtgttagg

SEQ ID NO: 9571 - DNA, 1262 bp, Ipomoea nil
ggccacgcgccgcccccaactttctccaccctaacgcgttttctttataaaccgcctttcttctgtcagttcctctattgcatttcagtgtcggaaaaacgcagcggttgctgcttcagtttaagaattaggtattaattgagtatagcaaagatggtgtcaactgagtcatctcgtgaagagaatgtgtacatggccaagttggccgagcaggctgagaggtatgaggaaatggtggagttcatggagaaggttgccaagacggtggatgtggatgagctaaccgtggaggaaaggaaccttctctcggtggcgtacaagaatgtgattggtgcgaggagggcctcgtggagaatcatatcttctattgagcaaaaggaggagagccgtgggaatgaggagcttgttaagaccattaaggaatataggggtagaattgaggcagagctgagcaagatatgcgatggcatattgagccttctcgagtcccacctggttccctcggcttccactgctgagtccaaggtgttttacttgaagatgaaaggcgattaccataggtaccttgctgagtttaagaccggggctgagaggaaagaagctgccgagagcactttgttggcatataagtccgctcaggatattgcattgggtgaactggctccaacccaccctattaggctcggacttgcccttaacttttctgtgttctattacgaaatccttaactcacctgaccgtgcctgcaaccttgccaagcaggcctttgatgaagccatctcggagctagacacacttggtgaagaatcttacaaggacagcacattgatcatgcaacttctcagagacaacttaactctgtggacttctgataccgcggatgatggcggggacgagatcaaggaagcatcaaagcgggaatcaggcgaggggccgcagtaatatttagcgccattcttttgcactcccacaatctctctacgtttaatgttatgaatttaagaatgaatgatggtttgggtacttctctatagtgttgtgtttttaatacgatacagtcagtaatattcctattatcagttggttgggttgatgaagtagattatatgttagtggtttagccttgtgtctgttacaatgatgatggtaataccaatgttttttcaaatgttcttccctcctatgttggggatttgtgactattattgaaaaattttacagtttcaaaagtaatatttatgaagaataattcttgtacttag

SEQ ID NO: 9572 - DNA, 1333 bp, Allium cepa
tccgtttctcagttgggttttctcatttcactgtttctcaattccattttgccctaattcgatttacaagacataaaaggaaagatgtctccagctgagttgacccgtgaagaaaacatattcatggccaagttggcagaacaagctgagcgatacgaagagatggtcgaattcatggaacacgtggtaaaatcagttaatgctgaggagctctcggttgaggaacgtaaccttctatcggttgcttacaaaaatgtgattggggcccgccgtgcctcatggcgcataatctcctcaatcgagcagaaagaggagagccgtggaaatgatgatcacgtcaaaatgatcaaggagtatcgtgcaaatgtcgaggcggaactcagcaagatatgcggtggtattttgaatcttttagaatctcacctaattccttcttctgtggctgctgagtctaaggttttctattacaagatgaaaggagattattacaggtaccttgctgagtttaagagtggtgacgagaggaaggaggcagctgagaatacgctcactgcttacaagactgctcaggacattgctcttgctgagatgcctccaactcatcccataagattgggcttagctctcaatttctcggtgttttactacgagattctgaactcgcctgaccgtgcctgtaaccttgcaaaacaggcgtttgatgaagccatctccgaacttgataatttgggtgaggaatcatacaaggatagcacgttgatcatgcaacttctgcgcgacaacttgactttatggacttctgacctcacggaggacgcaggagatgagatcaaggaggctccgaaaggcgagggtcagtgactttttaactgattccgagaccattagaatatgtgtgcagatcatctgctgatctgcttagttgtagtagtcttggacataaattgctcaggcttgtactgagcttttttagtggtttgattactttctattgaagtatgtctaaccaatggatatttttccttgttctgtatctgtcgttttctgaaatttgtagctcatgtaaaatgacgtatccatgctgtatcctgcaagtttatgtgcccttcaatccatcatggtagttagatttagcggaagatacagtaaatgttttttaagaatgttgcaactcaatttggaccgatttgggtattgtcgtcagctttatgctacgcaatatgttatatttgtttgtatgttgcatgcttgatgaaaaagtaagttgcaactgcaaaatggattttaggtgctctcagtagatatgaacttcgacgcatgaaatctgttattt

SEQ ID NO: 9573 - DNA, 1185 bp, Arachis hypogaea
atagcagtttttaatttcaactctctttattagggttacggtcgttctctttatttggctctttacctctcgattccctttgttcttctctggttccattccccgagatctgcatctctagttgcaggagtaatcgttgagaaactcgcgaactgaaaaaaatggcggaatcatctcgcgaggagaacgtgtacatggcaaagcttgcggagcaggcggagcgatacgaggagatggtggagttcatggagaaggtggcgaagtcttctgacaacgaagagctgacggtggaggagaggaacctgctgtcagttgcttacaagaacgttatcggtgcgaggagggcttcgtggaggatcatctcgtcgattgagcagaaggaggagagtaggggaaacgaggaccatgttgcaaccatcaaggagtataggggaaagattgaagctgagctcagcaagatctgtgatggcattttgaacctccttgagtccaaccttgtgccctctgctaccacccctgagtccaaagtgttctatctcaagatgaagggtgattatcataggtacctcgctgagttcaagactgctgcagagagaaaagaagctgctgagagtactttgttagcgtacaagtctgctcaggatattgctcttgcagaccttcctcctactcacccgataaggctgggtctggcactcaatttctctgtgttctattatgaaattcttaactcaccagatcgtgcttgtaatctcgccaagcaggcatttgatgaagcaattgctgagcttgacaccttgggtgaagaatcatacaaggacagtaccttgatcatgcaacttctcagagacaatctgactttgtggacatctgatatcacggatgaagccggagatgagatcaaggaaacatctaagcaacaaccaggcgaggggcagcagtagcatggtatttcatgggatacgcaattctgtacttcactggttaatatagattccatctgggttgcaatagtaggattgtatttacagatttctatcacttcaagtacgggttgtgcttgtggtttccaatgtttcaatgaattcatgtatgtgttttttattgatcagaatatgtgtcttggttgtttagtaatttactcattttcgatgtttttaaatagaatgtttggcgttcttttga

SEQ ID NO: 9574 - DNA, 1388 bp, Pinus taeda
agcctccctcgttctttagcccttttgttgattgtatgtgttgcacagcctttcaggaggaggagaagctagcgggaaaaggtgcgccgttgctgccgaggtttggccttttggaaacacggatctctgcgtcccttgacgccattgaggattttgatctttcggtttaggttttattttcagggaaaatgtcgcctgcggagtcttctcgtgaagaaagtgtgtatatggccaagcttgctgaacaggcagagcgctatgaggagatggtagagtacatggagaaagttgccaagacagtagatgtggaggaacttactgtcgaggaaaggaatctgctgtcagtggcttataagaatgtaattggagctcgcagggcttcatggaggataatttcctccattgaacaaaaggaagagagtaggggaaatgaagaacacgttactatgataagagaatacagaggcaaggttgagtctgagctcagtaatatttgtgatggcattctacgtcttctggatacacatcttatcccgtcatccacatctggtgagtccaaggtattttatcttaagatgaagggtgattaccatcgatatcttgcagaatttaaaactggtgctgagaggaaggaagctgctgaaagtacattgcttgcatacaaggcagcccaggacattgcgactacagagttggctccaactcaccctatcagactgggactggcccttaacttttctgtattctattatgagattttgaattcaccagatcgtgcctgtacacttgccaaacaggcctttgacgaggcaattgcagagcttgatacgttaggtgaagaatcttacaaggatagcactttgatcatgcagctccttcgtgataacctcacgttatggacttcagacatgcaggaggagactggaggagatgaaatcaaagaagcgccgaagaaagaagaaggtgatggacactgaaggtgatggacgcggacatcttttttatgaatgaaatcgattaggatggtgaaggggatgaacgtcaatgtttatccgtaaatgactgtcaagtaggttagattcatgagatatggtcaaatatgttgtattagaggttttagagtgtttttgtggttttctgcacgattgtgtgctaagggggatctttcagcaaattctcctataaaatctgctgccctgcaagattttattgttgcagggtactgctttgtactccaatcataccatggagggcacacttaaagttgttatttaagtgttattgatgtcatttggaaggatacctgcttgtcagtggatggatatggtaccctgcagacctgggattgtaataacatagtggataaattactgcaagttctaatatta

SEQ ID NO: 9575 - DNA, 1085 bp, Solanum tuberosum
ctctcttcttccgtcagagaaccaggtgtaatttcacatacaacaaaaatggccgactcttcgcgtgaagaaaatgtgtacttggccaagctggctgagcaggctgagcgatacgaggaaatgattgagttcatggagaaggttgcaaagacagcagatgttgaggagctgactgttgaggaaaggaatcttctttcagtggcctacaaaaatgtaattggcgcaagaagagcctcatggaggataatctcttcaattgagcaaaaggaggaaagccgtggaaatgaagaccatgtcaacactattaaagaatacagaagcaaaattgaggctgaacttagcaagatctgtgatgggattttgagcctccttgagtccaatttaataccatcggcctcaacagctgagtccaaagttttttacttgaagatgaaaggtgactaccataggtacctggctgagtttaaaacagggacagagaggaaagaagccgctgagaacactttgttggcatacaagtctgctcaggatattgctttggctgaactggctcctactcacccaatcaggctgggacttgcccttaacttttccgttttctattatgaaattctcaactcacctgatcgtgcttgtaaccttgcgaaacaggcatttgatgaagccatctcagagttggatacactgggtgaggaatcttacaaggacagtacattgatcatgcaactactccgagacaatctcactctttggacttcagacaatgcggatgatgctggggatgatatcaaggaagcttcaaaacctgagtcaggcgaggggcagcagtgatgagatagtagcatagtcctgtagtttttatcttatagggatgttggtagaagatatagcaagatagtgaatttagatctccgatggttgtcactgttgaaacggttcaatataaaacatgtcttagtgtggtaagaatatgtggttaagtcgatcgtgtagtgctatgatcattagagttgaattggtagcattacttgcttgtgttgataactttgctcgtatttttggtctcattcgcatgtttgtgtggg

SEQ ID NO: 9576 - DNA, 1346 bp, Pseudotsuga menziesii
gtttagcccttttgtcgattgtatgtttgcacaccctttcagaaggacgagaagctaacgggaaaggcgcgcagctgctgctgagggtttgccttttggaaacacgaatctctgcgttcgttgacgccgttggggattttgatctttcggtttagtttttattttcagggaaaatgtcacctgtagagtcttctcgtgaagaaagtgtctatatggccaagcttgctgaacaggcagagcgctatgaggagatggtagagtacatggagaaagttgccaagacagtagatgtggaggaacttaccgttgaggaaaggaatctgctgtcagtggcttataaaaatgtaattggagctcgtagggcttcttggaggataatttcttccattgagcaaaaggaagagagcaggggaaatgaagagcatgttactatgataagagattacagaggcaaggttgagtctgagctcagtaatatctgtgatggcattctacgccttttggatacacatcttatcccttcatccacatctggtgagtccaaggtattctaccttaagatgaaaggtgattaccatcgatatcttgcagaatttaaaacaggtgctgagaggaaggaagctgctgaaagcacactgcttgcatacaaggcagcccaggacattgcaatttcagagttggctccaactcaccctattagactgggactggctctaaacttctctgtattctattatgaaattttgaactcaccagatcgtgcctgtgcgcttgccaagcaggcctttgatgaggcaattgcagagcttgatacactaggtgaagaatcttacaaggatagcactctgatcatgcagctgcttcgtgataacctcacattatggacttcagacatgcaggaggagactggaggagacgaaatcaaagaagccccgaagaaagaggaaggggatgggcattgacatctttttcatttaatgaaatcaagtaggatggctgaaggcgatgaacatcattgtttgtccttagatgaatgtcaagtaggttagaatcatcaaatatggtcaaatatgatatagaggttttagagtgcttttttttggttttctgcacgattgtgtgctaatggggatctttcaacaaattctcctattaatctgctgccttgcaagattttattgttgcacggtattttttgtgagttctgtactcctattataccatggagggtagtacacttaaagttgatatttaagtgttatttatgtcaagtggaaggatccctgcttgttagcaatggatggacatggtacccttgagacctgggattgtaataacatagtggc

SEQ ID NO: 9577 - DNA, 1395 bp, Sequoia sempervirens
atcgatttccgcaaggaagagaaacaaggacaagttattttactcgacttgctattcgtctctagtgtttcacttagttgtcttcctccgccgtcttctgtccagcagaaatgtcacctgtagagtcttctcgtgatgaaagcgtctatatggccaagcttgctgagcaggctgagcgctatgaggagatggtagagtacatggaaaaggtagccaagacagtagatgtggaggaactgactgttgaggagagaaatttgctctcagtggcttacaaaaatgttattggagctcgcagggcttcttggaggataatttcctcaattgaacagaaggaagagagcaggggtaatgaagaacatgttacaatgataagagattacagagccaaggttgaggctgagcttactaaaatttgtgatggcattttgcgccttcttgacacacatcttataccatcatccacatctggtgagtccaaggtgttttaccttaagatgaagggtgattaccatcgatatcttgcagaattcaaaacaggtgcagagaggaaggaagctgctgaaaacactttgcttgcttataaggcagcccaagatattgcactggcagagttggcatcaactcatccaattaggcttggactggcccttaacttctctgttttctactatgaaattttgaattcacctgatcgtgcctgtgcactggcaaaacaggcatttgatgaggcaattgcagaacttgatactttaggtgaagaatcgtacaaggatagcaccttgatcatgcagctacttcgtgataacttaaccttatggacttcagatttgcaggatgaggttggaggagatgaaatcaaagaagcaccgaagaaggaagaaggggatagccattgatatccttgttttaaatgttgtcaagaaagccagctgtatgtgatacgatttaattttttgtaacagaagttctagattttcgttgccttccctgtatttttgtggtaagtggggttttttggcaacttcttattccattctccggccttgcaggatttactcttgtagtggcttctttgccacttgtgcccattatctttattaacaagtaacttccagtcaagttctgattatatctttctctgttagtttgggagattcttggaatttggcaatggttgaatattataccctcctatggctataaacataagggtttaaatgagtagaagatttttttatcatattattctgagttttgatctcacttcctctgtcgaagtaaataatgcatattattagggaaagaggtgaccccaaactccatgagatgtccgatgtttatgcttatgcttacatgcgtgttcttatagtttttccttattttgaattccag

SEQ ID NO: 9578 - DNA, 1147 bp, Solanum phureja
aagtctatattctctactctcatcttgctctcttcttccgtcagagaaccaggtgtaatttcacatacaacaaaaatggccgactcttcgcgtgaagaaaatgtgtacttggccaagctggctgagcaggctgagcgatacgaggaaatgattgagttcatggagaaggttgcaaagacagcagatgttgaggagctgactgttgaggaaaggaatcttctttcagtggcctacaaaaatgtaattggcgcaagaagagcctcatggaggataatctcttcaattgagcaaaaggaggaaagccgtggaaatgaagaccatgtcaacactattaaagaatacagaagcaaaattgaggctgaacttagcaagatctgtgatgggattttgagcctccttgagtccaatttaataccatcggcctcaacagctgagtccaaagttttttacttgaagatgaaaggtgactaccataggtacctggctgagtttaaaacagggacagagaggaaagaagccgctgagaacactttgttggcatacaagtctgctcaggatattgctttggctgaactggctcctactcacccaatcaggctgggacttgcccttaacttttccgttttctattatgaaattctcaactcacctgatcgtgcttgtaaccttgcgaaacaggcatttgatgaagccatctcagagttggatacactgggtgaggaatcttacaaggacagtacattgatcatgcaactactccgagacaatctcactctttggacttcagacaatgcggatgatgctggggatgatatcaaggaagcttcaaaacctgagtcaggcgaggggcagcagtgatgagatagtagcatagtcctgtagtttttatcttatagggatgttggtagaagatatagcaagatagtgaatttagatctccgatggttgtcactgttgaaacggttcaatataaaacatgtcttagtgtggtaagaatatgtggttaagtcgatcgtgtagtgctatgatcattagagttgaattggtagcattacttgcttgtgttgataactttgctcgtatttttggtctcatttgcatgtttgtgtgattgaatttgcatttgataatcctggaaatattttgt

SEQ ID NO: 9579 - DNA, 1026 bp, Nicotiana tabacum
cggggatgcacaaaagctctacaatcagagaccattagctatacatcaatcagataactagacaacaaacatggccgagtcaacacgtgaagaaaatgtgtacatggccaagctggctgagcaggctgagcggtatgaagaaatggttgagtttatggagaaggtcgcaaagacagtagatgttgaagaactgaccgtggaggaaaggaatcttctttctgtggcttacaagaatgtgattggtgcaagaagggcttcatggaggataatctcttcaattgagcagaaagaggaaagccgtggaaatgaagaccatgttagcagcattaaagaatacagaggcaaaattgaggctgaactcagcaagatatgtgatgggattttgaacctccttgagtcccatttaataccagttgcctcaacagccgagtctaaagtgttttacttgaagatgaaaggtgattatcacaggtacttggctgagtttaagacaggggcagaaaggaaagaagccgcagagaacactttattagcctacaagtctgctcaggatattgctttggctgaactagctcctactcacccaatcaggctgggacttgcccttaacttttcagtgttctattatgaaattctcaactcgtcggatcgtgcttgtaaccttgcaaagcaggcctttgacgatgccatcgcggagctggatactctgggtgaggaatcttacaaggacagtacattgattatgcaacttctccgagacaatcttacactttggacttctgataccacggatgatgccggggatgagatcaaggaagcttcaaaacgcgactcaggcgacggagagcagtaaccccatagcatcatagtcttttactctttattttgtttgaatttaatataggactactgtgtgaaagctagactggatatggatacttctatgattcttcgtatcactgctgaaatggtttgatataaaaacatgttttagtgcgatgagaaatatagtcatgccattgatgt

SEQ ID NO: 9580 - DNA, 1283 bp, Solanum lycopersicum
tttaagtcaagtctacattctctactttcatcttgctttcttcttccgtcaagagaaccaggtgtaatttcacatacaacaaaaatggctgactcttcgcgtgaagaaaatgtgtatttggctaagctggctgagcaggctgagcgatacgaggaaatgattgagtttatggagaaggttgcaaagacagcagatgttgaggagctgactgttgaggaaaggaatcttctttcagtggcctacaaaaatgtaattggcgcaagaagagcctcatggaggataatctcttcaattgagcaaaaggaggaaagccgtggaaatgaagaccatgtcaatactattaaagaatacagaagcaaaattgaggctgaacttagcaagatttgtgatgggattttgagcctccttgagtccaatttaataccatcggcctcaacagctgagtccaaagttttttacttgaagatgaaaggtgactaccataggtacctggctgagtttaaaacagggacagagaggaaagaagcagctgagaacactttgttggcttacaagtctgctcaggatattgctttggctgaactggctcctactcacccaatcaggctgggacttgcccttaacttttccgttttctattatgaaattctcaactcacctgatcgtgcttgtaaccttgcgaaacaggcatttgatgaagccatctcagagttggatacactgggtgaggaatcttacaaggacagtacattgatcatgcaacttctccgagacaatctcactctttggacttctgacaatgcggatgatgctggggatgacatcaaggaagcttcaaaacctgagtcaggcgaggggcagcagtgatgagagagtagcatagtcctgtagtctttatcttataggggatgttggtggagaggatatagcaagatcgtgaatttagatctccgatggttgtgtcactgttgaaacggttcaatataaaacatgtcttagtgttggtaagaatatctggttgagtcgattgcgtagtgctatgatcattagagttgaattggttgcattacttgcttgtgttgataacttttctcgtaattttttgtctcatttgcatgtttgtgtgattgaatttgcatttgattatcctggcaatattttgttcttaaaatcttgaaacacttgcctgaaaactctaccccgtgggaattacatggaagagaaattgtattggcatgtggaccaaaaactttctggttctgtgtgatcgaacacgattgttg

SEQ ID NO: 9581 - DNA, 1220 bp, Triphysaria pusilla
ctcattggccgacggctcctcaatcccacgcccattatttaaacgcctcactcgtctgaatcgccatttcgaaggtaatcatttccgaatcgagaatcaagagcggaagaggttaattctagtgatcacatataagtatgtcgccagctgactcttcccgtgaggaaaatgtctacatggccaagttgtctgaacaggccgaaagatacgaagaaatggttgagtttatggagaaggttgtgaagactgtcgataatgatgagctgactgttgaggagaggaaccttctctctgtggcatacaagaatgtgattggtgctaggagggcctcttggagaatcatctcttccattgagcaaaaggaagagggccgtggaaatgaggatcatgttaacattattaaggaatacaggggcaagatcgagactgagctcagcaagatatgtgacgggattttgaagcttctagagtcccatctcattccttctgcatctactgctgagtcgaaggtgttttacctgaagatgaagggtgattactacagatatttggctgaatttaagactggtgctgagaggaaagaagctgctgagagcactttgctagcttacaagtctgcacaggacatcgcattggctgaattggctcccactcacccgatcaggctgggacttgcacttaatttctctgttttctattacgaaatccttaactcacctgaccgtgcttgcgcccttgcaaagcaggcttttgatgaagccatctccgagttagatacattgggcgaggaatcatacaaggacagcacattgatcatgcagcttctccgtgataacttaactctttggacatctgacattgcagatgatggtgatgatatcaaggaaaccaaacgtgattccggagagggacaacagtgatgaatatgtactgtagcagtgtgttcttattgtgttgattctagcatagaagttgagttctattgtagcaaaatttaagttgtgtgggtatttggtggtttttatggtggggaggttcgactcttttatgtgaagtgttcttgttcaggggtgaggaggattgtatggaattgcttaattgttatgtttgtttctgcttatttgatttgatgtttttttacattcagtacatttcagttcgcttatctatactccgaagtccgaagtatgtgtgtgacctggtggatttctctcctattt

SEQ ID NO: 9582 - DNA, 1009 bp, Cleome spinosa
gacccgggaagagaatgtttacatggccaagctggccgagcaagctgaacgctacgaggaaatggtggagttcatggaaaaggttgcaaacacaggcgacactgaggagcttactgtcgaagagaggaacctcttgtccgttgcttacaagaatgtgattggtgcgaggagggcttcgtggaggattatatcttccattgagcagaaggaagaaagcaggggaaacgaggaccacgtctcgatgatcaaggagtacagaggcaagatcgaagctgagctcagcaagatctgtgatggcattttgaaccttctcgagtctcacctcattccttctgcatcctctgccgagtccgaggtcttctacctacaaaatgaagggtgattatcacaggtacctcgccgagtttaagaccggagccgagaggaaggaagcggctgagagcactctgttggcctacaaatccgctcaggatatcgctctcactgaactggctcctactcacccgatcagattgggacttgcgcttaacttctctgtcttttactacgaaattctcaattcacctgatcgtgcttgtaaccttgctaagcaggcttttgacgaggcaatctctgagttggacacgttgggagaggaatcatacaaggacagtacattgatcatgcaactcctccgtgacaacctgaccctctggacttccgacatcaacgacgaggccggagatgagatcaaggatgcctcgaaaggggaatcggaagaggggcaacaggcggcgcaggcagcagctccaccagcgcagtgatgtgagtgagacaggtcccatgagtacaaataccgaatatcattgccctaaattcacagatcagtagtttttatttctgtctctctggaagatgtgggtttgtagaagcagaagtttcgatttttctatggaaaactcttttctttcttggtggtggagctttgagtgttgtttactttggacttggggaggaaggaagaaagaat

SEQ ID NO: 9583 - DNA, 959 bp, Secale cereale
agcgcgcacccgagatccgcagccgaagcccgtgagagcagcgaagcgcgagaggaaaggtactgaactagtttgtaacaaagaagagggaaaatgtctaccgctgaggcaacccgtgaggagaatgtgtacatggccaagctcgccgagcaggctgagcgttatgaggaaatggtcgaattcatggagaaggtggcaaagccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggatagcaccttgatcatgcaacttcttcgtgacaacttgactctctggacctccgataacgcagaggagggcggtgatgagatcaaggaagccgcctcaaagcctgagggagaggggcactgattggctggccctagagcgtgcccaagtttattctgagtccatttacgcagctacctgtatcattcggatcataagatgtac

SEQ ID NO: 9584 - DNA, 1104 bp, Panax ginseng
agttttctacgcgaaagtgatcgatttgctgtttccaaaatagaactaaggtactgctaaactgtattaaagatgttgccacctgagtcatctcgcgaggacaatgtttacatggccaagctcgccgaacaggctgaaaggtatgaggaaatggttgagttcatggaaaaggttgctaaaactgtagatgttgaagagctgactgtggaggagaggaatctcctctctgttgcctacaagaatgtcattggagcgagaagggcttcgtggaggattatatcctccatagagcagaaggaagatagccgtggaaatgaagatcacgtcactattatcaaggagtataggggtaagattgaggctgaactcagcaagatctgtgatgggattctgaaccttcttgagtctcatcttgttccctcggcgtcatctgctgagtccaaggtgttttacttgaagatgaaaggtgattaccacaggtacctggctgagtttaagactgggtctgagaggaaagaagctgctgagagcaccttgctagcttacaagtctgctcaggatattgcattggctgaacttgcttccactcacccaataaggctgggacttgcacttaacttctctgtcttctattatgaaattctcaactccccagatcgtgcttgcaaccttgcgaagcaggcttttgatgaagccatctctgagctggatacattgggggaggaatcttacaaggacagcacactgatcatgcaacttctccgagacaatttgacattgtggacatctgatataacggatgaagctggggatgagatcaaagaagcagctcccaagccgtcgggtgaaatcatagaatagcattctgtacttttgcatttgtgccttgctataaatctttatatggtggttgtagcaagacataatggatttgaagatctcgagtccttgttggtgcttgggtttgtgacacgtttcaacaaattacaagcttgttataatactatggtgtggtgattaatgtctcccttcccttatgtggtggggtggtttcaaaattattagttgttctattgtttgggtattaaagagattgagattatt

SEQ ID NO: 9585 - DNA, 1484 bp, Cycas rumphii
agaggatcgccgctttcgacgcagccgcagcgcagtggtatttaacctttagtccgcggtaaaaagcgcaacatttactgttgtatcttccggacttttcttcgcgttctttcaagttttcaaacccttgcataagcggaagcagaaacgaagccgagggtttggtttcgggggcggatctctggctttcagacacacattcgatatctgaccgtgcttccgctactatcgtctcgtcttcagctttcgtttgagtggttgcacagcaggagtgtaagactaggtagggatgtcacccctggagtcatctcgtgaagaaagtgtgtacatggccaagcttgctgagcaggcagagcgctatgaggagatggtagagtatatggaaaaggtagccaagacggtggatgtggaggaactaaccgtggaggagcgaaatctgctgtcagtggcttacaaaaatgttattggagcacgcagggcttcttggaggatcatttcatctattgaacagaaggaagagagcagggggaatgaagaacatgttacaatgataagggaatatagagcaaaggtcgagtcagagcttaacaacatttgtgatagcattttgcgccttcttgacacccatcttattccttcatccacatctggtgagtccaaggtgttttaccttaagatgaagggtgattaccatcggtatcttgcagaattcaaaacaggagctgagaggaaggaagctgcagaaaacacattgctagcatacaagtctgctcaagatattgcattggcagacttggctcccacacatcctattagattggggcttgccctcaatttctccgttttctactatgaaattttgaattcgccagatcgagcctgttcgcttgccaagcaggccttcgatgaggcaattgcggagttggatacgttaggggaagagtcttacaaggacagcacactcattatgcagctccttcgtgataatcttactttatggacttcagatatgcaggaggatgctggaggtgatgaaatcaaggaagctccaaagcgtgaggaaggggagggacgttgatttctcatcttaaatgacatcaatcagctctggtgaaagtgagatatcaacatatatgttatattagtgattttaaattttcctgcttttctgcataaatgtgctgatgggatccctggcattatcttttctgttaaattgccaccctgcattatcttttctgttcaatctgcctccctgccggattttggtgttggagggtttgtgtgcctactgtacacaatcttctatgttaggaaggaggtcctgttaagttgcgtttgtgttaattgatctcatttggaaatatccctgctatttggcaatggataggtatgatagcctgtagacatgggggtgtaataacatattggttaacaagtagaagcttttaaattataatttatatttctgattttgttatgcc

SEQ ID NO: 9586 - DNA, 1662 bp, Rosmarinus officinalis
ccgagaatagcaaactccgccacacccccgccacctttctctttctcattggctggccgcccctcccccctaaatttccactatttaaacctcccggtcactgcggctcctcattcgaaccatttcgtcaaatagctgactgcatatatcaaatcaaactccagatctattgctacaggttttgtactattttagcttattaaaatgtcaccagctgattcatcccgtgaggagaatgtttacatggccaagttggccgaacaggctgagcgttatgaggaaatggttgagtttatggaaaaggtggcaaaggctagtgatagtgatgagctgactgtggaggaaaggaacctcctctcagtggcatacaagaatgtgattggtgctcggagggcttcatggaggattatctcttccattgagcagaaggaagagagtcgtgggaatgaggatcatgttaatattattaaagagtaccgaggcaagattgaggcggagctcagtaagatctgtgatgggattttggggctccttgagacccatctcattccttctgcctctactggtgaatcgaaggtgttttacttgaagatgaagggtgattatcatcggtacttggctgaatttaagactggggctgaaaggaaggaagcagctgagagcactttgcttgcttataagtctgcgcaggatattgcacttgctgagttggctcctactcaccctataaggctgggacttgctcttaacttctctgttttctattatgaaatcctcaactccccggatcgtgcttgcaaccttgcaaaacaggctttcgatgaagctatttctgagctagatacgctgggtgaggaatcatacaaggacagcacattgatcatgcaacttctacgagacaatttaactctttggacatctgatgtagcggatgaagctggggatgagatcaaggaagctccaaaacgtgaatctggcgaggcagcacaacagtgatgagattgaattgtgttgatgatgtattctgaaatatgttttagtatagaagtccttgtgccgtagtaagacttgatggttatgtcatatgtggtactggaggtttctacatattgaaatgtttttctcattgacgtcgtttcttaagatctcagtgcttttgattgtgtctgctccgtgctaggtgcatttgctgttatatttgcttgtcgatttgggccaagtaattaactcatgcatattaatgcgtgccctcccctacgaagaattatataatacttgaaccattcttctttgtataggtttctctgttattgtttagttttatatttcctatggttggttattgatagtattggtagaatttaattgatgattattttactttcacccgactaaccttccaattctaatttccctgcccccaactcccctcctgattctggtttatggggttttgtgatcgaccaaataagaatacgtgattggtataatgtttcttttgtatttttcacgtttaatttaacgagattgaagttcattattgcaggtacatcatatccaatctaatccctgtgcccttgtggtaagtttgatgcggtagtccagtgtattccccttcacaatgatgtgtcaaattgtggccaagccgggttttcaatcgat

SEQ ID NO: 9587 - DNA, 1251 bp, Spinacia oleracea
ttttttctctctcttacatcaataattaatctcccccatttttaactctccttcgcccttcccccaattcctcacctcctccctctcactgtctccgtaaacgacggtttgatattttctgtgtggtagaaatggcagctgaatcatcaagggaagacaatgtttacatggccaagttggccgagcaggctgaacgatacgaggaaatggtggaattcatggaaaaagttgctaagatgacagatgctgaggagcttactgtggaggagaggaacctcttgtccgtagcttacaagaatgtgattggtgctaggagggcttcttggaggatcatttcctctattgaacagaaggaggaaagcaggggaaacgaggatcatgttgcaaccatcaaggagtacaggggtaaaatcgagactgagcttagcaagatctgtgatgggattttgaaccttctagagtcacacctcatcccttcagcttcctcagctgaatcaaaggtcttctaccagaagatgaagggtgactatcacaggtaccttgctgagttcaagacaggagctgagcgcaaggaggctgctgagaacaccctgttggcttacaagtctgctcaggacattgctcttgctgaattggcccctactcatccaattaggcttgggcttgctctaaacttctctgtcttctattatgagattttgaattcacctgaccgtgcctgcaatcttgcaaaacaggcttttgacgaggctatatctgagctggacacattgggtgaggagtcatacaaggacagcacattgatcatgcagcttctgcgagacaatctgaccctgtggacttcagacaatgcggaggagggtggtgacgagattaaggaagctgcaggaaagcgtgaatcaagcgaacaacagtgataaaatggagaattgtgctctgtatttttggcatgaaactccagtatagttgtcatttcggtcgtagtagctaggtttattagaatcacatggtgtttagtgtggagtgctggtggtagtactcggaagtcggaattagtaatctattatattcgcagacacttataaaaatagtgttatgctatgtttattaattaatatgtttaatgcgtgagatgtagttgcataattaaacctttgcatgggcagagggagtatttgatttttgtcatccttaaggttttgatgtactctcagattatttgtcaatgttaaagaattaatgctttcctaa

SEQ ID NO: 9588 - DNA, 1435 bp, Cycas rumphii
tggatccaaagaattcggcacagggacttttcttagcgttctttcaagttttcaaacccttgcataagcagaagtagaaacgaagccgagggtttggtttcgggggcggatctttggctttcagacacacattcgatatctgaccgtgcttccgctactatcgtctcgtcttcagctttcgtttgagtggttgcacagcaggagtgtaagactaggtagggatgtcacccctggagtcatctcgtgaagaaagtgtgtacatggccaagcttgctgagcaggcagagcgctatgaggagatggtagagtatatggaaaaggtagccaagacggtggatgtggaggaactaaccgtggaggagcgaaatctgctgtcagtggcttacaaaaatgttattggagcacgcagggcttcttggaggatcatttcatctattgaacagaaggaagagagcagggggaatgaagaacatgttacaatgataagggaatatagagcaaaggtcgagtcagagcttaacaacatttgtgatagcattttgcgtcttcttgacacccatcttattccttcatccacatctggtgagtccaaggtgttttaccttaagatgaagggtgattaccatcggtatcttgcagaattcaaaacaggagctgagaggaaggaagctgcagaaaacacattgctagcatacaagtctgctcaagatattgcattggcagacttggctcccacacatcctattagattggggcttgccctcaatttctccgttttctactatgaaattttgaattcgccagatcgagcctgttcgcttgccaagcaggccttcgatgaggcaattgcggagttggatacgttaggggaagagtcttacaaggacagcacactcattatgcagctccttcgtgataatcttactttatggacttcagatatgcaggaggatgctggaggtgatgaaatcaaggaagctccaaagcgtgaggaaggggagggacgttgatttctcatcttaaatgacatcaatcagctctggtgaaagtgagatatcaacatatatgttatattagtgattttaaattttcctgcttttctgcataaatgtgctgatgggatccctggcattatcttttctgttaaattgccaccctgcattatcttttctgttcaatctgcctccctgccggattttggtgttggagggtttgtgtgcctactgtacacaatcttctatgttaggaaggaggtcctgttaagttgcgtttgtgttaattgatctcatttggaaatatccctgctatttggcaatggataggtatgatagcctgtagacatgggggtgtaataacatattggttaacaagtagaagcttttaaattataatttatatttctgattttgttatgccaaaaaaaactttggatcca

SEQ ID NO: 9589 - DNA, 1148 bp, Gossypium raimondii
acgctcctcgctgtggaaagaaaaaaaaagggaaaaaaagaaacagaagttttctatcagatcaagtattagattgatatagtaaagatgtcgccaaccgaatcatcacgagaggaaaatgtttacatggccaagctggctgagcaggccgagcgctatgaggaaatggtagagttcatggaaaatgtagcaaaaactgtagatgttggtgagctgactgtcgaggaaaggaaccttctctctgtagcttacaaaaatgtgattggggctaggagggcttcatggaggattatctcttctattgagcagaaggaagagagcagaggaaatgaggatcatgttgcaaccatcaaggagtataggagcaagattgaagctgagctcagcaagatatgtgatgggattttgagcctccttgagtctcacctcattccttcagcttcatctgccgagtccaaggtgttttaccttaaaatgaagggtgattatcataggtatcttgctgagttcaagactgctgctgagaggaaggaagctgctgagagcactttgttggcttacaagtctgcacaggatattgctctcggtgacctagcgccaactcacccaattaggctgggacttgctcttaacttctctgttttctactatgaaattcttaactcacctgatcgtgcttgcaatcttgcaaaacaggcatttgatgaggctatttctgagttggatacattgggtgaggaatcctacaaggatagtacattgatcatgcaacttcttcgggacaacctaaccctttggacatctgatatcacggatgaagctggagacgagatcaaggaagcttccaaacccgagtcaggggagggacagcagtgatgagttaagttcatatgatatgtactctgtaatttatgttgcaggttgtacttttacgtacatgcaaatgtgggctgttgtagaaggttccttttattttattttttttatttttacatttatcagtacttggagttgaaattttacattccaatggattattattatcattcggacatgaatttggttttgtttggtttcaatgttgtaatgctaaattcgagtttattgaatgttaattcagtcctgttttgaacttcttgtcatttgcc

SEQ ID NO: 9590 - DNA, 1291 bp, Mimulus guttatus
tccctaacccccgtactatttaaattccccatcgtcgctctgccccattttttttctgtcaaggtgaattcattttcgaaatcgaagccaagatccattactagaggtccaatactttttagcgaataaaaaaacatgtctcgtgaagaaaatgtgtacatggccaagctggctgagcaagcagagcggtacgaagagatggttgagttcatggagaaggttgcaaagtcagtcgacagcgacgaactgaccgtggaggaaaggaatctcctctcagtggcatacaagaacgtgattggtgctaggagagcttcttggagaatcatctcttcaatcgagcagaaagaagagagccgtgggaacgaggatcacgtgaagattatcaaggaatatcgtggtaagatcgagatggaacttagcaagatctgtgacggaatcttgggactgctcgaatcccatttgattccgtcggcatcttctgctgaatcgaaggtgttttacttgaagatgaagggtgattatcataggtatttggctgagttcaagactggttctgaaaggaaagaagctgctgagagcactttgcttgcatacaaatctgcccaggatattgctgttggtgagttggcgcctactcatccgatcaggctggggcttgctcttaatttctcggttttctattacgagatattgaactctccggatcgtgcttgcacacttgcgaagcaggcatttgatgaagctatttctgagctggatacattgggcgaagagtcgtacaaggacagcacattaatcatgcagcttctacgagacaacttgactctctggacttccgatgcagcggatgatgctggggatgagatcaaggaagcttcgaaacgtgattctggggagggacaacagtgatgagtttgtgctggttacgttttattctgtacttttgtttctctctctttagtatagaattcgtgttgtagggtgacgagtaacggtggttcttacgttttgaaatgttcctttttttcctcattttaagcgtgataatccttgagaagtgaacgtggatggtttttagttttaactagttatttctattcgagcgagttgattttttattttattttttttattctgatgatatcgtttgattacggagattgatttgcagtttgagtaatgaactaaatggcttgttcgagaattcgaaagatctattctgttgagttggcttctctctggtatgagctgaagtggttataaatctaataataaagttaacaaacatgaa

SEQ ID NO: 9591 - DNA, 995 bp, Nicotiana benthamiana
attttttgttgcatcagataactagacaacaaacatggccgagtcaacacgtgaagtaaatgtgtacatggccaagctggctgagcaggctgagcggtatgaagaaatggttgagtttatggagaaggttgcaaagacggtagatgttgaagaactgaccgtggaggaaaggaatcttctttctgtggcttacaagaatgtgattggtgcaagaagggcttcctggaggataatctcgtcaattgagcagaaggaagagagccgtggaaatgaagaccatgttagcagcattaaagaatacagaggcaaaattgaggctgaactcagcaagatatgtgatgggattttgaacctcctcgagtcccatttaataccagttgcctcaacagccgagtccaaagtgttttacttgaagatgaaaggtgattatcacaggtacttggctgagtttaagacaggggcagaaaggaaagaagccgcagagaacactttattagcctacaagtctgctcaggatattgctttggatgaactggctcctactcacccaatcaggctgggacttgccctcaacttttcagtgttctactatgaaattctcaactcgtcggatcgtgcttgtaatcttgcaaagcaggcctttgatgatgccattgccgagctggatacactgggtgaggaatcttacaaggacagtacattgattatgcagcttctccgagacaatcttacactttggacttctgataccacggatgatgccggagatgagatcaaggaagcttcaaaacgcgagtcaggcgacggagagcagtaacgacatagcatcatagtctttcctctttattttgtttgattttaatataggactactgtgtgaaagctagactggatatggttatttgatgattcttcgtatcactgctgaaatggtttgttataaaaacatttttagtacgatgagaaatatagtcatgtcattgatgtattggctt

SEQ ID NO: 9592 - DNA, 1240 bp, Olea europaea
agtaatcatgaaggattgcggcattactagcacggcccaattatcatagacgaaaaagacaaaaaagggctttgacggatcattgccagcgtgttgccatccaattcccaatctagcaaagtccgtcacgatccactgatcggacggcccaatctctcccctcacgcctgttaattatttaaacctcttcaccagtctctcccttcttgtttctcgtaggccattagcagaacaaacaattccgattcaacgacacccaagagatttgagtattatatagcacagtaaaaatgtcgccagctgattcgtcacgcgaggaaaatgtatacatggccaaattggctgaacaggctgagcgctacgaggaaatggttgagtttatggagaaggtagcaaagacagtcaatgcagaggagttttctgtcgaggaaaggaacttactctctgtggcatacaaaaacgttattggtgctagaagggcttcatggagaatcatctcttccatcgagcagaaagaagagagtcgtgggaatgaggatcatgtcaatgtaattaaggagtataggggtaagattgaggctgagctctgcaagatctgtgatgggattttgagccttctcgaatcccacctcattccctcagcttcatctgccgagtccaaggtgttttacctgaagatgaaaggtgattaccacaggtatttggctgagttcaagacgggggctgagaggaaggaagtcgctgagagtactttgttagcatacaagtctgctcaggatattgcattggcagacttgtctcccacccatccaattaggctgggacttgcactgaacttctctgttttttattacgagatccttaactcaccagatcgtgcttgcaaccttgctaagcaggctttcgatgaagccattgctgagctagacacattgggtgaggaatcgtacaaggacagcacattgatcatgcaacttcttcgagacaatctgactctttggacttctgatataacggatgatgctggggacgagatcaaggacacttcaaaacccgaatctggtgaggaacagcagtgacagtagcgttgtagagttgtgagcaccatttgttgttctaccattgaatttcttctgttgtagcaagacttgagggatttggtatgtcgagtgcagtagtcccttgaatcttgaaacgttttttgttataagaacatagagtcagttataaggcgtgcaaa

SEQ ID NO: 9593 - DNA, 1380 bp, Podocarpus macrophillus
aaatccatggcaattcattctacattccttatttaacacatcatttaagatctcatctacaaagaagacgaaggacaaaaaggaggtcgttcggttctacctttctccaattgtcattgctttgcccttggtgatttcgttttccaggaacaatgtcacctacagagtcttctcgggaggaaagcgtgtatatggctaagcttgctgagcaagcagagcgctatgaggagatggtggagtacatggaaaaagtagccaagacagtagatgtggaggaacttactgttgaggaaaggaatcttctctcagtggcttataaaaatgttattggagctcgaagggcttcttggaggataatttcttccattgaacagaaggaagagagtaggggaaacgaagaacatgtttccctgataagggattacagagctaaggtggaggctgagctcactaaaatttgtgatggcattttacgtcttcttgacacacatcttataccatcatctacaactggcgagtctaaagtgttctaccttaagatgaaaggtgactaccatcgatatcttgcagaattcaaaacaggtgctgagaggaaggaagctgctgaaagcacattgcttgcatataagtcggcacaggacattgcactttcagagttggcatcaacccatccaatcaggcttggattagcccttaacttttctgtgttctactacgaaattttaaattcacctgatagagcctgtgcacttgcaaagcaggcgtttgatgaggctattgcagagcttgatactttaggtgaagaatcatacaaggacagtactttgatcatgcagctccttcgagacaacctcaccttgtggacttccgacttacaggatgatgttggcggagatgaaattaaagaacccccaaagaaggaggaaggggatggccattgattcccattttaaactgatgtcaagattttgctgttgttggggtctttctttgccattatcacatcatctatattaacgccattatcacatcatctatattaacaagtccaagtaaatttgtgatgtcttcttcggtttatttgaaattattccagcaatttgtaaaggttgacattggacctttaaaagataggattggaatagcataggtgttgaatgagcaacaaaattttattattattttcgacatttttgctttccaaatatgttatcctcagaatttaggaaagaggtcgtttgtatttctcaaaatgtgttcaatgattgtttggtctgatattttgagtcgtcaaacatatggtcaaatgttctttttgggttttggttactcacaatttggcagcatttgtcaattcaattccttttaggcactgttatg

SEQ ID NO: 9594 - DNA, 1406 bp, Zamia vazquezii
gctaccgggtttcaaacccttgcgcgtaggcagaagcagaaacggtgttcagggtttggttttgggggccgatctcgggctttcagacgcatattccgcattcgagtcacttttcgctaccatcgtctcgttttcagctttcgtttgaggagtttaaagactagttagagatgtcgcccctggagtcgtctcgcgaagaaagtgtgtacatggccaaacttgctgagcaggcagagcgttatgaggagatggtagagtatatggaaaaggtagccaagacagtggatgtggaagaacttaccgtggaggaacggaatctgctgtcggtggcctacaagaatgttatcggagcacgcagggcttcgtggaggatcatttcatccattgaacagaaggaagagagcaggggaaatgaggaacatgttacaatgataagggaatacagagcaaaggtcgagtcagagcttagcaatatttgtgatagtattttacgccttcttgacagtcatcttattccttcatccacatctggtgagtcgaaggtattttaccttaagatgaagggtgattaccatcgctatcttgctgaattcaaaacgggtgctgagaggaaggaagctgctgaaaacacattgctagcatacaagtctgctcaagacattgcattggcagacttggctcccacgcatcctattagacgggggcttgcccttaacttctccgttttttactatgaaattttgaattcaccagatcgagcttgttcacttgccaaacaggcctttgatgaggcaattgcggagctggatactttgggggaagagtcttacaaggacagcacactcatcatgcagctgcttcgtgataatcttactttatggacctcagacatgcaggaggatgctggaggagatgaaatcaaggaagctacaaagcgtgaggaaggggaggggcagtgacatctctctttgaaagacatcaagtaggtctggtgaaagtgagaggatcagggtatgttttatgttagatgttttgaaattttctgcttgtcaatgcgccgatgggattcctggcattattttctgttaaatttgcctccctgcattatcttttctgttgaatctgcctccctgctggatttgttgttgttctatgtaaggatggtggtcccattaagttgcttttgtgctaattgatatcatttgaagtatccctgctatttgggactgtaatctgggactgtaatcagggatatgataccttgtagatctgggactgtaataccgtgttggttaacaagtagaacattttaaattataatttctatttctgattttgttatgatctgttttttgccttgaaccttgttttattgcaaaactgcacataatggaggaaagtggact

SEQ ID NO: 9595 - DNA, 1143 bp, Arabidopsis thaliana
ctcatttcgcgtctcgaccttcgaattcgacaaatccctaattccaaaatcctctcggatctaaaagagtgtgtgataacataagatgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggatattgcacttgctgatttagctcctactcatccgattagactgggacttgctcttaacttctctgtcttctactacgagattctcaactcacctgatcgtgcctgcagtctcgcaaaacaggcttttgatgaggccatttctgagctggatacattaggagaagaatcatacaaagacagtacgttgataatgcaacttctccgtgacaatctgaccctttggaactctgacatcaatgatgaggcgggcggtgatgagatcaaggaggcgtcaaaacatgagccggaagaggggaaaccagctgagacagggcagtgaccagagagagagggagagacatttctaagtatgtatggtatggattttccaaaaacatatgatatgattaggggatttgtagaagcagagagaaagatctttatttgattttctccaaaaatctctgttcccttttttttttattgggttattaaagctgtttgagtctttggttcctgcttcgttgcttgttagtatttaggaagtgaagaaacaaaactttgaattattgctttccattcaactcgtcataaattatc

SEQ ID NO: 9596 - DNA, 1417 bp, Glycine max
atttaaataaacatattaaaaaaatatttaaggaaaaattacttattttattaaaataaacttgaacaaattgagcttgcataatttttgttgttgttgattatattcaaaaccgagagagtagcctttttacacgccaaagagaatctgaaatactaagaaaacacaagaaaggcaaagcagacatgaaaagcatgtcagcgtgaagtgcgacggcaggctaggccccaccacctaacaagacaaactcaacaacggtcaacgcttcccacttctcacggaatccccgccacccaccacgtgccatcttctcattggacctcccccttcttcatctcctctcctatatctacgccttcaattctcttccattttgctacgctttcttttccttcagggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattggatatgtattaccgataatatggatccaatgtggcttgccatagtgggattattgtattaatgaattttatgatttcaagtgcgcgttgcgcttgggatttacaatgtttcagtggattgtctaatgtgttttatggatgagaagaatgtggtttagtgatttataaattttttattgttgcta

SEQ ID NO: 9597 - DNA, 1074 bp, Cyclamen graecum
tcaccgctagagagagaaccaaagatcctctcattgaagaagatggtaccaacggaggcatctcgtgaagataatgtttacatggccaaattggccgagcaagccgagagatacgaagagatggttgaattcatggagaaagttgcaaaaacagtcgatgtggaggagctaactgtggaggagcggaaccttctatctgtagcttacaagaatgtgattggggctaggagagcctcttggagaatcatctcatctatcgaacagaaggaggagagccgtgggaacgaggaccacgtggcaatcattaaggagtataggggaaagattgagactgaactcagcaagatctgcagcggaattttgagtctcttagaatcacaccttgtcccttctgcttcatcggccgagtctaaagtgttttaccttaagatgaagggtgactactatagatacctggcagagttcaagactggggctgagagaaaggaggctgctgagaataccctgttggcttacaaatctgctcaggatattgctttagttgacttggcttctactcacccgataaggctggggcttgcacttaatttctcagttttctactatgagatcctcaactctcctgaccgtgcttgcaatcttgcaaagcaggcttttgatgaggcaatatctgagttggatacattgggtgaggaatcatacaaggatagcacattgatcatgcaacttcttagagacaatcttaccttgtggacttctgatgtcgcggatgaaggtggagacgatatcaaagaaacatcaaaacgggagtcgggagaggagcagtagtaatgagattgtgccttgtactcgtattttttagtcgatttaaatgtagactgtttgcatggtttgtaggagttgatcttatatgaagatctgtagtgctcttgtgcttgggattgtaatactctgctggttataacttataagcttgctccggttgcacttcattaatttgccctaacaatctgtggccttgtaatatgggttcagtcttcgtatccgtgatcttgttttcttttatatggcggg

SEQ ID NO: 9598 - DNA, 1087 bp, Zingiber officinale
gcaccagtagcgactgggaaaaagaaacgctagggcgtctcgcttcctttgcgtcgaaggaggaagatttctgtgatccagatctagcaaaatgtctcctgctgaatcctcgcgcgaggacaatgtgtacttggcgaaactggcagagcaggcggagcggtacgaggagatggtggaatacatggaactcgtggccaagccaatcaacaccgaggagcttactgtggaggagcgcaacctcctctcagtagcctataagaacgtgattggggctagacgtgcgtcccggcgcatcatctcttcaattgagcagaaagaggagggccgtggtaacgagaatcatgtgacactgatcaaggagtaccgcagtaaggtggaggctgagctcggcaagatctgcgatggcatcctgaagctgcttgattcccacctggtcccctctgccagtactgctgaatccaaagtgttttacctcaagatgaagggtgattaccacaggtaccttgcggagttcaagactggtgccgagaggaaggaagctgctgagagcactctgttagcttacaaatctgcacaggatattgctttagctgatcttgctccaactcatcctataaggcttgggctggcgcttaacttctctgtgttctactatgagattcttaattcgccagatcgtgcttgcagcctcgccaagcaggcatttgatgaggccatctccgaactggatacgttgggcgaagactcgtacaaggacagtaccttgatcatgcaacttatacgagacaacttgacactgtggacctctgacattacggaggatggagctgatgagatcaaggaagcctcaaagaaagaatcaggagagggacagtgatctcaacttagttcctagtttacgcggatataaaaatccattgtttcaggtaggtgtagttactatctactaagtttcatctgcgtgtggatgtacctagacaagtagtattgcctaaagaaggagttcacatttgtcgaaggttttctcgattggtgtatctccctgcttgtgacggaaaagctcggtttctcattcggatttaagggg

SEQ ID NO: 9599 - DNA, 1489 bp, Gnetum gnemon
cacaactggtctccacatccgccatgccaccggcagtaatcctaacccggtgactaattaaacctaacctcgccgaagtgttcgaaccgatcgaatccttcataagcagcaggagcagaggaggaggccagattcaggagcagggcatacaaattctctcttgaaaaaccaaagcttgagcgagagagagagcaagagcagttctgggttgtctgttatttttgtgggttttcggttttgcttgtgggtttctggttgcagattctgatcgaaaatggccgccgctgcgtcgctgagggaggagaatgtttacatggcgaagctcgcagagcaggccgaacgctacgaagaaatggtggagtttatggagaaagtcaccaaggccgtggaggctgaagatctgactgtggaagagagaaatctgctctctgtggcttacaaaaacgtgattggggctcgcagggcttcatggaggatcatatcttcgattgagcagaaggaggaatccagaggcaacgaggaacatgttgtcatgatcaaggaatacagagccaaggttgaaactgagctttccaagatctgcgacagcatcctgaagcttctggatacgcatctgattccgtcctccactgccggggaatccaaggttttttacctcaaaatgaagggcgactatcacaggtatcttgcagagttcaagaccggtgctgacaggaaggaggcggcggagcacacgctgctggcgtacaagtctgctcaggatattgccaatgcggaacttgcacctactcatcccattcgactggggctggctctcaacttctctgtgttttactatgaaatcttgaactcaccagatcgtgcctgtgcccttgcaaaacaggcctttgatgaggcgatagctgagttggataccttaggtgaagattcctacaaggacagcactctgatcatgcaacttctgcgggataacttgacattgtggacttcagacatgcaggaggatgctggggatgaaatcaaggaagcctcaaagcatgagggggatgagcaatagtggactaggagcaactgtttagtagtactataagaattttagtgtttttggatgtcatgtccctgaattatttgataaagaggggccttggattgattgatggatctgttgtcaaactgttcctggtctttctttgaaagatgtgatttttgatttttcttctgctttagttattttagactgtccatgttatttcttgatggatggacagtagcgcttgatggcatggaagattgttatgctagaaaatttggtaattgcaacagtgttgtctgtgtttgactgactatctattatgtttcaaactaccgcactctgaatctctgtactaagaaggttttgttttaaagtcagattaactagaaacagagtttgcatgtcacttgtgtgatttgttctggaataaatttgaaatgacataggaaattcttt

SEQ ID NO: 9600 - DNA, 1259 bp, Sequoia sempervirens
caggtttcaatactcagactggttagggtttggttggttgcaggttggaagccgtgggataagtgattctgtctgcgtctgtggtgctcatttttgttttgtttggagagatgtcgcccgttgaggcttcccgcgaggaaaatgtgtacatggcgaagctcgcagagcaggcggagcggtatgaagaaatggtcgagtttatggagaaagtgaccaagggagtggaggtggaggagctgactgtggaggagcgcaatcttttgtctgtggcgtacaagaacgttatcggtgcgcgcagggcttcatggcggatcatttcatccattgagcagaaggaagagagccgcggcaacgatgaacatgtggtgagcataagagaatacagggccaaggtcgaggccgagcttaccaagatttgtgactcgatcctgcgcctcctcgactcgcatctcattccttcctccaccaccggtgaatccaaggttttttatctcaagatgaagggcgattaccatcggtatcttgccgagtttaaaaccggagcagagcgcaaggaggccgctgagagcaccttgctcgcttacaaggctgcgcaggatattgcggtggccgagctgaccccgacgcatcctattaggcttggcctggcgcttaacttctctgtattttattacgaaattttgaattctccagatcgtgcctgtgcccttgctaaaacggcatttgatgaggcaatcgctgaattagataccttaggtgaagattcttacaaggacagtactctcatcatgcagctcctgcgtgacaatctcacattgtggacgtcagacatgcaggaggatgcaggagaggagatcaaagatgcttccaagattgaggaaggtggggaccaatagtgattaacggacagctaatcctgtattaaggcagtagattatcaggcattcctgctgtaatttgtaactggtttctttgcgtgtgatcttgtttattagatctgcttctttgcagagtgtattggctaataaactattgttacctgcaattatgttgtcattttaaacaatccatattacttgtcaatgattggatatagtgggcttggtaatgtaatagcagattgatgaatgagctgagaagtaaatttgtaaccccattctgtcttgcgctacatggcattgtgttagtgttttagtctatactcgtgtttcaattcgttcaacggaatattttcctgaatgaaaccccatcggtttctc

SEQ ID NO: 9601 - DNA, 1178 bp, Glycine max
gctacgctttcttttccttcagggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattggatatgtattaccgataatatggatccaatgtggcttgccatagtgggattattgtattaatgaattttatgatttcaagtgcgcgttgcgcttgggatttacaatgtttcagtggattgtctaatgtgttttatggatgagaagaatgtggtttagtgatttataaattttttattgttgctagtagcgtttttgtgagattcatttttcatttgatgttgtttgtttatgctcctaaatcacttgctgagcacaggccgtgacatactccctccatcctgtaataaatcttcgtgtgtaaggagaaaaaatgagtttc

SEQ ID NO: 9602 - DNA, 1307 bp, Taxus baccata
caattttttgttggcgttatatttgttattcagatcgattcttttcctgcgtcgagccgtccgattcaagaggtggggaaggatgcgtccaatggagtcatcgcgtgaagaaaatgtgtacatggcgaaattagcagagcaggcagagcgttatgaggaaatggtagagttcatggagaaggtggcaaagactgtggatgtggaggagctgagtgtggaggagcggaatttgttgtcagtggcatacaagaatgtgattggagcccgaagagcttcttggagaatcatttcttccatcgaacagaaggaagaaagccgtggtaatgatgaacatgtgaccctgatcagagactacagggctaaggttgagtctgagctcagtaatatctgtgaaggtatacttagtcttcttgattcacatctggtaccctcatctactacaggggagtcgaaggtgttttatctgaagatgaagggagattatcaccgctatctggcagagttcaagacaggtgctgacaggaaagaggctgctgaaagcactttgctagcctacaagtctgctcaagatattgccatggcagaattggcttcaacccatcctatcaggctagggttagctctcaatttctctgtcttctactatgaaattctgaattcacccgatcgagcctgtgctcttgccaaacaggcctttgatgaagcaattgcagagttggatacattgggtgaagagtcttataaagacagcacacttatcatgcaactccttcgagacaatttgaccttatggacatcagacatgaatgaggatactggagacgaaatcaaggaagccccttcaaagcgtgagggagaggggcaatgacgtgaaatgaaatagtttctaatttattattgacatgtctgactattgagcttatcagtaaagtcttgattagtagttcaagtactgtaagaatatatggtgattgtgaacttttttattgtcatccctgctgtactattaagcttgttaggaatgatttccagacaagccagatttatgctgtattcttagtatatacaatttggcacccttgttttggtttttccaaaattatatctgtggatagtatgggacagcagcactgaatctctcagaagcattttattcatattaattgtattcctacacatttgaattgagctagggacgtccctcaccttgcccccatccctgccgcccacccctttctctgctccaccaagatattcttgtggagagggcccaggggttccaaggcctagtcactaggtaataaact

SEQ ID NO: 9603 - DNA, 973 bp, Camellia sinensis
gcatcgctttagattcgtcgtgtcgagtacgaagtaggtattagttcactataacaaagatggcgtcaaccgagtcatcacgtgaggaaaatgtttacatggccaaattggccgagcaggctgaaagatacgaagaaatggttgaattcatggagaaagtggcgaagactgtggatgttgaggagctaactgtggaggaaagaaacctcctttctgtggcttacgagaacgtgattggggctaggagagcttcttggaggattatctcttccatcgagcagaaggaagagagccgtggtaatgaagatcatgtctccattatcaaggagtacaggggaaagattgaggcagaactcagcaagatctgtgatgggattctgagccttcttgattctcatctcgttccttctgcctcatctgcagagtccaaggtgttctaccttaagatgaagggtgattaccacaggtaccttgctgagtttaagacgggggctgagaggaaggaagctgctgagaacaccttgttggcttacaagtctgctcaggatattgctttggctgagttggcccctactcatccaataaggctggggcttgcacttaacttctccgtcttctactatgaaatccttaactcacctgatcgtgcttgcaaccttgcgaagcaggctttcgatgaagctatatctgagctggatacgttgggtgaggaatcatacaaggacagcacattgatcatgcagcttctccgagacaatctgacgttgtggacttcggatatcacggatgaaggggggggatgagatcaaggaagcttcaaaacgggagtctggagaggggcagcagcagtagagatgtattttgtacttttcatatgtccttaatatagattgcatttgggtgaatgtataaagactcagatgaattggagatcttgactgcttgcatgcttgaagttgtagtgttcctatag

SEQ ID NO: 9604 - DNA, 974 bp, Thalictrum flavum
gaaattggtaacaatgtcgcctactgaatcatcatcgcgtgacgacaatgtttacttggcgaaactggctgaacaagctgaacggtatgaagaaatggtagaatttatggaaaatgtagcgaaaactgtggaggtagaagagttgactgttgaggaaagaaatctgctttctgttgcttacaagaatgttattggagcaagaagggcatcctggaggattatttcctcaattgaacaaaaagaagagaatcgtggaaatgaagaccatgttgttgctattaaggagtatagaggaaagattgagactgagctttgtaagatttgtgatgggattttaagccttcttgattcacatcttgttccttctgcgactgcggcagagtcaaaggtgttttatttgaagatgaagggtgattaccataggtatttggctgagttcaagacaggtgcggataggaaggaagctgccgagagtacattgttggcttacaagtctgctcaggatattgctgtagcagagctagctcctactcatccaataagattgggacttgcactcaacttctctgtgttctattatgaaatattgaattcgcctgatcgtgcttgcagtttggcaaagcaggcttttgatgaagctatttcggagctggatacattgggagaggagtcctataaagacagtacattgattatgcagcttttgcgtgacaatctgacgttgtggacctcagatattacggatgatgctggggatgagatcaaggaagctccaaaacctgagtaaggtgaagatagatttgattgattcatctcaaatgaaacttgtatttcctactataatatagatgtccttggctttgtgtacttttagtgaagttgaaaatgcgatttgaatggcatgtaaaccatacattatattcgtgaactagttcaaggtttagttattacttttcattcataatggagttgtg

SEQ ID NO: 9605 - DNA, 879 bp, Triticum aestivum
tcggggacgaacccacagcgcgcacccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcagagtccaaggtgttctatctgaaaatgaagggtgactaccacaggtaccttgcggagttcaaggcgggtgctgagaggaaagaagcagctgagaacactcttgtagcatacaagtcggcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagccattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctga

SEQ ID NO: 9606 - DNA, 1241 bp, Avena sativa
ctccctcgaacctacatacaacagcgcacacacgccccccgagatcggatccgcagacgagagcagaagcccgtgagaaaagccaagcgcccgaggaaaagtatttttcagatacttgacaagtttgtgtaacaaacaagagggaagatgtctgctgaggcaacccgtgaggagaatgtgtacatggccaagctcgccgagcaggctgagcgttatgaggaaatggtagaattcatggagaaggtggcaaagacagctgatgttggtgagctcactgttgaggagcgcaacctgctttctgtggcttacaagaatgtgattggtgcccggagggcttcctggaggatcatctcatccattgagcagaaggaggagagccgtggcaacgagcttatgtggcttcaatcgaaggacgtaccgtaccaggattgaaactgagctgagcaagatctgtgatggcatcctcaagcttctggattcccaccttgtcccctctgccactgcagcagagtccaaggtgttctacctgaaaatgaagggtgattaccacaggtaccttgcggagttcaaggcgggagctgagaggaaagaagcagccgagaacactcttgtagcttacaaggctgcccaggacattgcacttgctgacttgcctaccactcacccaataaggcttggacttgcactcaacttctcagtgttctactatgaaatcctgaactcgccagaccgtgcttgcaaccttgccaagcaggcatttgatgaagctattgctgagctggactcccttggtgaggagtcatacaaggacagcaccttgatcatgcagctctccgtgacacttgactctctggacctctgataacgcggatgagggtggtgatgagatcaaggaggcctcgaagcctgaggaggggcactaacttgcccacaagtctgctcaaagtttatttcctgagtccatttcgcagctacctgtattattcgaatcataagatgtactagggtcggttgcactatgtgaatcataagaagtagtaggatcgtgctatgcgaaagtgtcgagctgaagtacctagtggactacagtcatgagggcatcatgtggacatcgtcgcttcaggaactgcgttactagtcattagcagatttcaaactatttcctgtgttgcagcacattattagtattgctgtattatcaattttcattggcttgttaatgattgaagatgctggtgcct

SEQ ID NO: 9607 - DNA, 1312 bp, Podocarpus macrophillus
ttttttctttgctgtgaaaatgtcgcctgtagagtcttctcgggaggaaaatgtgtacatggcgaagttggcagagcaggcggagcggtatgaggaaatggtggagtttatggagaaggtggccaaggccgtggatgtggaggaactcagtgtggaggagcggaaccttttgtcggtggcctacaaaatgttattggggctcggcgagcctcttggagaattgtctcctccattgaacagaaggaggagagccgtggaaacgaggaacatgtgggtatcattaaggattacagggccaaggtcgaggcggagctcaccaagatttgtgattcgatcctcagtctcctggattcgcatcttgttcccgcttctacaacgggggaatccaaggttttttacctcaagatgaagggagactatcatcggtatttggctgagttcaagactggtgcagagagaaaggaggctgctgagagcactttgcttgcttacaagtctgcccaggacattgcagtggcagagctggctccaacgcatcctatcaggctaggactggcgctgaacttttctgtcttctactatgaaattttgaattccccagatcgcgcttgtactctcgcaaaacaggcatttgatgaggcgattgctgaattagataccttgggggaagaatcctacaaggacagtactctcatcatgcagctccttcgtgataatttaactttgtggacttcagacatgcaggaagatgcaggagacgagattaaagaagctcccaagcctgatgaagttgtagagcaatagtaaattatgaacactttgatattgcaatagggatagtagattctcggccattcttaaagtatttgataatgggtgccttcagtgtgcaatcttgtttactagatctgctgctctgcagtattttgtttttgtggagagcatttgtgcattatcttattatcttttgttacgtgctattatgttgacacgagatcattccccagcatttgttacttgttggatatgtgctggctgggcactgtaataacagattggtgaatgagctgagtatcaaatttgtaaccctattaagtactatgtggttgtgctgtttgatattttaattggtctaatttatttcatcactgctgtcattgtattagcaatccctttcccaaaactacagttattttcatgaaagtgatcactgtattagctctccaattattttgaagaatgttgatgtaacttttgctaatctcatgatttgatcgagtgaaatttttctcttcagtggtttgaggttgac

SEQ ID NO: 9608 - DNA, 1146 bp, Secale cereale
gtgagaacagcgcagcgcgagaggaaaggtactgaactagtttgtaacaaagaaagagggaaaatagtctaccgctgaggcaacccgtcgaggagaatgtgtacatggccaagctcgccgagcaggctgagcgttatgaggaaatggtcgaattcatggagaaggtggcaaagactgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggtgatgagatcaggaagccgcctcaaagcctgagggagaggggcactgattggctggccctagagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagggcggtcatgtggacatcgtcgcttcttagttcattagcagatttcaaactatttcctgtattgcagcacattattagtattgctgtattagcaattttcatggcttgttgatgattga

SEQ ID NO: 9609 - DNA, 1243 bp, Pinus taeda
tgcccttcattgtcttgcgctgctgctttcacagaaaatccagtaacagttcttggttctgccattttagtgtgtttgtgcagtgcagcggccgtttctttgaagatccagaggtgaagttgggtttttattatctgtgtacaaatggcggcagcggcgatggtggagtcatcgcgggaggagaatgtctacatggcgaagctggccgagcaggcggagcgctacgaagagatggtggagttcatggagaaagtgacaaaaggcgtggaggtggaggagctcacagtggaggagcggaacctgctatctgtagcctacaaaaacgtgatcggtgcccgcagggcctcctggaggattatctcctccatcgagcagaaggaggagagcaggggcaatgatgagcacgtggtcaccatcagggagtacagggccaaggtggaagcggagctttccaagatctgtgagggcattctccgcctcctcgactcccacctcatcccttcttccaccgctgcggagtccaaggttttctatctcaagatgaagggcgattaccatcgataccttgccgagtttaagacaggcgccgagaggaaggaggccgctgagaacactctgcttgcttacaagtctgcgcaggatattgctgcggcagagctggctccaacgcatcctattaggctagggctggctcttaacttctctgtattttactatgagattttgaattcgccagacagagcctgtaatctcgcaaaacaggcatttgatgaggcaattgcggagttagataccttaggtgaagattcttacaaggacagcactctcatcatgcagctccttcgtgacaatttgacattgtggacctcagacatgcaggaggatgctggggaagagatcaaagagacttctaagcgtgaggacggggaggagcaatagtgaaatgtgataatcttatagtgtattaggattaggattagattaccaggctttcctgcattgtttggtaaaggaggcctatgtgcacgattgtgtttattagatctcatgctctgccacatttagttgctgtgggtagcatattcttagtcatattttgttggctgcgcttatgttggcattttatatcatctatttgcgaatggttggagacagtggcttggtactgtaatatcagattggtggagtctatcaacaaatctgtaggcccattctgcttttgtgttcaataatattttttatt

SEQ ID NO: 9610 - DNA, 1537 bp, Brassica rapa
gggtcaacagcgttagacacttgtcgtactctgattgggccttttctccaaaaactcaaaaaagcccatcttctgccctttttcccccttatttcttctcactaccctcatttcgcgtctcgtgcttccaattccacaaaccctaattccaaaccccccccccctcggatctctaacaagagtgtaatacgaaacgatgtcgtctactcgggaagagaatgtgtacttggccaagttagccgaacaagctgaacgttacgaggagatggttgagttcatggagaaagtcgccaagactgttgactccgaggagcttactgtcgaagagaggaacctcttgtccgttgcttacaagaacgtgattggtgcaaggagagcttcgtggaggatcatttcttccattgaacagaaggaagaaagcaggggaaacgaagatcacgttgctcttatcaaggactacagagtgaagattgaaaccgagctcgggaagatctgtgatgggattttgaaccttttggattctcatcttgttcccgctgcgtctttggctgagtctaaagtgttttacctcaagatgaagggagattaccataggtaccttgctgagttcaagactggtgctgagaggaaggatgctgctgagagcactctcttggcttacaagtcagctcaggatattgcacttgctgatttacctccaactcatccgattagattggggcttgctcttaacttctctgtcttctactatgagattctcaactcacctgatcgcgcttgcagtctcgccaagcaggcttttgatgaagcaatctctgagctggacacattaggagaagaatcatacaaagacagtacactgataatgcaacttctccgcgacaatctgactctctggacttctgacctcaatgatgaggtgggtggtgacgagatcaaggaggcgtcaaaagacgagcctgaagaagggaaacaagcgtagacgttgaagtgatcagaggaaggaagcgagcaagacatttctaagtatgtatggtattggatttggctttagtttcataaaacattatgatttgaggtttgtagaagcaaagagaagaccatgatttggttttcttctttggaaactctaaactctgttttttatggggttttcaagctgttgagtctttcgttgattttactttattgtttgttagtactatttatttaggaagcgaaacccccatctttaaggaatcttgggaacaaaatcaaacacccccaagggaaacaagtaaaactttaaaattatgcagagaccacagacaataaaaacagagttcgaataagtttagtttacacgccattaaccttttattttatttgtttactataatattattggttttgaagctcaaaaagctttgataagacaaatgagaaagaagcatttggattttgttggttgcctttgcctttttctcatccatgaaaacaaccttcttcctgttgtcttcttctcctcttgattttcttttgtcatcatatgtttctt

SEQ ID NO: 9611 - DNA, 1124 bp, Cucurbita pepo
tagtttgttacattgaagatgtcgactgttgattcttcacgggaggaaaatgtttacttggccaagttggccgaacaggccgaacggtatgaggaaatggtagagttcatggagaaagttgccaaaactgtggatgtggaggagcttactgttgaggagaggaatcttctctctgttgcttacaagaatgtcattggggctcggagggcctcttggaggataatatcttccattgagcagaaggaagaaagtcgtggaaatgaggaccatgttgcaattatcaaggagtaccgtagcaaaatcgaaactgaattgagcaagatctgtgatgggattttgagcctactcgagtctcatctcatcccatcagcctcatctgctgagtcgaaggtgttttatctcaaaatgaaaggtgactaccacaggtatctggctgagttcaagactggagctgaaaggaaagaagcagctgagagcacattattagcttacaagtctgctcaggatattgctcttgctgaattggctcctacacatccaattaggctaggtcttgctcttaacttctcagtgttttattatgagatcctcaattcgccagaccgtgcttgcaatttggcaaagcaggcttttgacgaagcgatttctgagcttgacacattgggtgaagaatcatacaaggatagcaccttaatcatgcaacttctccgagacaacttgaccctttggacctctgatgttggggatgaagccggcgatgaaattaaggaagcatcaaaacgtgaatcaggagagggacatggacagtagtttgtctggttgttcgagtcaataggagctgtactctgtacttttacttttccttttttctcttcttttcttctttaaaatgtggcgaccctgtcttttagtgttgttagtgctacttgggttgttgttggtagttcctgaatgaaatgatgtctttggttgatgggctttggcttttgagtgcaagatgtggaagcacttctagagccttcctttgaatactccaacaaagagtataatgtggttttattatttatgagaagaatttgatgtttcggtgtttcgatgtttcgaagtgctatggaatatgatct

SEQ ID NO: 9612 - DNA, 1263 bp, Euonymus alatus
aacgtgacggatcaatctccacggaatctccgtcacgcagcacttgtcggcttctcattggaccacgccaaccctcttctcttctcatttttttcaagacttcttcgctcttgcttttctcgcacacacttcgaatctctctcgtctctacgaatcttgatagatagtctgctgaagcaaagatgtcgcccgactcatcacgagaggaaaatgtctacatggccaagttggctgaacaggctgaaagatatgaggaaatggtggagttcatggagaaagttgcaaagacggtggaggttgaggagctgactgttgaggaacgaaacctcctttctgtagcttacaaaaatgtgataggggcaaggagggcctcatggaggattatctcttccatcgagcagaaggaagagagtaggggaaatgaggaccatgttaatatcatcaaggagtaccggagcaagattgagtctgagctaagcaagatctgtgatgggattttaaacctcctagagtcaaatctggtcccctcagccagtgctgccgagtccaaggtgttttatcttaagatgaaaggtgattatcacaggtacctggctgaatttaagactggagctgagaggaaggaagctgcagagagcactttgctggcttacaagtctgcccaggacattgctctggccgaactagcctctactcaccctataaggctgggacttgcattgaacttctctgttttctattatgaaatccttaattcccctgatcgtgcttgcaatcttgcaaagcaggcttttgatgaggctatctctgagctggataccttgggcgaggaatcatacaaggacagtacgttgatcatgcaacttctccgagacaatctgacactttggacttctgacattgcggatgatgctggggatgaaatcaaggaggcatcatcaaaacacgaatctagcgaggtgcagcaatcttgatgttagatctcatagagagtatcctattctgtactgggtttttttttttaaatcttgcgacctttaaattagttttagatgccttgtgagttgttgtagcaggatttgttgatgtatttggtgatcttgattgcagacagctcctgggttttaaatgttccggttgatcataaaatgtgcttttattatttgtgatgaagatttgtttggtttggcaatcttgtttagtcgaattagttaacataagattgtttggtagaataaaaattacacaaaacaatatgagaac

SEQ ID NO: 9613 - DNA, 958 bp, Fagopyrum esculentum
gagaaatataaaggatctgtgaggaaacatgtcggcatccagggaagaaaatgtgtatctagccaaactagccgaacaagctgaacggtacgaggagatggttgagttcatggagaaggtagccaagatggttgacgttgacattgaggaattgaccatagaggaaagaaatcttctttctgttgcttacaagaatgtgataggtgcaaggagggcagcttggagaatcatttcatcaattgaacaaaaggaagagagtcgtggaaatgaggatcatgttttcaccattaaagattacagggctaagattgaggatgaactcagcaagatctgtgaagggatactcaagcttctggattcacaccttgtaccagctgcctcatctgcagaatcaaaagtgttctatttgaagatgaagggagactaccacagatatttggctgagtttaagacaggagctgagaggaaagaggctgctgaaagcactttgttggcttacaaggcggcacaggacattgctcttgttgaattacctcctactcacccaataaggctggggcttgctctaaatttttcggtgttctactatgaaatcttgaactcacccgatcgtgcttgcaatctcgctaagcaggcattcgacgaggccatatcagagcttgatactctaggagaggaatcctacaaggacagcacacttatcatgcagcttctccgcgacaacttgacactctggacatctgatacagcggatgaagccggtgaagagatcaaggaagctgctcccggggaaggagctgatggaaaatgattattggattctaaaggaatttaagcaaatgaatgttgttttcttggttcaaacccttctttttagtgtttggcttaaatgattgccttaatgtattatggcttcttattctcagacactataattttctgctcaagttcaaagctt

SEQ ID NO: 9614 - DNA, 1174 bp, Raphanus sativus
tcatatcgcgtctcgtgcttcggattccacaaaccctaattccaaacccccccccccccctcggatctgtagcaagagtgtgattaagaaacgatgtcgtgtactcgtgaagagaatgtgtacttagccaagttggccgagcaagctgaacgttacgaggagatggttgagttcatggagaaagttgccaagactgttgacaccgaggagcttactgtcgaagagaggaacctcttgtccgttgcttacaagaacgtgattggtgctaggagagcttcctggaggatcatttcttccattgaacagaaggaagaaagcagaggaaacgaggatcacgtttcgctcatcaaggactacagagggaagattgaaaccgagcttgggaagatctgtgatgggatactgaaccttttggattctcaccttgttcccgctgcgtccttggctgagtccaaagtgttttacctgaagatgaagggagattaccataggtaccttgctgagtttaagactggtgctgagaggaaggatgctgctgagagtactctcttggcttacaagtcagctcaggatattgcacttgctgatttgcctcctactcatccgattagattgggacttgctctcaacttctctgtcttctactatgagattctcaactcacctgatcgcgcttgcagtctcgccaaacaggcttttgatgaagcaatctctgagctggacacattaggagaagaatcatacaaagacagtacactgataatgcaacttctccgtgataatctgaccctctggacttctgacctcaatgatgaggtgggtggtgatgagatcaaggaggcgtcaaaagacgagcctgaagaaggaaaacaagcgtagacgttgaagtgacctcagtaagggagcgagcaggacatttctaagtatgtatggtctggatttggctttagtttctgaaaacattatgatttgaggtttgtagaagcagagagaaggtcatgatttggttttcttctttggaaactctgaactctgttctttttttaatggggtttttaagctgttgagtctttcgttggttttacttttgttagtattatttaggagtatcttgccaacaaaatcaaacacccaactcctgccagaaaaattgtgttgaaaagttttttgccca

SEQ ID NO: 9615 - DNA, 1183 bp, Raphanus sativus
catatcgcgtctcgtgcttcggattccacaaaccctaattccaaaactccccccccccctcggatctctagcaagagtgtgattaagaaacgatgtcgtctactcgtgaagagaatgtgtacttagccaagttagccgagcaagctgaacgttacgaggagatggttgagttcatggagaaagttgccaagactgttgacaccgaggagcttactgtcgaagagaggaacctcttgtccgttgcttacaagaacgtgattggtgctaggagagcttcctggaggatcatttcttccattgaacagaaggaagaaagcagagggaacgaggatcacgtttcgctcatcaaggactacagagggaagattgagaccgagcttgggaagatctgtgatgggattctgaaccttttggattctcaccttgttcccgctgcgtctttggctgagtccaaagtgttttacctcaagatgaaaggagattaccataggtaccttgctgagtttaagactggtgctgagaggaaggatgctgctgagagtactctcttggcttacaaatcagctcaggatattgcacttgctgatttacctcctactcatccgattagattgggacttgctctcaacttctctgtcttctactatgagattctcaactcacctgatcgcgcttgcagtctcgccaaacaggcttttgatgaagcaatctctgagctggacacattaggagaagaatcatacaaggacagcacgctcataatgcaacttctccgtgacaatctgaccctctggacttctgaccttaatgatgaggtgggtggtgatgagatcaaggaggcgtcaaaagacgagcctgaagaaggaaaacaagcgtagacgttgaagtgacctcagtaagggagcgagcaagacatttctaagtatgtatggtctggatttggctttagtttctgaaaacattatgatttgaggtttgtaaaagcagagagaaggtcatgatttggttttcttctttggaaactctgtgaactctgttctttttttaatgggggttttaagctgttgagtctttcgttggttttacttttgttagtattatctaggaagtgtaacccatctttaagagtatcttgccaacaaaatcaaacacccaactcctgccagaaaaattgtgaaaaaaa

SEQ ID NO: 9616 - DNA, 1391 bp, Cephalotaxus harringtonia
gtcgcttctacacgcacggcttgttgttttgcctcggcgttttcttttcaaggagcaatgtctcatttagagtcttctcgtgatgaaagtgtgtacatggccaagcttgccgagcaggctgagcgctatgaggagatggtagagtacatggagaaagtagccaagacggtagatgtggaggaacttactgttgaggagaggaatctactctcagtagcttataaaaatgttattggagctcgcagggcttcatggaggataatttcttccatcgagcagaaggaagagagcagggggaatgaagaacatgtttcaatgataagggattacagaggcaaggtcgaagccgagctcactaaaatctgcgatggcattttacgccttctagacacgcatcttataccctcatccacatctggtgagtccaaggtgttttatctcaagatgaagggtgactatcatcgatatcttgcagaattcaaaacaggtgctgagaggaaggaagctgctgaaaacactttgcttgcatataagtcggcccaagatattgcactggcagagttggcatcaactcatccaataaggcttggactggcccttaacttctctgttttctactatgagattttgaattcacctgatcgtgcctgtgcacttgcaaaacaggcatttgatgaggcaattgcagagcttgatacgttaggtgaagaatcatacaaggatagcaccttgatcatgcagctacttcgtgataacctaaccttatggacttcagacttgcaggatgaggttggagtagatgaaatcaaagaagccccaaagaaggaggaggggaatagccattgacatccttctcttaaatgttatcaagatttaattattgcagtggtttctttgccccttgtgcacaccatctatattgacaaggaagttccagtttagttctgatcatgttttttttctgctcgtctatgttaacaaggaagttccagttatgttctgattttgttttactctgctcatttaggagtgttctgcaatttgacaaatggttggatattgtaacctcttattgtaataaacataggggttaaattagtagaaggttattgattatattattctcagttttggtctcccacgtgcttcccctttccaagaaaatgatgctcattatgatggaaagaggtcacacaagaggccttatattgtcgaaggcttatgcttacatgctttttcttgtagtttgagccacaaatatggttagttttcttagtttggattccagtaaaaaattagcagcacgtctcatttatcttacctttttaaaccaacactggaaatgatttttatcctcacattatttttgttgacctgttgttggtctgcct

SEQ ID NO: 9617 - DNA, 1205 bp, Gossypium hirsutum
cagaagttttctatcagatcaagtattagattgatatagtaaagatgtcgccaaccgaatcatcacgagaggaaaatgtttacatggccaagctggctgagcaggccgagcgctatgaggaaatggtagagttcatggaaaatgtagcaaaaactgtagatgttggtgagctgactgtcgaggaaaggaaccttctctctgtagcttacaaaaatgtgattggggctaggagggcttcatggaggattatctcttctattgagcagaaggaagagagcagaggaaatgaggatcatgttgcaaccatcaagaagtataggagcaagattgaagctgagctcagcaagatatgtgatgggattttgagcctccttgagtctcacctcattccttcagcttcatctgccgagtccaaggtgttttaccttaaaatgaagggtgattatcataggtatcttgctgagttcaggactgctgctgagaggaaggaagctgctgagagcactttgttggcttacaagtctgcacaggatattgctctcggtgacctagcgccaactcatccaattaggctgggacttgctcttaacttctctgttttctactatgaaattcttaactcacctgatcgtgcttgcaatcttgcaaaacaggcatttgatgaggctatttctgagttggatacattgggtgaggaatcctacaaggatagtacattgatcatgcaacttcttcgggacaacctaaccctttggacatctgatatcacggatgaagctggagacgagatcaaggaagcttccaaacccgagtcaggagagggacagcagtgatgagttaagttcatatgatatgtactctgtaatttatgttgcaggttgtacttttacgtacatgcaacgtgggctggtgtagaaggttccttttattttattttttttattttacatttatcagtacttggagttgaaattttacattccaatattattatcattcggacatgaatttggttttgtttggtttggtttcaatgttgtaatgctaaattcgagtttattgaatgttaattcagtcctgttttgaacttcttgtcatttgccaaatgaatctgaaggtacttaaagctccaaagtgtttgcttttattattattactattattgagggggatgtgattttgccttgtttgaggtactgctcaaa

SEQ ID NO: 9618 - DNA, 1061 bp, Plantago ovata
aatcaaaattttcacagatttcctcttattcaacatagctcaggtatactgtaagtagttgaagatgtctccagccgattcatcgcgtgaggattatgtttacctggccaagttggcggagcaggctgaacgttacgaagaaatggtggagtttatggagaaggttgcaaagtccacggagagtgatgagttgactgtggaggagaggaaccttctctctgttgcgtacaagaatgtgattggtgctaggagggcttcgtggaggatcatctcctccattgagcagaaggaggaaggtcgtgggaatgaggatcatgtcagggttattaaggaatacaggggaaagattgagactgagctcagcaagatttgtgatgggattttgggacttcttgatagtaatcttgtccctgctgctggttctgcggagtctaaggtcttctacttgaagatgaagggtgattactataggtatttggctgagtttaagattggggctgaaaggaaggaagctgctgagaacactttggcagcctacaagtctgcacaggacattgcattggctgatttggcacccactcacccaataaggctggggcttgcacttaacttctctgtcttctattatgaaattctcaattctccagaccgtgcttgcaaccttgctaagcaggcttttgatgaagccatctctgagctagacacattgggcgaggaatcatacaaagacagcacattgatcatgcaacttctcagagacaatttgactctgtggacttctgatacaacggatgacgctggggacgagatcaaggagtctggcaaaaacgaatctggtgaaggacaagagtgaattgagctttagtattgcgctcacttttgattttgttgttttagtttagagcatgttataacagcagttgatggaaaactatatgtgatggcatttggcagtttcttacagtctgcagaacttacataattaggcacctgtaagaatatactgaggtgtagaatgtttttttatcaaggagcatgatctacggagcttcatattatta

SEQ ID NO: 9619 - DNA, 1134 bp, Secale cereale
agcgcgagaggaaaggtactgaactagtttgtaacaaagaagagggaaaatgtctaccgctgaggcaacccgtgaggagaatgtgtacatggccaagctcgctgagcaggctgagcgttatgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtagacctaccgacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggcggtgatgagatcaaggaagctgcctcaaagcctgagggagaggggcactgattggctggccctagagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattga

SEQ ID NO: 9620 - DNA, 1350 bp, Sesamum indicum
tttctcccactcctattatttaaacacctcgcttctcactccgcaggcaggagacccatttccaagggaagattcatttctctgtcaaatttctatagctaaggaggttaaattctagtaatcacataaaagtatgtcgccagctgactcttcatgcgaggaaaatgtgtacatggccaagttggccgaacaggctgagaggtatgaggagatggttgaattcatggagaaggttgtgaaggccgtggacactgatgagctgacagtcgaggaaaggaaccttctctctgtggcatacaagaatgtgattggtgctaggagggcttcatggaggatcatctcttcaatcgagcagaaggaagagagccgtggaaatgaggatcacgtgaacactattaaggaataccggagtaagattgaggctgagctcagcaagatctgtgatgggattttgaaacttcttgagacccatctcattccttccgccgcttctgctgaatcgaaggtgttctatttgaaaatgaagggcgactatcataggtatttagctgagtttaagactggggctgagaggaaggaagctgcagagagcactttgctagcttacaagtctgcgcaggatattgcactggctgagttggctcccactcacccaattaggctgggactcgcacttaacttctcagttttctattatgaaatccttaactctcctgatcgtgcttgcaaccttgcgaagcaggcttttgatgaagccatcgctgagcttgatacattgggtgaggaatcatacaaggacagcacattgatcatgcaacttctccgagacaatttaactctttggacctctgacatagcggatgatgctggcgatgagatcaaggaaactgccaaatctggcgaaggacaacagtgatgcatttgtactctagcagtttactctttcgttttgttgttttagtatagaagtctgttggagcaagatttggtggagatgatgccggggtatttgtggttcttgcagtttgaccaatttactcgttttagacatggatggtgatactgtttctgttcacgagagtcaatgtaagaattttcatattgttgttatgttcgcttttgttgctaccagagctggtgattgcatcaagtaatacatgttagctaattgagcaatcggagtatcctcgcttacctatattacaatcggtaatacttccaactcgttattgtggattttctctagtatttgcccaaaaaattggattatgccttgaaaagtcgaatagtggaatagcggcaatactgaagagtgttaaatggacttgtcacactgaatagtcatcacta

SEQ ID NO: 9621 - DNA, 1282 bp, Taxus baccata
ggcccaatcgttgcaagcgtcaccatatatagcggcaaatctagcggaaaggaatccaggtataattaaccaataatctcaatcccgctacatttagcgaaggtttattgtttttcttctttcagatttggtggtcgcaggttcgaatccacaaatactgtctagggtttggctggttgcaggttcgaatcccgcgggcaccgtgtttctgtttctgttactttctttttcgttcgatttgtttcagagatatgtcgcctgtggaggcttcccgcgaagaaaatgtgtatatggcgaagctcgcagagcaggcggagagatacgaagaaatggtggagttcatggagaaagtgaccaagggcgtggaggtggaggagctcacagtggaggagcgcaatttgctgtccgtggcgtacaagaacgtcatcggcgcgcgcagggcgtcgtggaggattatttcctccatcgagcagaaggaggagagccgcggaaacgatgatcatgtggtgaccataagagaatacagggccaaggtcgagtccgagctcaccaagatctgtgactcgatcctgcgcctcctggactcgcatctcattccttcgtcgaccaccggggagtcgaaggtgttttatctcaagatgaagggcgactatcatcgctatcttgcggagtttaagaccggcgcagagcgaaaggaggccgctgagagcaccttgctcgcttacaagtctgcacaggatattgcggtggcagagctgaccccgacgcatcctattaggctgggattggcgcttaacttttctgtattttactacgaaattttgaattctccagatcgtgcctgtgctcttgctaagacggcattcgacgaggcaattgctgaattagataccttaggtgaagattcttacaaggacagtactctcatcatgcagctcctgcgtgataatctcacattatggacttcagacatgcaggaggatgctggagaggagataaaagaagctcccaagcttctggaaggaggggatcaatagtgaataacggacactaatcctatattaggactatggattattgggaactcctgttgtattttgtaatggttaccttttgcgtgcaatctgattgattagatcttgctagtatgcagagtatttagttgctgcagagagacttgcaattatgttagcatgttaaaccatccatattatttgccaatggttggatatagtggcttggtaatgtaaaagcagattgatgaatgagctttgtagtggaa

SEQ ID NO: 9622 - DNA, 1174 bp, Vinca minor
acttaatttgaactagaaaatatggtgctcaccgattcacctcgcgaggagaatgtttatatggccaagttggctgagcaggctgagaggtacgaggaaatggtcgaattcatggaaaaagttgccaagggggcagatgctgaagaactgactatggaggaaaggaatctgttctctgtagcttacaagaatgttattggggctaggagagcttcatggcgaatcatctcctctattgagcaaaaggaagagagtcgtggtaatgaagaccatgtggcaattattaaggaatataggggaaagattgaagccgagctcactaaaatatgcgatgggatattgcaacttcttgagggacatcttatcccctctgccaatgctggagagtcaaaggtgttttatctgaagatgaaaggtgactatcatagatacttagccgagttcaagactggtgctgagaaaaaagaagctgctgagaatacgctagttgcttacaaatctgctcaggacatttccctggctgagcttcctccgacacacccaataagattaggtcttgcgctgaacttctctgtgttctactatgagatactgaactcacctgaacgtgcttgcgctcttgctaagcaggcttttgatgaagctatatccgagctagatacattgggcgaagaatcctacaaagacagcacacttatcatgcaacttcttcgcgacaatttgactttgtggacttctgatgtgccggaggatgctggtgctgagatcaaggaagcttccgtcaatgagccgggcaatggtgagaagtaatttttgcaatcttgctggagggttcaacagattaactagatttagggcttgggatgtagtatttgttgttatgatacactataaaccgtgttaaattttgcgattatgcttcgttaataatcagaaccaccatatgatacgatactggagtttactaatgattagcagttgagtagtcagttttgtctttccagtatatttgctaatcatagcaaatctagaacccttaaaatttgactcagtaattacccaaagtagcatacttagcgtcttgcgtgggagatagatctgggttctgtacttttgagtgtaaaatgacattaatgcccttatcttttatttgggcaaattggtgaaatcagtc

SEQ ID NO: 9623 - DNA, 1190 bp, Arabidopsis lyrata
tcctttcgcgtctcgagcttcgaattcgacaaatccctaattccaaaatcctctcggtaagctacggatctaaatgtttttttgataacagaagatgtcgtcttctcgggaagagaatgtgtacttagccaagttagctgagcaagctgaacgttatgaggaaatggttgaattcatggagaaagttgcaaagactgttgacaccgatgagcttactgtcgaagagcgaaacctcttgtctgttgcctacaagaacgtcattggtgctaggagagcttcctggaggatcatatcttccattgaacagaaggaagaaagcagaggaaacgatgatcatgtttccattatcaaggactacagagggaagatcgaaaccgagctcagcaaaatctgtgatggaatactcaatcttctggattctcaccttgttcccactgcatctttggctgagtccaaagtcttttacctcaaaatgaaaggagattaccacaggtaccttgctgagtttaagactggtgctgagaggaaggaatctgcagagagcactctggttgcttacaagtcagctcaggatattgcacttgctgatttagctcctactcatccgattagattgggacttgctcttaacttctctgtcttctactacgagattctcaactcacctgatcgtgcctgcagtctcgcaaaacaggcttttgatgaggccatctctgagcttgacacattaggagaagaatcatacaaagacagtacactgataatgcaacttctccgtgacaatctgaccctatggaattctgacatcaatgatgaggcgggcggtgatgagatcaagggggcctcaaaacatgagccggaagaagggaaaccagcagagacagggcagtgaccagagagagagggagagacatttcttagtatgtgtggtacggattttccaaaaaacatatgatgattatgggatttgtagaagcagagagaaagatcattatttgattttctccttgaaaactcaaaaaactctgttctcttttttttttaatgggttttaaagctgttgagtctttgattccgtcttcgttgcttgttagtaattactaattaggaagtgaagaaacaaaacttagaattattgctttggattcaactcgtctaagattatcattaagggtatcagtgtataattt

SEQ ID NO: 9624 - DNA, 960 bp, Eutrema parvulum
aacatttttttttaaaatagtattgcaaagatgtcttctgagtcgtcccgggaagagaatgtgtacatggccaagttggccgagcaggctgagcgttatgaggaaatggttgagttcatggagaaagttgcaaagacagtcgatactgcggagcttactgtcgaagagaggaacctcttgtctgttgcctacaagaacgtgattggtgctaggagggcttcgtggagaatcatctcctccattgagcagaaggaagaaagcaggggaaacaacgatcacgtctcgattatcaaggactacagaggcaagattgaaactgagctcagcaagatttgcgatggcattttgaaccttctcgagtctcacctcgttcctactgcatccttggctgagtccaaagttttctacctcaaaatgaagggagactatcaccgctacctcgccgagttcaagactggagctgagaggaaagaagctgctgagagcactcttttggcgtacaagtcagctcaggatattgctcttgctgatcttcctcccactcacccaatcaggctggggcttgctcttaacttctctgttttctactatgagattctcaactcatctgatcgtgcttgtaacctcgcaaaacaggcttttgatgaggcaatctctgagctagacacattgggagaggaatcatacaaggacagtacattgatcatgcagcttctccgtgacaatctcaccctctggacttctgacctcaatgacgaagctggtgatgatatcaaggaagcctcgaaagaggtgcagaaaggtgacgaacaagcccaaccaccaccgtcgcagtgatgaaaccatgtccatggaatgaattacaaagaaatcgtattgtttagttctgtgtgtttcacgtaaacagaaagcaaaaaagaaaaaaaaatcttgtagtttccttttaaacatgggtttgta

SEQ ID NO: 9625 - DNA, 1383 bp, Chrysanthemum coronarium
caactccgccccctaggcaataacacgtgtcacaatcccattcgtccatctccctctcattcacgcgtctcccatttatttaaaccctcacaattcgcttcctctcatttctcctccgatcaaaacagaatctctctcacacacaaacacaaaacccccttttcttccttttcacacactcaggtaactacttaatagaatggcaactgaagcttcacgtgaggagaatgtgtacatggccaagctcgcagagcaggccgagaggtacgaagagatggttgagtttatggagaaggttgccaagactgtcgacgtcgaggagttgacagttgaagaaaggaatcttctttccgtggcttacaagaacgtgattggagctaggagggcttcgtggaggatcatttcttccattgagcagaaggaagagagccgtgggaacgaggaccacgttaagctgatcaaggattacaggagtaccatcgagactgaactaagcaagatatgtgatggtatcttgggacttcttgagtcgcatcttgttccatctgcttcgtctgctgagtcaaagatcttttacttgaagatgaagggtgattactttaggtacttggctgagtttaagaccggatctgacaggaaggaagctgctgagagcactttgttggcttacaaatctgctcaggatatcgctctctctgacttggctcccacccaccctatcaggcttggacttgcacttaacttctcagtgttttattatgagatccttaactcacctgaccgtgcttgcaacctcgccaagcaggcttttgatgaagctatcgctgagttggatacattaggtgaggactcgtacaaggacagcaccctgatcatgcaacttctccgtgacaacctcactttgtggacatctgatattgcggatgaggctggcgatgagatcaaggaatcttcaaagccggaggaaacacagtgatttaatttggtttcgtaggaaaatagtttgtgcactactcattggtactttatagatcttctattcagatggcgtgtatctgggactaaatggtgcctatggttgaaagcttgttcaagtacttgtggcttgcctatggttgtgctttgaacttgagttggttcttccttttaaattaattctggatttttaggcactcttttgtgtgtctcgttatatgctcttattattgtgtttccgaagctgtttgggtggcttctttcctttgattgttcgtgacccatattttgttttacattcgaggttgtcactctaaagaatgttatgcttttgtacccaataaataacgactcatttaaaatttccagctatttatcgaatatgagtttttgtcgtcgacaacccat

SEQ ID NO: 9626 - DNA, 1105 bp, Taraxacum officinale
tcaagagcatcacacacactaacacctagcaacacacactcgctgctgttcgccctaataatcgagggatttactaattaatagaatggcatccgaagcttcacgtgaggaaaatgtgtacatggcgaagcttgcagagcaagccgaaaggtacgaagaaatggttgagttcatggagaaggtcgccaagactgttgacgttgaggaactcacagtagaagaaagaaacctcctctccgttgcttacaagaacgtgattggagccaggagggcatcatggaggatcatctcctcaattgaacagaaagaagagagccgtgggaatgaagatcacgtcaagctcatcaaggactacaggagtacaatcgagactgaattaagcaaaatctgtgacggaattttgggtcttcttgagtcacaccttgtcccttctgcttcttctgctgaatcaaagatcttttacttgaagatgaaaggtgattatttcagatacttggctgagtttaaaacaggtgctgagagaaaggaagctgctgagagcactttgttggcttacaaatctgctcaggatattgctttatccgacttggcacccactcacccaatcaggcttggacttgcacttaacttctctgtgttttattatgaaatcctcaactcccctgatcgtgcttgcaaccttgccaaacaggcttttgatgaagcaattgctgagctggacacattaggtgaggattcatacaaggacagcacactcatcatgcaacttctccgtgacaatctcactttgtggacatcagatatcgcggatgaaactggggatgagattaaggagacaacaaaagctgaggaagcacagtgacataaagaaaaggggatttggtaggaaaattaatagtttgtgtactactactattactattactatggctactcattaatgaaaaattgaagacttgaagttggtttaatcaaatgctacttctgttattgtgttttctgaaagctatttttgttttttttttattggaggttagttgatgtagcctctgcaggatgtttgtttttgtaccccccatgaaataatgagtgattggattttttc

SEQ ID NO: 9627 - DNA, 2106 bp, Conyza canadensis
agccaactccgtcccctaagaaaacataacacgtgtcatattgtcattggcttatttctcctctctttcacaccttcctcaattatataaacccctcgaatccgcttctttccatcccctccgataaaaccgcatcaaatttcaccttaaacaccttcaaatcacacacactctctggccgccccttcttatcagtcaatttagaaatggcatcagctgaaccttcgcgagaagaaaatgtgtatatggctaagttggctgagcaggccgaaaggtatgaggaaatggttgagtttatggagaaggtagcaaagactgttgacgttgaggagttgacggtggaggaaaggaatcttctttctgtggcttacaagaatgtgattggtgctaggagggcatcatggaggatcatatcttccattgagcagaaggaagagagccgtgggaatgaagatcatgttaagctgattaaggactacagagctacaattgagactgaactaagcaaaatctgtgatggaattttgggactcctggagtcgcatcttgttccttctgcttcttctgccgagtctaagatcttttacttgaagatgaagggtgattactttagatacttggctgaattcaagacaggagccgataggaaggaggctgccgagagcactttgttagcttataaatctgctcaggatattgctctctccgacttggctcctactcacccaattcggctaggacttgcacttaacttctcagtgttttattatgagattctcaattcacctgaccgtgcttgcaatcttgccaagcaggcatttgatgaagctattgccgagttggatacattaggtgaggattcatacaaggacagcacactgatcatgcagcttctccgagataatctcactctgtggacatctgatattgcggatgaggctggagatgagatcaaggaatcctcaaaacccgaagaaactcagtaagatacaggggttttgtaggaaaatagtttgtgtactacgcattggtacgttttaggtcttctatttaaagtgacgtgatgatttgcacaattgttgggtgctgctagcatacccaatagattgaaagcttgttcaagtacttgtggcttaggactcgagttggtttttctttttatcaaattctggatttttaggcacactactgtgtctggctcatcatatgtttattgtgtttctgaagctattttgggtggcttcgccccttctattgtttgtgacccatatattgtttaccatggaggtcactctaccacaaatgtttgcttttgtacccgctaaataatgaatgtttttacttttccggctatcatagattcatcttttgttacaaacaaaatcgttttcttgaatagctacacatttttggaacaattgtttttcaaagagttctcatagtctatgatgcaccgaaactccaaacaggtaggcgtacccgtttccgaaactccatggaaacgtttccgcatacgaaacacgtatgaaacgtctccttgaattttctatagataccgaaacgtttctttgaagtttccatactgtttctaactaatatcaaggttttaatgggctttttctattccccaaacccagacaggctatattatatacaatttgattaacattaaattttttctattccaaaaccaattattaaacactaaacattcaatgagtgatcactgatcaagcatatattatacagttatacatataaaattacacataatctctcaattctcaagtatttctctataaaaaattgatataatttatatttgtatattttttattgccgtacccgtatcctggattttgtagttttgtcgttccccgttcccgtatcgttcccgtacccttttgccgtatccgtttcggtgctacatagtatgtaatcttaagttgaatctagtgtccatacaataacaagaattgttggcaattattatataattaatttcaaaatgcatagacagatccctgagtagttgtgtaattaccttttctttactgtgtaccagccagcacagattgctggatgtaaaacagtagtgcttgcaac

SEQ ID NO: 9628 - DNA, 1076 bp, Glycine max
ctttcttctccttttagggtttcctttttgtttctcctttccagatctgcatcttccattttttaggattaagcggtgagattcgtgaatctgagaaatgtcggattcttctcgggaggagaatgtttacatggcgaaattggcggagcaggccgagcgttacgaggagatggttgagttcatggagaaggtagcaaagactgtggaggttgaggagttgacggtggaggagagaaatcttctctctgtggcttacaagaacgtgattggtgcgaggagggcttcgtggaggatcatatcctccattgagcagaaggaggagagcaggggcaatgaggaccatgtggccattataaaggagtacaggggcaaaattgaggctgaactcagcaagatctgtgacgggattttgaacctccttgagtccaacctcatcccatccgccgcatctcccgagagtaaagtgttttaccttaaaatgaagggtgattaccacaggtaccttgccgagttcaagactggggcagagaggaaagaggcagcagagagtactttgcttgcttacaaatctgctcaggatattgctcttgctgacttggcccccactcaccccattaggctgggacttgctctcaacttttctgtcttctattatgaaatccttaactcgccagatcgggcttgtaatcttgccaaacaggcatttgatgaggcaatttccgagcttgacacattgggtgaagagtcatacaaggatagtacgttgatcatgcaacttctccgtgacaatctgactttgtggacatcagacatcacggacgatgctggagatgagatcaaggaaacatctaagcaacaaccaggtgaataggcgatggcagtagttgatgggatatgtattaccgataatatacatccaatgtggcttgccatagtggaactgtgtattaatgagtttcgtgatttcaattgcgggttgcgcttgagatttacaatgtttcagtcgtgtatgtgttttattgacgagaacaatgtggcttggtggtttagtgatttataaattttttattgttgct

SEQ ID NO: 9629 - DNA, 1015 bp, Arnica chamissonis
caaacaccttaacacacacataaacgctgctgctcgccctatcaatcgaggtctatactaatcaatagaatggcatcaaccgaagcctcacgtgaggaaaatgtgtacatggccaagttggcagagcaggccgaaaggtatgaagaaatggttgagtttatggaaaaggttgcaaagacagtggatgttgaggagttgaccgtggaggaaaggaatcttctttctgtggcttacaagaatgtgattggagcgaggagggcgtcatggaggataatatcctccatcgagcagaaagaagaaagccgcgggaacgaagatcatgttaagcttattaaggattacagggctacaatcgagactgaactaagcaaaatctgtgatggtattctgggccttctggaatctcatattgttccttccgcttcatctgcagagtcgaagatcttttacctgaagatgaagggtgattactatagatacttggctgagtttaagacaggagctgatagaaaagaagctgctgagagcactttattagcttacaaatctgctcaagatattgctctatctgacttggctcctactcacccaatacggctagggcttgcacttaacttctcagtgttttattatgagattctaaactcacctgaccgtgcttgcaaccttgccaagcaggcttttgatgaagctattgctgagttggatacattgggagaggattcatacaaggacagcacattgatcatgcaacttctccgtgacaatctcactttgtggacatctgatatcgcggatgatgctggggatgagatcaaggagtcctcaaaacccgaggaaacgcagtgactgaaaaacagtatgtttactacacatcagtaccttattttaaagtatcctattacgaatgacgggtatcaaggacataatgatcaccatcaccgcacgatgctagcactcagtagttcaagtacccgtggctcgcagtttgttatctgcttagggcttgagttag

SEQ ID NO: 9630 - DNA, 1225 bp, Brachypodium distachyon
atctcccccccaacaaacgcgttctccttcctactccttccgtccagtccccggatccgctgcccttccttcccccaaactccgaccccggccagcgagcgagcgagagaagcagcagccatgtcgccggcggagccgacgcgggaggagagcgtgtacatggcgaagctggcggagcaggcggagcggtacgaggagatggtggagttcatggagcgcgtggccaaggccaccggcggggccggccccggggaggagctctccgtcgaggagcgcaacctgctgtccgtcgcctacaagaacgtcatcggcgcccgcagggcctcctggaggatcatctcctccatcgagcagaaggaggaaggccggggcaacgagtcccacgccgctaccatccggacctaccgcagcaagatcgaggccgagctcgccaagatctgcgacggcatcctcgccctcctcgactcccacctcgtcccttccgccggcgccgccgagtccaaggtcttctacctcaagatgaagggcgactaccacaggtacctcgcggagtttaagtctggcgctgagaggaaggaagccgcagagagcaccatgaacgcctacaaagctgctcaggacattgctcttgcagatttggctccgactcaccccataaggcttgggcttgcacttaacttctctgtgttctactatgagatcttgaactctcctgaccgtgcctgcaaccttgcaaaacaggcctttgatgaggctatatcagagctggacagtctgggtgaagaatcctacaaggacagcactttgatcatgcagctcctgcgtgacaacttgactctatggacatctgacaccaatgaggatggtggtgatgagatcaaggaagccccggctccaaaagaatctggagatggacagtaagctcagacaccagtctgatccaccagcggttgttgggggtaatgaaaatcgagggacttggatttgatagctatgttctagcatacatgctgctatcgtcgctgtgtcgatgagcagacaacgctgtttaattaagtacttagaagtttctgggctatgcttttcttgtgttgataaatgctggctggatcatggttttcttgttccaatggccactagcaaaaacctgctctttttcacccattagaatgtttgctatatcaatcatgtttgacaagactcattaactagtactgttctactg

SEQ ID NO: 9631 - DNA, 1211 bp, Daucus carota
gtctttaccagctgtcaccttcttattgggcccaaacccagcccaatttcatccgtcttataaatttcacatcttcacgtctgctgcttctctctcgcccccaaatcaaaacacacatcacttatttttcaattcgaagataaataactgtaaagatggtggcttcggatgcatctcgtgaggacaatgtttacaatgccaagcttgctgaacaggctgagcggtatgaggaaatggttgagtttatggaaaaggttgctaagactgtagatgttgaggagcttactgtggaggagaggaatcttctatctgttgcttacaagaatgtcattggagcaagaagggcttcttggaggatcatatcttccattgagcagaaggaagagagccgtggaaacgatgatcatgttaacattattaaggagtacaggggtaagattgaggctgaactcagcaagatctgtgatgggatcttgaaccttctggactcacatctcgttccttctgcatcttcggccgagtcaaaggtgttctacatgaagatgaaaggtgattaccacaggtatttggctgagttcaaggttggggctgagaggaaagaagctgctgagagcaccttgctagcatacaagtctgctcaggatattgctttagctgaattggcttctactcacccaataaggcttggacttgcactcaacttctctgttttctactatgaaattctcaactcccctgatcgtgcttgcaaccttgcaaagcaggcttttgatgaagcaatctctgaactggatactttgggtgaggagtcgtacaaggatagcacactaattatgcaacttctccgtgacaatctgacattgtggacatctgatattgcggacgaagctggggatgaaatcaaagaggatcccaagccatctgatgattagcaacatcaatgaagtgctagaatagtattgtgtactcgtcacattgtgtctttattacagattttcatttcgcaaggatttggaaatatctagtttggatttcaattgatgattgatgttgtgattgggttctctatttatggctcttctaaattgcagtcaagtgtagtttacccccccccccccccccccccccccccccccccccccccccccccccccccccccccccccccccccccccccccccccccccccccccccccccccccccccccc

SEQ ID NO: 9632 - DNA, 1169 bp, Chelidonium majus
ttcatatctgtcttccgtctccgttctcattccatcagatctgaaacaatggcatcaccaagagaggaattcgtctacatggcgaaactagctgaacaggctgaacgatatgaagaaatggttgaattcatggagaaggttacaactaatgttgaatccgaggaacttacagttgaagaacgtaaccttctttctgtagcttacaaaaacgtaatcggtgctcgtcgtgcttcatggcgtattatttcatcgattgaacagaaagaagagagccgtggtaacgaagataacgtgtcgactatccgtgattacagatctaagatcgaaactgaactttcttcgatctgtgatggtatcttaaagttgcttgattccaggctgatcccttctgctaccaccggtgattctaaggtcttctatttgaagatgaagggtgattatcatcgttaccttgctgagttcaaaactggtgctgaacgtaaagaggctgcggagagtaccctcaatgcttacaaatcagcccaggatattgctactgctgagcttgctcctactcacccgatcaggcttggattggctcttaacttctccgtgttttactatgagatcttgaattctcccgatcgcgcttgcagtcttgccaaacaggcatttgacgaagctattgctgagcttgacaccctaggggaagaatcatacaaggacagcactttaatcatgcagctccttcgcgacaatctcactctgtggacctcagacatgcaggatgatggagcagatgagatcaaggaagcacccaagcgtgaagacgaacagtaatgaagaatttcgttttttcttcttcttaagattagggtttccacctctcctcagtttgttttattaaaagggagaaggtgtgcttggtaccaaaattcctcccccctcagtctatttatgaagtttaaaagagagttgaggtaccgagtttctttagtttgtcattcttatcttttgtgtttctcttatctaattcttctgttaaagagtttgaagttgtatgttttatcttaatctttgttgcaactctgttttacctaaattatcttgaagatgttctcttttaattatggaatcagtgaatgcatttaaatccttctcatctttgtattcaatataatgtttgtgct

SEQ ID NO: 9633 - DNA, 1121 bp, Cirsium arvense
taagagtacacgtgtctccttctcattggcttattctttctcactttcacgcgttccccattttatataaacccctcgaatccgcttcttttccttctccttcgctcaaagagaatcacacacacacaaaaacacctagtagatacacacacacttgcttctgctcgccctatcgatcgagcgatataccaatcaatagaatggcatcagctgaagcttcccgtgaagaaaatgtgtacatggccaagctggcagagcaggccgagaggtacgaagaaatggttgagtttatggagaaggttgccaagactgtggatgttgaggagttgacagtggaggaaagaaatcttctttccgtggcttataagaacgtgattggagctaggagggcatcatggaggatcatatcttccattgagcagaaggaagagagccgtgggaatgaagatcatgttaagctaatcaaggactacaggggttcgatcgagactgaattaagcaaaatctgtgatggtatcttgggtcttctggagtcgcatcttattccttcagcctcaactgctgagtcaaagatcttttacttgaagatgaaaggtgattactatcgatatttggctgaatttaagacaggagctgataggaaggaagctgctgaaagcactttattagcttacaaatctgctcaggacattgctctttctgacttggctcctacccacccaattcggctaggacttgcacttaacttctcagtgttctattacgagattctcaattcacctgaccgtgcttgcaacctcgccaagcaggcttttgatgaagctattgctgagttggatacattaggtgaggattcatacaaggacagcaccctgatcatgcaacttctgcgtgacaacctcactttgtggacatctgatatcgcggacgagggtggggatgagatcaaggaatcctcgaaagcggaagaaagtcagtgacgtaggaaaggaaaggaaggaaagaaaatagtatttgtgtaccgtttttataggtctttgtattcggaatgatttccgatagattgaatgcttgattgcttgctttatgggttgccgattgttgtttgggagttggtcttt

SEQ ID NO: 9634 - DNA, 1106 bp, Flaveria ramosissima
attttccccccgtcggcacagaaaccacacacataaacccttaattactctcaaccccatcgattcagaatcagccacaactgattataaaaatggcgcaaactgaagcttcgcgtgaagaaaatgtgtacatggccaaattagcagagcaggcagaaaggtatgaagaaatggtagagttcatggagaaggttgtgaagattgttgattctgaagagttgacagtggaggaaagaaatcttctttccgtggcttacaagaatgtgattggtgctaggagagcttcgtggaggattgtttcttctattgaacagaaagaagaaagccgtgggaatgaagatcatgttaccacaattaagaactacaggggtaagatcgaggtggaattgagcaaaatctgtgatggcatcttgggcctcctcgagtctcatcttattccttctgcatcatctgctgaatctaaggttttttacttgaagatgaaaggagattattacagatacttagctgagtttaagacaggagccgacaggaaggaagctgctgagaatactttattaggatacaaatctgctcaggatattgctttagccgatttggctcccacccacccaataaggctgggtcttgcactaaatttctcggtgttctattatgaaattcttaactcacctgaccatgcttgcagtctcgctaagcaggcgtttgatgaagccatctctgagctagacacacttggtgaggattcatataaagatagcacattgatcatgcaacttctgcgggacaacctcactttgtggacatctgatgctgcggacgagacaggggatgagatcaaggaagcttcaaatccggaggaaaagcagtgatatttacaagtcaaatgatgatagttgtgtactacttttggtggtgttttttattttaggttttcatttagggtgtttttatattgagaacataatggatatttgcacattctctatggttgctgcttgctagtttctcataggttgtaagcttgtccaagttattgacgtttggttttgtgtcatgcttctgttaattgcaactttagatgtttatgctctaaagctcttctg

SEQ ID NO: 9635 - DNA, 1060 bp, Flaveria ramosissima
ttctccttcgatcaaatagaatcgcacacacaaccgctgctgttcgctctatcaatcaaggcatatactaacagaaatggcatcaactgaagcttcacgtgaggaaaatgtgtacatggccaagctggcagagcaggccgaaagatacgaagaaatggttgagtttatggaaaaggttgtaaagattgttgacaatgaggagttgactgtcgaggaaaggaatcttctttctgtggcttacaagaatgtgattggggccaggagggcatcatggaggatcatatcttccattgagcagaaggaagagagccgtgggaatgaagatcatgttaagctaatcaaggattatcgtgctacaattgagagcgaactaagcaaaatatgcgacggtattttgggtcttttggattctcatctggttccttctgcatcctctgcagagtcgaagatcttctatttgaagatgaagggtgattactttagatacttggctgaatttaagactggagctgataggaaggaagctgctgagagcactttattagcttacaaatctgctcaggatattgctctatctgacttggcccctactcacccaattcggcttgggcttgcacttaacttctcagtgttttattatgagattctcaattcacctgaccgtgcttgcaaccttgccaagcaggcttttgatgaagctattgctgagttggatacattaggtgaggaatcatataaggacagcacattgatcatgcaacttctccgtgacaacctcactttatggacatctgatatcacggatgaggctggggacgagacgaaagaacctccaaaagcagaggaaacacactgattgatatacacacgttttgtaggaaatactcgtgtgtactttattatagatgttctgttctgaaagagggacagactgttttgcgcaatcctggggtgttgaaatccctgaagtttggtgattgttatctgcgtaagacttgagttggtttttcgtataattaaattctggattattatgtttctggagtctgtttgggtagtc

SEQ ID NO: 9636 - DNA, 926 bp, Zingiber officinale
cgtccaaagggaaaatacaaagggtggaaatttttagtctagatctagcaaaatgccgccggtggaaccgccccgcgaggagaatgtttacttggccaagctggctgagcaggcggagcggtatgaggagatggtcgagtccatggacaaggtggtgaagacgatcaacggggaggagctcaccgtcgaggagcgcaacctcctctcagtagcctacaagaatgtcattggagctcgtcgtgcgtcctggcgaattatctcctccatcgagcagaaggaggagagccgcggcaacgaggaccatgtttctttgataaaacattatcgagccgaggtcgaagcagaactcagcaagatctgctatggtattctgaagctacttgattcccacctcgtcccctccgccaccagtgcagaatcaaaggtcttttatcataagatgaagggtgactaccacaggtacctggctgagttcaagactggagcagagaggaaagaagcagctgaaaacactcttttggcatacaaatctgcacaggatattgctttagctgatttggctcctactcatcctataaggcttgggctggcactgaacttctctgtcttctactatgagattctgaactcaccagaccgtgcttgtagccttgcaaagcaggcttttgatgaggctatctctgaacttgattctttgggagaagaatcatacaaagacagcaccttgataattcaacttcttcgagacaacttgacgctgtggacctccgatatcacggaggatggaacggatgagatcaaggaagctacgaagaaggaaacaggcgagggcctgtgaacttaatttagttcatttatcttgctaaaagaacgaaattatctgcttgtagtgtggcattttccataataaagcaaccaatactccc

SEQ ID NO: 9637 - DNA, 1096 bp, Actinidia deliciosa
gttcctctgcaagagagagagattcgccgcgaagaagtagtattagtttagcataacaaagatggtgccaccggagttgcgggaggaaaatgtttacatggccaaattggccgaacaggctgaaagatacgaagaaatggttgaattcatggagaaagtggtgaagtcactgacttccggcgagctgactgtggaggaaaggaacctcctttctgtggcttacaagaatgtgattggggctaggagggcttcttggagaattatctcttctatcgagcagaaggaagagagtcgtggaaatgaagatcacgtcgcgattatcaaggagtacagggggaagatcgaggcagaactcagcaagatctgtgatgggattctgagccttcttgagtcgaatctcattccttctgcctcatctgcagagtccaaggtgttctactttaagatgaagggtgattaccacaggtacctggctgagtttaagacgggggctgagaggaaagaggctgctgagagcaccttgttggcttacaagtctgctcaggatattgctgaggctgatttggctcctactcacccaattaggctgggtcttgcacttaacttctctgttttctactatgaaatcctcaactcccctgatcgtgcttgcgatcttgcgaaacaggcttttgatgaggctatttctgagctggatacattgggcgaggaatcatacaaggatagcacattgatcatgcaacttctccgggataatctgacattgtggacttctgatatcacggatgaaggtgcggatgagatcaaggaagcttcaaaacgtgagcccggagaggggcagtagtgactagttggtaggagatgtactctgtactttttaaattggtatcgtaatagggattgcctttgagtggtataaagacttgttaaattggaagatttagcactgcttggggttgtaatacccttataagctcgtgtttattacttatgaaaagggtattgtttggtgcttgatggctctgatacttgagacagtccttgagttggtgatttttgttccaatactatgttgtttgtgcttaaaaaaaaaaaa

SEQ ID NO: 9638 - DNA, 1182 bp, Liriodendron tulipifera
tttttctgcttacctctcctctctcctcctctccttcagatcagaaaaaggaaacaaagaaaaaaaaaaaaaagaagaagagaaaattcgaaatggcttctcctcgcgaggaaaacgtctacatggcgaaactcgccgagcaggcggagcggtacgaagagatggtggagttcatggagaaagtgactgcggccgtcgaatcggaggagctgacggtggaggagcgcaacctcctgtccgtcgcgtacaagaacgtgatcggtgcgcgccgcgcgtcctggcgtatcatatcctcgatcgagcagaaggaggagagccgcggcaacgaggaccacgtggcaaccatccgcgactacagggctaagatcgaatccgagcttacctccatctgcgatggcatcctccgcctcctcgacacccgcctcatcccctccgcctccgctggagattcgaaggtcttttatctgaagatgaagggcgattaccaccgttacctcgccgagtttaagaccggcgctgagaggaaggaggctgctgaaagtacactcgctgcctacaaatccgcccaggatattgcagtggcagagctggcgccgacgcatccgatccggctcgggctcgctctcaatttctctgtgttttactatgagatcttgaattctccagatcgagcatgtacactcgccaaacaggcttttgatgaagcaattgctgagctggatactctcggcgaagaatcatacaaggacagtactctgataatgcagctccttcgtgacaacctcaccttgtggacctcagatatgcaggatgatggggcagatgagatcaaagaagcccccaagcgtgaggacgaacagtaggagcaagtttaattcggttccgggttagggtttcacttctccacttgatttcaaaataggagaagatgtggttgttgctgtttctgctccccccctttttttttataagtttaggagtctcagctcacagattacctgacctacaaggtaccgagttttgttagaccgtgatatttttatttttcctgtgcgtgcgtgtttgtgttttcttttctttttctttttaccttttttccttcttccttttgctatgataagttgcagctgtgtttgcgtttcatcatgtttggaactctggtttctatcaagttattgatgc

SEQ ID NO: 9639 - DNA, 1424 bp, Mimulus guttatus
aggaggtagtgaaatgacgaaaaagggcatggaggagtcagtgccagcgtgtcaccattgattttctccgccacaaacccaccacttctcacatcccattggccggcagcacttcctcttcccccattatttatttatttaacctctctctctctctctccctctccactttcaaaagccattttctcccaactcataattcaacttccaaccaggttaaatcttattaatcacataacagcatgtctccatcagctgacccatcgcgcgaggaaaatgtctacctggcaaagctgtctgagcaggccgaacggtacgaggaaatggtcgagtttatggagaaggtcgtaaagacaattcacggcgacgagctaacagtcgaagagaggaacctcctctccgtggcgtacaagaatgtgattggtgcaaggagggcttcgtggaggataatctcttccatcgagcagaaggaagagagccgtgggaacgaggatcacgtgaacattatcaaggagtaccgaggcaagatcgaggctgagctcagcaagatctgcgacgggattttgagccttctcaacagtcatcttgttccttctgcggcttctgctgagtcgaaggtgttttatttgaagatgaagggtgattactataggtacttggctgagttcaagaccggagctgagaggaaggaagctgctgagagcactttgcttgcttacaagtctgcgcaggatattgcgttggctgaattggcacccactcacccgattaggcttggacttgcgctcaacttttcagttttctattatgaaatccttaactcgcccgatcgagcttgtgcccttgcaaagcaggctttcgacgaggccatctctgagctagatacgttgggtgaggaatcatacaaggacagcacattgatcatgcaacttctccgagacaatttaactctctggacttctgacatagcggatgatggtggcgacgagattaaggaaacctccaaaggcgagtgacggcaatgatgaatttgtattctagcaaatgtgctcttcgttttgttgtttcaatatataagtcgtcttaggcaaagatttgattggtacgaacgaatgttgtgattcttctttttttacggtttcggactatttattatcgtttattattccttaaaagtgtgtgattgctgcccgttagaaagcgtggagtggcgataaaaaatgtttcggttcacgactcacgagaggtgtgatgttcgaaatctcatgttgttgttttctttctatttattttatttaagaatgggggggtgtgctcaccttatattgaaatggataataataatatcatccctaatttatcacttcgtctcttttgtatgcctaatctactgcagtttgttctatgctagctctgtcgtatag

SEQ ID NO: 9640 - DNA, 1223 bp, Allium cepa
tagttacggggggtcgggaatctgtgtcgtcaatccgagccctttatcttcttcttcctctttcgattttccccctcattctgatcccaacggaaaatttctcatccgggagatcaaaagcataaagaagaattattttaactaaacaacacaagaaaaatgtcttcatcccgcgaggaaaacatatacatggcaaagctagcggagcaggcagagaggtacgaagagatggtagagttcatggaaaaagtagtgaaagcagcagatacagaggagctcagtgtggaggagaggaatcttctgtcagttgcttacaaaaatgtaattggtgctcgccgtgcttcatggcgtattatttcttcaattgagcaaaaggaggagagccgtggtaatgaagatcatgtgaacatgatcaaggagtatcgtgcaaaagtcgaggctgaactcagcaagatttgtgatgggatcctaaagcttctagattctcaccttatcccttcctcttctggtgcagagtctaaagttttttacctcaagatgaaaggggattaccataggtacctagctgagtttctgactggtgatgctagaaaagatgcagctgaggatacgctcactgcatataagtctgctcaggatatcgctcttgctgagatgcccccaactcatccaatcaggctgggattggcactcaacttctcagtcttctattacgagattttgaattctcctgatcgtgcttgtagtcttgccaaacaggcatttgatgaagctatatccgaactcgacagcctgggtgaggaatcttacaaagatagcacattgatcatgcagcttctccgagacaatttgactttatggacctctgacatcacggacgatgctggagatgaaaacaaggaggcttcgaaaaaagaagccgaggaccagtaatttacctcctaaatgaaacctaaacgcaagcaggtgatagcttatgaaaccaaccaagttaaaatgcttgtctgttcccatcttattctaattcatagttagatttaaaatgatttgtgagaactgtaagcttctgttgttgattatgaatctgtaaactagtgttttcaataagactttgatacttctgttatgtgctctcttttatgactatcagttgttatcttatattgttacgtttcatctcactgattaacaatttgtttcatctcaccgagtaaaacacacac

SEQ ID NO: 9641 - DNA, 957 bp, Allium cepa
ctcagccgcgttttctcattgcactgttttttgtttccgtttgccctaattcgatctacaagacataaaagaaaagatgtctcctgctgagttgacccgtgaagaaaacatattcatggccaagttggcagaacaagctgagcgatacgaagagatggttgaatacatggaacacgtggtaaaatcagttaatgccgaggagctctcagttgaggaacgcaaccttctatcggttgcttacaaaaacgtgattggggcccgtcgtgcctcatggcgcataatttcatcgatcgagcagaaagaggagagccgtggaaatgatgagcacgtcaaaatgatcaaggagtatcgtgcaaatgtcgaagctgagctcagcaagatatgtggtggtattttgaatcttttagaatctcacctaattccttcttctgtggctgccgagtctaaggttttctattacaagatgaaaggagattattacaggtaccttgctgagtttaagagtggcgatgagaggaaggaggcagctgagaatacgctcactgcttacaagtctgctcaggacattgctctggctgagatgcctccgactcatcccataagattgggcttggctctcaatttctcggtgttttactacgagatcctgaactcgcctgaccgtgcctgtaacctagcaaaacaggcatttgatgaagcgatctctgaacttgataatttgggtgaggaatcgtacaaggatagcacgttgatcatgcaacttctgcgcgacaacttgactttatggacttctgatctaacggaggatgcaggagatgagattaaggaggctccaaaaggcgagggtcagtgattttttaactgattccgagaccattagaatatgtttgcagatcatctgttgatcttgttagttgtagcagtcttgaacataaattgctcaggcctgtactgagc

SEQ ID NO: 9642 - DNA, 1113 bp, Allium cepa
ttagttacggggggtgtcgttcaatccgagccctttatcttcttcttcctctttcgattttcccctcattctgatcccaacggaaaatttctcatccgggagatcaaaagcataaagaagaattattttaactaaacaacacaagaaaaatgtcttcatcccgcgaggaaaacatatacatggcaaagctagcggagcaggcagagaggtacgaagagatggtagagttcatggaaaaagtagtgaaagcagcagatacagaggagctcagtgtggaggagaggaatcttctgtcagttgcttacaaaaatgtaattggtgctcgccgtgcttcatggcgtattatttcttcaattgagcaaaaggaggagagccgtggtaatgaagagcatgtgaacatgatcaaggagtatcgtgcaaaagttgaggctgaactcagcaagatttgtgatgggatcctaaagcttctagattctcaccttatcccttcctcttctggtgcagagtctaaagttttttacctaaagatgaaaggggactatcataggtaccttgctgagtttctgactggtgatgcaaggaaagatgcagctgaggatacactcactgcatataagtctgctcaggatattgctcttgctgagatgcccccaactcatccaatcagactaggattggcactcaacttctcggtcttctattacgagattctgaattcacctgatcgtgcttgtagtcttgccaagcaggcatttgatgaagctatctccgaactcgacagcctgggtgaggaatcttacaaagatagcacactgatcatgcagcttctccgagacaatttgaccttatggacctcggacatcacggatgatgctggagatgaaaacaaggaggctccgaaaaaagaagcagaggatcagtaatttacctcctaaacgaaacctgaatgcaagcaggtgatcaattatgaaaccagcctagttaaatgcttgttgtttctgatcttgttctaatttatagaaagagttaaatgatttgtgggagctacgagcctctgttgttggattatgaatatttaaaccagtgttttcaataagactggtgcttttgccg

SEQ ID NO: 9643 - DNA, 1440 bp, Cajanus cajan
ggtcaacgcttcccactttccacggaatctccgccacccaccacgtgtcacactcctattggacctcacctctcctatatcttagcctccctttccccatcttttccccatttccatttttttctaaaattttctctctccttcaggattaggcgaatctgagaaatggcggcaacagattattctcgggaggagaacgtctacatggcgaagttggcggagcaggctgagcggtacgaggagatggtggagttcatggagaaggttgcgaagacggtggaggttgaggagttgacggtggaggagaggaatcttctctccgtggcttacaagaacgtgattggggcgaggagggcttcgtggaggatcatttcctccattgagcagaaggaggagggtagaggcaacgaggaccacgtgaccgttataaaggagtacaggggcaagattgaggctgaactcagcaagatctgtgatgggattttgaacctccttgagaccaacctcatcccctctgctgcaactcccgagtccaaagtcttttaccttaaaatgaagggtgattaccataggtaccttgctgagtttaagactggggcagagaggaaagaggctgcagagagtacattgcttgcttacaaatcggctcaggatattgctcttgctgacctggcccccacccacccgattaggcttggacttgctctcaacttttctgtgttttattatgaaatccttaactcaccagatcgtgcttgtaaccttgccaagcaggcatttgatgaggcaatttctgagcttgacacattgggtgaagagtcatacaaggatagtacattgatcatgcaactcctccgtgacaatctgactttgtggacatcagacatcacggatgatgctggagatgagatcaaggaaacatctaagcaacaaccagctgaataggcgatgggcagttgtaatgtggtagttgatgtgatatgtattacccttaatatagatccaatgtggcttgccattgtaggattgtattaatggatttcatgatttcaagtgcgggttgcgcttgggatttacaatgtttcaatggttcgtgtatgtgttttattgatgagaagaatgtggcttggtggtttagtgatttacaatttttttgttgttgttagtgtatgaatgcatagtgttcttgtgaggtttattttgcatttaatggtgtgtttgtttatactcctgaatcacttgcagtgcacagccggcaaatatctaaacttttatagcaaaatcaaccatcttggtacgggatttctttttgtttatagccccgaatcacttgcaataggattctaaggtagaccgcctatgatggtggatcaccatgtgccacaattaatggcccaagtttacataaatattgtgcactctcgacatcgtagcactatt

SEQ ID NO: 9644 - DNA, 1169 bp, Glycine max
ctctctccgtcaggttcatcgtcccactttcttctccttttagggtttcctttttgtttctcctttccagatctgcatcttccattttttaggattaagcggtgagattcgtgaatctgagaaatgtcggattcttctcgggaggagaatgtttacatggcgaaattggcggagcaggccgagcgttacgaggagatggttgagttcatggagaaggtagcaaagactgtggaggttgaggagttgacggtggaggagagaaatcttctctctgtggcttacaagaacgtgattggtgcgaggagggcttcgtggaggatcatatcctccattgagcagaaggaggagagcaggggcaatgaggaccatgtggccattataaaggagtacaggggcaaaattgaggctgaactcagcaagatctgtgacgggattttgaacctccttgagtccaacctcatcccatccgccgcatctcccgagagtaaagtgttttaccttaaaatgaagggtgattaccacaggtaccttgccgagttcaagactggggcagagaggaaagaggcagcagagagtactttgcttgcttacaaatctgctcaggatattgctcttgctgacttggcccccactcaccccattaggctgggacttgctctcaacttttctgtcttctattatgaaatccttaactcgccagatcgggcttgtaatcttgccaaacaggcatttgatgaggcaatttccgagcttgacacattgggtgaagagtcatacaaggatagtacgttgatcatgcaacttctccgtgacaatctgactttgtggacatcagacatcacggacgatgctggagatgagatcaaggaaacatctaagcaacaaccaggtgaataggcgatggcagtagttgatgggatatgtattaccgataatatacatccaatgtggcttgccatagtggaactgtgtattaatgagtttcgtgatttcaattgcgggttgcgcttgagatttacaatgtttcagtcgtgtatgtgttttattgacgagaacaatgtggcttggtggtttagtgatttataaattttttattgttgctatgtagttgcctcttttttattgacgagaacaacgttggattttttttttttttaagtcaatgactc

SEQ ID NO: 9645 - DNA, 1130 bp, Zostera marina
agaatagcgatcatagataaagaaatgtcaccagcagagtcaccaagagaggaaaatgtatacttggcaaaagtctccgagcaagcagaaaggtatgaagagatggttgagttcatggaaaaggtcgtgaaatccgtagatgcagaggagctcacagttgaagagcgtaatctcctctctgtggcatacaaaaatgttatcggagctcgtcgtgcctcttggagaatcatatcttctattgagcagaaggaagagagccgtggcaatgaagatcatgtatctttaattaaaacctatcgtggcaagattgagattgagctaagcaaaatctgtgatggaatcttgaagttacttgaaactcatctcatcccatcagctagtgcagcagagtccaaggtgttctatctcaagatgaagggtgattattacaggtaccttgctgagttcaaaactggagctgagaggaaagaggctgccgagagcactttggtagcttacaagtctgctcaggatactgccataacagatttggcacccactcatccaataagacttggacttgcacttaatttctcagtcttctattatgaaatcttgaactcacctgaccgtgcctgcagccttgcgaaacaggcatttgatgaagctatctcagagttggacactttgggtgaggaatcatacaaagacagtacattgatcatgcaacttctcagagataatttgacactgtggtcctctgacatcaatgaagagggcggtgatgagatcaaagaggcctcgaaggctgaaggaggtgatgagaagtgatgtgatgatcaagtatggtctccaaaatgaaaaaacaaagcagagagaatgtgataaaattaaaatggtctccatttgtcctttcttcgtttttgttatgcttttccccttctgtcatggggatgcagcaagattctgtttgctttggaatattgttcaatttgtgctccgccctatttaacaacgttatttcttatgtttagtaaatgatgattgtcagtctatttgacaaatatgctttgcttagtttttatggtgctgtctattttatggtgctgacaaattaaaatgcaaattaatttaacttaatttacttaaag

SEQ ID NO: 9646 - DNA, 1444 bp, Amaranthus tuberculatus
ctgaattggacctcatattttctatattttctcaataaattctccaccatttttatcttcctccattttcgcaactccaatcagtaccttactttctctctcttccccataacatcgattgtgatacgtggttattgtagtgaaaatggcagctgattcgtcaagggaagaaaatgtgtacttggccaagttggctgagcaggctgagcgctatgaggaaatggtggagttcatggaaaaagttgcaaagatggcagatgctgaggaattaactgtggaggagagaaatttattgtctgtagcttacaagaatgttattggtgcaaggagggcttcttggaggattatttcttctattgagcagaaggaggaaagcagaggaaatgaagaccatgttgctaccattaaggaatacaggggtaagattgagactgagcttagcaagatctgtgatgggattttgaatatccttgagtcacacctcatcccttcagcttcgacagctgagtctaaggtcttctaccttaagatgaagggtgactatcataggtaccttgctgagttcaagactggagctgagcgcaaggaggccgctgaaaatacccttttggcctacaagtctgctcaggatattgctcttgctgaattggcccctactcatccaattaggcttgggcttgctcttaacttctcagtcttctactatgagattctgaattcacctgaccgtgcctgcaatcttgcaaaacaggcttttgacgaggctatctctgaactcgacacattgggagaggagtcatacaaggatagcacattgatcatgcagcttttgcgagacaacttgactctttggacttcggacaatgcggaggagggcggtgacgagatcaaggaagccgcaggaaaacgtgaatcaggagagggtcagccacagcagtgataagttggagattatgctttgtattttgagcatgaaactccagtatagtagctaggtttattagattcatatcacctttagtctaaagtaccggtcatacaccgatgtagtcatctcttttcatcgtagacatgaaacggcctcacgccatgttaatttctatgttcgatgtgtgggttttagttgcaattcaacctttgtcatggacagaagggagagtcacgaggcacgactcacaaagtattcgatttttgcagtcgtcttgaaggttttgtgtactcttgttattgtttgcttatgctaaaagtatttttaataatggtttcgtttccgtttggagttaaactgaagtttggtgagacagaaaatggagaacaaaaagttatctatatatggtgtggactattatggcgtacttttttgggctattagtacgtgcccatctttcttggtgtggttgtatagatttttactcgtgatcaaatttaagtactagtaagtggt

SEQ ID NO: 9647 - DNA, 1428 bp, Brassica oleracea
acaaaccctaattccaaaaatccccctcgagtgtgatacgaaacgatgtcgtctactcgggaagagaatgtgtacttggccaagttagccgagcaagctgaacgttacgaggagatggttgagttcatggagaaagttgccaagactgttgactccgaggagcttactgtcgaagagaggaacctcttgtccgttgcttacaagaacgtgattggtgctaggagagcatcgtggaggatcatttcttccattgaacagaaggaagaaagcagagggaacgaagatcacgttgctcttatcaaggactacagagtgaagattgaaaccgagctcgggaagatctgcgatgggattttgaaccttttggatactcaccttgttcccgctgcgtctttggctgagtccaaagtgttttacctgaagatgaagggagattaccataggtaccttgctgagttcaagactggtgctgagaggaaggatgctgctgagagcactctcttggcttacaagtcagctcaggatattgcacttgctgatttacctccaactcatccgattagattgggacttgctcttaacttctctgtcttctactatgagattctcaactcacctgatcgtgcttgcagtctcgccaagcaggcttttgatgaagcaatctctgagctggacacattaggagaagaatcatacaaagacagtacactgataatgcaacttctccgtgacaatctgaccctctggacttctgacctcaatgatgaggtgggtggtgatgagatcaaggaggcgtcaaaagacgagcctgaagaagggaaacaagcgtagacgttgaagtgatcagaggaagggagcgagcaagacatttctaagtatgtatggtatggatttggctttagtttcttaaaacattatgatttgaggtttgtagaagcaaagagaagaccatgatttggttttcttctttggaaactctaaactctgtttttttttatggggttttcaagctgttgagtctttcgttggttttactttattgtttgttagtactatttatttaggaagcgaaacccccatctttaaggaatcttgggaacaaaatcaaacacccccaaggctccaactccggcgagaaacaagtaaaacttcaaaattaaaattatgcagagaccacagacaataaaacagaattcgaacaagtttagttttcacaccattaaccttttattttatttgtttactataatattattggttttgaagctcaaaaagcttcgataagacaaatgagaaagacgcatttggattttgttggttgcctttgcctttttctcatccatgaaaacaaccttcttcctgttttcttcttctcttcttgattttcttttgtcatcatatgtttcttgtcttcatctaccttcacat

SEQ ID NO: 9648 - DNA, 1134 bp, Brassica napus
cggctgccacttccacaaaccctaattccaaaaatccccctcggatctctaacaagactgtgatacgaaacgatgtcgtctactcgggaagagaatgtgtacttggctaagttagccgaacaagctgaacgttacgaggagatggttgagttcatggagaaagtcgccaagactgttgactccgaggagcttactgtggaagagaggaacctcttgtccgttgcttacaagaacgtgattggtgcaaggagagcttcgtggaggatcatttcttccattgaacagaaggaagaaagcagagggaacgatgatcacgttgctcttatcaaggactacagagtgaagattgaaaccgagcttgggaagatctgtgatgggattttgaaccttttggattctcaccttgttcccgctgcgtctttggctgagtccaaagtgttttacctgaagatgaagggggattaccataggtaccttgctgagtttaagactggtgctgagaggaaggatgctgctgagagcactctcttggcttacaagtcagctcaggatattgcacttgctgatttacctccaactcatccgattagattggggcttgctctgaacttctctgtcttctactatgagattctcaactctcctgatcgtgcttgcagtctcgccaagcaggcttttgatgaagcaatctctgagctggacacattaggagaagaatcatacaaagacagtacactgataatgcaacttctccgtgacaatctgaccctctggacttctgacctcaatgatgaggtgggtggtgacgagatcaaggaggcgtcaaaagacgagcctgaagaagggaaacaagcgtagacgttgaagtgatcagaggaagggagcgagcaagagatttctaagtatgatggtattggatttggctttagtttctttaaacagtatgatttgaggtttgtagaagcaaagagaagaccatgatttggttttcttctttggaaactctaaactctgttttttttaatggggttttcaagctgttgagtctttcgttggttttactttattgtttgttagtagtttagtactatttatttggaagtgaaacccccatctttaatgaatcttgggaac

SEQ ID NO: 9649 - DNA, 1090 bp, Brassica napus
gaattcgacaaaccctaattccaaaaatccccctcggatctctaacaagagtgtgatacgaaacgatgtcgtctactcgggaagagaatgtgtacttggccaagttagccgagcaagctgaacgttacgaggagatggttgagttcatggagaaagttgccaagaccgttgactccgaggagcttactgtcgaagagaggaacctcttgtccgttgcttacaagaacgtgattggtgctaggagagcatcgtggaggatcatttcttccattgaacagaaggaagaaagcagagggaacgaagatcacgttgctcttatcaaggactacagagggaaggttgaaaccgagcttgggaagatctgcgatgggattttgaaccttttggatactcaccttgttcccgctgcgtctttggctgagtccaaagtgttttacttgaagatgaagggagattaccataggtaccttgctgagttcaagactggtgctgagaggaaggatgctgctgagagcactctcttggcttacaagtcagctcaggatattgcacttgctgatttacctccaactcatccgattagattggggcttgctcttaacttctctgtcttctactatgagattctcaactctcctgatcgtgcttgcagtctcgccaagcaggcttttgatgaagcaatctctgagctggacacattaggagaagaatcatacaaagacagtacactgataatgcaacttctccgtgacaatctgaccctctggacttctgacctcaacgatgaggtgggtggtgatgagatcaaggaggcgtcaaaagacgagcctgaagaagggaaacaagcgtagttgttgaagtgatcagaggaagggagcgagcaagacatttctaagtatgtatggtatggatttggctttagtttcttaaaacattatgatttgaggtttgtagaagcaaagagaagaccatgatttggttttcttctttggaaactctaaactctgtttttttttatggggttttcaagctgttgagtctttcgttggttttactttattgtttgttagtaccatttatttaggaagtg

SEQ ID NO: 9650 - DNA, 914 bp, Panax ginseng
ggtctcagttttctacgcgaaagtgaccggttggctgtttccaaaagagaactaaggtactgctaaactgtattaaagatgttgccaccagagtcatctcgtgaggacaatgtttacatggccaagctcgccgaacaggctgaaaggtatgaggaaatggttgagttcatggaaaaggttgctaaaactgtagatgttgaagagctgactgtggaggagaggaatctcctctctgttgcctacaagaatgtcattggagcgagaagggcttcgtggaggattatatcctccatagagcagaaggaagagagccgtggaaatgaagatcatgtcaacattatcaaggagtataggggtaagattgaggctgaactcagcaagatctgtgatgggattctgaaccttcttgagtctcatcttgttccctcggcgtcatctgctgagtccaaggtgttttacttgaagatgaaaggtgattaccacaggtacctggctgagtttaagactgggtctgagaggaaagaagctgctgagagcaccttgctagcttacaagtctgctcaggatattgcattggctgaacttgcttccactcacccaataaggctgggacttgcactcaacttctctgtcttctattatgaaattctcaactccccagatcgtgcttgcaaccttgcgaagcaggcttttgatgaagccatctctgagctggatacgttggggggagaatcttacaaggacagcacactgatcatgcaacttctccgagacaatctgacattgtggacatctgatataacggatgaagccggggatgagatcaaagaagcagctccaagccgtcgggtgaaatcatagaatagcattctgtacttttgctatttgtgccttgctataaatctttatatggt

SEQ ID NO: 9651 - DNA, 1405 bp, Eutrema halophilum
tttttttttttttcccccttatttctcctcctcacttgcaatatttcgcttccaaattcgacaaccccaaattcgaaaatctctcggatcgatcgatcgaacaagaaaatatgtcgtctactcgggaagagaatgtgtacttagccaagcttgccgagcaagctgaacgttacgaagaaatggttgagttcatggagaaagttgcaaagaccgtagacacggaggagctcactgtggaggagagaaacctcttgtctgttgcttacaagaacgttattggtgctaggagagcttcgtggaggatcatttcttccatcgaacagaaggaagaaagcagaggaaacggagatcatgtttcgataatcaaggactacagaggaaagatcgaaaccgagctcaacaaaatctgcgatggaatattgaaccttctggattctcatctgattcccactgcatctttggctgagtccaaagtcttttacctcaagatgaaaggagattaccacaggtaccttgctgagtttaagactggatctgagaggaaggaagctgcggagagcactcttttggcttacaagtcagctcaggatattgcacttgctgatttacctcctactcatccgattagattgggacttgctcttaacttttctgtcttctactatgagattcttaactcacctgatcgcgcttgcaacctcgcaaaacaggcctttgatgaagcaatctctgagctggacacattaggagaagaatcatacaaagacagtacacttatcatgcaacttctccgtgacaatctcaccctctggacttctgacatcaatgatgaggcgggtggtgatgagatcaaggaggcgtcaaaacctgagtcggaagaagggaaacaaacttagacgtggaagtgaccagagagagagagagagagaggcatgtatggtataaatttggctctagtttcctggagatcatgatttgattctcctttgaaaactcataaactctcttcttcttcttcttcttcttcttcttcttcttcttctttttttggttttaaaagctgtcgagtctttgattttacttcgttgcttgttactacatttaggaagtgaaggtcgagaagcagaaacaaaacttaggattattgatttcgattccactcgttttggattttaccattcagggtatcggagtattattttttcactagggtatttgaagaatcttgaaagcaaaatcaaacacttgattacgccaagaaaagaaaataaaaactttcagcatcaaagttttattcacgcgcagagtcaacaaacaaacaaaaatacaaaatacaatatggtttcaaatttcaaaccatatttatatccctgtgtgtgtaactagtataggactttctggaaaa

SEQ ID NO: 9652 - DNA, 920 bp, Eutrema parvulum
gatccagcaagagtgtgataggaaaatatgtcgtctactcgggaagagaatgtgtacttagccaagcttgccgagcaagctgaacgttacgaagaaatggttgagttcatggagaaagttgcaaagaccgtagacacggaggagctcactgtggaggagagaaacctcttgtctgttgcttacaagaacgttattggtgctaggagagcttcgtggaggatcatttcttccatcgaacagaaggaagaaagcagaggaaacggagatcatgtttcgataatcaaggactacagaggaaagatcgaaaccgagctcaacaaaatctgcgatggaatattgaaccttctggattctcatctgattcccactgcatctttggctgagtccaaagtcttttacctcaagatgaaaggagattaccacaggtaccttgctgagtttaagactggatctgagaggaaggaagctgcggagagcactcttttggcttacaagtcagctcaggatattgcacttgctgatttacctcctactcatccgattagattgggacttgctcttaacttttctgtcttctactatgagattcttaactcacctgatcgcgcttgcaacctcgcaaaacaggcctttgatgaagcaatctctgagctggacacattaggagaagaatcatacaaagacagtacacttatcatgcaacttctccgtgacaatctcaccctctggacttctgacatcaatgatgaggcgggtggtgatgagatcaaggaggcgtcaaaacctgagtcggaagaagggaaacaaacttagacgtggaagtgaccagagagagagagagagagacatgtatggtataaatttggctctagtttcctggagatcatgatttgattctcctttgaaaactcataaactct

SEQ ID NO: 9653 - DNA, 1106 bp, Picea glauca
aaagccctcttcctgcattgcccttcattgtctcgctgtgcttctttcacagaaaatccattcacagttcacagtccttggtttggtttcgccattttagtgtatttcttccttttagtggccgtttgttgaagatccagaggtaaagttgggcgtttaagatctgtgcagagatggcggcagcggcgatggtggagtcatcgcgggaggagaatgtatacatggcgaagctggctgagcaggcggagcgctacgaggagatggtggagttcatggagaaagttaccaaaggcgtggaggtggaggagctcacagtcgaggagcgcaaccttctctctgtggcctacaagaacgtgattggtgcccgccgggcctcctggaggatcatttcctccattgagcagaaggaggagagcaggggcaacgacgaacacgtggtcaccatccgggagtacaggtccaaggtggaatcggagctttccaagatctgcgagggcattctccgcctcctcgactcccatctcatcccttcttccaccgccgcggagtccaaggtcttctatctcaagatgaagggcgattaccatcgataccttgccgagtttaaaacaggcgccgagaggaaggaggccgctgagaacactttgcttgcttacaagtctgcccaggatattgctgcggcagagttggctccaacgcatcctattaggctagggctggctcttaacttctctgtattttactatgagattttgaattcgccagatagagcctgtaatcttgcaaaacaggcatttgatgaggcaattgcagaacttgatgctcttagtgaagagtcgtacaaggatagcacattaataatgcaactactaagagacaatcttaccctttggacttcagatttgcaagaagattggaggagaagagcggtcccaaaggcgaagaggttaagccagaagatggagagcattaatactaaaggggagcagattcgagtgtgtgcatgagaagcttacgatcccttgattattagggtgtaggtcgattatttaattgttagttcttccatagtttctgctgctttgtaggtatttatattacttcag

SEQ ID NO: 9654 - DNA, 1155 bp, Silene vulgaris
tctccacctccaattccttcctctaactccgatttttgagatttgtttcgtgagttgaaaaaatggctgatgcgtcgagggaagacaatgtgtacatggcaaagttggccgagcaagctgagcgatatgaagaaatggtagagtttatggagaaggtggcaaagatggcagatgctgaggagcttactgtggaggaaaggaacctcctttctgtagcttacaagaatgtgattggtgctaggagggcgtcatggaggatcatttcctctatcgagcagaaggaggaaagcaggggaaacgaggatcatgttgccactatcaaggagtatagggctaagattgagaccgaacttagcaagatttgtgatggaatcttgaaccttctcgaggcgcacctagtccctaaggcatcctctgccgagtctaaggtgttttaccttaagatgaagggtgactaccacaggtatcttgctgaattcaagaccggtgctgagaggaaagaggctgccgagaatactcttttggcttacaagtctgctcaggacattgctttggctgatttggcccctactcacccgattaggcttggtcttgctttgaacttctctgtcttctattatgagattctgaactcacctgatcgtgcttgcaaccttgcaaagcaggcttttgatgaggctatatccgagttggacacattgggtgaggagtcatacaaggacagcactttaatcatgcaacttctccgagacaatttgaccttgtggacttccgataatgcggaggagggaagcgaggagatcaaggaagctacaaaaggcgaatcggccgaggctcagccacagtgatcatgaaatgggttctgctctgtatttttagcagaagacttgagtagagttgccacttcgatggttgtagttaggatttttaagttaatcatatgttgttagtcttgactctagagtgctggtagcgtaccagtaccaccggagatcaggcttggtagtagtttactcgtaaaccgcgtattcttggatgtgagatgtgggttatgatttaagtttgcttgcttgcttcccgagctttgtttgatgtaaacttgattgttcattgttggtgtgttaccttaatcaaaatttcaagctctgaagtttt

SEQ ID NO: 9655 - DNA, 1276 bp, Echinochloa colona
cccagaggagcatccgccgccgcagccgctcgaggagtccgcgtagtctcggcgggcggcgatgtcgggacaggacgcgggtgaggggacgaaggagaggtcgatggacttcacggccgcggcggggcagcaggggacccgggaggagatggtgtacatggcgaagctggcggagcaggcggagcggtacgaggagatggtggagttcatggagaaggtggtcacggcggcgggcgccggggagctcaccgtcgaggagcgcaacctgctgtcggtcgcctacaagaacgtcatcggcgcgcgcagggcctcgtggcggatcatctcctccatcgagcagaaggaggagggccgcggcaacgaggcccacgccgcctccatccgcgcctaccgctccaagatcgaggccgagctcgcccgcatctgcgacggcatcctcgcgctcctcgactcccacctcgtcccctccgccagcgccgccgagtccaaggtcttctacctcaagatgaagggagactaccacaggtaccttgctgagttcaagtcaggtgcagagaggaaggaagctgcagagagcaccatgaacgcctacaaagccgcgcaggacattgctcttgcagatctggctccgacccaccccatcaggcttggcctggcgctcaacttctcagtgttctactatgagatcctgaactcccctgaccgggcttgcaaccttgccaaacaggcttttgatgaagccatctctgagctagacagcctgggcgaggagtcctacaaggacagcactctgatcatgcagctcctgcgtgacaatttgaccctatggacttctgacaccaatgaggatgctggcgatgagatcaaggaagccgccgccccgaaggaatccggagagggccagtaatatggatcccaagctccctacctgatgcacccgctgatgtttgggagtgaccagagccacaatgttcctggatttcaatagctacttagtatacgtacctccgttgtcgtcgcactggacgatactgcattgctgctgtttgattaagtaccttagatgatgtttgttacgccgcaccctttgtttcagtttaagtcgataaaatgatggctggatgctggttttcatgctccaatctggccatcatgggaaaaaacctgctctcgctgcagcgttgttagaatgattgcttatgtcacttgacctatggagtatttgacaggcctgctgccagtagtatttcgttgagatggctttgcaagtattgtg

SEQ ID NO: 9656 - DNA, 1320 bp, Trifolium pratense
caatcctcatcacactctcctttttctatttctctcacaacctctttcgctttctctctctaaaaatccctaaaaccagatctcactttctctctctacgattcaacaatggcggccgctcccactcctcgggaagagaacgtttacatggctaagctagccgaacaagccgaacgctacgaagaaatggttgaattcatggagaaagtttccgccaacgccgataacgaagaactcacggtggaggaaaggaaccttctctcggtggcttataagaatgttatcggagctcgccgtgcctcatggcgtatcatttcatcgatcgagcagaaagaagagagccgcggcaacgaggatcacgtcaacgtcatccgtgactaccgatctaagatcgaatctgagctctctaacatctgtgacggtatcctcaagcttcttgattctcgtctcattccttctgcttcctctggcgattccaaggttttctacctcaagatgaagggagattatcacaggtacctcgctgagttcaagaccggagctgaacgtaaggatgctgcagaggctactctcgccgcttacaaatctgctcaggacattgcaaatgctgaattgcctccaactcatccaattaggcttggccttgctctgaatttctctgttttttactatgaaattcttaactctcctgatcgtgcttgcaaccttgcaaaacaggcttttgacgaagcaattgctgaattggatacccttggagaggaatcatacaaggatagcactttgatcatgcaacttcttcgcgataacctcaccctatggacctctgacatgcaggatgatggtgccgatgaaattaaagaagcagccccaaaaccagatgaacagcagtaaacaaattttactgccattcatgtctgttgctaatctctttgggtgctgagattttaggcattcacgtctgttatgaattctggatgtcctgggctgttttagtttgtccttccatttttaagcgttttacaaattattgcctattttcttgaggacactgaagttttattatatggaattgaaaatttaagattctctttctagtttacttgatcttgcagaatttagtgagaatgttagctttatctgttatcgacagcgtcattatcattatcatttattataattgagggatcccagtcaaaataatattaattgtgacatgataagtaactttttaatatttaattttgagaggaattaatgacgcgagatgaaactttgtgcctccaaagtaaagcaagacccccacttcttccgtttctatct

SEQ ID NO: 9657 - DNA, 1345 bp, Trifolium pratense
gtcaatcctcatcactctcctttttctatttctctcacaacctctttcgctttctctctctaaaaatccctaaaaccagatctcactttctctctctacgattcaacaatggcggccgctcccactcctcgggaagagaacgtttacatggctaagctagccgaacaagccgagcgatacgaagaaatggtggaattcatggagaaagtttccgccaacgccgataacgaagaactcacggtggaggaaaggaaccttctctctgttgcttacaagaacgtcatcggagctcgacgtgcctcctggcgtatcatttcatcgatcgagcagaaagaggaaagccgcggcaacgaggatcacgtcaccatcatccgtgactaccgatctaagatcgaatctgagctctctaacatctgtgacggtatcctcaagcttcttgattctcgtctcattccttccgcttcctctggcgattctaaggttttctacctcaagatgaagggagattaccacaggtaccttgctgagttcaagaccggagctgagcgtaaggaggctgctgaggctactctcgccgcttacaaatctgctcaggacattgcaaatgctgaattgcctccaactcatccaattaggctcggtcttgctctgaacttctctgttttttactatgaaattcttaattctcctgatcgtgcttgcaaccttgcaaaacaggcttttgatgaagcaattgctgaattggatacccttggagaagaatcatacaaggatagcactttgatcatgcaacttcttcgtgataacctcaccctatggacctctgacatgcaggatgatggtgccgatgaaattaaagaagcagccccaaaaccagatgaacagcagtaaacaaattttactgccaattagattcaaacttctcctactctacatgtttatgaatgaatgaaggaagaaggtgcttgttgctaatctctttgggtgctgagattataggcattcatgtctgttatgaattctggatgtcctgggctgttttagtttgtccttccatttttaagcgttttacaaattattgcctatttttcttgaggacactgaagttttattatatggaattgaaaatttaagattctctttctagtttacttgatcttgcagaatttagtgattggataataagccaacattttggcttacttgatcttgcagaatttagtgagaatgttagctttatctgttatcgacagcgtcattatcattatcatttattataattgagggatcccagtcaaaataatattaattgtgacatgataagtaactttttaatatttaattt

SEQ ID NO: 9658 - DNA, 1297 bp, Trifolium pratense
tccgtcaatcctcatcactctcctttttctatttctctcacaacgtctttcgctttctctctctaaaatccctaaaaccagatctcacactttctctctctacgattcaacaatggcggccgctcccactcctcgggaagagaacgtttacatggctaagctagccgaacaagccgagcgatacgaagaaatggtggaattcatggagaaagtttccgccaacgccgataacgaagaactcacggtggaggaaaggaaccttctctctgttgcttacaagaacgtcatcggagctcgacgtgcctcctggcgtatcatttcatcgatcgagcagaaagaggagagccgcggcaacgaggatcacgtcaccatcatccgtgactaccgatctaagatcgaatctgagctctctaacatctgtgacggtatcctcaagcttcttgattctcgtctcattccttctgcttcatctggtgattccaaggttttctacctcaagatgaagggagattaccataggtatcttgctgagttcaagaccggagctgagcgtaaggaggctgctgaggctactctcgccgcttacaaatctgctcaggacattgcaaatgctgaattgcctccaactcatccaattaggctcggccttgctctgaacttctctgttttttactatgaaattctcaactctcctgatcgtgcttgcaaccttgcaaaacaggcttttgatgaagcaattgctgaattggatacccttggagaagaatcatacaaggatagcactttgatcatgcaacttcttcgtgataacctcaccctatggacctctgacatgcaggatgatggtgccgatgaaattaaagaagcagccccaaaaccagatgaacagcagtaaacaaattttactgccaattagattcaaacttctcctactctacatgtttatgaatgaatgaaggaagaaggtgcttgttgctaatctctttgggtgctgagattataggcattcatgtctgttatgaattctggatgtcctgggctgttttagtttgtccttccatttttaagcgttttacaaattattgcctatttttcttgaggacactgaagttttattatatggaattgaaaatttaagattctctttctagtttacttgatcttgcaaaatttagtgagaatattagctttatttgtatctgtcgtgaactcatggtggggtgtcattttcatttgttataattgagggatcctagtcaaaataatataaattgtgacatgataagcaactttttta

SEQ ID NO: 9659 - DNA, 1098 bp, Eutrema halophilum
gctctctcttccgatttaatgttcacgcccgtctcctcaatttctcactctcctcaaacttcgcgtctcttgcttcgaattcgaaatccctaattccaaaatccccaggttttagaaagagtattgcaaagatgtcttctgattcgtctcgggaagagaatgtgtacatggccaagttggccgagcaggctgagcgttatgaggaaatggttgagttcatggagaaagttgcaaagacagtcgatactgcggagcttactgtcgaagagaggaacctcttgtctgttgcctacaagaacgtgattggtgctaggagggcttcgtggagaatcatctcctccattgagcagaaggaagaaagcaggggaaacaacgatcacgtctcgattatcaaggactacagagggaagattgaaactgagctcagcaagatttgcgatggcattttgaacctgctcgagtctcaccttgttcctactgcatccttggctgagtccaaagttttctacctcaaaatgaagggagactatcaccgctacctcgccgagttcaagactggagctgagaggaaagaagctgctgagagcactcttttggcgtacaagtcagctcaggatattgctcttgctgatcttcctcccactcacccaatcaggctggggcttgctcttaacttctctgttttctactatgagattctcaactcatctgatcgtgcttgtaacctcgcaaaacaggcttttgatgaggcaatctctgagctagacacattgggagaggaatcatacaaggacagtacattgatcatgcagcttctccgtgacaatctcaccctctggacttctgacctcaatgacgaagctggtgatgatatcaaggaagcctcgaaagaggtgcagaaaggtgacgaacaagcccaaccaccgccgtcgcagtgatgaaaccatgtccatggaatgaattacaaagaaatcgtattgtttagttctgtgtgttttcacgtaaacccaaaaaaaaaaatctcgtagtttctttaaacgtggggtttgtaaagatattcaagtcacattggtttaaaatttggataatcgaaattgt

SEQ ID NO: 9660 - DNA, 1128 bp, Vicia sativa
ctttcctcttcttcctccttttctatttctctctcgcaatcccaatcgctttctctctctaaaaccagatctcactttctctctctaggtttcatcaatggcgaccgctcatactcctcgggaagagaacgtatacatggcgaaactcgcggaacaagccgagcgctacgaagaaatggtggagttcatggaaaaggtctccgccaacgccgatagcgaggaactcacggtggaggagaggaatcttctctccgtcgcgtacaaaaacgtgatcggagccagacgtgcctcgtggcggatcatttcgtcgatcgagcagaaggaagagagccgcggtaacgaggaccacgttgcggttatccgtgattaccgatctaagatcgagtcggagctttcaaacatctgtgacggtatcctcaagcttctcgattctcgtctcattccttccgcttcctctggagattctaaggttttctaccttaagatgaagggagattatcacaggtacctcgctgagtttaagaccggagccgagcgtaaggaggccgcagagagcactctcgccgcgtacaaatctgctcaggacattgcaaatgcggaattgccaccaactcatccaattaggctcggccttgctctgaatttctctgtattttactatgaaatccttaactctcctgatcgtgcctgcaatcttgcaaaacaggcttttgatgaagctattgctgaattggatacccttggagaggagtcatacaaggatagcactttgatcatgcaacttctccgtgataatctcactctatggacctctgacatgcaggatgatggtgccgacgaaattaaagaagcagccccaaaagcagatgaacaacagtaaacaaattcaactgcctattagaatcaaacttctcctctataagttaatgaatgaaggaagaaggtgcttgttgccattctctttgggtttgagattttaggcattcatgtctgttgagttctggagtcctgggctgttttagtttgtccttccatttttaagtgttttacaaattattgcctattttattgaggacactgaagtgttattatatggaattggaaatttaagattcccttctttctagt

SEQ ID NO: 9661 - DNA, 1093 bp, Distylium racemosum
agaaatagctacaaaaatcacgaattatgtgaatccttatatggccatgactaatagcttgtttcataaccacaagtgtccaagactgttcacatgtcacctgtagaggcttctcgggaggaaagtgtgtacatggctaagcttgctgagcaggcagagcgctatgaggagatggtagagtacatggagaaggtagcaaagacagtagatgtggaggaacttactgtcgaagaaagaaatctgctctcggttgcttataagaacgtcattggagctcgcagggcatcttggaggataatttcttccattgaacagaaggaagagagtagaggaaatgaagaacatgtttcaatgataagggaatacagagctaaggttgaggctgagcttagtaaaatttgtgatggcattttacgccttcttgatacacatcttataccatcatccacatctggtgagtcaaaggtgttttaccttaagatgaagggtgactaccatcgatatcttgcagaattcaaaacaggtgctgagaggaaggaagctgccgaaagcacactgcttgcatataagtcagcccaggatattgcagtttcagagttgccttccactcatcctattaggcttggattggctctcaacttctccgtattctactatgaaattttgaattcgcctgatcgggcttgtacccttgcaaagcaggcctttgatgaggcaattgcagagcttgatactttaggtgaagaatcatacaaggatagcaccttgatcatgcagctacttcgagataaccttaccttatggacttcggacttgcaggacgaagctggaggcgacgaaatcaaggaagccccaaagagggaggaaggggatggtcattaacacccatttttattgctgtgaagtaggcaggttgctagtgatatgaccgaatttgttgccatagacttctagatttttctgctttcctacatcattgtcgtaattggggttcttgtgtaaattctcctgttgaatctcctgcatagcaggattttgctgttggaggattttcttttctacttgcacatcatctttatattagaaaaaaagt

SEQ ID NO: 9662 - DNA, 1399 bp, Echinacea purpurea
tcctcttcgatcaaacagaatcactctcacacacacactctctctgctcatcgcactatcaatcgagaatggcatcaactgaagcttcacgcgaggaaaatgtgtacatggccaaactggcagagcaggccgaaaggtatgaagaaatggtggagtttatggaaaaggttgcaaagactgtggatgttgaggagttgactgtggaggaaaggaatcttctgtctgtggcttacaagaacgtgatcggagccaggagggcatcatggaggataatatcttccatcgagcagaaagaagagagtcgtgggaatgaagatcatgttaagctaatcaaggattacagggctacaatcgaaactgaacttagcaaaatctgtgatggtattctgggacttctggaatcgcatcttgttccctccgcttcatctgcggagtcaaagatcttttacttgaagatgaagggtgattactatagatacttggctgaatttaagacgggagctgataggaaggaagctgctgagagcactttgttagcctacaaatcagcccaggatattgctctatctgacttggctcctactcacccaatacggcttgggcttgcactcaacttctcagtgttttattatgagattctcaattcacctgaccgcgcttgtaaccttgccaagcaggcttttgatgaagctattgctgagttggatacactgggagaggattcatacaaggacagcacattgatcatgcaacttctccgtgacaatctcactttgtggacatcagatatcgcggacgaggctggtgatgagatcaaggaatcctcctcaaaaccagaggaaacacaatgattgatatacagggtttataggaaaacagtctgtttactacattacagtacctttattataagtatcctattctgaatgacgtgtatcaaggacataatgtttgcacaatcacctggtgcttgtagcacccagtagatcgaaagcttgttcaagtacttctggcttgccggttgttacccgcgtttaggacttcagttagttgttttttgtttaatcaaattccggattagttgcactcttttgcgtgtggatcatcatatgcttattatattgtgtttatggagctgtttgggtgctttctttcccatttttattcttcgtgacccaaatctgattgtacccaacaaatattgagttttatttgaaataaaagtgtacctttcaaaatgaacgttttccctgcaaaatgtttgtatctgattctgatagtggtcataggcgactcaaaacaagtcaggggactcatgtaaaaattcagtttcaaacattttccaaaacactcctcttggtttgtactgaaaataataaactaagtactttgttgtgtg

SEQ ID NO: 9663 - DNA, 1093 bp, Vitis vinifera
aggctaaaacaaaccacccctggctctatccctctcaaaaccaaaccacaccaaaaccaacagatctagaaatcgcaggctctctcttcccccaacagaaaaaaattcatcagaatcaatggcggcagctccatccgcacgcgaagagaacgtctacatggcgaaactagccgagcaagccgagcgctacgaagaaatggtggagttcatggagaaggtctcggccgccgtggattccgaggaactcactgtcgaggaaaggaacctcctctccgtcgcctacaagaacgtgatcggtgctcgccgagcctcctggcgcattatttcatccatcgagcagaaggaggagagccgcggcaacgaggatcacgttgccatgatccgcgactacagatctaagatcgagtccgagctctcctcgatctgcgatggtattctcaagcttcttgattcccggctgattccctcggcttcctccggagactccaaggtcttttatctgaagatgaagggcgattatcatcgctatctggccgagtttaaaactggagccgagcgcaaggaggcggctgagagtaccctcactgcctataaatctgctcaggatattgcaaacgcagaactggctccaactcatccaatccggctcggactggctctcaacttctctgtgttttactacgagattctgaattctcccgatcgagcttgtaaccttgcgaaacaggcatttgatgaagccattgctgaattggataccttgggtgaggagtcatacaaggatagcactttgataatgcaacttcttcgtgacaatctcactctgtggacctcagatatgcaggatgatggggcagatgagattaaagaagcaccaaagcgtgatgatgaacagcagtgagggttctcatcctccaacttgtgctgaacttctcctttatttgtttttttataggagaaggtgcttgttcctaatttccttgccattctcagtttctaggcattcttgtttttattgctgaatcttggaggtacctggttttttagattgtcaacttcaattctatctttccgaatgtcatattttcatgga

SEQ ID NO: 9664 - DNA, 1164 bp, Taxus baccata
aaaaagttttttcttttttctataaaacttcctcttcgcttctacgcggctcggttgtgcacttgttctggctgggagttttttttatcttttttgttccaggaacaatgtcacatgtagagtcttctcgtgatgaaagtgtgtacatggccaagcttgctgagcaggctgaacgttatgaagagatggtagagtacatggagaaagtagccaagacagtagatgtggaggaacttactgttgaggagaggaatctgctctcagtggcttataaaaatgttattggagctcgcagggcttcttggaggataatttcttccattgaacaaaaggaagagagcagagggaatgaagaacatgtttcaatgataagggattacagagctaaggttgaggctgagctcactaaaatctgcgaaggcattttacgccttcttgatacacatcttataccatcatccacatctggtgagtccaaggtgttttaccttaagatgaagggtgactaccatcgatatcttgcagaatttaaaacaggtgctgaaaggaaggaagctgctgaaaacactttgcttgcatataaagcggcccaagatattgcacttgcagaattggcatcaactcatccaattaggcttggactggctcttaacttttctgttttctactatgaaattttgaattcacctgaccgtgcctgtgcacttgcaaaacaggcatttgatgaggcaattgcagagcttgatactttaggtgaagaatcatacaaagatagcaccttgatcatgcagctacttcgtgacaacctaaccttatggacttcggacttgcaggacgaggttggaggagatgaaatcaaagaagccccaaagaaggaggaggggaatagccattgacattccttttttacatgttgttaagattcaactattgcagtggtttctttgtcacccacgcatttcatctatgagttccagttaggttctaattgtgtttttctttgctcatttatattaacaaggaagaaccagttatgttctgcttatgtttttctctgcccattttggagtattcctgcgatttcacaatggttggatattgtaccctcttattgtaataaatatagaggttaaatgagtagaagatttgctatcatattattct

SEQ ID NO: 9665 - DNA, 939 bp, Ambrosia trifida
cgatctctctctcacacacacactgcctctcgccctatcaatcgaggaacatactaatcgatagaatggtatcaaccgaagcttcacgcgaggaaaatagtgtacatggccaaactggcagagcaggccgaaaggtatgaagaaatggtcgagtttatggaaaaggttgcaaagactgtggacgttgaggagttgactgtggaggaaaggaatcttctgtctgtggcttacaagaatgtgattggagccaggagggcatcatggaggataatatcttccatcgagcagaaagaagagagccgtgggaacgaagatcatgttaagctgattaaggattatagggctacaatcgagactgaactaagcaaaatctgtgatggtattctgggccttctggaatctcatcttgttccctctgcttcatctgcagagtcaaagatcttttacttgaaaatgaagggcgattactatagatacctggctgaatttaagacgggagctgataggaaggaagctgctgagagcactttattagcttacaaatccgctcaggatattgctctatctgacttggctcctactcacccaatacggctaggactcgctcttaacttctcagtgttttattatgagattctcaattcacctgaccgtgcttgcaaccttgccaaacaggcttttgatgaagctattgctgagttggatacattgggagaggattcatacaaggacagcacattgatcatgcaacttctccgtgacaatctcactttgtggacatctgatatcgcggatgaggctggagacgagatcaaggaatcctcaaaaccagaggaaactcaatgattactacatatacggggcttgtaggaaaaacagtctgtttactacatatcagtaccttatttcaagtatcctattctgaatgacgtgaagctt

SEQ ID NO: 9666 - DNA, 963 bp, Ambrosia trifida
gcaaactgaagcgtctcgtgaagaaaatagtatacatggcgaaactagccgagcaggcagaaaggtacgaagaaatggtggagttcatggagaaggtagtgaagaatgtggaatctgaagagttgacggtggaggaaaggaatcttctttctgtggcttacaagaatgtgattggtgctcggagggcttcatggaggatcatttcgtctattgaacagaaagaagaaagtcgtgggaatgaagatcatgttactacaatcaagaactacaggggtaagattgagactgagctgagcaagatctgtgatggtatcttggctctactcgagtctcatcttattccctctgcgtcctctgctgagtcgaaggttttttacttgaagatgaaaggtgattattatagatacctagctgaatttaagacaggtgccgataggaaggaggctgctgagaatactttattaggatacaaatctgctcaggatattgctttagctgatttggctcccacgcacccaataaggttgggtcttgcactcaacttctcggtgttctattatgaaattctcaactcgcctgatcgtgcttgcagccttgctaagcaggcatttgatgaagccatctctgagttagacacacttggtgaggattcatacaaagatagcacattgatcatgcaacttctgcgggataaccttactttgtggacatcagatgttgcggacgaggcaggggatgagatcaaggaagcttcaaatcctgaggaaaaacagtaatatatatatataagtgaaacgataatagttgtgtgctacaaatagtcggtggtgctatgtaggttttatctagcgttgctgcttgctagtttctcatagattataagcttgttggagttatttgcatatggttttgtgtcgacgttttttaaattgcaactttagatgttttgaatttaaaaaagaa

SEQ ID NO: 9667 - DNA, 1202 bp, Cleome gynandra
gggggggacctcaccagtcacactttcaaatatattaattttaaatatcaacaacgcgtcagcagtttcttcatcgccccaatctttgcagttttcaaagccctagcaattcagatcagatctcctgacgaaaaggttctcaaaagcaatatagccaagatgtcgactgggtcatcacgggaagaatttgtttacatggcaaaattggctgaacaagctgaacgttatgaggaaatggttgaatttatggagaaggttgccaagactgttgatgtcgaggaactcactgtagaggagaggaatctgctctctgttgcctacaagaatgttattggagccagaaggggttcatggaggatcatatcttctattgagcagaaggaagagagcaagggaaacgaggatcatgttgctaccatcaaggattacaggggcaggattgaaactgaacttagcaagatctgtgatgggattttgaaccttctcgattctcatctcgttccagctgcttcttcagctgaatctaaagtcttctaccttaaaatgaaaggtgactaccacaggtaccttgctgagtttaagactggcgctgagaggaaggaagctgctgagagcaccttgttggcttacaagtctgctcaggacattgctcttgctgagttagctcctactcatccaatcaggctgggccttgcacttaacttctcagttttctactatgaaatccttaactcccccgaccgtgcctgcaaccttgccaagcaggctttcgatgaagctatctctgagttggatacacttggtgaggaatcatacaaggacagcacactgataatgcaacttctccgagacaatctgacactctggacttcagacattactgatgaggcgggcgatgacatcaaggaatcagccaagcctgaaggagtagagggtgagcagaagcagtaaaacacgaaagaaaaagaggagcaagttatattttatgggtttattatagggcacacattcgaatcatggttatggtgttatgcttttgaaatttcgggttaaactaaggatattacacttagcctcataaacccaacccaggatttattagatagagaaaatcctagtcagacttttttattcaggttgttttcttatcgttatgtttcacaaacacttgcgcattccttgacatggagttctttctatac

SEQ ID NO: 9668 - DNA, 1053 bp, Flaveria ramosissima
tactctcagccccatcgatatagaatcagccataactgattataaaattggtgcaaactgaagcttcgcgtgaagaaaatgtgtacatggccaaattagcagagcaggcagaaaggtatgaagaaatggtagagttcatggagaaggttgtgagattgtggattctgaagagttgacagtggaggaaagaaatcttctttctgtggcttacaagaatgtaattggtgctaggagagcttcatggaggattgtttcttctattgaacagaaagaagaaagccgtgggaatgaagatcatgttaccacaatcaagaattacaggggtaagatcgaggtggaactgagcaaaatctgtgatggcatcttgggcctcctcgagtctcatcttattccttctgcatcatctgctgagtctaaggtgttttacttgaagatgaaaggagattactacagatacctagctgagtttaagacaggagctgataggaaggaggctgctgagaatactttattaggatacaaatcagctcaggatattgctttagccgatttggctcccacccacccaataaggctgggtcttgcactcaatttctcggtgttctattatgaaattctcaactcacctgaccgtgcttgcagtcttgctaagcaggcgtttgatgaagccatctctgagctagacacacttggtgaggattcatataaagatagcacattgatcatgcaacttctgcgggacaacctcactttgtggacatctgatgctgcggacgagacaggggacgagatcaaggaagcttcaaatccagaggaaaagcagtgatatttacaagtcaaaatgatgatagctgtgtactacttttggttgtgttttttaggttttcatttagggtgtttttatattgagaacttaatggatatttgcacattttctatggttgctgcttgctagtttctcataggatgtaagcttgtccaagttattgacgtttggttttgtgttatgcttctgttaattgcaactttagatgtttataatctaaagctctt

SEQ ID NO: 9669 - DNA, 1574 bp, Hordeum vulgare
ctccccacaaacgcgtattgcctcctacgcccccggatccgctgctccaccccccaactccgttgccacacgccccttgcacaagcgagcaaccatgtcgccggcggagccgacgcgagacgagagcgtctacatggcgaagcttgcggagcaggccgagcgctacgaggagatggtcgagttcatggagcgcgtggccaaggccaccggcggggcagggcccggggaggagctatccgtggaggagcgcaacctgctctctgtggcttacaagaacgtcatcggggcccggcgcgcgtcctggaggattatctcctcaatcgagcagaaggaggaaggtcggggcaacgaggcgcacgccgccaccatccgctcctaccgcaccaagatcgaggccgagctcgcaaagatctgcgacggcatcctcgcgctgctcgattcccatctcgtgccatccgccggagccgccgagtccaaagtcttctatctgaagatgaagggcgactaccacaggtaccttgcagagtttaagtctggtgcggagaggaaggaagccgccgagagcaccatgaatgcgtacaaagctgctcaggatatcgctctagcagatttggcgccaacccaccccatcaggcttgggcttgcactcaacttctctgtgttctactatgagatcttgaactcccctgaccgcgcctgcaaccttgcaaaacaggcctttgatgaggctatatcagagctggacagcttaggcgaggaatcctacaaggatagcactttaatcatgcagctcctacgtgacaatttgactctatggacatccgacaccaatgaggatgacgttgatgagataaaggaagccccagctccaaaagaatcgggagacgggcagtgaggtgaatccaaacaacagtctgcattgttgggggcgatggaagccgatggtcttggttctagttcataatgtggtcatcactaccgatgtttaattatgcacataagaagtttctggtctatgtttttctggtgctgataaatgctggctggagtcgtgttttcttgtttaaatctggccacaaagcaaaagacctgctctttttcaccattagaaagtttgctatatcaaccatgtttgacgagacttgatgcaactagtactccgtactattttgcttaaattgaggtgtcctgttcatgtgtggctgaactacatcatgacaagatggtttgcgcaaagaggttcatttgcacgtgctagctgtggcatggtctcagtccattgagaagaaggtgaaggttcacctgattgatgcttttcccggtccagttttcgttgcaactgaagcaaagaagtgctttgctgtgccgttaccgccattcttggcattgccatggtgattgatatggcaaatgatctgatgcgctgcaaggattttcctatctactagccactttcctgaagaatgtaacgtgaactaaatgaggaatgtgaaatacaaattaatctgtaataggtggacacattctaaaggaaaggaaccattagctctctaccacattgttagtaatgtttt

SEQ ID NO: 9670 - DNA, 1188 bp, Ambrosia trifida
ccccttcgatcacacactcacaccccctcaaacacgctccttctcgccctatcaatctaaggaacatactaatcaatagaatggcatcaaccgaagcttcacgtgaggaaaatgtgtacatggccaaactggcagagcaggctgaaaggtatgaagaaatggtcgagtttatggaaaaggttgcaaagactgtggatgttgaggagttgactgtggaggaaaggaatcttctgtctgtggcttacaagaatgtgataggagccaggagggcatcatggaggataatatcttccatcgagcagaaagaagagagccgtgggaatgaagatcatgttaagcagattaaggattatagggctacaatcgagactgaactaagcaaaatctgtgatggtattctgggccttctggaatctcatcttgttccctctgcttcatctgcagagtcaaagatcttttacttgaaaatgaagggtgattactatagatacctggctgaatttaagacgggagctgataggaaggaagctgctgagagcactttattagcttacaaatccgctcaggatattgctctatctgacttggctcctactcacccaatacggctaggacttgcacttaacttctcagtgttttattatgagattctcaattcacctgaccgtgcttgcaaccttgccaaacaggcttttgatgaagctattgctgagttggatacactgggagaggattcatacaaggacagcacattgatcatgcaacttctccgtgacaatctcactttgtggacatctgatatcgcggatgaggctggagacgagatcaaggaatcctcgaaacctgaggaaactcaatgattactacatatacggggcgtgtagggaaaacagtctgtttactgcatatcagtacctcatttcaagtatcctattcttaatgacgtgaagcttgttaaggtacttgtggtttgccggttgttatccgcttaggcctcgagttagtttttttaatcaaattctggacttgtaggcactcttttgcgtgttgatcatcgtatgcttattattgtgtttatgaagctgtttgggtagctttttccccatttttactgtttgtgacccagctcttgtttactttgtacccatcaaatatcgagtctatatagtcttctttataacaaaaaga

SEQ ID NO: 9671 - DNA, 902 bp, Ambrosia trifida
ttcaccctctagtctcaaaagctgaccgcatatataaacactcaaatcttttcttcattcactatcgtcacacaaatcacactctcaaacccttggataccaactccatcgatccagaattagttgtactcggttatagaaaatggtgcaaactgaagcgtctcgtgaagaaaatgtgtacatggcgaaactagccgagcaggcagaaaggtacgaagaaatggtggagttcatggagaaggtagtgaagaatgtggaatccgaagagttgacggtggaggaaaggaatcttctttctgtggcttacaagaatgtgattggtgctcggagggcttcatggaggatcatttcgtctattgaacagaaagaagaaagtcgtgggaatgaagatcatgttactacaatcaagagctacaggggtaagattgagactgagctgagcaagatctgtgatgggatcttggctctactcgagtctcatcttattccctctgcgtcatctgctgagtcgaaggttttttacttgaagatgaaaggtgattattatagatacctagctgaatttaagacaggtgccgataggaaggaggctgctgagaatactttattaggatacaaatctgctcaggatattgccttagctgatttggctcccacgcacccaataaggttgggtcttgcactcaacttctcggtgttctattacgaaattctcaattcacctgaccgtgcttgcagccttgctaagcaggcatttgatgaagccatctctgagttagacacacttggtgaggattcatacaaagatagcacattgatcatgcaacttctgcgggataaccttactttgtggacatcagatgtcgcggatgaggcaggagatgagatcaaggaagcgacaa

SEQ ID NO: 9672 - DNA, 979 bp, Ambrosia trifida
tcgtcatacaaaccacactcacaaacccttggatacccactccatcgatccagaattagttgtaatcggttatagaaaatggcgcaaactgaagcctctcgtgaagaaaatgtgtacatggcgaaattagccgagcaggcggaaaggtacgaagaaatggtggagttcatggagaaggtagtgaagaatgtggaatctgaagagttgacggtggaggaaaggaatcttctttctgtggcttacaagaatgtaattggtgctaggagggcatcatggaggatcatttcttccattgaacagaaggaagaaagtcgtgggaatgaagatcatgttgcgacaattaagaactacaggagtaagatcgagactgagctgagcaagatctgtgatggtatcttggcccttctcgagtctcatcttattccctctgcgtcatctgctgagtcgaaggttttttacttgaagatgaaaggtgattattatagatacctagctgagtttaagacaggtgctgatagaaaggaggctgctgagaatactttattaggatacaaatctgctcaggatattgctttagctgatttggctcccacgcacccaataaggttgggtcttgcactcaacttctcggtgttctattacgaaattctcaactcacctgaccgtgcttgcagccttgctaagcaggcatttgatgaagccatctctgagttagacacacttggtgaagattcatacaaagatagcacattgatcatgcaacttctgcgggataaccttactttgtggacatcagatgttgcggacgaggcaggggatgagatcaaggaagcgtcaaatcccgaggaaaaacagtaatatatataagtgagacgataatagttgtgtgctacaagtagtcggtggtgctatgtaggttttatctatagttgctgcttgctagtttctcatagaatgtaagcttgttggagttatttgc

SEQ ID NO: 9673 - DNA, 1663 bp, Hordeum vulgare
ctccccacaaacgcgtattgcctcctacgcccccggatccgctgctccaccccccaactccgttgccacacgccccttgcacaagcgagcaaccatgtcgccggcggagccgacgcgagacgagagcgtctacatggcgaagcttgcggagcaggccgagcgctacgaggagatggtcgagttcatggagcgcgtggccaaggccaccggcggggcagggcccggggaggagctatccgtggaggagcgcaacctgctctctgtggcttacaagaacgtcatcggggcccggcgcgcgtcctggaggattatctcctcaatcgagcagaaggaggaaggtcggggcaacgaggcgcacgccgccaccatccgctcctaccgcaccaagatcgaggccgagctcgcaaagatctgcgacggcatcctcgcgctgctcgattcccatctcgtgccatccgccggagccgccgagtccaaagtcttctatctgaagatgaagggcgactaccacaggtaccttgcagagtttaagtctggtgcggagaggaaggaagccgccgagagcaccatgaatgcgtacaaagctgctcaggatatcgctctagcagatttggcgccaacccaccccatcaggcttgggcttgcactcaacttctctgtgttctactatgagatcttgaactcccctgaccgcgcctgcaaccttgcaaaacaggcctttgatgaggctatatcagagctggacagcttaggcgaggaatcctacaaggatagcactttaatcatgcagctcctacgtgacaatttgactctatggacatccgacaccaatgaggatgacgttgatgagataaaggaagccccagctccaaaagaatcgggagacgggcagtgaggtgaatccaaacaacagtctgcattgttgggggcgatggaagccgatggtcttggttctagttcataatgtggtcatcactaccgatgtttaattatgcacataagaagtttctggtctatgtttttctggtgctgataaatgctggctggagtcgtgttttcttgtttaaatctggccacaaagcaaaagacctgctctttttcaccattagaaagtttgctatatcaaccatgtttgacgagacttgatgcaactagtactccgtactattttgcttaaattgaggtgtcctgttcatgtgtggctgaactacatcatgacaagatggtttgcgcaaagaggttcatttgcacgtgctagctgtggcatggtctcagtccattgagaagaaggtgaaggttcacctgattgatgcttttcccggtccagttttcgttgcaactgaagcaaagaagtgctttgctgtgccgttaccgccattcttggcattgccatggtgattgatatggcaaatgatctgatgcgctgcaaggattttcctatctactagccactttcctgaagaatgtaacgtgaactaaatgaggaatgtgaaatacaaattaatctgtaataggtggacacattctaaaggaaaggaaccattagctctctaccacattgttagtaatgttttccttgcaggctattctaacatgcaaaactaggtgacaaattaatctgtaataggtggacacattctaaaggaaaggagccattagctct

SEQ ID NO: 9674 - DNA, 1038 bp, Brassica napus
acattccaaatttgaaaccactctccagcaattccacacaagatgtcgtcacgtgaagagaatgtgtacatggcgaaactagcggaacaagcggagcgttacgaagagatggttgagttcatggagaaagttgctaagaccgttgactctgaagaactcactgtcgaggagaggaaccttctctccgtcgcttacaagaacgtgatcggggcgaggagggcttcgtggaggatcatctcttccatcgagcagaaggaagagagcaaagggaacgaagagcacgttgctatcatcaaggagtacagggggaagattgaaaccgagcttagcaaaatctgcgacgggatcttgaatgttcttgaagctcatctcatcccctctgcttcacctgctgagtctaaggtgttttatctcaagatgaagggagattatcacaggtatcttgctgagtttaaggctggtgatgagaggaaagatgctgctgagagcactttggttgcttacaagtctgctcaggacattgcgactgctgagttagctccaactcaccctatcaggcttggtcttgcactcaacttctctgtgttttactatgagatccttaactcgcctgaccgtgcctgcaccctcgctaagcaggcatttgatgaagctatcgctgagttggatacattgggagaggaatcatacaaagacagtacgctgattatgcagcttctcagagacaacctcactctctggacttctgatatgactgacgaggccggagatgagataaaggaggcatcgaagccagagggtggtgcagcagagtaacgctgaagaagaggaagtcggtttataagggtagaaacttccttatgtgataatctgagtgagggataataagctcaggaatcagatactcttttgatttgagtttgtttattttgtttgtttgggaaacaatttgataactactttcgaatttgcgattgattccttgaaatttccacacatgatcctctagcgtgacaataataacacgtttaaacacgt

SEQ ID NO: 9675 - DNA, 1032 bp, Centaurea maculosa
acagaatcaatctcatacacacacaaacacctagatacacacactagcttctcttctcttctcgccctatcaatccagaatggcatcagctgaagcttcgcgtgaagagaatgtgtacatggccaagctggcagagcaggccgaaaggtacgaagaaatggttgagttcatggagaaggttgcaaagaccgtggatgtcgaggagttgaccgttgaggaaaggaatcttctttccgtggcttacaagaacgtgattggagccaggagggcctcatggaggatcatatcttccatcgagcagaaggaagagagccgtgggaatgaagatcatgttaagctaatcaaggactacagggcttcgattgagactgaactaagcaagatctgtgacggtatcttgggacttctggagtcgcaccttatcccctctgcctcatctgcggaatcaaagatcttttacttgaaaatgaaaggtgattactatcgatacctggctgaatttaagacaggtgctgataggaaggaagctgctgaaagcactttattagcttacaaatctgctcaggacattgctctatccgacttggctcccacccacccaataaggctgggactcgcactcaacttctcagtgttttattatgagatcctcaattcacctgaccgtgcttgcaatcttgccaagcaggctttcgatgaagctattgctgagttggacacattaggcgaggattcatacaaggacagcacgctcatcatgcaacttctgcgtgacaacctcactttgtggacatccgacatcgcggatgagggtggtgatgagatcaaggaatcgtcgaaagcggaggaaagccagtgatgtaggaaaaggaaggaaaaaatagtgtttgtgtacgtttttataggggttgtcttgtattcggaatgatttccgatagattgaatgcttgcttgcttgctttatgggttgccgattgttgtttgggagttgctcttttcctttaatcaaatgctctgctgctgctggatttt

SEQ ID NO: 9676 - DNA, 920 bp, Centaurea maculosa
catacacacactaccttctcttctcttctcgccctatcaatccagaatggcatcagctgaagcttcgcgtgaagagaatgtgtacatggccaagctggcagagcaggccgaaaggtacgaagaaatggtcgagttcatggagaaggttgcaaagaccgtggatgtcgaggagttgaccgttgaggaaaggaatcttctttccgtggcttacaagaacgtgattggagccaggagggcctcgtggaggatcatttcttccatcgagcagaaggaagagagccgtgggaatgaagatcatgttaagctaatcaaggactacagggcttcgatcgagactgaactaagcaagatctgtgacggtatcttgggacttctggagtcgcaccttatcccctctgcctcatctgcagagtcgaagatcttttacttgaaaatgaaaggtgattactatcgatacctggctgaatttaagacaggtgctgataggaaggaagctgctgaaagcactttattggcttacaaatctgctcaggacattgctctatccgacttggctcccacccacccaataaggctgggactcgcactcaacttctcagtgttctattatgagatcctcaattcacctgaccgcgcttgcaatcttgccaagcaggctttcgatgaagctattgctgaattggacacattaggcgaggattcatacaaggacagcacgctcatcatgcaacttctgcgtgacaacctcactttgtggacatctgatatcgcggatgagggtggtgacgagatcaaggaatcgtcgaaagcggaggaaagccagtgatgtaggaaaaaggaaggaaaatagtgtttgtgtacgtttttataggggttgtcttgtattcggaatgatttccgatagattgaatgcttgcttg

SEQ ID NO: 9677 - DNA, 1115 bp, Centaurea maculosa
tcaaacagaatcaatctcatacacacacaaacacctagatacacacactagcttctcttctcttctcgccctatcaatccagaatggcatcagctgaagcttcgcgtgaagagaatgtgtacatggccaagctggcagagcaggccgaaaggtacgaagaaatggttgagttcatggagaaggttgcaaagaccgtggatgtcgaggagttgaccgttgaggaaaggaatcttctttcggtggcttacaagaacgtgattggagccaggagggcctcatggaggatcatatcttccatcgagcagaaggaagagagccgtgggaatgaagatcatgttaagctaatcaaggactacagggcttcgatcgagactgaactaagcaagatctgtgacggtatcttgggacttctggagtcgcaccttatcccctctgcctcatctgcggaatcaaagatcttttacttgaaaatgaaaggtgattactatcgatacctggctgaatttaagacaggtgctgataggaaggaagctgctgaaagcactttattagcttacaaatctgctcaggacattgctctatccgacttggctcccacccacccaataaggctgggacttgcactcaacttctcagtgttctattatgagatcctcaattcacctgaccgtgcttgcaatcttgccaaacaggcctttgatgaagctattgctgagttggacacattaggcgaggattcatacaaggacagcacattgatcatgcaacttctgcgtgacaacctcactttgtggacatctgatatcgcggatgagggtggtgacgagatcaaggaatcgtcgaaagcagaggaaagccagtgatgtaggaaaaggaaggaaaaaatagtgtttgtgtacgtttttataggggttgtcttgtattcggaatgatttccgatagattgaatgcttgcttgcttgctttatgggttgccgattgttgtttgggagttgctcttttcctttaatcaaatgctctgctgctgctggatttttagctactctccgtatctcgacctattcctattatttcttaaattctgttctaaatagcgaatgtttcgttttgtaccc

SEQ ID NO: 9678 - DNA, 1179 bp, Cirsium arvense
acatacacacactaccttctcttctcttctcgccctatcaatccagaatggcatcagctgaagcttcgcgtgaagagaatgtgtacatggccaagctggcagagcaggccgaaaggtacgaagaaatggtcgagttcatggagaaggttgcaaagaccgtggatgtcgaggagttgaccgttgaggaaaggaatcttctttccgtggcttacaagaacgtgattggagccaggagggcctcgtggaggatcatttcttccatcgagcagaaggaagagagccgtgggaatgaagatcatgttaagctaatcaaggactacagggcttcgatcgagactgaactaagcaagatctgtgacggtatcttgggacttctggagtcgcaccttatcccctctgcctcatctgcggagtcgaagatcttttacttgaaaatgaaaggtgattactatcgatacctggctgaatttaagacaggtgctgataggaaggaagctgctgaaagcactttattggcttacaaatctgctcaggacattgctctatccgacttggctcccacccacccaataaggctgggactcgcactcaacttctcagtgttctattatgagatcctcaattcacctgaccgcgcttgcaatcttgccaagcaggctttcgatgaagctattgctgaattggacacattaggcgaggattcatacaaggacagcacgctcatcatgcaacttctgcgtgacaacctcactttgtggacatctgatatcgcggatgagggtggtgacgagatcaaggaatcgtcgaaagcggaggaaagccagtgatgtaggaaaaaggaaggaaaatagtgtttgtgtacgtttttataggggttgtcttgtattcggaatgatttccgatagattgaatgcttgcttgcttgctttatgggttgccgattgttgtttgggagttgctcttttcctttaatcaaatgctctgctgctgctggatttttagccactctccatatctcgacctatttctattatttttcttaaattactgttctaagtatcgaatgttacgttttgtagccaataaataattgagtttttctagctattatgctatatctgttgttactttttgtaaaataaagagactacacaaataagttacatcctatagaactaa

SEQ ID NO: 9679 - DNA, 925 bp, Cleome spinosa
agattcgaattctcaaggatctagaactgtataacaaagatgtcgcctgccgatttgacccgggaagagaatgtgtacatggccaaattggcggagcaagctgaacgttacgaggaaatggtggagttcatggaaaacgtagcgaagactgtggacacagaggagctcacggtcgaagagaggaacctattgtctgttgcttacaaaaatgtgattggtgcgaggagggcttcgtggaggatcatctcttccattgaacagaaagaagaaagcagggggaatgaggaccatgtttcgacaatcaaggaatacagaggcaagatcgaagctgaactcagcaagatatgtgatggcattttgaaccttcttgagactcacctcattccttgtgcatcatctgcggagtcaaaggtcttctacctcaaaatgaagggtgattaccacaggtacctcgccgagtttaagactggtaccgagaggaaggaagccgctgagaacactctgttggcctacaagtccgcacaggatattgctcttgcagaactggctcccactcacccaatcagattggggctagcgcttaacttctctgtcttctactatgaaattctcaactcacctgatcgtgcttgcaatctggctaagcaggctttcgacgaggcaatctctgagttggacacgttgggagaggaatcatacaaggacagtacattgatcatgcaactcctccgggacaacctcaccctatggacttctgacatcaatgacgaggctggcgacgagatcaaggatgcctcaaagcaggagtcagaagaggggcaggaggctcagacagcagccccaccggcacattgatgtgagtgagaccaggtcccacgcgtacaaatacccaatatctttgcttgaataaacagatctgtagcgt

SEQ ID NO: 9680 - DNA, 1000 bp, Zingiber officinale
catccacagagagagacagagagaggggtgagcacgaggaaccctaatcggcgaagaaaggaacttcttcgtggagatctagcaagatgtcagcggtggaatcttcccgtgaagaaaatgtctacttggccaagctggctgagcagaccgagcgatacgaggagatggtagagttcatggaaaaggtcgtgaagacgttgattggggaggagctcaccgtggaggagcgcaacctcctctcagtggcttataagaatgtgatcggagctcgccgtgcctcctggcgtattatctcctcaattgaacagaatgaggagacccgcgggaacgaggaccatgtttccttgatcaaggagtaccgtggcaaggtcgaggcagaactcagtaagatctgcgatgggatcctgaagcttcttgattcccacctcgttccctctgcatccagtgcagaatccaaggtgttttaccttaagatgaagggtgactaccacaggtatctggcagagttcaaaactggagctgagaggaaagaagcagctgagaacactcttttgtcctacaaatctgcacaggatattgctttagctgatttggcttctacccatcctataaggcttggtttggcacttaacttctctgtcttctactatgagattcttaactcaccagaccgtgcttgcagccttgcgaaacaggcttttgatgaggctatctctgaactggataccttgggagaagaatcgtacaaagatagcactttgataatgcagcttctccgagacaacttgacactatggacatctgatattacggaggatggagccgatgagatcaaggaggctacaaaaaaggaatcaggagaggagcagcgatcaaatgattaaattatgtagtttctcatgctaatataagatgtaccattaagtagatgccatcatcttctgcttgttgattgtcctcgtcataaagcaaccaatatgcttaaaggattggatttctg

SEQ ID NO: 9681 - DNA, 1184 bp, Zingiber officinale
gaatctgtaatcaggtctagcaaaatgcctcccatgcattcctcacgcgagaataatgtgtatttggccaaacttgccgagcaggcagagaggtacgaggagatggtggagttcatggaaaaggtggtgagaacgatcaacggggaggagcttagcgtggaggagcgcaacctcctctcagtggcctataagaacgtgatcggggctagacgtgcctcttggcgtattatctcttccattgagcagaaggaggagcgtcgcggcaacgaggaacacgtcacagtcatcaaggagtatcgtgggaaggtggaggcggaactcggcaagatctgtgacgggattctcaagctgctcgattcccaccttgtaccatctgccagttctgccgaatccaaggtgttttaccctaagatgaaaggtgactatcacaggtaccttgcagaattcaagactggagctgagaggaaagaagctgctgagagcaccatgttggcatacaaatctgcccaggacattgctatagcagatctagctccaactcatcccataaggcttgggctggcacttaacttctctgtgttctattatgagattcttaattcacctgatcgcgcatgtagccttgcaaagcaggcatttgatgaagctatctctgagcttgataccttgggtgaagaatcatacaaggacagtacattgattatgcagcttctccgggacaatttgacattatggacctctgatattatggaggatggaggtgatgagatcaaggaaggcccaaagaaggagtcaggagacgaccagtgaccttcatttagttcctctttattttgcagtagaatggattgttgtttaagtgggtttagatgctaagtttcatatgcttctggacaagcctgggttactagtattgcctaaaaaattggatatctagttacttgagcgtttttatgtagtcgattcgaaactatttgaagttgcggcttgttggtgccacgagttctgcaagcttgtgattgaaaagtctaggagtgcagagaaaacaaccatgcttgcttagtcggttgatatcttcctatagcagcattggagaagatttcatcatcgattttttttcatcttaaatttctgatggatttggcttgtttcatagctaattatttgtatcaaacttcatattg

SEQ ID NO: 9682 - DNA, 1342 bp, Mesembryanthemum crystallinum
ctccaaccccccattttctctctctctcctctctctctctctctcaattccgtaataaccgattttgagatttgtttggcatagtgaaaatgtcgtccgaatcctccagggaagaaaatgtttacatggccaagctggccgagcaggcggagcgctatgaggaaatggtggagttcatggagaaagttgcaaagatgacagataccgaggaacttagcgttgaggagagaaacctcttgtctgtggcttacaagaatgtgattggtgctaggagggcttcgtggaggattatttcctctattgagcagaaggaggaaagcaggggaaacgaggatcacgtttcaaccatcaaggagtacaggggtaagattgaaactgagttgagcaagatctgtgatgggatcttgaacctccttgagtcacacctcatcccttcagcctccactgctgaatcaaaggtcttttacctcaagatgaagggtgactaccataggtaccttgccgagttcaagactggagccgagaggaaggaggctgctgagaacaccctgttggcttacaagtccgctcaggacattgctttggcagaattggccccgactcatcctattaggcttggacttgctcttaacttttctgtcttctattacgaaattttgaactcacctgaccgtgcttgcaatctagcgaaacaggcttttgatgaggctatctctgagcttgatactttgggtgaggagtcatacaaggacagcacattgatcatgcagcttctccgagacaatctaaccttgtggacttcagataatgcggaggagggaggcgatgagatcaaggaggctgctgccaaacgggaatcaggcgaggagaagcctcagcagtgataaatttaaaggagttctgctatgtatttgtcgcacggggctcctatatagatgtcatttgggtggttgtagctaggattattagtgaatcatattatctttagcacctgattgctgggtagcactcagatttagcggtcatcatgtcatttccatagacttataaacagcttctgctcgtggtcgtatttcagtgttgtgagagttttagcttatattcaacttgtttgcgtgcccaaagaggaggtattttgatttatctcagcctaaaggttgtacttatacttctgttcttgtttgtccatgttgaagtaactatctgctttgtactactattattcgcttgtggtttgcacctaaaagagtgattacaatgcaagtaagcattttaatactgtacttgttctctttaagcttcaaagtaatagaagagggaaaaagagaagaattattattct

SEQ ID NO: 9683 - DNA, 1155 bp, Actinidia deliciosa
atttaacttcccataacaccccccctatcccttctctcgctctcccctcaattccatcgttcctctgcaagagagagagagattcgtcgtgaagaagtagtattagtttagaaaaacaaagatggtgccaccggaatcgcgcgaggagaatgtttacatggccaaattggctgaacaggctgaaagatacgaagaaatggttgaattcatggagaaagtggtgaagtcactgacttcggacgaactgacagtggaggaaaggaacctcctttctgtggcttacaagaatgtgattggggctaggagggcttcttggagaattatctcttctatcgagcagaaggaagagagtcgtggaaatgaagatcacgtcgtgattatcaaggagtacagggggaagatcgaggcagaactcagcaagatctgtgatgggattctgagccttctcgagtcgaatctcattccttctgcctcatctgcagagtccaaggtgttctactttaagatgaagggtgattaccacaggtacctggctgagtttaagacaggggctgagaggaaagaggctgctgagagcaccttgttggcttacaagtctgctcaggatattgctttgactgatttggctcctactcacccaataaggctgggtcttgcacttaacttctctgttttctactatgaaattctcaactcccctgatcgtgcttgcagtcttgcgaagcaggcttttgatgaggctatttctgagctggatacattgggtgaggaatcatacaaggatagcacattgatcatgcaacttcttcgagataatctgacattgtggacttctgatatcacggatgaaggtgtggatgagatcaaggaagcctcaaaacgtgagtctggagaagggcagtagtgattagttggttggtgatgtactctttactttttaaattggtatcgtaatagggattgcctttgagtggtagaaagacttgttaaattggaagattcagcactgcttggggttgtaatgctgttacaagcttttgtgtttattacttatgaaaagagtattgtttggtgcttgatggccctgatacttgagattgtccttgaatcagtaatttttgtaccaatactatgctttgacgtgataaaaaaaaa

SEQ ID NO: 9684 - DNA, 1185 bp, Leymus cinereus x Leymus triticoides
tgcctcctacgcccccggatccgctgctccacccccccaactccgctgccacacgccattgcacaagcgagcgagcaaccatgtcgccggcggagccgacgcgagacgagagcgtgtacatggcgaagcttgcggagcaggccgagcgctacgaggagatggtcgagttcatggagcgcgtggcgaaggccaccggcggggcagggcccggggaggagctatccgtcgaggagcgcaacctgctctctgtggcttacaagaacgtcatcggggcccggcgcgcttcctggaggatcatctcctccatcgagcagaaggaggaaggtcggggcaacgaggcgcacgccgccaccatccgctcctaccgcagcaagatcgaggccgagctcgcaaagatctgcgacggcatcctcgcgctgctcgattcccacctcgtgccatccgccggagccgccgagtccaaagtcttctatctcaagatgaagggcgactaccacaggtaccttgcagagtttaagtctggtgcggagaggaaggaagccgccgagagcaccatgaacgcgtacaaagctgctcaggatatcgccctagcagatttggctccaacccaccccatcaggcttgggcttgcactcaacttctctgtgttctactatgagatcttgaactcccctgaccgcgcctgcaaccttgcaaaacaggcctttgatgaggctatatcagagttggacagcttaggcgaggaatcctacaaggacagcactttaatcatgcagctcctgcgtgacaatttgactctatggacatccgataccaatgaggatgacgttgacgagataaaggaagccccagctccaaaagaatctggagacggacagtgaggtgaatccaaacaacagtctgtgcattgttgggggcaatggaagtcgatggtcttggttctagtgctcatactgttgtcatcactacctctgtttaattatgcacttaagaagtttctgggatttttctggtgctgataaatgctggctggattcgtgttttcttgttcaaatctggccacaaagcaaaagacctgctctttttcaccattagaatgtttgctatatcaaccatgtttgacgagacttgatgcaactagtactattttgctgcaattgaggtgtcctgttcatgtttggctga

SEQ ID NO: 9685 - DNA, 1342 bp, Pinus pinaster
aaagccctcgctccccctgtactgcccttcattgtcttgtgctgctgctttcacagaaattccagtcacagttcttggttctgccattttagtgtgtttgtgcattgcagtggccgtttctttgaagatccagaagtgaagttaggtttttaatatctgtgtacaaatggcggcagcggcgatggtggagtcatcgcgggaggagaatgtctacatggcgaagctggctgagcaggcggagcgctacgaagagatggtggagttcatggagaaagtgacaaaaggcgtggaggtggaggagctcacagtggaggagcggaacctgctatctgtagcctacaaaaacgtgatcggtgcccgcagggcctcctggagaattatttcctccatcgagcagaaggaggagagcaggggcaatgatgagcacgtggtcaccatcagggagtacagggccaaggtggaagcggagctttccaagatctgtgagggcattctccgccttctcgactcccacctcatcccttcttccaccgctgcggagtccaaggttttctatctcaagatgaagggcgattaccatcgatacctcgccgagtttaagacaggcgccgagaggaaggaggccgctgagaacactctacttgcttacaagtctgctcaggatattgctgcggcagagctggctccaacgcatcctattaggctagggctggctcttaacttctctgtattttactatgagattttgaattcgccagacagagcctgtaatctcgcaaaacaggcatttgatgaggcaattgcggagttagataccttaggtgaagattcttacaaggacagcactctcatcatgcagctccttcgtgacaatctgacattgtggacctcagacatgcaggaggatgctggggaagagatcaaagagacttctaagcgtgaggatggggaggagcaatagtgaaatgtgataatcttatactgtattaggattaggattagattaccaggctttcctgcattgtttggtaaaggaggcctacgtgcacgatcgtgtttattagatctcatgctctgcagcatttagttgctgttggtagcatattcttagtcatattttgttggctacgcttatgttggcattttatatcatctatttgcgaatggttggagacagtggcttggtactgtaatatcagattggtggagtctatcaacaaatctgtaggcccattctgcttttgtgttcaataatattttttattgtcttgatttagcttctcgctgcttgtatcaatgaacattttttttcaatttatcttgaaaagcctcgtgccgaatt

SEQ ID NO: 9686 - DNA, 1054 bp, Petroselinum crispum
ttattgggcctaaattaaagcccattttatttacgtagactcgttatttattcgacatcttcacttctatttctcctctctcgcctcccaacacacaaccttattttttgattaagagattagtaagaagtaaagatggtggcttcagatgcatctcgtgaggacaatgtttacaatgccaagcttgccgaacaggctgagcgttatgaggaaatggttgagttcatggaaaaagttgctaagaccgtagatgttgaggagcttactgtggaggagaggaatcttctctctgttgcttacaagaatgtcattggagccagaagggcttcttggaggatcatatcttccattgagcagaaagaagagagccgtggaaatgaagatcatgttaacattataaaggactacaggggtaagattgaggctgaactcagcaagatctgtgaagggatcttgaaccttctcgactcccatctggttccctcggcatcttctgctgagtctaaggtgttctacatgaagatgaaaggagattaccacaggtatttggctgaatttaaggttggggctgagaggaaagaagctgctgagagcaccttgctagcctacaagtctgctcaggatattgctttagctgaactagcttccactcacccaataaggcttggactagctcttaacttctctgttttctactatgaaattctcaactcccctgatcgtgcttgcaaccttgcaaagcaggcttttgatgaagctatctctgaactggatacattgggcgaggaatcttacaaggatagcacactaatcatgcaacttctccgtgacaatctgacattgtggacatctgatatagcggacgaaactggggatgaaatcaaagaagatcccaagcaatctgatgaatagcaacattgatgaagtggtagaatagaattgcgtactcgtcacattgtgtctttaatacagattttcatgtcgcaaggatttgaaaatttctagtttggatttcattgatgattgatgtttgtgattgggttctactcttttt

SEQ ID NO: 9687 - DNA, 1667 bp, Chenopodium quinoa
cccatatttaatctccctttccctattcttctcaccttccactctccctcttcctctccccctctttctctgatttttatttttgctgtgagtggtagaaatggcgactgaatcaagggaagacagtgtttacatggctaagttggccgagcaggctgagcggtatgaggaaatggtggagttcatggagaaggttgcaaagatgacagatgccgaggagcttactgtggaagagaggaacctcttgtccgtggcttacaagaatgtgattggtgcaaggagggcttcttggaggatcatttcttcgattgagcaaaaggaggaaagtagaggaaacgaagatcatgttacaaccatcaaggagtacaggggtaagattgagaccgagcttagcaagatctgtgatgggattttgaaccttcttgagtcgcacctcatcccttcggcttcctctgccgagtctaaggtattctaccagaagatgaagggtgactatcacaggtaccttgctgagttcaagacaggagctgagcggaaggaggctgctgagaacaccctgttggcttacaagtccgctcaggatattgctcttgctgaattgcctcctactcatccaattaggcttgggcttgctcttaacttctccgtattttattatgagattttgaattctcctgaccgtgcctgcaatcttgccaagcaggcttttgacgaggctatctctgagctggacacattgggtgaggattcatacaaggacagcacattgatcatgcagctgctgcgagacaatttgaccctttggacttcagacaatgcggaggaaggcggtgacgagattaaggaaaccgctggaaaatcaggcgaacagtgataagttggagaattgtgctatgtatttttggcatgagactccagtatagtagttgttatttggatcgtagtagctaggttaatatattagaatcacatggtttttagttctgggtattatcgtactcgtatttagtattctctttttcatcttagacacttaaaaacacagcattgtgctatttttattttatgttcaatgtgtgagatgtagttgcatatttaacctttgcttggcgagggagtatttgatttttgtcatcctcaaggtttggtgtactctctgattgtttgtcaatgtttaataattacttcctccgatctttataacttgacctgtattcctttttgggaatttcttttatggcaaatgtaacactacacttttactatttacccctgataaccatttcaacgtaataggacactatagtactatatccttgagtctttaacctttccttcttcctcacctcagtcaaccccatagttaattgattaccagtccctaccaccggtcatccctccctctttccctcctacctttaaccatacgggtaacgccctaaccacctccgactccaaccgtcctaacgtcctcctcctcgttacactccgactaactcgggccttccgactaccttcctacccgtatccaccgtaccaacgtaactccgtaccacttccaacccgttccggtacccgtttcccgaacccgtacccggtttacgtaacgttaccgttacctaaacggtttttaacccaaaccggtaccgtaaccgtaacgttaaccg

SEQ ID NO: 9688 - DNA, 1012 bp, Carthamus tinctorius
ggcgggggctaatagaatcatcacacacacacacaaacacctagttacacacactagctcctgctctcgccctatcaatccagaatggcatcagctgaagcttcgcgtgaagagaatgtgtacatggccaagctggcagagcaggccgaaaggtacgaagaaatggttgagttcatggagaaggttgcaaagactgtggatgttgaggagttgacagtggaggaaagaaatcttctttccgtggcttacaagaacgtgattggagctaggagggcttcgtggaggatcatttcttccatcgagcagaaggaagagagccgtgggaatgaggatcatgttaagctaatcaaggactacagggcttcgatcgagactgaactaagcaaaatctgtgatggtattttggggcttctggagtcgcaccttatcccctctgcctcatctgcagagtcgaagatcttttacttgaaaatgaaaggtgattactatcgatacctggctgaatttaagacaggtgctgataggaaggaagctgctgaaagcactttattagcttacaaatctgctcaggacattgctctatccgacttggctcccacccatccaataaggctgggactcgcactcaacttctcggtgttctattatgagatcctcaactcacctgaccgtgcttgcaatcttgccaagcaggcttttgatgaagctattgctgagttggatacgttaggcgaggattcatacaaggacagcacgctcatcatgcaacttctgcgtgacaacctcactttgtggacatctgatatcgcggatgagggtggtgacgagatcaaggaatcgtcgaaagccgaggaaagccagtgatgtaggacaggaaggaaaatagtgtttgtgtacgtttttataggggttgtcttgtattcggaatgatttccgatagattgaatgcttgcttgcttgctttatgggttgccgattgttgtttgggagttgctcttttcctttaatcaat

SEQ ID NO: 9689 - DNA, 1091 bp, Sarracenia psittacina
gactccccctctttctccgcttctctctcctcgtatatttatcctctttctaaaaacgttctctccctcaccccgaataaccacactgtcaaaatccaaccccaataccgaagatatcaatcaatcgacccttacattgagagatccaatcaaccatggcggtcgcatcaaccgcgcgcgaggagaacgtttacatggcaaagctggctgagcaggccgagcggtacgaagagatggtggagttcatggagaaggtcacggcggcggtagactcggaggaactgtccgtggaggagcgcaacctgctgtcggtggcgtacaagaacgtgatcggcgcgcggagggcctcctggcgtatcatttcgtccattgagcagaaggaggagagccgcgggaatgaggaccacgtcgccatgatcagggactacagatccaagattgaatcggagctctcgtcgatctgcgacggaattctcaagctacttgactccaggctcatcccgtcgggttcgtctggggactcgaaagtgttttacctgaagatgaagggagattaccatcgttatctcgctgagttcaagacaggcgcggagcgcaaagaggcagccgaaagcactctcaccgcctacaaagcggctcaggacattgcaaatgcagaacttgctccaacacatccaatccggctcggacttgctcttaatttctctgtattttactatgagattttgaactctcctgaccgtgcttgtagtcttgccaaacaggctttcgatgaagcaattgccgagttggataccttgggagaggagtcttataaggatagcacattgatcatgcaacttctccgggacaacctcactctatggacctcagacatgcaggatgacggtgctgatgagattaaagatgctcccaagcatgatgccgaacagcattgaacctcaaaactagggtctcacctctcccctaattgatttgtttttaggtgttcttgcttttgataccaaaacttcaaggttattggtgctcttggacttgttttaaaatatgtttttatcaaatggtcacgtcttacaatgggtaatatgaaa

SEQ ID NO: 9690 - DNA, 1529 bp, Sciadopitys verticillata
cgcgaatctcgatcctgctaaatttagcgcaagtctttatcatttctatttgtggttaggcagtcgcgtgttcgaatcctcagactatttagggtttggtagcagtaaaagtttttcgggtttggtagagcggcggaagaatttttctgttgttgacttgatctgttaaaaaagtctgtctactctacttttcgctacactttggtattcagggggtcgcaggttcaaatctagggtttggtcgcagggagactttctggtgttgtaaagctgcggaaatagtttttatttttctgtgaaaaatgtcgcccgtggagtcctctcgcgaggagaatgtttacatggcgaagcttgcagagcaggcggagcgatacgaagaaatggtggagttcatggagaaggtgacgaaggctttggaggtggaggagctcaccgtggaggagcgcaacctcctgtcggtggcgtacaagaatgtgatcggcgcgcgcagggcgtcgtggaggattatttcgtcgatcgagcagaaggaggagagccgtggcaacgacgatcatgtggtcaccattagagaatacagggccaaggtcgaggcggagctcagcaagatctgtgattcgatcctgcgcctcctggactcgcatcttattccctcttccactgctggggaatcgaaggtattttatctcaagatgaaaggagattatcatcggtatctcgccgagtttaagaccggcgccgagagaaaggaggccgcggagagcaccttgctcgcttacaagtcggcccaggacattgcagtggcagagcttgctcctacgcatcctatccggctagggctggctcttaacttttccgtattttactacgaaattttgaactctcctgatcgtgcctgtctccttgcaaaaacggcatttgacgaggcaattgcagaattagatacgttgggcgaagagtcatacaaggatagtactctcatcatgcagctccttcgtgacaatctgacattgtggacctcagacatgcaggaggatgcaggagatgagatcaaagaaactcccaagcccgaagaaggcggagagcaatagtgaattatgagcacctgatacattattaggacagtagattatcaggcattcatgcagtatttggtaatgggtgccttttgtgtgcggtcttatttattatatcggctagtctgcaaagtttagtttgttgcagagagcatatgcctaatcatcttttgttacctgcaaatatgttgtcatttcaaaccatccatactatttgcctatggttggatatggtggcttggtactgtaatatcagattggtgaatgagttgagtagcaaacttgtaaccacgttttgtgattgtgttgattgatttttttttagttgtcggaagttattttctcactgcttctgtcatgggcttagcaattcctttgtcaaaactactcgagaatgttttcactattttgagaaaatgagcatcatttggtcctcaattgtttgaaggtcattga

SEQ ID NO: 9691 - DNA, 1368 bp, Panicum virgatum
tgtaagatgtaaagtttacaaattgcttcactgttgtttctttttggtgtggtaattagcgttcaactcaccaaagttttttttctccccttcaatcctccagtttgacctttggtgaactgttagaaaccataaacagtgaagatgtcgctgcctgctgagctttcccgtgaggaaaacgtttacatggccaagcttgcagagcaggctgagaggtatgaagagatggttgagttcatggagaaggtggctaaggcagttgattctgaggagcttactgtggaggagcgcaaccttctgtcagttgcttacaaaaatgtcattggagcccgacgtgcctcatggcgcatcatatcctccattgagcagaaggaagagggacgtggcaatgaggaccgtgtcactcttatcaaggactaccgtagcaagatagaagttgaactcaccaagatatgtgatggaattctcaagctccttgattcccaccttgtcccctcatccacggctccagagtccaaggtcttctacctcaagatgaagggtgactactacaggtaccttgcggagtttaaaactggatctgagaggaaggatgcagctgagaacaccatggtggcatacaaagcagctcaggatattgccctggcagagttggcccccactcatcctattaggctcgggctggcgctcaacttctcagtattttattatgagatcctcaactctcctgatcgtgcttgcagtcttgctaagcaggcttttgatgaggccatctcggagctggataccctgagcgaggaatcctacaaggacagcactctgatcatgcagcttctgcgtgataacttgaccctgtggacttcagaatctcggaggatgccgccgaagaaatcaaggaggctcccaagggcgagtctggagatgggcagtaaagatgatccatgtccccaaaaactacatttcagtgttcggtctcctagcgaatctgtcatgtgctctgggttctgatttcgtccatataggttgtattgctgcttgtgatagctggaaattggtgactcccttctgtgctgtggtagaaaggcttgcaagtaccatgctgcttggcaggtgtcgtcaagctacacttggttgagggagcctttatttgttcgaatcattggcgttactttgtatttgtaggttggtctacctgtttcttttgtctccatgttcgtgtcttttctattgttgattgattttgatgtgtttccgtcaatgtgcatgcatgatgcccttgaactgaaatagtttttgccatctagttgtgatgctggatgaatgttcaggcctctgccctggcagtgttttttttaaccacgattacca

SEQ ID NO: 9692 - DNA, 1193 bp, Tripterygium wilfordii
tgatttttgattcttcacattttagcaatggcggtagcaccttcaccacgcgaggagagcgtgtacatggctaagctggcggagcaggccgagcgctacgaggagatggttgagttcatggagaaggtgtcggcatcggtcgacaacgaggagctgaccgttgaggagaggaatcttctctctgttgcttacaagaacgtgatcggtgctcgtagggcttcctggcgcatcatctcatccatcgagcagaaggaggagagcaggggcaacgaggaccatgtctctacgattcgagactacagatccaagatcgagaatgagctatccaacatctgcgatggcatactcaagctccttgacaccaggctcatcccatccgcctctgctggtgattccaaggtcttctatctcaagatgaagggagactaccacaggtacctcgctgagttcaagactggtgctgagcgcaaggaggccgccgagagcaccctcactgcctacaaagctgctcaggatattgcaaatgccgaactggctccaactcacccaatccgtttgggactggctctgaacttctccgtcttctactatgagattctgaattctcctgaccgtgcctgcaatctggccaagcaggcttttgacgaagctattgccgagttggataccttgggcgaggaatcatacaaggatagcactttgatcatgcagcttctgcgtgacaatcttaccctatggacctctgatatgcaggatgatggagctgatgagattaaagaagcacccaagcgcgatgaagatcagcagtgatgcaactcaaatcaactgcaaattagggagaaggtgcttgtttgccaatttatctactatttttagccattcttgtttggttatgaatcaatggatgtactgagccagctttctttttctagtttgttttatcaatttaagtgtttctgaatgagccttcatttgtgatgatatccgagctgttgcgttggcattgaattcctccaattcagttagccagctacctagcctttttcccctgcctcctttatacatctttttgcttttgttctcttttgtaatctgtgattttacagtgaactccatttctgtatgatgtttgggtgggtaccccccagtattaaagggccaatctggcatagaccttgtccccccattgacct

SEQ ID NO: 9693 - DNA, 1461 bp, Zamia vazquezii
gatccctcgtaccttgccaattcgttctgctccgtaagatccaagcagccactgattttcgttctccattgtggttaaataggtacagcgttcgattcctgccgaatcctctcggtcgtttttccccctttgctctctggttttttattcccccccccaatcgggatttctgtagttcaaatgtcgcctgtggagtcctcccggaaaaaaaatgtgtacatggcgaagctcgcggagcaggcggagcgctacgaggagatggtggaattcatggagaaggtgatcaagactgtcgatgtcgaggagcttacggtcgaggaacgaaatctgctgtccgtggcctacaagaatgttatcggtgcccgcagggcttcatggaggatcatttcttctattgaacagaaggaagagagcaggggtaatgacgatcatgtggccacaatcagagagtacagagccaaggtcgagtccgagctctccagcatttgtgatagcattctgcgcttgctcgattcccacctaattccctcttccaccagtggggagtccaaggtattttatctgaaaatgaagggcgattaccatcgctacctcgccgagttcaaaacaggcgccgaaaggaaggaggccgcggaaaatacttcgctcgcgtacaagtctgcacaggacattgcgggttcggacttggctccgacgcatcctattagattggggctggctctcaacttctccgtcttctactatgagattctgaattcacccgaccgagcatgtgctcttgccaagcaggcatttgatgaggcaattgcggagttggatactttaggtgaagaatcgtacaaggacagcactctgatcatgcagctgctacgtgacaatctcaccttatggacttcagacatgcaggaggatgctggagaggagatccgagatccctccaaacgcgaggaaggggatgaacaatagtcaaatttggtcacatattgcatgtaatagggattttagattatttggcttccctgtgtaatttgatgatgcttgcctttgtgcacaattttaggtattagatgtgctgctctcagtatttggttgttacagagaagttgatcttctttgttagttgcaaatttgttagcatttaagctatccatactgtttttcaatagtttggatcatggtgactagtggatgtaatagcagattggtaaacgagttgagtatgcgcagaataatgcttgttaccccaatttagttgttcactaattgggtctctgcattcataaaatttttgggcaacttcaagtttcattactttacagtttcgatattggaagacaggtttcacttatcctgactttgaaatttagggtgggtttgaatctttttatatctgtgtcatggtagacaaaattatagattgactggccttttgttcaatctgttattgggagcctcttgtta

SEQ ID NO: 9694 - DNA, 1229 bp, Silene vulgaris
tctctctacatctcacatttcttccttaattaacggttgttgagatatctgtagtgacttgaaaatggcgtctgatgcttcaagggaagacaatgtgtacatggccaagttggctgagcaagctgagcgatatgaagagatggtggaatttatggagaaggtagcaaagatggcagatgccgatgagcttactgtggaggagaggaacctcctttctgtggcttataagaatgtcatcggggcgagaagggcttcatggagaatcatttcctctattgaacaaaaggaggaaagcagaggaaatgaggatcatgttgcaactattaaggaatacaggagtaagattgagaccgagcttagcaagatctgtgatgggatcctgaaccttcttgagtcgcacctcatccctaaggcatctgctgctgagtctaaggtgttttacctcaagatgaagggtgactatcacaggtaccttgccgagtttaagaccggtgctgaaagaaaggaagctgccgaaaatacccttttggcttacaagtccgctcaggacattgctttggcagagttggcccccacccatccaattaggcttggtctagctctgaatttctccgtcttctattatgaaattcttaactcacccgaccgtgcttgtagccttgcaaaacaggcatttgatgaagctatttctgagcttgacacattgggtgaggagtcttacaaagacagcactttgatcatgcagcttctcagagacaatctgaccttatggacttccgataatgcggatgagggaaatgatgatatcaaggaagctgcaaagggtgattctggcgaggtgcagccgcaacagtaatcgtcaaaggagttctgctctgtatttttagcagaaccctagaatagaatttacccttgaatggttagtaagctaccactatcagtgaagcatgtcatattagtctttagtgctggtagagtggccccccaaagcccagatttagtttgttgtttatcggtcttaatgttatgtttgtgagatttatttcatggtgatttttgtttgcttgccggaattcgatttattgtaagcgtgattgctgtttggtactcgtgtctatttattcgtggagttttttttttattttatttttttgtaaccgatcttggcagagtagatcattttctttgtttgaccttggtggtttacctaaatgaattttgatgattaa

SEQ ID NO: 9695 - DNA, 1182 bp, Picea glauca
tccattcacagttcacagtccttggtttggtttcgccattttagtgtatttcttcattttagtggccgtttgttgaagatccagaggtaaagttgggcgtttaagatctgtgcagagatggcggcagcggcggtggtggagtcatcgcgggaggagaatgtatacatggcgaagctggccgagcaggcggagcgctacgaggagatggtggagttcatggagaaagttaccaaaggcgtggaggtggaggagctcacagtcgaggagcgcaaccttctctctgtggcctacaagaacgtgattggtgcccgccgggcctcctggaggatcatttcctccattgagcagaaggaggagagcaggggcaacgacgaacacgtggtcaccatccgggagtacaggtccaaggtggaatcggagctttccaagatctgcgagggcattctccgccttctcgactcccatctcatcccttcttccaccgccgctgagtccaaggtcttctatctcaagatgaagggcgattaccatcgataccttgccgagtttaaaacaggcgccgagaggaaggaggccgctgagaacaccttgcttgcttacaagtctgcccaggatattgctgcggcagagttggctccaacgcatcctattaggctagggctggctcttaacttctctgtattttactatgagattttgaattcgccagatagagcctgtaatcttgcaaaacaggcatttgacgaggcaattgcggaattagatactttaggtgaagattcttacaaggatagcactctcatcatgcagttgcttcgtgacaatttgacattgtggacctcagacatgcaggaggatgctggggatgagatcaaagagacttctaagcgtgatgaaggagaggagcaatagtgaaatatgatgatctattagtatattaggattagattagcaggctatcctgcattgtttggtaaaggaggctatgtgcacgattgtgtttattagatctcatgctctgcagtatttagttgctgtgggtagcatattcttaatcatcttttgttagctgcgcttatgttggcattttaaatgatccatactatttgcgaatggttggagacagtggcttggtactgtaatagcagattggtggagtctatcaacaaatctgtaggccca

SEQ ID NO: 9696 - DNA, 1013 bp, Helianthus annuus
tcacaaacccttggatacgcactcgcagctcttgcccgtatcgatccagcgagtaatcaaccacaaaaatggtgcaaaccgaagcgtctcgtgaagaaaacgtgtacatggcaaaactagcagagcaagccgaaaggtacgaagaaatggtggagttcatggagaaggtagtgaagattgtggattccgaagagttgacagtggaggaaagaaaccttctttccgtggcttacaaaaacgtaattggtgctagaagggcttcatggaggatcatttcctccatcgaacagaaagaagaaagccgtgggaacgaaggtcacgttaccacaatcaagagctacaggggtaagatcgagaccgaattgagcaagatctgtgacggcatcctggctcttctcgagtctcatcttattccctctgcgtcgtctgctgagtctaaggttttttacttgaagatgaaaggtgattattacagatacttagctgagtttaagacgggagccgaaaggaaagaggctgctgagaatactttattaggatacaaatctgctcaggatattgctttagctgatttggctcccacccatccgatacggttgggccttgcactcaacttctcggtgttctattatgaaattctcaactcacctgaccgtgcttgcagtcttgctaagcaggcatttgatgaagccatctctgagttagacacacttggtgaggattcatacaaagatagcacgttgatcatgcaacttctgcgggataatctcactttgtggacgtctgatgttgcggacgagacaggggacgagatcaaggaaacttcaaatcccgatgaagaacagtgatatttacaagtgaaatgacagtagttgttgctttttagattttcatttagggttgctgcttgctggtttctcatagattgtaagcttgttggagttttggcatttggttgtgtcatgtttttgttgattgcaactttagatgtttccagtgaaagctctaaaact

SEQ ID NO: 9697 - DNA, 1061 bp, Glycine max
ctttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctccggcgattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttgccaaattgcctattttattaaggacgctgaagtttttattatatgga

SEQ ID NO: 9698 - DNA, 1099 bp, Glycine max
ttctccgtctcccctcatttgctcactttctctctctaaccagatctcgcactcgcgctttaactctctaggattcgacgacaatggcggccgctccctcgcctcgcgaagagaacgtctacatggcgaagctcgccgagcaggccgagcgctacgaagagatggtggagttcatggagaaggtctccgccgccgccgacaacgaggaacttaccgtggaggagaggaacctcctctccgtcgcctacaagaacgtgatcggagcgcgccgcgcctcgtggcgcatcatctcctcgatcgagcagaaggaggagagccgcggcaacgaggatcacgtctccgtcatccgcgactaccgatccaagatcgagtccgagctctccaacatctgcgacggtatcctcaagctcctcgactctcgcctcattccatccgcttcctccggcgattccaaggtcttctacctcaagatgaagggagattaccacagataccttgccgagttcaagaccggcgccgagcgtaaggaggctgccgagagcactctctctgcatacaaagccgcacaggacattgcgaatgccgaactgcctcctactcatccaattaggcttggccttgctcttaacttttctgtattttactacgaaatccttaattctccggatcgtgcctgcaaccttgcaaaacaggcttttgatgaagctattgctgaattggatacactgggagaggagtcatacaaggatagcactttgatcatgcaactccttcgtgataacctcacactttggacctctgacatgcaggacgatggagcagatgaaattaaagaagcagcaccgaaaccggatgaccagtaaaaatattttactgctaattagaattgaacttctcctccatatctttttgaagggagaaggtgtttgttgctaatatctctttggtactgggattttaggcattcatgtctgttatgaattgtggatgtactgggccgttttagtttgtccttccattttctcaagtgttttccaaattgcctattttattaaggacactgaagtttttattatatggaattggaattttaagattc

SEQ ID NO: 9699 - DNA, 1306 bp, Phaseolus vulgaris
gatcgccaaaacaacccacccacgcttctcaaaacgcaattatcggacgccataccctcaaaaccaccctttccctttcgtcgatctccgtctccctcatcgcttcctccctctctctgtctctctcagtctctctctcgctctctaatccctaaccagatctcgctctctctccaggattcaacaatggcggccgctcccacgcctcgcgaagagaacgtgtacatggcgaagctcgccgagcaggccgagcgctacgaagagatggtggagttcatggagaaagtgtccgctgccgctgataacgaggaactcaccgtcgaggagaggaacctcctctccgtagcctacaagaacgtgatcggagcgcgtcgcgcctcgtggcgtataatctcctcgatcgagcagaaggaggagagccgcggcaacgaggatcacgtcgccgtcatccgcgactaccgatccaagatagagtccgagctctccaacatctgcgacggtattcttaagctccttgactctcgcctcattccctcggcttcctccggcgattccaaggtcttctacctcaagatgaagggcgattaccacaggtaccttgccgagttcaagaccggcgcagagcgcaaggaggctgccgagagcactctcgctgcatacaaatccgctcaggacattgccaatgccgaactgcctccaactcatccaattaggcttggccttgctcttaacttctctgtattttactatgaaatccttaactctcccgatcgtgcctgcaaccttgcaaaacaggcttttgatgaagcgattgctgaattggatacactgggagaggagtcatacaaggatagcactttgatcatgcaactgcttcgtgataacctcaccctttggacctctgacatgcaggacgatggagcagatgaaattaaagaagcagcaccgaaacaggatgatcagtaaagatgttttactgctaattagaattgaacttctcctctatatctttttgaagggaggtgtttgtcgctaatatctttggtgctgggattttaggcattcatgtctgttatgaattgtggatgtactgggccgttttagtttgtccttccattttcaagtgtttttccaaattgcctattttattaaggacacttttaagtttttattttatggaattggaattttaagattctcttctatctagtcaacttgatgtcaccatcttttttattgtgaggattagcaagatctgtgttcactttgaaacctctaaattggaattggttttggttttggtttt

SEQ ID NO: 9700 - DNA, 1256 bp, Trifolium pratense
gctttctctctctaaaatccctaaaaccagatctcacactttctctctctacgattcaacaatggcggccgctcccactcctcgggaagagaacgtttacatggctaagctagccgaacaagccgagcgctacgaagaaatggtggaattcatggagaaagtttccgccaacgccgataacgaagaactcacggtggaggaaaggaaccttctctctgttgcttacaagaatgtcatcggagctcgacgtgcctcatggcgtatcatttcatcgatcgagcagaaagaagagagccgtggcaacgaggatcacgtcaacgtcatccgtgactaccgatctaagatcgagtctgagctctctaacatctgtgacggtatcctcaagcttcttgattctcgtctcattccttctgcttcctctggtgattccaaggttttctacctcaagatgaagggagattaccataggtacctcgctgagttcaagaccggagctgagcgtaaggaggctgcagaggctactctcgccgcttacaaatctgctcaggacattgcaaatgctgaattgcctccaactcatccaattaggctcggccttgctctgaacttctctgttttttactatgaaattcttaactctcctgatcgtgcttgcaaccttgcaaaacaggcttttgatgaagcaattgctgaattggatacccttggagaagaatcatacaaggatagcactttgatcatgcaacttcttcgtgataacctcaccctatggacctctgacatgcaggatgatggtgccgatgaaattaaagaagcagccccaaaaccagatgaacagcagtaaacaaattttactgccaattagattcaaacttctcctactctacatgtttatgaatgaatgaaggaagaaggtgcttgttgctaatctctttgggtgctgagattttaggcattcacgtctgttatgaattctggatgtcctgggctgttttagtttgtccttccatttttaagcgttttacaaattattgcctatttttcttgaggacactgaaattttattatatggaattgaaaatttaagattctctttctagtttacttgatcttgcagaatttagtgattggataataagccaacattttggcttacttgatcttgcagaatttagtgagaatgttagctttatctgttatcgacagcgtcattatcattatcatttattataattgagggatcccagtcaaaataa

SEQ ID NO: 9701 - DNA, 1146 bp, Gossypium hirsutum
aaaacgtattcctctcggctcttgccctaattcacttgcaataatattttttcacttcacatctgcaacgaaaaagaaagcgcccctttatctggatcaggtattagagtggtatagtaaaaatgtcttcaactgggtcaacacgagaggaaaatgtttacatggccaagttggctgagcaagctgaacggtatgaagaaatggtggagttcatggagaaagttgtaaaagctgtcaatgtagaggagctaactgttgaggaacgaaatcttctctccgtggcttacaaaaacgtgattggggccaggagggcatcatggaggataatctcttcaattgagcagaaggaagagagcaaaggaaatggggatcatgttgctatcatcaaggagtataggggcaagatcgaagctgagcttagcaagatctgtgatgggattttgagccttctggaatctcatctcatcccttcagcctcaacagctgagtccaaggtgttttaccttaagatgaagggtgattatcacaggtatcttgctgagtttaagactggcgtcgagaggaaggaagcagctgaaagcactttgttggcttacaagtctgctcaggatattgctattgttgaacttgctcctactcacccaattagactcgggcttgctcttaacttctctgttttctactacgaaatcctcaactcacctgatcgtgcctgcaatcttgcaaaacaggcttttgatgatgcaatttcagagttggatactttgggtgaggaatcttacaaggatagtacattgatcatgcaacttctccgggacaatctgaccctctggacatctgacatcacggatgaagctggagatgagatcaaggaagcacctctaaagcctgagtcaggggagggacagcagtgacgagtcaagctcataggatatgtactctgtacttcatctagtagtttcttatagatgcaatctaggttgtagaagtgttccttttacttttttttcttctctaatcagcacttggaatcaaatgttccgatggattatacatgcgctttattattggacaggaatttgtttggttttcatgtggtaatatgctaaaatagtgtttaccaatacaaataaatatgcacacttt

SEQ ID NO: 9702 - DNA, 1158 bp, Gossypium raimondii
aacacacaaaacgtattcctctcggctcttgccctaattcacttgcaataatattttttcacttcacatctgcaacgaaaaagaaagcgcccctttatctggatcaggttttagagtggtatagtaaaaatgtcttcaactgggtcaacacgagaggaaaatgtttacatggccaaattggctgagcaagctgaacggtatgaagaaatggtggagttcatggagaaagttgtaaaagctgtcaatgtagaggagctaactgttgaggaacgaaatcttctctccgtggcttacaaaaacgtgattggggctaggagggcatcatggaggataatctcttcaattgagcagaaggaagagagcaaaggaaatggggatcatgttgctatcatcaaggagtataggggcaagatcgaagctgagcttagcaagatctgtgatgggattttgagccttctggaatctcatctcatcccttcagcctcaacagctgagtccaaggtgttttaccttaagatgaagggtgattatcacaggtatcttgctgagtttaagactggcgtcgagaggaaggaagcagctgaaagcactttgttggcttacaagtctgctcaggatattgctattgttgaacttgctcctactcacccaattagactcgggcttgctcttaacttctctgttttctactacgaaatcctcaactcacctgatcgtgcctgcaatcttgcaaaacaggcttttgatgatgcaatttcagagttggatactttgggtgaggaatcttacaaggatagtacattgatcatgcaacttctccgggacaatctgaccctttggacatctgacatcacggatgaagctggagatgagatcaaggaagcacctctaaagcctgagtcaggggagggacagcagtgacgagtcaagctcataggatatgtactctgtacttcatctagtagtttcttatagatgcaatctaggttgtagaagtgttccttttactttttttttcttctctaatcagcacttggaatcaaatgttccgatggattatacatgcgctttattattggacaggaatttgtttggttttcatgtggtaatatgctaaaatagtgtttaccaatacaaataaatatgcacactttaggt

SEQ ID NO: 9703 - DNA, 1087 bp, Medicago truncatula
ctcattcgctttctctctctaaaaaaaatccctaaaaccagatctcactttctctctctagaattcaacgatggcggccgctcattctcctcgggaagagaacgtctacatggcaaagctcgccgaacaagccgaacgctacgaagaaatggtggagttcatggaaaaagtctccgccaacgccgataacgaagaactcaccgttgaagagaggaaccttctctctgtagcctacaagaatgtcatcggagcaagacgtgcttcgtggcgtatcatttcctcgatcgaacagaaagaggagagccgcggcaacgaggatcatgtctccgtcatccgtgactaccgatctaagatcgaatcagagctttctaacatctgtgacggtattctcaagcttcttgattctcgtctcattccttccgctgcttccggtgattccaaggttttctaccttaagatgaagggagactatcacaggtatcttgctgagttcaagactggtgccgagcgtaaggaggctgctgagagcactctcgccgcttacaaatctgctcaggacattgcaaatgctgaattgccaccaactcatccaattaggctgggtcttgctctgaatttctctgtgttttactacgagattcttaactctcctgatcgtgcctgcaatcttgctaaacaggcttttgatgaagcaattgctgagttggatacccttggcgaggaatcatacaaggatagcactttgatcatgcaacttcttcgtgataacctcaccctatggacatctgacatgcaggacgatggagccgatgaaattaaagaagcagcacctaaacctgatgaacagcagtaaacaaattttactgccaattagaatcaaaacttctcctctatatgttaatgaatgaaggaagaaggttcttgttgctaatctctttgggtgctgagattttaggaattcatgtctgttatgagttctggatgtcctgggctgttttagtttgtccttccatttttaagtgttttacaaattattgcctattttcttgaggacacttaagttttattatatggaattgaaaattta

SEQ ID NO: 9704 - DNA, 1176 bp, Pisum sativum
tttttttctctctcacaatctcaatcgctttctctctctaaactccctaaaaccagatctcgctttctctctctaggtttcaacaatggcggccgctcatactcctcgggaagagaacgtctacatggctaagctcgccgagcaagccgagcgctacgaagaaatggtggagttcatggaaaaggtttccgctaacgccgatagcgaagaactcaccgtggaggagaggaatcttctctccgtggcttacaaaaacgtgatcggagctagacgtgcctcgtggcgtatcatttcgtcgatcgagcagaaggaagagagccgcggcaacgaggatcacgtcgccgtcatccgtgattaccgatctaaaatcgagtctgagctctctaacatctgcgacggtatcctcaagctcctcgatactcgtctcattccatcagcttcctctggcgattctaaggttttctaccttaagatgaagggagattaccacaggtacctcgctgagtttaagaccggagccgagcgtaaggaggctgcagagagcactcttgccgcttacaaatctgctcaggacattgcaaatgctgaattaccaccaactcatccaattaggcttggccttgctctgaacttctccgttttttactatgaaatccttaactctcctgatcgtgcctgcaatcttgcaaaacaggcttttgatgaagctattgctgaattggatacccttggagaggaatcatacaaggatagcactttgatcatgcaacttcttcgtgataatctcaccctatggacctctgacatgcaggatgatggtgctgatgaaattaaagaagcagccccaaaagcagatgaacagcagtaaacaaattcaactgccaattagaatcgaacttctcctcctctataagttaatgaatgaaggaagaaggtgcttgttgccaatctctttgggttctgagattttaggcattcatgtctgttgagttctggagtcctgggctgttttagtttgtccttccatttttaagtgttttacaaattattgcctattttattgaggacactgaagttttattatatggaattggaaatttaagattcccttctttctagtaaggattttagctttatttgtatcagtcgtgaacacttgttataatctagggtgcc

SEQ ID NO: 9705 - DNA, 1426 bp, Cajanus cajan
gcgcgcgtccaaaaataaaaaagaacccctcgaaaacgcgatcatgggtggcagaaacggaagcacaggacgacccaatcccaacctttcggttcgcccacaaataaaatagttaacaaagcccactatttcttccttcgaatcacacccacgcccctccctgcctctctctctctctctactttcccactctctctttctctctcttccgaatccagatcccgcaatggccagcgctccctccccacgcgaagagttcgtgtacatggcgaagctggcggagcaagccgagcgctacgaggagatggtcgagttcatggagaaggtctccgccgccgtcgagaacgaggagctcaccgtcgaggagaggaacctcctctccgtcgcctacaagaacgtcatcggcgccaggcgcgcctcctggcgcatcatctcctccatcgagcagaaggaggagagcagaggcaacgaggaccacgtcgccgtcatccgcgactaccgatccaagatcgaggctgagctttccaacatctgcgacggaatcctcaagctcctcgactcgcgcctcgttccctccgccgctgctggcgactccaaggtcttctacctcaagatgaagggcgactaccacaggtacctcgccgagttcaagactggcgccgaccgcaaggaggccgctgagagcacgctctccgcctacaaatctgctcaggacattgcaaataccgagctgcctccaactcaccctatcaggctgggtcttgctctgaacttctctgtgttttactatgagattcttaactctcctgaccgggcgtgcagtcttgcaaaacaggcctttgatgaggcgattgctgaattggatacactgggagaggaatcatacaaggatagcactttgatcatgcaacttcttcgtgataaccttaccctctggacctctgacatgcaggatgatggtgcagatgaaattaaagaagccgcacctaaaggtgacggggaacaaaattaaacataccatactgctaattagtcattgaacttcccttatgtgtttttaaagggtgaagatgctgattgctaatctcgatgttactgagattttaggcattcatgatcttcgttatgaattctggatgtactggggctattttagtttgtccttccatttgtacgcgtttctgaattgcctattttcttaatgacactgaaatttccattaaatatattctctttagaaaactcggcatcattattttttttttagaatgtgtagcgtgaccattgtttttatttttgtgcctcggaatcataattttaacgtgttttgcgaggtttgctttctgcctgcttttgttgattttgagcgctatttttgtgaaatgcacatggagtcgtggagaagtttatgatttctaattttcaa

SEQ ID NO: 9706 - DNA, 1219 bp, Glycine max
ccctttcgtcgttctccgtctccctcatttgttcactttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctccggcgattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttgccaaattgcctattttattaaggacgctgaagtttttattatatggaattggaattttaagattcttctcttctatctagtaaacttgatgtcacccgcttatattgtgaggattagatatatttgtattctttttgaagcctcgatatttaaatttagtttgattggaa

SEQ ID NO: 9707 - DNA, 1411 bp, Glycine max
cacagagaacagagaaagagtatcaaaaccccgtgtctgacagctgtctcttttttcttatttccaatttcaagatattaataaataaaaaaatcatcgatccaacggtccatattcaatctccaaaacgacccctcccacgcttctcaaaacgcaattatcggacgcaatagcctcaaaaccaccctttaccctttccctttcgtccttctccgtctcccctcatttgctcactttctctctctaaccagatctcgcactcgcgctttaactctctaggattcgacgacaatggcggccgctccctcgcctcgcgaagagaacgtctacatggcgaagctcgccgagcaggccgagcgctacgaagagatggtggagttcatggagaaggtctccgccgccgccgacaacgaggaacttaccgtggaggagaggaacctcctctccgtcgcctacaagaacgtgatcggagcgcgccgcgcctcgtggcgcatcatctcctcgatcgagcagaaggaggagagccgcggcaacgaggatcacgtctccgtcatccgcgactaccgatccaagatcgagtccgagctctccaacatctgcgacggtatcctcaagctcctcgactctcgcctcattccatccgcttcctccggcgattccaaggtcttctacctcaagatgaagggagattaccacagataccttgccgagttcaagaccggcgccgagcgtaaggaggctgccgagagcactctctctgcatacaaagccgcacaggacattgcgaatgccgaactgcctcctactcatccaattaggcttggccttgctcttaacttttctgtattttactacgaaatccttaattctccggatcgtgcctgcaaccttgcaaaacaggcttttgatgaagctattgctgaattggatacactgggagaggagtcatacaaggatagcactttgatcatgcaactccttcgtgataacctcacactttggacctctgacatgcaggacgatggagcagatgaaattaaagaagcagcaccgaaaccggatgaccagtaaaaatattttactgctaattagaattgaacttctcctccatatctttttgaagggagaaggtgtttgttgctaatatctctttggtactgggattttaggcattcatgtctgttatgaattgtggatgtactgggccgttttagtttgtccttccattttctcaagtgttttccaaattgcctattttattaaggacactgaagtttttattatatggaattggaattttaagattctcttctatctagtaaactttgttaccggcttttattgtgaggattagatatatttgtattctttttgaagcctcgaaatttgaatttagcttgattggaattgg

SEQ ID NO: 9708 - DNA, 1034 bp, Camellia sinensis
acgcggggaccctttttgtttcctctcccttcttcttctcagaccagatctcagccaaattcctccaatggcgacatcaaccccacgcgaagagagcgtctacatggccaaactggccgagcaagccgagcgctacgaagaaatggtggaattcatggaaaaagtctcctccaccgtcgtcgaatccgaggagctcacggtggaggagcgcaacctcctctccgtcgcctacaagaacgtgatcggcgctcgtcgtgcttcgtggcggatcatctcctcgatcgagcagaaggaggagtctcgcggcaacgccgaccatgtctccaccatcaaggactacaggtccaagattgagaacgagctctcttcgatctgcgacggcattctcaagcttctcgacaccaagttgatcccctccgccaccgccggtgactcgaaggtgttttatctgaagatgaagggtgattatcataggtatttggcggagttcaagactggttcggagaggaaggaggccgctgagaatactcttaatgcttataaggctgctcaggatatcgctaatacagagttggctccaacacatccaattcgactaggcctggctctcaacttttcggtgttttactacgaaattttgaattcacctgatcgagcatgcagtcttgcaaaacaggcctttgatgaagccattgcggagctggatacactggtggaggattcatacaaggacagcactttgataatgcaactccttcgtgataatctgactttgcggacctcagacacgcaggatgatggagcagaggagatcaaagaagcacccaagcacgaagaggagaagcagtaaactaactgattgttttcattttagtatttcacttctcttctgtttgtttttgaatggagaagttgtgtggaccctctatctatctggtgtggagcctctaggatttgatgtgattcttattgttttttaatttcggaatacgagtgtttacttttgtgatttaatgattagtgcctaaatccac

SEQ ID NO: 9709 - DNA, 1287 bp, Trigonella foenum-graecum
ggggtcttccgctccatttttttatttctctcacaacctctctcgctttctctctctaaaagagtccagatcttactttctctctctagaattcaacaatggcggccgctcattctcctcgggaagagaacgtctacatggcaaagctcgccgaacaagccgaacgctacgaagaaatggtggagttcatggaaaaagtctccgccaacgccgataacgaagaactcacggtggaggaaaggaaccttctctctgtagcctacaagaacgtcatcggagcacgacgcgcttcgtggcgtatcatttcctcgatcgaacagaaagaggagagccgcggcaacgaggaccacgtcgccgtcatccgtgactaccgatctaagatcgagtcggagctctctaacatctgtgacggtattctcaagcttcttgattctcgtctcattccttccgctgcctctggtgattccaaggttttctaccttaagatgaagggagattaccataggtatcttgctgagttcaagaccggtgccgagcgtaaggaggctgctgaaagcactcttgccgcttacaaatctgctcaggatattgcaaatgctgaattgccaccaactcatccaattaggctcggccttgctttgaacttctctgttttttactatgaaattcttaactctcctgatcgtgcctgcaaccttgcaaaacaggcttttgacgaagcaattgctgaattggatacccttggagaggaatcatacaaggatagcactttgattatgcaacttcttcgtgataacctcaccctatggacttctgacatgcaggacgatggtgcagatgaaattaaagaagcagcacctaaaccagatgaacagcagtaaacaaattttactgccaattagaatcaaacttctcctctatatgttaatgaatgaaggaagaaggtgcttgttgctaaatctctcttgagattttaggcattcatgtctgttatgagttctggatgtcctgggctgttttagtttgtccttccatttttaagtgttttacaaattattgcctattatcttgaggacactgaagttttattatatggaattgaaaatttatgattctcttctttctagtaaactggatttcgctgaatttggcgaggatattagtttttttatgggtcatgaactaatggtggtgtgtcagtcattatcacttgttatagtaatcgtgggaaaccaggtcaaacaaaaaataatcgtgacatgtcaactaactttttatttaattatt

SEQ ID NO: 9710 - DNA, 1128 bp, Ambrosia trifida
ccctatcactccaaggtttaggcttatattaagtaatagaaatggcatcaaccgaggctacgcgtgaggaaaatgtgtacatggcgaagcttgcagagcaggccgaacggtacgaagaaatggttgagtttatggaaaaggttgtgaagattgttgactctgaggagttgactgtggaggaaaggaatcttttgtctgtggcttacaagaatgtgattggagcgaggagggcgtcgtggaggatcatttcgtcgattgagcagaaggaagagagccgtgggaacgaagatcatgttaagttgattaaggattatagggcgacaatcgagactgagttgagcaaaatatgtgatggtattttggctcttttggactcgcatttggttccctctgcatcgtccgctgagtcgaagatcttttacttgaagatgaagggtgattattttagatacttggctgagtttaagactggtgctgaccggaaggaagctgccgagagtactttattagcttacaaatctgctcaagatattgctctatctgacttggctcctactcacccgatacggcttgggcttgcacttaacttctcagtgttttattatgagattctcaattcacctgaccgtgcttgcaaccttgccaaacaggcatttgatgaggctatcgctgagttggatacattaggtgaggattcatacaaggacagcacattgatcatgcaactactgcgtgacaacctcactttgtggacatctgatatcgcggatgaggctggggacgagatcaaggaatccacaaaagctgaagaaacacagtgattgatctacaagagttttgtaggaaacaattgtctctactttattattatatatctgttctgttctgaatgaggacggaatgatttatgcaatcgtcgggtgttgaagtagtttgtggcttcgtgattgttatccgcataatactttgaattggttttttgattaatcagattctggatcattgtgttctagatctgtttgatggcttctttcttgttaattcttgtaccaaataaataactaagtcatttgtaatttccaggtattgtatatctggactctgttataaacaagacaaatactcttt

SEQ ID NO: 9711 - DNA, 1129 bp, Arnica chamissonis
atcggaaagaatcacacaaacaaacgctgctgctcgccctatcaatccaggcatatactgatagaaatggcatcaaccgaagcatcacgtgaagagaatgtgtacatggccaagctggcagagcaggctgaacgatatgaagaaatggttgagtttatggaaaaggttgtaaagattgttgatgttgaggagttgaatgtggaggaaaggaaccttctttctgtggcttacaagaatgtgattggagccaggagggcatcatggaggatcatatcttctattgagcagaaggaagagagccgtgggaatgaagatcatgttaagttaatcaaggactatagggctactatcgagactgaactaagcaaaatatgtgatggtatattggcccttctggattcgcatctggttccctctgcatcctctgcagagtcaaagatcttttacttgaagatgaagggtgattacttcagatatttggctgaatttaagactggagctgagaggaaggaagctgctgagagcactttattagcttacaagtctgctcaggatattgctctatccgacttggctcctactcacccaatacggcttgggcttgcacttaacttctcggtgttttattatgagattctcaattcgcctgatcgtgcttgcaaccttgccaagcaggcttttgatgaagctatcgctgagttggatacattaggtgaggattcatacaaggacagcacattgatcatgcaactgctccgtgacaacctcactttgtggacatctgatatcgcggatgaggctggagacgagatcaaggaaccctcaaaagctgaggaaacacagtgattgatatacatgagttttgtagggaaatagtcgcgtgtactttattataggtgttctgttctgaatgagggatggaatgatttgcacaatcgtcgggtttcttaattagttgtggcttgctggttgttatctgcttaagactttaagttggtttgttttctctaatcaaattctggatcattgtgtttgggtggcttctttcctcttacttcttgtacccattaaataactagtcatttgatatatcttgactttgttataaacagatcatccttctttctgg

SEQ ID NO: 9712 - DNA, 1217 bp, Artemisia annua
atatcgcgagggtatcaacgcagtactccgacgggaagtagtggtatcaacgcagtactccgacggggaatttcgattaaatcactcaaacccttcaaacagcagccagccactaagaatcagctatatttaattattcaaaatggtgcaaagtgaagtttcccgtgaagacaatgtgtacttggccaagctagcagagcaagccgaaaggtatgaggaaatggttgagttcatggagaaggttgtcaaggcggtggatgctgaggagttgactgtggaggaaaggaaccttctttctgtcgcttacaagaatgtgattggtgcaaggagggcttcatggaggatcatctcttccatcgagcagaaggaagagagccgtggtaatgaagatcatgttaccgtaatcaaggagtacaggagtaagatcgagactgaactgagcaaaatctgtgatgggattttgggccttctcgactcgcatcttgttccctctgcttccgctgcggaatctaaagtgttttacttgaagatgaaaggtgattattaccgataccttgctgagtttaagaccggagctgagaggaaggaggctgctgagaagactttgttggcgtacaagtctgctcaggatattgctgtgacagatttggcttccactcacccaataaggctaggtcttgcactcaacttctcagtgttctattatgaaattctcaactcgcctgaccgtgcttgcaaccttgctaagcaggcatttgatgaagccatctctgagctagatactttgggtgaagattcatacaaagacagcacgttgatcatgcaacttctgagggacaaccttactttgtggacatctgatgtcgcggatgaggcaggggatgagatcaaggaagcttcaaatcctgaggagaaacagtgatacctatctatctataggatgaatgaaaatagttgtgaactacttggtggtgttttttatggttttcatttaggatgcttatattgagagtgtgatttttgcacatttcttatggttgctagaccttatggattgaaagtttttattttagtatttatagttttcttggatgaatcatgttgtatttcatgtgtttattgttttacggctttcaacgctattattacttttattcaagtagtatcatcattcagtgtctcttaactttaaccacaatgtttgacacacgacactt

SEQ ID NO: 9713 - DNA, 1096 bp, Brassica juncea
attcagttgttctctccattttccaaatttcaaaccaccactcagatccttagacgaagaacaaaggattgttgaaatcgaagatgtcatcatcatcacgtgaagagaatgtgtacatggcgaagctagcggagcaagccgagcgttacgaagagatggtggagttcatggagaaagttgccaaatccgttgacaacgaagagctcacagttgaagagaggaaccttctctccgtcgcttacaagaacgtgattggagcgaggagggcttcgtggaggatcatctcttccattgagcagaaggaagagagcaaagggaacgaggatcacgttgctatcatcaaggactacaggggcaagatcgaagctgagcttagcaagatctgcgatggaatcttgaatgttcttgaagctcatctcattccatctgcttcgcctgctgagtctaaagtgttttacttgaagatgaagggagattatcacaggtatcttgctgagtttaaggctggcaacgagaggaaagatgctgctgaaagcactttggttgcttacaagtctgctcaggacattgccactgctgagttggctcccactcacccgatcaggcttggtcttgcactcaacttctctgtgttttactatgagatccttaactcccctgaccgtgcctgcagcctcgcgaagcaggcttttgatgaagcaatcgctgagttggatacgttgggtgaggaatcatacaaggacagtacactgatcatgcagcttctcagggacaatctcactctctggacttcagacatgacagacgaagcaggagatgagataaaggagacgtcgaagccagaaggtgctgcagagtaaagctgaagactgaggaagtggttttatcaaggtataaacttcctagaaggttatgtgataattctgagtgagggatggtagctcagaactcgtaccagataacacttttattgtttgttttgtttgtttgaaaaccactttgcgaatttgcgattgattcctcctttaggttcctcgaaattttctatttttcagtgaaataaaaacctgcagtctgctctttttctaattttcgg

SEQ ID NO: 9714 - DNA, 984 bp, Brassica oleracea
ctcagatctttagacgaagaacgaaggattgttgaaatcgaagatgtcatcatcacgtgaagagaatgtgtacatggcgaaactagccgagcaagccgagcgttacgaagaaatggtcgagttcatggagaaagttgctaaatctgttgacaacgaagagctcactgttgaagagaggaaccttctctccgttgcttacaagaacgtgattggagccaggagggcttcgtggaggatcatctcttccattgagcagaaggaagagagcaaagggaacgaggatcacgttgctatcatcaaggactacaggggcaagatcgaagctgagcttagcaagatctgcgatggaatcttgaatgttcttgaagctcatctcattccatctgcttcgcctgctgagtctaaagtgttttacctgaagatgaagggagattatcacaggtatcttgctgagtttaaggctggcaacgagaggaaagatgctgctgaaagcactttggttgcgtacaagtctgctcaggacattgccactgctgagttggctcccactcacccgatcaggcttggtcttgcactcaacttctctgtgttttactacgagatccttaactcgcctgaccgtgcctgcagcctcgccaaacaggcttttgatgaagcaatcgctgagttggacacgttgggtgaggaatcgtacaaggacagtacactgatcatgcagcttctcagggacaatctcactctctggacttcggacatgacagacgaagcaggagatgagataaaggagacgtcgaagccagaaggtgctgcagagtaaagctgaagactgaggagtggttttatgaatggtataaacttcgtagaaggttatgtgataattctgagtgagagatggtagctcagaactcgtaccagttacacttttattgtttgttttgtttgtttcgtaacaatttgaaatccactgtgcgaatttgcgattga

SEQ ID NO: 9715 - DNA, 1012 bp, Brassica oleracea
cattccaaatttgaaaccactctctagcaattcgacacagatattcacaagcgaagatgtcgtcacgtgaggtgaatgtgtacatggcgaaactagccgaacaagccgagcgttacgaagagatggttgagttcatggagaaagttgctaaaaccgtcgactctgaagaactcactgtcgaggagaggaaccttctctccgttgcttacaagaacgtgatcggagcgaggagggcttcgtggaggatcatctcttccattgagcagaaggaagagagcaaagggaacgaagaacacgttgctatcatcaaggagtacagggggaagattgaaaccgagcttagcaaaatctgcgacgggatcttgaatgttcttgaagctcatctcatcccctctgcttcgcctgctgagtctaaggtgttttatctgaagatgaagggagattatcacaggtatcttgctgagtttaaggctggtgatgagaggaaagatgctgctgagagcactttggttgcttacaagtctgctcaggacattgcgactgctgagttagctccaactcacccgatcaggcttggtcttgcactcaacttctctgtgttttactatgagatccttaactcgcctgaccgtgcctgcaccctcgctaagcaggcatttgatgaagctatcgctgagctggatacattgggagaggaatcatacaaagacagtacgctgattatgcagcttctcagagacaacctcactctctggacttctgacatgactgacgaagcaggagatgagataaaggaggcatcgaagccagaaggtggtgcagcagagtaacgctgaagaagaggaagtcggtttataagggtagaaacttccttatgtgataatctgagtgagggataataagctcaggaatcagatactcttttgatttgagtttgtttattttgtttgtttgggaaacaatttgaaaactactttcgaatttgcgattgattcctcgaaatttccacaaa

SEQ ID NO: 9716 - DNA, 1416 bp, Brassica rapa
cgcgtgtctggtcgaggcctctgtcaccttcagcatccgacacttgtcagccaaccattggataactaaactcaacgcctcgaaaacagtgttattccattttccgtattatatcagattcagttgttctctccattttccaaatttcaaaccaccactcagatccttagacgaagaacaaaggattgttgaaatcgaagatgtcatcatcatcacgtgaagagaatgtgtacatggcgaagctagcggagcaagccgagcgttacgaagagatggtggagttcatggagaaagttgctaaatctgttgacaacgaagagctcacagtcgaagagaggaaccttctctccgtcgcttacaagaacgtgattggagcgaggagggcttcgtggaggatcatctcttccatcgagcagaaggaagagagcaaagggaacgaggatcacgttgctatcatcaaggactacaggggcaagatcgaagctgagcttagcaagatctgcgatggaatcttgaatgttcttgaagctcatctcattccctctgcttcgcctgctgagtctaaagtgttttacctgaagatgaagggagattatcacaggtatcttgctgagtttaaggctggcaacgagaggaaagatgctgctgaaagcactttggttgcgtacaagtctgctcaggacattgccactgctgagttggctcccactcacccgatcaggcttggtcttgcactcaacttctctgtgttttactatgagatccttaactcccctgaccgtgcctgcagcctcgccaagcaggcttttgatgaagcaatcgctgagttggacacgttgggtgaggaatcgtacaaggacagtacactgatcatgcagcttctcagggacaatctcactctctggacttcggacatgacagacgaagcaggagatgagataaaggagacgtcgaagccagaaggtgctgcagagtaaaggtgaagactgaggaagtggttttatcaaggtataaacttcctagaaggttatgtgataattctgagtgagggatggtagctcagaactcgtaccagataacacttttattgtttgttttgtttgtttgaaaaccactttgcgaatttgcgattgattcctcctttaggttcctcgaaattttctatttttcagtgaaataaaaacctgcagtctgctctttttctaattttcggttatggattttgacaagtttaaacacgtatttttcgtgagagttatgatgatattcccgattaaaagatgcctagtagttgtcaaattgatgaacttctcaaacattcctttaaccatacgcattaccgatccgccaatgattttggtcgatcgaattacaagttgtaataatttaacgaatagcatagttattgaactgatg

SEQ ID NO: 9717 - DNA, 1185 bp, Beta vulgaris
acagacaacagacaacagagaagaagagacttagagagaaaccaaaacccaaattcctgtgacgaaagatgtctccagcagaaggatcccgggatgaaaatgtctacttggccaaattggctgagcaggctgaacggtatgaggaaatggtggagttcatggagaaggttgcgaagactgttgatgttgaggagctaacagtggaggagaggaacctcctttctgtggcttacaagaatgtgattggagcaaggagagcttcttggagaattacctcttctattgaacaaaaggaagaaagccgtggtaatgacgaccatgtagctataatcaaggagtacagggggaaaattgaggcggagctcagcaagatctgccaggggatattgaaacttcttgattcacatctcatcccaacagcaactattgctgagtcaaaggtgttttatctgaagatgaagagtgactaccacagatatttggctgaattcatgactggatctgagagaaaggaatctgctgagcacaccttactggcttacaagtctgctcaggacattgcactggctgaactggctcctactcaccctataaggctggggcttgctcttaatttctctgtgttctattatgagatattgaattcccctgatcgtgcttgtgctcttgctaagcaggcttttgacgaagccatctcggagttggacactctgggtgaggaatcctacaaagacagcaccttgattatgcaacttctccgcgataatttgacattgtggacttctgacaacacggatgaggttggtgacgagattaaggaacttgcaaaggatgaatcagctcctgggcagcattgatttggtcactaggttggaagagttagatgagatatatttatttaacttggagatttgttctgttgttttaggcttttcccaaacttggtatgcttgtttgttatatgtagcgtcaattagacgctcattatatcttaccataacaccttctttaattgttattgtctagtttagttaactctttgcacttttagtgctctcgccttcatttcatcaaatgaaggcaatgtaatccaataatgtgttcgaatatatgttgctctttgttattattatctcttaactggaactatttcaggtaatcaaggaacttctactttatctgtcc

SEQ ID NO: 9718 - DNA, 1282 bp, Vaccinium corymbosum
ccccatttcctctcacctttccttctctctctaaaaccaattctctcacaatctcagatctgcacccaaagctcctccaatggcgaccccaaccccacgcgaagacaacgtctacatggccaaactggccgagcaagccgagcgctacgaggaaatggtggagttcatggaaaaggtctcctccttgaacgactcggaggaactcaccgtggaggagcgcaacctcctctccgtcgcctacaagaatgtgatcggcgcccgccgcgcttcctggcggatcatctcctcgatcgagcagaaggaggagtcgcgcggcaacgccgaccacgtggcggcgatcaaggactacagggccaagatcgagtccgagctgtcgtcgatctgcgatgggatcttgaaattacttgattcgaagctgattccgtctgctgcgtctggtgactcgaaggtgttttatctgaagatgaagggcgattatcataggtacttggcggagttcaagtctggggctgagaggaaggaagcggcggagaatacgctcaatggatataaggctgctcaggatatagctaatgcagagttggctccaacgcatccaattcggctaggattggctcttaacttctctgtgttttactatgaaattctgaattcaccagatcgagcatgcagccttgcaaaacaggcttttgatgaagccattgcagagctggatacactgggagaggattcatacaaggacagcaccttgataatgcaacttctccgtgacaatctgactttgtggacctcggacatgcaggaggacggaggagatgagatcaaagaagcacccaagcgtgacgatgagcagcagtagtggtctcatttgtttccattttagcttgcctcttctccgaagtatgtttttgaccggagaagttgcgtggtctcgctatctattcctctatgagtccctaggatttgatgccttaatttataagtacctaattttctagttccccatttttattttcaagaatcttgttgttggtctttggattatgaagttttatgttttctgcttaaaatggtgggtggcttattttgatggctgtcaacatctgatactagtggtggaatttatgcctccacaagaaccatgtttcctcccttgcttttattagtggggatgtttcttaaatcaactccgcatttgggtgttttctgttttgtacctgacagtttcttattgtttgctcacgattaatcttgcttgagttgctgtgggacagtgcttgag

SEQ ID NO: 9719 - DNA, 1022 bp, Theobroma cacao
gtcaaccgccagcgtggcaggcccaaaactccacgggaatctctgctccccaccacttgtcgcgctcccattggaccaaccctctttctctctttgacactcccaatttttttaacaaaaaaaaaaaaaaaaagcagccccctaacctcttgccctcttcactcccctataataattttccttccctttctcatttccatcaacgaatcgaaaggacaaaaaatctgcaggagaaaaaaattctcgattggatcaaatattagattgatatagtaaagatgtcgccaactgaatcatcacgagaggaaaatgtgtacatggccaagttagctgagcaggccgaacgctatgaggaaatggtggagttcatggaaaaagttgcaaaaaccgttgatgttgaggagctaactgtcgaggagcgaaaccttctctctgtggcttacaaaaatgtgatcggggctaggagggcttcatggaggatcatctcttccatcgagcagaaggaagagagcagaggaaatgaggatcatgttgcaatcatcaaggagtataggggcaagattgaagctgagctcagcaagatttgtgatggcattttgagccttcttgagtctcacctcattccttcagcctcatctgctgagtccaaggtgttttaccttaagatgaagggtgattatcacaggtatcttgctgagtttaagactggggctgagaggaaagaagctgctgagagcactttgttggcttacaagtctgcccaggatattgctcttgctgaacttgctcctactcacccaatcaggctgggacttgctcttaacttctctgtcttctactatgaaatcctcaactcacctgatcgtgcttgcaatcttgctaaacaggcttttgatgaggctatttctgagttggatacattgggtgaggaatcttacaaggatagtacattgatcatgcaacttctccgggataatctgaccctttggacatctgacatcacggtctctctctctctctct

SEQ ID NO: 9720 - DNA, 1074 bp, Brassica napus
atcagattcagtttctcttccacattccaaatttgaaaccactctctagcaattcgacacagatattcacaagcgaagatgtcgtcacgtgaggtgaatgtgtacatggcgaaactagccgaacaagccgagcgttacgaagagatggttgagttcatggagaaagttgctaaaaccgtcgactctgaagaactcactgtcgaggagaggaaccttctctccgttgcttacaagaacgtgatcggagcgaggagggcttcgtggaggatcatctcttccattgagcagaaggaagagagcaaagggaacgaagaacacgttgctatcatcaaggagtacagggggaagattgaaaccgagcttagcaaaatctgcgacgggatcttgaatgttcttgaagctcatctcatcccctctgcttcgcctgctgagtctaaggtgttttatctgaagatgaagggagattatcacaggtatcttgctgagtttaaggctggtgatgagaggaaagatgctgctgagagcactttggttgcttacaagtctgctcaggacattgcgactgctgagttagctccaactcacccgatcaggcttggtcttgcactcaacttctctgtgttttactatgagatccttaactcgcctgaccgtgcctgcaccctcgctaagcaggcatttgatgaagctatcgctgagctggatacattgggagaggaatcatacaaagacagtacgctgattatgcagcttctcagagacaacctcactctctggacttctgacatgactgacgaagcaggagatgagataaaggaggcatcgaagccagaaggcggtgcagcagagtaacgctgaagaagaggaagtcgttttataaagggtagaaacttccttatgtgataatctgagtgagggataagctcaggattcttatcagatactcttttgatttgagtttgtttattttgtttgtttgggaaacaatttgaaaactactttcgaatttgcgattgattcctcgaaatttccacaaatgatcctctagtgtgacaataataaacatgtttaatc

SEQ ID NO: 9721 - DNA, 1010 bp, Brassica napus
gattgttgaaatcgaagatgtcatcatcatcacgtgaagagaatgtgtacatggcgaagctagcggagcaagccgagcgttacgaagagatggtggagttcatggagaaagttgctaaatctgttgacaacgaagagctcacagtcgaagagaggaaccttctctccgtcgcttacaagaacgtgattggagcgaggagggcttcgtggaggatcatctcttccatcgagcagaaggaagagagcaaagggaacgaggatcacgttgctatcatcaaggactacaggggcaagatcgaagctgagcttagcaagatctgcgatggaatcttgaatgttcttgaagctcatctcattccatctgcttcgcctgctgagtctaaagtgttttacttgaagatgaagggagattatcataggtatcttgctgagtttaaggctggcaacgagaggaaagatgctgctgaaagcactttggttgcgtacaagtctgctcaggacattgccactgctgagttggctcccactcacccgatcaggcttggtcttgcactcaacttctctgtgttctactatgagatccttaactcgcctgaccgtgcctgcagcctcgccaaacaggcttttgatgaagcaatcgctgagttggacacgttgggtgaggaatcgtacaaggacagtacactgatcatgcagcttctcagggacaatctcactctctggacttcggacatgacagacgaagcaggagatgagataaaggagacgtcgaagccagaaggtgctgcagagtaaagctgaagactgaggaagtggttttatcaaggtataaacttcctagaaggttatgtgataattctgagtgagggatggtagctcagaactcgtaccagatacacttttattgtttgttttgtttgtttgaaaaccactttgcgaatttgcgattgattcctcctttaggttcctcgaaatttcctatttttcagtgaaatcaaaacatgcattctg

SEQ ID NO: 9722 - DNA, 1405 bp, Cedrus atlantica
ctaccacaggtagatcctatgcatctgaaccaagtaaagagacaaggaggtcacttccgtccagcaacggaacccaattgagtacactctagttatactgtagagattagacgaaacgcccatactgttccttctattgttgctgtgctgtctttcacagaaaatccattcacagttcttggttccgtcattttagtaggttttttcatcattgtgttcctttgttgaagatcaagaggtgaagtttggtttttaagatctgtgtagagatggccgcagcggcgatggtggagtcatcgcgggaggagaatgtgtacatggcgaagctagctgagcaggcggagcgctacgaggagatggttgagttcatggagaaggtgacaaagggcgtggaggtggaggagctgacggtggaggagcgcaaccttctctccgtggcctacaagaacgtgatcggtgcccgcagggcctcctggaggatcatctcctctatcgagcagaaagaggagagcaggggcaacgatgagcacgtggtcaccatcagggagtacagggccaaggtggaatcggagctgtccaagatctgtgagggcattctccgcctcctcgactcccatctcataccctcttcgaccgccgcagagtccaaggtcttctatctcaagatgaagggcgattaccatcgataccttgccgagtttaaaacaggggccgagaggaaggaggccgctgagaacactttgcttgcttacaagtctgcccaggatattgctgcggcagagctggctccaacacatcctattaggctagggctggctcttaacttctctgtattttactatgagattttgaattcgccagatcgggcctgcaatcttgcaaaacaggcatttgatgaggcaattgcggagttagatactttaggtgaagattcttacaaggatagcactctcatcatgcagctgcttcgtgacaatttgacgttgtggacttcagacatgcaggaggatgctggagatgagatcaaagagacttctaagcgagaagaaggggaggagcaatagtgaaatatgatgacttaatagtgtattaggattagattatcaagctttcctgcattgtttgattaaggaggcctatgtgcacgatcgtgtttattagatcccatgctctgcagcatttagtgtctgtggggagcatattcttaatcatcttttgttagccgtgcttatgttggcattttaaatcatccatactatttgcgaatggttggatacagtcgcttggtactgtaatagcagattggtggagtctagcaacaaatccataggcctattccgcttttgtgttgaataatatttttttattgccgtcacttagcttctcactgcttgtatcaatgaac

SEQ ID NO: 9723 - DNA, 1505 bp, Ceratodon purpureus
cttgtgttacagagcgtcgtagactgagagagcgttgttgctgcccttctcaccccaagtgtcgctcctctttctcttgttcccccctgtttgtcgaggccgccccgtttctgtgtttagtgtacatttgttctccagtccgcatccaaaatgacgtctgagtccagggaggagaatgtgtacatggccaagctcgccgagcaggccgagcggtacgacgagatggtggaggccatggagaaggtcgccaagaccgtcgacacggaggagctcaccgtcgaggagcgcaacctgttgtcggtagcgtttaagaacgtgattggtgccaggagggcgtcgtggcggatcatctcctccatcgagcagaaggaggagagcaagggtaacgaggaccatgtttccgccattaaggagtaccgttccaaggtggaggctgagttgagcaccatctgcgacagcatcttgaagctgttggactcgcacttgatcccgtcgtccaccaccggggagtccaaggtgttctaccttaagatgaagggagactatcacaggtacttggcagagttcaagaccggcgccgagaggaaagaggctgctgaggccacattactcgcctacaagtctgcacaagatattgccttgacggagttggcgccgacacatcccattagactgggacttgctttgaacttttccgtgttttactatgagattctgaactcaccagaccgggcctgtactctggccaagcaggctttcgatgaagcgatcgctgagttggatactttaggagaggagtcatacaaggacagcactcttatcatgcagctcctccgtgacaaccttactttgtggacatcagatatgcaggatgatattggtgaggagggaaaggactccaagattgaagatgctgatgaccattagaatctagataaatgaatctaacattgcacgcgagtgagtgaatgagactggtgttcttgattgttctgggtgatcgtagcattcgctttgtagcttcttctcacaatgaagcctactggcacgagctttattagaaaattgaccctctgaattttcatattttgtttacatcttcgctcgtcctgttggcgatgcagcaacagtcccattgatgtatcgcgtttgactttattatctctagtattcaccatctgttggtgttggttttcaagatgacaattattcgaatctttttgctctttctggattatctcccgtgccgtgatgttcaatcgtaactgtgagtatattgcattcttgatgtcctagtttttcctcagaggtgaggtagtagcactcacaactgccgctttgtctgatttctccattttcagatgttccattgaaagatggaacagttttagatgcttcatgaattcgcgaatatcatgttcataggggagagtaactaatccaattgtagaagtatcctgacccaacatatatgaatgtatatgcacttttaagttgaaatgatt

SEQ ID NO: 9724 - DNA, 1391 bp, Ceratodon purpureus
ccccgagctaagatcgtagagcagcgtcgtcgtcgtcgttgtttttgtttagttgttgttgttgttgtggtggtgcgtccaagtctagtcccggagagtgtgcttagggagcttacagggcagcctcgatgacgtccgagtcgcgggaggagaatgtgtacatggcgaagctcgccgagcaggccgagcggtacgacgagatggtggaggccatggagaaggtcgccaagacggtcgacacagaggagctcaccgtggaggagcggaacctgttgtcggttgcgtttaagaacgtgattggcgctaggagggcgtcgtggcggatcatctcctccatcgagcagaaggaggagagcaagggtaacgaggaccatgtttccgccattaaggagtaccgttccaaggtggaggctgagttgagcaccatttgcgacagcatcttgaagctgttggactcgcacttgatcccgtcgtccaccaccggggagtccaaggtcttctaccttaagatgaagggagactatcacaggtacttggcagagttcaagaccggcgccgagaggaaagaggccgccgaggctacattgctcgcgtacaagtctgcgcaagatattgcattgacagagctggcgccgacacatcccatcagattgggacttgctttgaacttctccgtgttttactatgagattctgaattcccctgaccgggcatgcactttggccaagcaggctttcgatgaagcaatcgctgagttggataccctaggagaggagtcttacaaagacagcactcttatcatgcagctcctccgtgacaaccttaccttgtggacgtcagacatgcaggatgatattggtgaggaaggcaaggactccaagattgaagatgccgacgaccactagaatttagggaaatggaaatggcactgcaggaaagtgagagaacgagatgggtgttgatatgttctttgattattctgggagactattcgctagcttatgtaggttgtttttataatgaagcctactggcacgagctttattagataatttaccctttgaattctcatattttgattacatcttctctcgtcggtgtggaagatgtaacagcagtcttgttgatgtgtcacgatagcaacctcgagctccctttaccctctgtgtggtgaaacggaggtttgctgtgacgatgtcatgcatctttcttaaaagttctctcatgatacaaaaatctcggactattatacttttgtaaaccagctttggtgtgtgcatccgacgccggggtcgatcgattgtggagtattaagtgggttgtcatttcagtgttatctgttgtaatattaccaaccttgctgatcattgtgtagtatgaataaactagtt

SEQ ID NO: 9725 - DNA, 1364 bp, Cichorium intybus
gaaaaagttaatattgaaacgtagatctaaactatttctacgtaattttcaattttgtctttatccgttgtttgaaatttgaaaaggttttgatttttgaattcccataggccatagattggaataaaaattgcacttctgacggtcagcggcaggcaaaggatggggtaaactcgtgtgtatcgcccgacttgtgtgtagccaactccgccccctaccaatacagctgtcgccatctcattggattattcctcctcgctttcacgcgtttcccatttatataaacccctcgaatccgcttctttccattctccttcgatcaaagagaatcacatcacacacccaaaaacacctagcatactcgctgccgttcgccctttcaagtttcaatccaggcatatactaattaacagaatggcatccgaagcttcacgtgaggaaaatgtgtacatggccaagctagcggaacaagccgaaaggtacgaagaaatggtggagttcatggagaaggttgcaaagacagtcgatgttgaggaactcacagttgaagaacgaaaccttctttctgttgcttacaagaacgtgattggagccaggagggcatcatggaggatcatatcttcaattgaacagaaagaagagagccgtgggaatgaagatcacgtcaagctaatcaaggactacagaagcacaatcgagactgaattaagcaagatctgtgatggcattttgagtctccttgaatcacatctcgttccatctgcttcatctgctgaatcaaagatcttttacttgaagatgaaaggtgattactacagatacttggctgaattcaaaacaggtgctgagagaaaggaagctgctgaaagcacattgttagcttacaaatctgctcaggacattgctttatctgatttggctcccactcacccaattcgtcttggacttgcacttaacttctcagtcttttattatgagatcctcaattcacctgatcgcgcttgcaaccttgccaaacaggcatttgatgaagctattgctgagttggacacattaggtgaagattcatacaaggacagcacactcatcatgcaacttctccgtgataatctcactttgtggacatcagatattgcggatgaaactggggatgaaatcaaggaatcctcaaaagctgaagaagcacagtgacatgataagaaatgggtttggtaggaaaattaatagtttgtgtactattactactcattaatgaaaaattgaaagcttgttcaagtacttagtggcttgccattgttgactcttaagacttgaagttgggagtttttttttttttttggttggtttaatcaaatgctgctgga

SEQ ID NO: 9726 - DNA, 1432 bp, Cichorium intybus
ataaccgttgattcctttgacggtcagcggcagccatagggtggagccagaaaagacgttgattcctttgacggtcagcggcggccatagggtagtgtttcgtagcaatctccgccacctgtgcacacctggcgccttttaattggtttattcctcctccggcctctaatctgcttaaataaacccgcaaacgttcctctatcattcttccccagtccccactttcgttgaacgaagaaatcacacacgtaaacgcttagattcgcactcgcaacccttcgccctatcgaccaagaatcaaaccacaaattgatcatagaaaatggtgcaaactgaagcatcgcgtgatgaaaacgtctacatggcgaagttagcagagcaagcagaaaggtacgaagaaatggttgagttcatggagaaggttgtgaagacagtggatacagaggagttaacaatggaggaaaggaatcttctctctgtagcttacaagaatgtaatcggcgctcgaagagcttcatggaggatcacatcttccattgagcaaaaggaagagagccgcgggaatgaagatcatgtcaccataatcaaaaactacaggagtaagatcgaatctgaactcagcaaaatctgtgatggcatcttgtcacttctcgattctcatctcgtcccctctgcttcatctgctgaatctaaagttttttacttgaagatgaaaggcgattactatagatacttagctgagttcaaaaccggatctgatagaaaggaagctgctgagaatactttattagcatacaaatctgctcaggatattgctttagcagatttggcttctactcatccaataaggctagggcttgcactcaatttttcagtgttttattatgaaattttaaactcgcctgaccgtgcttgcaaccttgctaaacaggcttttgatgaagcaatctctgagttggatacacttggtgaggattcatataaggacagcactttgatcatgcaacttttgcgggacaatctcactttgtggacatctgatgttggggatgaggtaggggatgagatcaaggaagcttcaaatctggaggaaaaagagtgatatttataggtctattgataatagttgtgtactatttagcggtgcgttttgggttttgattatagtgcttttatatcgaaaatgttatcaatttttgcacatttgctatggttgctagctagtaacggataaattgtaggcttgttcaagtatgttgtagttattttggaggtagaaatattcttttataaaagatgtgggttgtttgtgaaccagccaaaaactcaaaaataatgtgtatgatatgaaggactgtattgtcggtggtcaaatttcagggttgattgagcctttaacttgatataaatgggcttgggtcaagcccaaaac

SEQ ID NO: 9727 - DNA, 1306 bp, Trifolium pratense
cactctcctttttctatttctctcacaacctctttcgctttctctctctaaaaatccctaaaaccagatctcactttctctctctacgattcaacaatggcggccgctcccactcctcgggaagagaacgtttacatggctaagctagccgaacaagccgaacgctacgaagaaatggttgaattcatggagaaagtttccgccaacgccgataacgaagaactcacggtggaggaaaggaaccttctctcggtggcttataagaatgttatcggagctcgccgtgcctcatggcgtatcatttcatcgatcgagcagaaagaagagagccgcggtaacgaggatcacgtcaccgtcatccgtgactaccgatctaagatcgaatctgagctctctaacatctgtgacggtatcctcaagcttcttgattctcgtctcattccttctgcttcctctggcgattccaaggttttctacctcaagatgaagggagattatcacaggtacctcgctgagttcaagaccggagctgaacgtaaggatgctgcagaggctactctcgccgcttacaaatctgctcaggacattgcaaatgctgaattgcctccaactcatccaattaggcttggccttgctctgaatttctctgttttttactatgaaattcttaactctcctgatcgtgcttgcaaccttgcaaaacaggcttttgacgaagcaattgctgaattggatacccttggagaggaatcatacaaggatagcactttgatcatgcaacttcttcgcgataacctcaccctatggacctctgacatgcaggatgatggtgccgatgaaattaaagaagcagccccaaaaccagatgaacagcagtaaacaaattttactgccattcatgtctgttgctaatctctttgggtgctgagattttaggcattcacgtctgttatgaattctggatgtcctgggctgttttagtttgtccttccatttttaagcgttttacaaattattgcctattttcttgaggacactgaagttttattatatggaattgaaaatttaagattctctttctagtttacttgatcttgcagaatttagtgattggataataagccaacattttggcttacttgatcttgcagaatttagtgagaatgttagctttatctgttatcgacagcgtcattatcattatcatttattataattgagggatcccagtcaaaataatattaattgtgacatgataagtaactttttaatatttaattttgagaggaattaatgttggttgttt

SEQ ID NO: 9728 - DNA, 1428 bp, Cocos nucifera
ttttttctcctctccttcctccatttccactccaattcttctctctcttggcatcgagctccggcggtagtgacgacggcgatggcggcggtggcggcgacgagggaggagaacgtgtacatggcgaaactggcagagcaggcggagcgatacgaggagatggtggagttcatggagggggtcacggcggcgatggcggagggggaggagctcacggtggaggagcgcaacctcctctccgtcgcttacaagaacgtcatcggcgcccgccgggcctcgtggcgtatcgtctcgtccattgagcagaaggaggagagccgcggcaaccaggaccacgtcgccgccatccgcgattatcgggcccggatcgaggccgagctcaccaaaatctgcgacgggatccttaaccttttggattctcgcctcgtcctatccgccgccgccgtcgactccaaggtcttctacctcaagatgaagggcgactactaccgctacctagccgagttcaagaccggatccgagcgcaaggacgccgccgagagcaccctcaacgcctacaaggcggctcaggatatagcgttgccggaactggcaccgacgcatccgatccggctggggctggcgctcaacttctccgtcttctactacgagatcttgaattcgcccgacagggcttgcactctcgccaagcaggcttttgatgaagcaatttctgagctggatactcttggagaggagtcgtacaaggatagcactctaatcatgcagcttctccgtgacaacctcaccttgtggacttctgatatgcaggatgatggggcagatgatatcaaagaagcaaccaaaaatgaggatgagcagtagctgagcaaaataattctagttgtcagctgcctttggtgatttttaggtgtttcagcttgcagattgactctcatcttcagtaccaagtctgttttatttcctggcttgtgatctagaaaatcgtttattttatgtcttttcttgttggcatcttttctcctttactttctccttctttattttcttcttccaattagaaggtttgctgcagtttaagttttaatgctacaaatctgctattgagtgcttgatgttaaaagttcctgtcttatagtggatctaatggctctatttcttacgaaatggggagccttatctttgatgcttgaaaattctacggtgttcagcttttgccatattactatgttactggtattgaggtgcatgttcctgatgaatgtcaattgattggatgatggttgtccaaaacattgggtttgtcttcgcatttgtgagcttgaaatgttaatgagattgggtcttcagttatgtctaagaaagctccattcgtatgcttactctgaatatagattcatgcatcatcttatcaatatagcattcgtg

SEQ ID NO: 9729 - DNA, 1362 bp, Eucalyptus grandis
tccatttgtggtttttccgtttttttcctacgtcgctcccagcggatacgcgtcttccgccacctcatctcgccccgccgtataaattcggagtcctccctggcgcactcccctctcgcgtccgtccgcaaaacactccccccgcccgccccccccgcccgcagctcgctccgcccggctttttctcgctcgctcgctcgcgattcttgctcttccgcaaatccctagtcgagagttaggtttcgtaacagtacacggaagatgtcgccctctgattcttcacgggaggaatatgtgtacatggccaagttagctgaacaggctgagcggtacgaggagatggtggatttcatggagaaagttgccaagactgtagacgtcgaggagctaaccgttgaggaacgtaaccttttgtctgtggcgtacaagaatgtgattggggccaggagggcatcgtggaggatcatttcttccattgagcagaaggaagagagcaggggtaacactgatcatgtctcgatcattaaggactacaggggaaagatcgagtccgagctcagcaagatctgtgaaggcattctcagccttcttgagtcgcatctcattccttcagcctcctctgctgagtccaaggtgttttaccttaagatgaaaggtgattaccacaggtatctggcagagtttaagactgcgactgaaaggaaagaagctgccgagagcactttattggcctacaaatctgctcaggatattgctggggccgaactggcttctactcacccaattaggctgggacttgcgctgaacttctctgttttctactatgaaatacttaactctcctgatcgggcttgcgctcttgcaaagcaggcatttgatgaggccatcgctgagttggatacgctgggcgaggaatcatacaaggacagtacattgatcatgcaacttcttcgagataacttgactctgtggacttctgatctcacggatgaagctggggatgacattaaggaagcttcgaaactggagtctggagaggggcagcaatgatttgctaggatgatgtcagtactttaatgatattttgcaccgtcgtagatgccttgtggtttgtcacagtgaagattatttatgaactgagagtgctataagttgtttctctagtgttccttgatgagattcgggttggtctttagagtgttctaatggatattactatctcaaattgtcggttccgtgtgcgctctttcgtgctgcctagtttaaattgcacggacccgttgcatgtgattatagatttctttctttatcagttaatgctaagacagttcaaggagggcttggtccttactaagttatggc

SEQ ID NO: 9730 - DNA, 1082 bp, Flaveria ramosissima
cttcgatcaaagagaatcacacacacacacaaacgctgctactcgcactatcaatcgaggcatatactaatcaatacaatgggatcaatggaagcttcgcgtgaggaaaacgtgtacatggctaagctggcagagcaggctgaaaggtatgaagaaatggttgagtttatggaaaaggttgcaaagactgtggatgttgaggagctgagtgtggaggaaaggaatcttctttctgtggcttacaagaatgtgattggagccaggagggcgtcatggaggataatatcttccattgagcagaaagaagaaagccgtgggaatgaagaccatgttaagctaatcaaggattatagggctacaatcgagactgaactaagcaaaatctgtgatggtattctgggtcttttggaatctcatcttgttccctctgcttcatctgcagagtcgaagatcttttacttgaagatgaagggtgattactatagatacttggctgaattcaagacgggagctgataggaaggaagctgctgagaacaccttattagcttacaaatctgctcaggatattgctctatctgacttggctcctactcacccaatacgcctagggcttgcacttaacttctcagtgttttattatgagattctcaattcacctgaccgtgcttgcaaccttgctaagcaggcttttgatgaagctattgctgaattggatacattgggagaggattcatacaaggacagcactttgatcatgcaacttctccgtgacaatctcactttgtggacatctgatatcacggatgagggtggagacgagatcaaggaatcttcaaaacccgaggaaacacaatgattgatatacaacagtctgtttactacacatcagtaccttattatatgtatcctattctgaacgatatgtatcaaggacataatgtttgcaccatcattatgtgatgcttgcacttaagtagatcaaaggcttgttgaagttcttgtcgcttgcgggttgttatccccataggacttgagtttagttttttttcctcctcttaatcaaattctggatttgtaggc

SEQ ID NO: 9731 - DNA, 1222 bp, Plantago ovata
ggatctctcgctattttttttgctctctcaatctaaaaagagaataactagcgcagttctctccatctgaaccaccagacctacaggttttagcattcaaaatgtctccgtcggattcgccacgagaagagaatgtgtacatggctaagttggccgaacaggctgaaagatacgaggaaatggtagagttcatggagaaggtggccaagacttcggacaccgatgagctgactgtcgaggagaggaaccttctctccgtggcttacaagaatgtcattggtgctaggagggcttcatggagaatcatctcttctattgagcagaaggaagagagccgtgggaatgaggaccatgtgagcatcatcaaggattataggggtaagattgagactgagcttagcaagatctgtgatgggatcctgaaccttctggagactcatcttgttcctgctgcctcttcggctgagtcaaaggtgttttacttgaaaatgaagggtgattaccataggtacttggccgagtttaagactggggctgagagaaaggaagccgcagaaagcactttgttggcttacaagtctgcccaggatattgctttggctgacttggcaccaactcatcctatcaggctgggactcgcactcaatttctctgttttctactatgaaatccttaactcaccagaccgtgcttgcaatcttgcaaagcaggcatttgatgaagctatctctgagctagatacattgggcgaggagtcatacaaggatagcacactgatcatgcaacttctgagagacaatttaactctctggacctctgatacaacggacgaggttggggatgagattaaggaggccgccaaacccgtacctggggagggtcaagagtaatgaagttgaacaattgctggagcatagtgctcggcgcacatttatctttgtttccgaggtcgagtacaagatgccctatttatccaagatttggcggatgttacatatatgtagtggttctggtttgcaatatctaccccattaggttttgattgtggccgtaaaagaacgtttctgattaggacttcttgatgttcgaaatttccgcagttgtattttgcccttaatatgctatttggttgcattaagtggttgtttgcaataattttataacctgccagttgccttacagtgttgaaacatgatagtagaaaaacaaaagcacaaataat

SEQ ID NO: 9732 - DNA, 1063 bp, Platanus occidentalis
tgtttgattgtttctctttttcctctttcttcactttcgcacttataccaatcgaagccagtacagagatctcatcaatggcggccgcagcaccccgcgaggagaacgtttacatggcgaaactcgccgagcaggcggagcgatacgaagagatggtcgagttcatggaaaaggtcacggccaccgtcgaggccgaggagctcactgtggaggagcgtaacctcctctccgtcgcttacaagaacgtcatcggcgcgcgtcgcgcgtcgtggcgaatcatatcctcgatcgagcagaaggaggaaagccgcggcaacgaggaccatgtcgccatcatccgtgactaccgatctaagatcgagtcggagctctcctcgatctgtgatggtattttgcgtctccttgactcgaggctcatcccttcgtcctccgctggtgactctaaggtcttttatctgaaaatgaagggcgattatcatcgctatctcgccgagtttaagtccggcgccgaccgcaaagaggcggccgagaacacccttgctgcttataaatcggcgcaggatattgcagttgcagaactagctccaacgcatccaatccggctggggttggctcttaacttctctgtgttttactacgagatcttgaattctcctgatcgagcctgtactcttgcgaaacaggcatttgatgaagcaattgcagagctggataccttaggagaggaatcatacaaggatagcactttgatcatgcagcttcttcgtgataaccttactttgtggacctctgacatgcaggatgatggcgctgatgagatcaaagaagcacccaagcccaatgatgaacagcagtgatgttatttagttttagattttgggttctcttctccttaatttgtctaacaggagaaaggtgcttggttccagctatatgagtttcttgtttcttctttgacttttccgacctttaagatactgttttttctcagtttgtattttatcattatgtgttctaattgtcttctaactttgaagggtttgaagtttctgttttcgttgag

SEQ ID NO: 9733 - DNA, 1298 bp, Pseudotsuga menziesii
ctgcccttcattgtctcgctgtgctggtctcacagaaaatccattcacagttcttggtttcgccattttagtgtgttttttgttcattttagtggccgtttgttgaagatccagaggtgaagttgggtgattaagatctgtgcagagatggcggcagcggcgatggtggagtcatcgcgggaggagaatgtatacatggcgaagctggctgagcaggcggagcgctacgaggagatggtggagttcatggagaaggtaaccaaaggcgtggaggtggaggagctcacagtggaggagcgcaacctgctctccgtggcctacaagaatgtgatcggtgctcgtagggcctcctggaggatcatctcctccatcgagcagaaggaggagagcaggggcaacgatgagcacgttgttaccatcagggagtacaggtctaaggtggaatccgagctctccaagatctgtgagggcattctccgcctgctggactcccatctcatcccctcctccaccgctgcggagtccaaggtcttctatctcaagatgaagggcgattaccatcgataccttgcggagtttaaaacaggcgccgagaggaaggaggctgccgaaaacactttgcttgcttacaagtctgcccaggatattgctgcggcagagctggctccaactcatccaattagactagggctggctcttaacttctctgtattttactatgagattttgaattcgccagatagagcctgtaatcttgcaaaacaggcatttgatgaggcaattgcggagttagatactttaggtgaagattcctacaaggacagcactctgattatgcagctgcttcgtgacaatctgacattgtggacttcagacatgcaggaggatgctggggatgagatcaaagagacttctaagcgtgaagaaggggaggagcaatagtgaaataggatgacctgttagtgtattagggatagattattgggctttccttcattgtttggaaaaggatgcctatgtgcatgattgtgtttattagatctcattctctgcagcatttagttgctgcggtgagcatattcttaaatcatcttttgttagctgcgcttatgttggcattttaaatcatccatactgtttgcgaatggttggatacagtggcttggtactgtaatagcggattggtggagtctatcaactaatctgtagccccattctgcttttgtgttaaataatattttttattgccttcatttagcttctcattgcttgtatcaatgaactatttttcaatttat

SEQ ID NO: 9734 - DNA, 1069 bp, Raphanus sativus
gggatatcagattcagtttctctctcgccattccaaatttcaaaccaccactcagatctttagacgaagaacaaaggattcaaaagatgacatcatcatcacgggaagagaatgtgtacatggcgaaactagcggagcaggcggagcgttacgaagaaatggtggagttcatggagaaagtagccaaatccgttgacaacgaagaactcaccgtcgaagagaggaaccttctctcggtcgcttacaagaacgtgatcggagccaggagggcgtcgtggaggatcatctcttccatcgagcagaaggaagagagcaaagggaacgaggatcacgtcgctatcatcaaggactacagggggaagatcgaagccgagcttagcaaaatctgcgacgggattttgaatgtcctcgaagctcatctcatcccgtctgcttcgcctcctgagtctaaagtgttttacctcaagatgaagggagattatcacaggtaccttgctgagttcaaggctggcgacgagaggaaagatgctgctgaaagcactttggtttcttacaagtctgctcaggacattgccactgctgagttggctcccactcaccccatcaggcttggtcttgcactcaacttctctgtgttttactatgagatacttaactcccctgaccgtgcctgcagcctcgccaagcaggcttttgatgaagcaattgctgagttggatacgttgggtgaggaatcatacaaggacagtacactgatcatgcagcttcttagagacaatctcactctctggacttcagacatgacagacgaagcaggagatgagataaaggagacatcaaagccagaaggtgcagcagagtaatgctgaagactaggaactggttttatgaaggtagaaagaaacttcctagaaggttatgtgataattctgagtgatagctcagaactcgtaccagacacacttttattgtttgttttgtttgtttggataccaaatttgaaaaccactttgcgaatttgcgattgattccctataaatttcctatttttcagtgaaatttcggttct

SEQ ID NO: 9735 - DNA, 1391 bp, Secale cereale
ggattattaaggacgtcaaatttggcaaagccgtatggaccatgctcctccctattcctatcccccctccccacgaacccacagcgcgcacccgagatccgcagccgaagcccgtgagaacagcgcagcgcgagaggaaaggtactgaactagtttgtaacaaagaagagggaaaatgtctaccgctgaggcaacccgtgaggagaatgtgtacatggccaagctcgctgagcaggctgagcgttacgaggaaatggtcgaattcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtggtaacgaggcttatgtcgcttcaatcaaggagtaccgtaccaggattgaaaccgagctcagcaagatctgtgatggcatcctcaagctcctggactcccaccttgtcccctctgccactgcagcagagtccaaggtgttctatctgaaaatgaagggtgactaccacaggtaccttgctgagttcaaggcgggtgctgagaggaaagaagcagctgagaacactcttgttgcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggatagcaccttgatcatgcaacttcttcgtgacaacttgactctctggacctccgataacgcagaggaggggcggtgatgagatcaaggaagccgcctccaaagacctgagggagaggggcgactgattggctggccctccgagcgtgcccaacgttatttctggagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttggcgtcaagcaccccaaaagcttgcctttcttatgaggcaacatctgagtttttcttgtctacttccttctcaaaatattgagttctaggctcctaaaagttatatcagcatctacaaaa

SEQ ID NO: 9736 - DNA, 1106 bp, Helianthus annuus
cctccgatcattcagaatccgccctatcaatcgaggtatatattaagtaatagaaatggcatcaaccgaagcttcacgtgaggacaatgtgtacatggccaagctggcagagcaggccgaacgatacgaagaaatggtcgagtttatggaaaaggtcgtgaagatcgttgactccgaggagttgaccgtggaggaaaggaatcttctttctgtggcttacaagaacgtgatcggagccaggagggcatcatggaggatcatatcttctatcgagcagaaggaagagagccgtgggaacgaagatcatgtcaagctaattaaggattatagggcgacaatcgagaccgaactaagcaaaatttgtgacggcattttggctcttctggactcacatttggttccatctgcatcaactgcagagtcaaagatcttttacttgaagatgaagggtgattactttagatacttggctgagtttaagactggtgctgataggaaggaagctgctgagagcactttattagcttacaaatctgctcaggatattgctctatctgacttggctcctactcacccgatacggcttgggcttgcacttaacttctcagtgttttattatgagatcctcaattcacctgaccgtgcttgcaaccttgccaaacaggcatttgatgaagctattgctgagctggatacattaggtgaggattcatacaaggacagcacactgatcatgcaactactccgtgacaatctcactttgtggacatctgatattgcggatgaggctggtgacgagatcaaggaatctgcaaaagcagaggaaacacaatgattggtctacatgagttttttaggaagcaattgtgtgtactttattattatagctgttctgttctgaatgaggacggaatgatttgcacaatcgtcgggttttcaagtagttgtggcttcctgattgttatctgcgtaaaactttgaattcgttttttcagttaatcagattctggatcattgtgtttctagagctgtttggtggcttctttcttttaaaatctttgtacttgataaataactggtcatttgaatttccaggaactaaacaa

SEQ ID NO: 9737 - DNA, 950 bp, Helianthus annuus
caaaaatggtgcaaccgaagcgtctcgtgaagaaaacgtgtacatggctaaactagcagagcaagccgaaaggtacgaagaaatggtggagttcatggagaaggtagtgaagatcgtggattccgaagagttgacagtggaggaaagaaatcttctttccgtagcttacaagaacgtaatcggtgctaggagagcttcatggaggatcatttcctccatcgaacagaaagaagaaagccgtgggaacgaagatcacgttaccacaatcaagagctacaggggtaagatcgagaccgaattgagcaagatctgtgacggcatcttggctcttctcgagtctcatcttattccctcagcgtcgtctgctgagtctaaggttttttacttgaagatgaaaggtgattattacagatacttagctgagtttaagacgggagccgaaaggaaagaggctgctgagaatactttattaggatacaaatctgctcaggatattgctttagctgatttggctcccacccatccgatacggttgggtcttgcactcaacttctcggtgttctattatgaaattctcaactcacctgaccgtgcttgcagtcttgctaagcaggcatttgatgaagccatctctgagttagacacacttggtgaggattcatacaaagatagcacgttgatcatgcaacttctgcgggataacctcactttgtggacgtctgatgttgcggacgagacaggggacgagatcaaggaaacttcaaatcccgaggaaaaacagtgatatttataagtgaaatgacaatagttgttggtttttagattttcatttagggttgctgcttgctggtttctcatagattgtaagcttgttggagttttggcatttggttgtgtcatgtttttgttaattgcaactttagatgtttcaagttgaaagctctaaaact

SEQ ID NO: 9738 - DNA, 1077 bp, Tripterygium wilfordii
atctctctctctctgtctttcaatcgttgactctttacatttcagcaatggcggtgacaccttcacctcgcgaggagaacgtgtacatggctaagctggcggagcaggccgagcgctacgaagagatggttgagttcatggagaagttatcggcatcggtcgacaacgaggagctcaccgttgaggagaggaatctcctctctgtggcttacaagaacgtgatcggtgctcgtagggcttcctggcgcatcatctcctccatcgagcagaaggaggagagcaggggcaacgaggatcatgtttctacgatccgagactacagatccaagatcgagaatgagctctcgaatatttgtgatggcatactaaagctccttgataccaggctcatcccatctgcctctgcaggtgactccaaggtcttctatctcaaaatgaagggggactaccaccggtacctcgctgagttcaagactggagccgagcgcaaggaagccgccgagagcaccctcactgcctacaaagctgctcaggatattgcaaatgcagaattggccccaactcacccgatccgtttgggactggctctgaacttttctgtcttctactatgagattctgaattctcctgaccgtgcctgcaatcttgccaagcaggcttttgacgaagctattgccgagttggataccttgggcgaggagtcgtacaaggatagcactctgatcatgcagcttctgcgtgacaatctcaccctctggacctctgatatgcaggatgatggagctgatgagattaaagaagcacccaagcgcgatgatgaccagcagtgatgcaaactcaatcaactgcaaattagggacttctccataatatgtttttaatgggagaaggtgattgtttgctgatttatctactatttttagtcaattcttgttttgttatgaatcaatggatgtactgagcttttcttttagtttgttttatccattgatgtgtttctgaatgaagcctttcttcttgatgatacccaagctgttgcattgacgttggatttctctcatccagttaggatgctct

SEQ ID NO: 9739 - DNA, 1112 bp, Tripterygium wilfordii
cgcagtccaggagttttgtctccctcagatctaatctctctcaatctgtcgctcaatctttgactcttcacatttcagcaatggcggtgacaccttcaccacgcgaggagagcgtgtacatggctaagctggcggagcaggccgagcgctacgaagagatggttgaattcatggagaaggtatccgcgtcggtcgacaacgaggagctgactgttgaggagaggaatctcctctccgtggcttacaagaatgtgatcggtgctcgtagggcttcctggcgcatcatctcctccattgagcagaaggaggagagcaggggcaacgaggaccatgtctctacgatccgagactacagatccaagatcgagaatgagctctccaacatctgtgatggcatactcaagctccttgacaccaggctcatcccatccgcctctgcgggtgactccaaggtcttctatctgaaaatgaagggagactaccacaggtacctcgctgagttcaagactggagccgagcgcaaggaagccgccgagagcaccctcactgcctacaaagctgctcaggatattgcaaatgcagaactggctccaactcacccgatccgtttgggactggctctgaacttttctgtcttctactatgagattctaaattctcctgaccgagcctgcaaccttgccaagcaggcttttgacgaagctattgctgagttggataccttgggcgaggagtcatacaaggatagcactttgatcatgcagcttctgcgtgacaatctcaccctctggacctctgatatgcaggatgacggagctgatgagattaaagaagcacccaagcctgacgaagacaagcagtgatgcaactcaatcaactgcaagttagggacttctccttgatatgttttaatgggagaaggtgcttgttttctgatttatctaccatttctagccattcttgtttggttatgaatcagtggatgtattgagcttttcttcttgtagtttgttgtttgaacaatttgtgtgtttctgaatgaagcctttctcatcgatgatatccatgctgttgcactggtgtcgaatttctctgatgctactttacctttt

SEQ ID NO: 9740 - DNA, 1310 bp, Abies balsamea
cagcattgccctcattgtcttcctgtgctgttttcacagaaaatcctttcacagttcttggttccgccattttagtggccttttttcattttagtggctgtttgttgaggaacaagaggtgaagttgggtgtttaagatctgtgcagagatggcggcagctgcgatggtggagtcatcgcgtgaggagaatgtgtacatggcgaagctggctgagcaggcggagcgctacgaggagatggtggagttcatggagaaggtgaccaaaggcgtggaagtggaggagctcactgtggaggagcgcaatctgctctccgtggcctacaagaacgtgatcggtgcccgcagggcctcctggaggatcatctcctccatcgagcagaaggaggagagcaggggcaacgatgagcatgtggtcaccatcagggagtacagggccaaggtggagtcggagctctccaagatctgtgagggcattctccgcctcctcgactcccatctcatccccgcttccaccgctgcggagtccaaggtcttctatctcaagatgaagggcgactaccatcgataccttgccgagtttaaaacaggcgccgagaggaaggaggctgccgagaacactttgctcgcttacaaatctgcccaggatattgctgctgcagagttggctccaacccatcctataaggctagggctggctcttaacttctctgtattttactatgagattttgaattcgccagatcgagcctgtaatcttgcaaaacaggcattcgatgaggcaattgcagagttagatactttaggtgaagattcttacaaggatagcactctcatcatgcagctacttcgtgacaatttgacattgtggacttcagacatgcaggaggatgccggggatgagatcaaagagacgtctaagcgtgaagaaggggaggagcaatagtgaaatatgatgacctattagtgtattagtgtattaggattagattatcaagcttccctgcattgtttgattaaggaggcctatgtgcacgattgtgtttattagatctcatgctctcagtatttagtttctgtggggagcatattcttaatcatcttttgttagctgcgattatgttggcattttaaatgatccatcctatttgcgaatggttggatacagtggcttggtagtgtaatagcagattggtggagtctagcaacaaatctgtaggcccattccgcttttgtgttgaataatattttttattgccgtcatttagcttctcactgcttgtatcaatgaacaattttttcaagttatccg

SEQ ID NO: 9741 - DNA, 1151 bp, Ambrosia trifida
aggtttaggcatataataagtaatagaaatggcatcaactgaagctacgcgtgatgaaaatgtgtacatggcgaagctggcggagcaggccgagcggtacgaagaaatggttgagtttatggaaaaggttgtgaagattgttgactctgaggagttgacggtggaggaaaggaatcttttgtctgtggcttacaagaatgtgattggagcgaggagggcgtcgtggaggatcatttcgtcgattgagcagaaggaagagagccgtgggaatgaagatcatgttaagttgattaaggattatagagcgacaatcgagactgagttaagtaaaatatgtgatgggattttggctcttttggactcgcatttggttccctctgcatcgtctgctgagtcgaagatcttttatttgaagatgaagggtgattactttaggtacttggctgagtttaagactggcgctgataggaaggaagctgccgagagtactttattagcttacaaatctgctcaagatattgctctatctgacttggctcctactcacccgatacggcttgggcttgcacttaacttctcagtgttttattatgagattctcaattcgcctgaccgtgcttgcaaccttgccaaacaggcatttgatgaggctatcgctgagttggatacattaggtgaggattcatacaaggacagcacattgatcatgcaactactccgtgacaacctcactttgtggacatctgatatcgcggatgaggctggggacgagatcaaggaatccacaaaagctgaagaaacacagtgattgatctacaagagttttgtaggaaacaattgtctctactttattattatatatctgttctgttctgaatgaggacggaatgatttatgcaatcgtcgggtgttgaagtagtttgtggcttcgtgattgttatccgcataatactttgaattggttttttgattaatcagattctggatcattgtgtttctagatctgtttgatggcttctttcttgttaattattgtaccaaataaataactagtcatttgaatttccaggtattatatatctgcactgttataaacagacaaatctctttctaaaaatttcatacattgttgtgctttcttgaaaaaagaa

SEQ ID NO: 9742 - DNA, 1305 bp, Brassica rapa
atttagtcggcccattcccatttatcagcaaatggatgttagcacctagcagcatgaaaggacacgtggctggtggagagaagaagtcgtcttcagcatcggacacctgtcaaactttcagtggatctcttaactaagttttataccactttcgcattgcatcagattcagtttctcttccacattccaaatttgaaaccactctctagcaattccacacaaggtaagcgaagatgtcgtcacgtgaagagaatgtgtacatggcgaaactagcggaacaagcggagcgttacgaagagatggttgagttcatggagaaagttgctaagaccgttgactctgaagaactcactgtcgaggagaggaaccttctctccgttgcttacaagaacgtgatcggggcgaggagggcttcgtggaggatcatctcttccatcgagcagaaggaagagagcaaagggaacgaggagcacgttgctatcatcaaggagtacagggggaagatcgaaaccgagcttagcaaaatctgcgacgggatcttgaatgttcttgaagctcatctcatcccctctgcttcgcctgctgagtctaaggtgttttatctgaagatgaagggagattatcacaggtaccttgctgagtttaaggctggtgatgagaggaaagagactgctgagagcactttggttgcttacaagtctgctcaggacattgcgactgctgagttagctccaactcaccctatcaggcttggtcttgcgctcaacttctctgtgttttactatgagatccttaactcgcctgaccgtgcctgcaccctcgctaagcaggcatttgatgaagctatcgctgagttggatacattgggagaagaatcatacaaagacagtactttgattatgcagcttctcagagacaacctcactctctggacttctgatatgactgacgaagccggagatgagataaaggaggcgtcgaagccagagggtggtgcagcagagtaacgctgaagaagaggaagtcggtttataagggtagaaacttccttatgtgataatctgagtgagggataataagctcaggaatcagatactcttttgatttgagtttgtttattttgtttgtttgggaaacaatgtgaaaactactttccaatttgcgattgattccttgaaatttccacacatgatcctctagcgtgacaataataacacgtttaaacacgtgctttaaattttttaaattgattagtctttcaaaatttccaacaagtacttttgctttagtaaatgtagttttttg

SEQ ID NO: 9743 - DNA, 1390 bp, Chrysanthemum coronarium
atagggtgtatcgccctttaatatacaactccgccccctaggcaataacacgtgtcacaatcctattcgtccatgaccctctcattcacgcgtctcccatttatttaaacccttagaatccgcttccattcatttctcctccgatcaaaacagaatctctcacacacacaaaacccccttccttttcacacactcaggtaactaattattagaatggcaactgaagcttcacgtgaggagaatgtgtacatggccaagctcgcagagcaggccgagaggtacgaagagatggttgagtttatggagaaggttgccaagactgttgacgttgaggagttgacagttgaagaaaggaatcttctttccgtggcttacaagaacgtgattggagctaggagggcttcgtggaggatcatttcttccattgagcagaaggaagagagccgtggcaatgaggaccatgttaagctgatcaaagattacaggagtaccatcgagactgaactaagcaagatctgtgatggtattttgggacttcttgagtcgcatcttgttccatctgcttcgtctgctgagtcgaagatcttctacttgaagatgaagggtgattactttaggtacttggctgagttcaagaccggatctgacaggaaggaagctgctgagagcactttgttggcttacaaatctgctcaggatatcgccctctctgacttggctcccactcaccccatcaggcttggacttgcacttaacttctcagtgttttattatgagatccttaactcacctgaccgtgcttgcaaccttgccaagcaggcttttgatgaagctatcgctgagttggatacgttaggtgaggactcatacaaggacagcacactcatcatgcaacttctccgtgacaacctcactttgtggacatctgatatcgcggatgaagctggcgatgagatcaaggaatcttcaaagcccgaggaaacacagtgatttaatttggtttcgtaggaatatagtttgtgcactactcattggtactttatagatcttctattcagatggcgtgtatctgggactaaatggtgcctatggttgaaagcttgttcaagtacttgtggcttgcctatggttgtgcttagaacttgagttggttcttccttttaaattaattctggatttttaggcactcttttgtgtctgtctcattatatgctcttattattgtgtttcggaagctgtttgggtggcttctttcctttgattgttcgtgacccatattttgttttacattcgaggttgtcactctaaagaatgttatgcttttgtacccaataaataacgactgatttaaattttcctgctattatatcttatctgattttttgttgtg

SEQ ID NO: 9744 - DNA, 1090 bp, Flaveria ramosissima
ttctccttcgatcaaatagaatcgcacacacaaccgctgctgttcgctctatcaatcaaggcactactagggaataggaatggcatcaactgaagcttcacgtgaggaaaatgtgtacatggccaagctggcagagcaggccgaaagatacgaagaaatggttgagttcatggaaaaggttgtaaagattgttgacactgaggagttgactgtcgaggaaaggaatcttctttctgtggcttacaagaatgtgattggggccaggagggcatcatggaggatcatatcttccattgagcagaaggaagagagccgtgggaatgaagatcatgttaagctaatcaaggattatcgtgctacaatcgagagcgaactaagcaaaatatgcgatggtattttgggtcttttggattctcatctggttccctctgcatcctctgcagagtcgaagatcttctatttgaagatgaagggtgattactttagatacttggctgaatttaagactggagctgataggaaggaagctgctgagagcactttattagcttacaaatctgctcaggatattgctctatctgacttggctcctactcacccaatacggctagggcttgcacttaacttctccgtgttttattatgaaattctcaattcacctgaccgtgcttgcaaccttgctaagcaggcttttgatgaagctattgctgagttggatacattgggagaggattcatacaaggacagcactttgatcatgcaacttctccgtgacaatctcactttgtggacatctgatatcgcggatgagggtggagacgagatcaaggaatcttcaaaacctgaggaaacacaatgattgatacataacaatctgtttactacatatcaataccttattatatgtatcctattctgaacgacatgttcaaggacataatgtttgcaccatcattatgtgatgcttgcacttaagtagatcaaaggcttgttgaagttcttgtcgcttgcgggttgttatccccataggacttgtagttagttttttttcctcgttcttaatctaaattctgatttgtaggcactcttt

SEQ ID NO: 9745 - DNA, 1155 bp, Platanus occidentalis
caatcgcagctgaagtacagagatcagatcccctaaatcgaagttcctagctaagagatctcatcaatggcggccgcagctatctcaccgcgcgaggagaacgtttacatggcgaagctcgccgagcaggcggagcgatacgaggagatggttgagttcatggagaaggtcacggccgccgtcgaggccgaggagctcaccgtcgaggagcggaacctcctctccgtggcttacaagaacgttatcggtgcgcgccgcgcttcctggcgcatcatttcctcgatcgagcagaaggaggagagccgcggcaacgaggaccacgtcgcgacgatccgtgactacagatctaagattgagtcggagctctcgtcgatctgtgatggtattctgcgtctccttgattcgagactcatcccctcggcctcctctggtgactccaaagtcttttatttgaagatgaagggcgattatcatcgctaccttgccgagtttaagaccggcgcggagcgcaaagaggcggctgagagcaccctcgccgcatataaatcggctcaggatattgcaactgcggaactggctccaacgcatccaatccggctggggctggctcttaacttctctgtgttttactacgagatcctgaattctcctgatcgagcttgtaatcttgcgaaacaggcatttgatgaagcaattgcggagctggataccttaggcgaggagtcatacaaggatagcactttaataatgcagcttctccgtgataacctcaccttgtggacctctgacatgcaggatgatggtgctgatgagatcaaagaagcacccaagcacgaggatgaacaacagtgaagtatctcattttcatatttggggctctcttctccttcaaatgtttttcaacaggagaaggtgcttaatgtctgcaattatgaatttttagttattatcttgatttctctgacctttgttgaggtactgagatttgttagttcgtgtttttatctatatgtgtttcttattgttttttatcttgaagttgaagtttatatttgtgttgagcatgtccgaaccttgttatccatagttagttggatgacatccttttttttaaatgggaatttgtgatgtatcaaaaccaggtttttttagatt

SEQ ID NO: 9746 - DNA, 1302 bp, Picea glauca
aagccctcttcctgcactgcccttcattgtctcgctgtgcttctttcacagaaaatccattcacagttcacagtccttggtttggtttcgccattttagtgtatttcttcattttagtggccgtttgttgaagatccagaggtaaagttgggcgtttaagatctgtgcagagatggcggcagcggcgatggtggagtcatcgcgggaggagaatgtatacatggcgaagctggctgagcaggcggagcgctacgaggagatggtggagttcatggagaaagttaccaaaggcgtggaggtggaggagctcacagtcgaggagcgcaaccttctctctgtggcctacaagaacgtgatcggtgcccgccgggcctcctggaggatcatttcctccattgagcagaaggaggagagcaggggcaacgacgaacacgtggtcaccatccgggagtacaggtccaaggtggaatcggagctttccaagatctgcgagggcattctccgcctcctcgactcccatctcatcccttcttccaccgccgcggagtccaaggtcttctatctcaagatgaagggcgattaccatcgataccttgccgagtttaaaacaggcgccgagaggaaggaggccgctgagaacactttgcttgcttacaagtctgcccaggatattgctgcggcagagttggctccaacgcatcctattaggctagggctggctcttaacttctctgtattttactatgagattttgaattcgccagatagagcctgtaatcttgcaaaacaggcatttgatgaggcaattgcggaattagatactttaggtgaagattcttacaaggatagcactctcatcatgcagctgcttcgtgacaatttgacattgtggacctcagacatgcaggaggatgctggggatgagatcaaagagacttctaagcgtgatgaaggagaggagcaatagtgaaatatgatgatctattagtatattaggattagattagcaggctatcctgcattgtttggtaaaggaggctatgtgcacgattgtgtttattagatctcatgctctgcagtatttagttgctgtgggtagcatattcttaatcatcttttgttagctgcgcttatgttggcattttaaatgatccatactatttgcgaatggttggagacagtggcttggtactgtaatagcagattggtggagtctatcaacaaatctgtaggcccattctgcctttgtgttgaataatattttttattgccttgatttagcttctcactgcttgtatcaat

SEQ ID NO: 9747 - DNA, 1373 bp, Picea glauca
gccctcttcctgcactgcctttcattgtctcgctgtgcttctttcacagaaaatccattcacagttcacagtccttggtttggtttcgccattttagtgtatttcttcattttagtggccgtttgttgaagatccagaggtaaagttgggcgtttaagatctgtgcagagatggcggcagcggcgatggtggagtcatcgcgggaggagaatgtatacatggcgaagctggctgagcaggcggagcgctacgaggagatggtggagttcatggagaaagttaccaaaggcgtggaggtggaggagctcacagtcgaggagcgcaaccttctctctgtggcctacaagaacgtgattggtgcccgccgggcctcctggaggatcatttcctccattgagcagaaggaggagagcaggggcaacgacgaacacgtggtcaccatccgggagtacaggtccaaggtggaatcggagctttccaagatctgcgagggcattctccgcctcctcgactcccatctcatcccttcttccaccgccgcggagtccaaggtcttctatctcaagatgaagggcgattaccatcgataccttgccgagtttaaaacaggcgccgagaggaaggaggccgctgagaacactttgcttgcttacaagtctgcccaggatattgctgcggcagagttggctccaacgcatcctattaggctaggactggctcttaacttctctgtattttactatgagattttgaattcgccagatagagcctgtaatcttgcaaaacaggcatttgatgaggcaattgcggaattagatactttaggtgaagattcttacaaggatagcactctcatcatgcagctgcttcgtgacaatttgacattgtggacctcagacatgcaggaggatgctggggatgagatcaaagagacttctaagcgtgatgaaggagaggagcaatagtgaaatatgataatctattagtatattaggattagattagcaggctatcctgcattgtttggtaaaggaggctatgtgcacgattgtgtttattagatctcatgctctgcagtatttagttgctgtgggtagcatattcttaatcatcttttgttagctgcgcttatgttggcattttaaatgatccatactatttgcgaatggttggagacagtggcttggtactgtaatagcagattggtggagtctatcaacaaatctgtaggcccattctgcctttgtgttgaataatattttttattgccttgatttagcttctcactgcttgtatcaatgaacattttttttcaatttatcccggaaagaactccatttttgttctcaccgttaaataattataggtatcat

SEQ ID NO: 9748 - DNA, 1290 bp, Picea glauca
aaagccctcttcctgcactgcccttaattgtctcgctgtgcttctttcacagaaaatccattcacagttcacagtccttggtttggtttcgccattttagtgtatttcttcattttagtggccgtttgttgaagatccagaggtaaagttgggcgtttaagatctgtgcagagatggcggcagcggcgatggtggagtcatcgcgggaggagaatgtatacatggcgaagctggctgagcaggcggagcgctacgaggagatggtggagttcatggagaaagttaccaaaggcgtggaggtggaggagctcacagtcgaggagcgcaaccttctctctgtggcctacaagaacgtgattggtgcccgccgggcctcctggaggatcatttcctccattgagcagaaggaggagagcaggggcaacgacgaacacgtggtcaccatccgggagtacaggtccaaggtggaatcggagctttccaagatctgcgagggcattctccgcctcctcgactcccatctcatcccttcttccaccgccgcggagtccaaggtcttctatctcaagatgaagggcgattaccatcgataccttgccgagtttaaaacaggcgccgagaggaaggaggccgctgagaacactttgcttgcttacaagtctgcccaggatattgctgcggcagagttggctccaacgcatcctattaggctagggctggctcttaacttctctgtattttactatgagattttgaattcgccagatagagcctgtaatcttgcaaaacaggcatttgatgaggcaattgcggaattagatactttaggtgaagattcttacaaggatagcactctcatcatgcagctgcttcgtgacaatttgacattgtggacctcagacatgcaggaggatgctggggatgagatcaaagagacttctaagcgtgatgaaggagaggagcaatagtgaaatatgatgatctattagtatattaggattagattagcaggctatcctgcattgtttggtaaaggaggctatgtgcacgattgtgtttattagatctcatgctctgcagtatttagttgctgtgggtagcatattcttaatcatcttttgttagctgcgcttatgttggcattttaaatgatccatactatttgcgaatggttggagacagtggcttggtactgtaatagcagattggtggagtctatcaacaaatctgtaggcccattctgcctttgtgttgaataatattttttattgccttgatttagcttctcac

SEQ ID NO: 9749 - DNA, 1079 bp, Helianthus annuus
cttctcgccctatcaatcgaggcatatactaatcaataatggtatcatcaaccgaagcttcccgcgaggaaaatgtgtacatggccaaactggcagagcaggccgaaaggtatgaagaaatggtcgagtttatggaaaaggttgcaaagactgtggacgtcgaggagttgaccgtggaggaaaggaatcttctgtctgtagcttacaagaatgtgatcggcgccaggagggcatcatggaggataatatcttccatcgagcagaaagaagagagccgtgggaatgaagatcatgttaaactaattaaggattacagggctacaatcgagactgaactaagcaaaatctgtgacggtattctgggccttctggaatcttatcttgtcccctctgcttcgtctgcagagtcaaagatcttttacttgaagatgaagggtgattattatagatacttggcggaattcaagactggagctgataggaaagaagctgctgagagcactttgttagcttacaaatccgctcaggatatcgctctatctgatttggctcctactcacccgatacggctagggctcgcacttaacttctcagtgttttattatgagattctcaattcacctgaccgtgcttgcaaccttgccaagcaggcctttgatgaagctattgctgagttggatacattgggagaggattcatacaaggacagcacattgatcatgcaacttctccgtgacaacctcactttgtggacatctgatatcgcggatgaagctggagacgagatcaaggaatcctcaaaaccagacgaaacacaatgattgatatattatgaggtttgtaggaaaaagagtctgtttactacatatcagtaccttattttaagtatcctattctgaatgacgtgtatcaaggacataatgtttgcccaatcaccgggtgctagcacccagtagttcaaaagcttgttcaagtacttgtggcttgccggtttttatccgcttaggatttgagttagtttttttattcaaattccagattcgtatgcactcttttgggtgtggatcaacatatgctta

SEQ ID NO: 9750 - DNA, 960 bp, Thalictrum flavum
ccaaaacctcttctttcactcacatcaatggcgacagcacgtgaggaaaacgtgtacatggcaaagcttgcagagcaagctgaacgatatgaagaaatggttgagtttatggaaaaagtaacagcatctgttgaagctgaagagcttactgttgaagaacgaaatcttctttctgttgcttataagaacgttattggtgctcgtcgtgcttcatggagaattatttcttcaattgaacagaaagaagagagtcgtggtaatgaagatcatgttgctgctattcgtgattatagatctaagattgaaactgaacttacttcgatctgtgatggtattcttcgtcttcttgatactagactcattccttctgcttctgctggtgattctaaggtcttctatttgaagatgaagggtgattatcatcgttatcttgccgaatttaagactggtgctgaacgtaaagaagccgctgaaagcactctttctgcttacaaagccgctcaggatattgcaactgctgagttggcaccaacacacccgatccggcttggattggctcttaatttctctgtcttttattatgagatcttgaattctccagatcgtgcttgtagtcttgcaaaacaggcatttgatgaagccattgcggagttggacaccctgggggaggaatcctacaaggatagcactttgataatgcagctccttcgtgataacctcactttgtggacttctgacatgcaggatgatggaacagatgagatcaaggaagcaccaaagcgtgaggatgaacagttgtaatttcagtttgtttcagattaggttgttagtttcctttatttatctataccagaatgtgtttggtgttgattccccaattactttgaattttaagaactgcattggtttcccagacctttaaggtacagggttttgtgattcttaaatttgatgtgtttt

SEQ ID NO: 9751 - DNA, 1084 bp, Vinca minor
tgtacatggccaagctagctgagcaggctgagcgttatgaggaaatggttgaatttatggagaaggttgcaaagactgttgatgttgaggagctgacagtggaggaaaggaatctcctttctgtggcttacaagaatgtgatcggggccaggagagcttcatggaggatcatctcttccattgagcaaaaggaagagagccgtgggaatgaagaacatgtgaacattattaaggattatagaggcaagattgagactgagctcagcaagatctgtgatgggattctgaaccttcttgagtcccatctcattcccgcagcctccactgctgagtccaaggtgttttacttgaaaatgaagggggattaccacaggtaccttgctgagtttaagactggagcagagaggaaagaagctgctgagagcactttgttggcttataagtctgctcaggatattgctttggcagaattggcccccactcacccaattaggcttggccttgcacttaatttctcagttttctattatgaaatccttaactcgcctgaccgtgcatgcaatcttgcaaagcaggcttttgatgaggccatctctgagattgatacattgggtgtggaatcatacaaggacagtacattgatcatgcaacttctgcgcgacaatctgactctatggacttctgatatttcggaggaagctggagacgagattaaggaagcacctaaagctgacaaaggagaagggcagcagtgatgatccaagtattgtagcctaaccatgtactctttgtgattttaatacaggacttccttcgaggggttacagcaaaagatttgatggtttgatagtgatgctcaaggttccagtgttctacctatttatgtttcgatacctggagagaagattttagtgtttggatgtgtcattagggaatgtagtgcttttatgagcaattctatttctggttttaatattgaaaatgggccttcatcctaatagagttgaacaacagacaacggtaggagctaataaatggcctcatgcatctactctcggtcgtgaatctagaagaacttctgttg

SEQ ID NO: 9752 - DNA, 766 bp, Momordica charantia
acgaggagatggttgagttcatggagaaggtagccaagaccgtggactcggaggagctcaccgtggaggagcgcaacctcctttctgttgcatacaagaatgtcattggagcccgtcgtgcctcatggcgcatcatctcctccatcgagcagaaggaggaaggccgaggcaatgaggaccgtgtaacactcatcaaggactaccgtgggaagattgagactgagctcaccaagatctgtgatggcatcctcaagctgctcgagtcccaccttgtcccctcttccactgcccccgagtccaaggtcttctacctcaagatgaagggtgactactacagataccttgctgagttcaagactggggctgagagaaaggacgctgccgagaataccatggtggcatacaaggctgcccaggacattgctttggctgagctgcctccaactcaccctattaggcttggtctggcacttaacttctcagtgttctactatgagattctgaactcaccagatcgcgcatgcagtcttgcaaagcaggcttttgatgaggccatctcggagctcgacaccctgagcgaggagtcctacaaggacagcactttgatcatgcaactccttcgtgataacttgaccctatggacttccgacatctcggaggaccctgcggaagagatcaggaggcacccaagcacgactcgagcgaggggcagtaaagacggatttacgtgccctagaaactagtcgctagtgtttgctgctgtcta

SEQ ID NO: 9753 - DNA, 1715 bp, Triticum aestivum
aacgcgtattgcctcctacgcccccggatccgctgctccaccccccaactccgttgccacacgcccttgcacaagcgagcgagcaaccatgtcgccagcagagccgacgcgagacgagagcgtctacatggccaagcttgcggagcaggccgagcgctacgaggagatggtggagttcatggagcgcgtcgcgaaggccaccggcggggcagggcccggggaggagctatccgtcgaggagcgcaacctgctctctgtggcttacaagaatgtcatcggggcccggcgcgcgtcctggaggatcatctcctccatcgagcagaaggaggaaggtcggggcaacgacgcgcacgccgccaccatccgctcctaccgcagcaagatcgaggccgagctcgcaaagatctgcgacggcatcctcgccctgcttgattcccacctcgtgccatccgccggagctgccgagtccaaagtcttctatctcaagatgaagggcgactaccacaggtaccttgcagagtttaagtccggtggggagaggaaggaagccgccgagagcaccatgaacgcgtacaaagctgctcaggatatcgccctagcagatttggctccaacccaccccatcaggcttgggcttgcactcaacttttctgtgttctactatgagatcttgaactcccctgaccgcgcctgcaaccttgcaaaacaagcctttgatgaggctatatcagagctggacagcttaggcgaggaatcctacaaggacagcactttaatcatgcagctcctgcgtgacaatttgactctatggacatccgacaccaatgaggatgacgttgatgagattaaggaagccccagctccaaaagaatctggagacggacagtgaggtgaatgaaaacaacagtctgtgcattgttgggggcaatggaagtcggtcttggttctagtgctcatactgttgtcatcactacctctgtttaattatgcacttaagaagtttctgggctatgtttttctggtgctgataaatgctggctggattcgtgttttctttttaaatctcgccacaagcaaaagacctgctctttttcaccattagaatgtttgctatatctaccatgtttggcgagacttgatgcaactagtactattttgctgaaattgaggtatcatgttcatgtttggctgaactacattatgacaagacggtttgcgcaaagatgttcatttgcacgtgctagctgtggcatggcctcaatcgattgagaagaatgtcaaggttcacctgattgatgcttttcttggcccagttttcgttgcaactagaagcaaaggtgcgctttgctgcgttgttcctatcattcttggcattgtcatggtgattgatatggcaaataatccgatgcgctgcaagaatttctatctagtcaccttcctgaagaatgtaacgtgagctaaatgaggaatgttatacaaagttaatctgtaataagaggacacattctaaataaaaggaaccattagctcactaccatattgtcagtgttttccttgcaagctgtattataatagcaccttgagcaactggaagcaattctttttgggatgcaacaaatttggcttgctcttggttattccttttcttgttggaactgaatttgtacaatcttgccacattcctggatctcaaatggatgcaacttattcgtatc

SEQ ID NO: 9754 - DNA, 2512 bp, Populus trichocarpa
aactgattagaaatatgaaaaatagaagaccaaaccatgttgttgtctgtctcaatggtttccacagtttgattatttttaaaaatctttaaaaaggggctatcaatttttatgtacctgacgtgatctagcccttcttttctctttttcaattgggtttgtgggtattgaagagaaattgctaaatttgaaacctctttttttggatgtggcaagtggtgggatttggggtgttggtttgatgaaaagtgggttttggaatttagggtttttgaagaggaaaggagaggatgggtttaggcagtgaagaaggtaaagtgaagtcttcttgggatgtgtgcaaatcaaaggagaggaagaagaaagatggtacaaaggcggggtgttgggtcaagttaaggcttgttgggggctgcatttcgtcaagatccaaagttgatagctctgttagtgggactagtacccattttgaaagtaaatccataaatgatacaagcacagaccaaccagctgttcctgttgtctcatcgtcaaccacaagcaatacagaaagtaattcatccctttccaaacttgaagaggagcttaaagttgcttctcgactgcggaagttcacatttaatgatctcaaactggcaactcgaaattttagacctgagagtcttcttggtgaaggtggctttggttgtgttttcaagggatggattgaagaaaatggaactgctccggtgaaacctggtactggccttaccgttgctgttaaaacccttaatcatgatgggctccagggtcataaagaatggctggctgaagtaaattaccttggtgatcttgttcatcctaacctggttaaactgattggttactgcattgaagatgatcaaaggctgctagtttacgagttcatgcctcgaggaagcttggagaaccacctatttcgacggtccctacctcttccatggtctataagaatgaaaatcgctctcggtgctgccaaaggtcttgcctttcttcatgaagaagctgaaaggccagtgatttatcgtgatttcaaaacctccaatatattattagatgcggattacaatgccaagctttctgattttggacttgccaaagatgctcccgagggagataagacccatgtatcaacccgggtgatgggaacttatggttatgcagccccagagtatgtaatgaccggacatcttacatcaaggagcgacgtctacagttttggtgtggtcttgcttgaaatgataaccggcaggagatccatggataagaaccgtcctaatggagagcataatcttgttgagtgggcgaggccatatctaggagagagaagaagattctaccggctgatagaccctcgacttcaaggtcacttttcaataaaaggagcccagaaagctgcacagctggctgctcattgccttagcagggatcctaaagccaggcctctaatgagtgaagtggtcgacacattgaagcctctgcccaacctcaaggacatggcaagctcatcgtattatttccagaccatgcaaggtgaccgggttgggtctagcccaaatgccaaaaatggtgtccgctcacaggctggattgttatctcggaatgggcaccaacaaaggagtttttcaataccacatggtccccatgcttctcctttccaccatcaatatccccaccaatctccaaaacccagtggcaaaccatagcacaggatcagtgaagtatctgcttcttttagctgcctcttttcattcatttcttttttcacccttttcttactatagatgtattttctgtgaaagcatttgttcttgtacaactgagaaggcaatggaggaacatgtccctatatgttgtatttagaatgatgaccatccttcacacacggggtaatgatgaggcttatggcgcaaaatgttagtcgattgccctctacagtccagaaaatgttaaggaatattaggtcctgtctgattgaatcttttttcataactcgatcggaaaaatccgattgggattgtttccatgttccataataactcgacgttattcagccggacaggtataaattgcctctttcaatcaacaaaaaatggtgagaagggtggttaaaagattatagcatgttagaacaaacgtccaataatataggtattgtgaataaagtttattcatgtactgtgagtcatgatatatgtacttatgtaaggatctcagccttgaagaccacttcttgagtaacttctagcgatcattctttgtcgtctaaatagtgattcatctcacccagttcgccttgtcaattgctctttggatgtgctctcaaaaatcttatctgcatttccaacctcaaacccatctcgcctgtgaaactccttgacctcttccttgcgtagatttttatattgtggcaacacaaggcgttcggcaaactctatgtatgagcagggaactgattcagtgaagccatcagaaaacttgaaagagattgagt

SEQ ID NO: 9755 - DNA, 3331 bp, Prunus mume
ttttcaccccactttaaactggtcagcttgtgggagttcatttctgagatttatgtgtctttgagcagacatttctgggttaaactgaaatttggttgttcctatctgttaaaaacggacacttgctccttggtttttgtctttttcctcactagctgatcaattttgagcttcaagggtttgtcaagtttgatctactttccgtgtgatctagctctttctcagctgggtcatcctttttaccaccaaattaagttgggttttgaggaaagtttggaaatttcagagctttttggtgaatttttatatgggttgtgtggagggctagaggcagtttttgactggttttgttgtgggggtgggagggttggtggttgggctttttttatggtatctgaatttcgttctttagggtttgtgaaagatgggtttgggagctgagaatggtaaagtggagtcttggagcatgtgcaaatcgaaggtgaggaagaagaagaagaaagatgatgatgatgatgtggaggaagaggagactgggtgttgggttaggctgaggttctttgggagctgcatttcttcaagatccaaagttgatagctcaatcagtggaaccagtactcactgtgaaactaaatctacaaatgatacaagcagagaccaaccaacagctactgtagtctcttcctcaaccactagtaacacagaaagtaatgcatccacttccaaacttgaagaggaacttaaagttgcttcgcggttacgaaaattcacatttaatgatcttaaattggcaacaaggaatttcagacctgaaagtcttcttggtgaaggtggttttggttgtgtgttcaaggggtggatagaagaaaatggaactgctccagtaaaacctggcacagggcttactgttgcagttaaaactcttaaccatgatgggcttcagggtcataaagaatggctggctgaagtgaatttccttggtgaccttgtccatccaaacttagttaaacttataggatactgcattgaagatgatcaaaggctgctagtgtatgagttcatgcctcgagggagtttggagaaccatctgtttaggaggtccttgcctcttccatggtcaattagaatgaaaattgcattaggtgctgcaaaaggtctcgcttttcttcacgaggaagcagaaagacctgttatatatcgggattttaaaacctccaacatcttattggatgcggattacaatgccaaactgtctgactttggacttgccaaagatggtcctgagggtgataaaacccatgtctccacccgtgtgatgggaacttatggttatgcagctccggaatatgtaatgactggacatcttacatccaggagtgatgtctatagttttggcgtggttttacttgagatgctgactggcagaagatctatggacaaaaatcgaccgaatggtgaacataaccttgtggaatgggcacggccacatttaggcgagagaagaagattctaccgattgatagacccccggcttgaaggccacttttcaataaaaggtgtccaaaaagctgcacaactagctgcccattgccttagtcgagatcctaaagccaggcccctaatgagtgaagttgttgaagccttaaagccgctgccaaacctcaaggatatggcaagctcatcatactatttccagaccatgcaagctgaccgcgttgggtccagcccgaataccagaaatggtgtcagaacacaagcaggattgctaacaaggaatgggcatcatcagcagaggagcctctcaataccaaatggttcccatgcttctccatatcaccatcaatatccccatcaatcaccaaaacctaacagcaaaccttaagatagggttggcagctgtctatatcatttcccaccccattgtcagcagtcattttccttttttttttctttttttttttcctctttttttcttccttttccctcttcttcggtatagatgtatcatctgttaaagcatttgttcatggacaactcaaaaagcaacagagaaacatgtttgcttgatgttatgtttagagtgatgacctcgaagtaagggcatgtgaagttcactgagcaaaatgtattggttagaaataccaagacaagattgttgcctcccgttacattatatcctttgtcatctgttccttagatgaatacaagtccttgtttcttggtcacatgtcatatccctttctggtataaaacaaaatgcactactttgtcttaattaagtacatgagaaaaaccaatttcaaataagctacgtcttgtctcgtgcccttatattttggacttggtaaaaagcttggcgccattcaacgagaggaggagggagagagatagcagggttggtaggatctcaccatcagatagcaatatgtagcataagataagaaaatttaatcttaaattgaaataaaatcattatcggcatattgtgccacaacagctacagctaagagtcaactggacacatttccaaagaggcttatttgcattgagttgagcccatgggacccaaaaaagaaaacccataagacctgccttctattattatttctatcaagtagatatatacatgctccaactcctccaatggtggcacatgtatttacattaccatctcagccttgaagaccactttgttagatgcactaaacttaatccctgaagaggttttatttttcgttcctctcttctttttggaggatcttcaaatgtgaaatccacttcatcattgtaaaggatcattctttcatgcagccttcctggtcagctgctccttggatgtactctcgaagatcttgtcagcatttccaacctcaaatccatctcgcctgtgatgctctttgacctgtgcaagttgctagttcataattgtgcaacaccaaaagcaacttgaaaaacccaaaataccaacagacaaaagtttggttacctcttcaaggggtagattactgtactgaggcagcaccaggcgctcagcaaactcgatataggagcaggggactgattcagttagaccatcagaaaattggaaatgaattgaatctgcgacagttgaactttgctgaagaaggccatcggggctcactgttaatggaagaagtaaactcataataatcagcattgagtaatatgcaataaaagatattgcaagaaatttcacttaactcaacttctgcttatggcatgccacgttaattcagttgatgatatgcacaaaggcccagtcatgtgttccaacaaacatatcagtttctgaataccaataatatcattc

SEQ ID NO: 9756 - DNA, 2046 bp, Prunus persica
agcttgtgggagttcatttctgagatttatgtctttgagcagtcatttctgggttagactgaaatttggttgttcctatctgttaaaaacggacacttgctccttggtttttgtctttttcctcactagctgatcaattttgagcttcaagggtttgtcaagtttgatctactttccgtgtgatctagctcttttctcagctgcgtcatccttttttccaccaaatttagttgggttttgaggaaagtttggaaatttcagagctttctggtgattttttatatggtttgtgtggagggctagaggcagtttttgactggttttgttgttgggggtgggaaagttggtggttgggttttttttttatggtatctggatttcattctttagggtttgtgaaagatgggtttgggagctgagaatggtaaagtggagtcttggagcatgtgcaaatcgaaggtgaggaagaagaagaagaaagatgatgatgatgatgtggaggaagaggagactgggtgttgggttaggctgaggttctttgggagctgcatttcttcaagatccaaagttgatagctcaatcagtggaaccagtactcactgtgaaactaaatctacaaatgatacaagcagagaccaacctactgctactgtagtctcttcctcaaccactagtaacacagaaagtaatgcatccacttccaaacttgaagaggaactgaaagttgcttcgcggttacgaaaattcacatttaatgatcttaaattggcaacaaggaatttcagacctgaaagtcttcttggtgaaggtggttttggttgtgtgttcaaggggtggatagaagaaaatggaactgctccagtaaaacctggcacagggcttactgttgcggttaaaactcttaaccatgatgggcttcagggtcataaagaatggctggctgaagtaaatttccttggtgaccttgtccatccaaacttagttaaacttataggatactgcattgaagatgatcaaaggctgctcgtgtatgagttcatgcctcgagggagtttggagaaccatctgtttaggaggtccttgcctcttccatggtcaattagaatgaaaattgcattaggtgctgctaaaggtcttgcttttcttcacgaggaagcagaaagacctgttatatatcgggattttaaaacttccaacatcttattggatgcagattacaatgccaaactgtctgactttggacttgccaaagatggtcctgagggtgataaaacccatgtctccacccgtgtgatgggaacttatggttatgcagctccagaatatgtaatgactggacatcttacatccaggagtgatgtctatagttttggcgtggttttacttgagatgctgactggcagaagatctatggacaaaaatcgaccgaatggtgaacataaccttgtggaatgggcacggccacatttaggcgagagaagaagattctaccgattgatagacccccggcttgaaggccacttttcaataaaaggtgtccaaaaagctgcacaactagctgcccattgccttagtcgagatcctaaagccaggcccctaatgagtgaagttgttgaagccctaaagccgctgccaaacctcaaggatatggcaagctcatcatactatttccagaccatgcaagctgaccgcgttgggtccagcccgaataccagaaatggtgtcagaacacaagcaggattgctaacaaggaatgggcatcatcagcagaggagcctctcaataccaaatggttcccatgcttctccatatcaccatcaatatccccatcaatcaccaaaacctaatagcaaaccttaagatagggttggcagctgtctgtatcatttcccaccccattgtcagcaatcattttcctttcttttttttttttttttttttttttttttttcttccttttacctcttcttcggtatagatgtatcatctgttaaagcatttgttcatggacaactcaaaaagcaacagagaaacatgtttgcttga

SEQ ID NO: 9757 - DNA, 2542 bp, Cannabis sativa
cggatttttttggatatataatttttttccccttctctctccaaattattattattattattttcgagaaattattgttattataattattattattatcgtttacctatctttaaactggtcagcttgtgaagagtccatttctgagattttctgtatctctggacagacatttctggctccaactgaaattttggtgcatttgtaaatccacgcttcttccttttttgggctttcaattttcagattgatttttctaggggataggggttcaggtgtgatctactttgcgtgatctagttctctgaactgagttttacttttttgggtttctacttctttgaagctgatctttttgaaagaaagtctttgaatttctgagtcatatagttacttttgcatctggggtgtttatagttgccttgactagttcaggtgggaagttggtatctgggattttgtgagacgtttgatggtctctgggtttaattattagggtttttctgagatgggtattggtgctgagaatggtaaggtggagtcttgggatgtgtataaatcaaaggtgaggaagaagaaaaaagttgatgatgctgatgaagaggaggaaactgggtgctgggttaggctgaggtttattggtagctgcatttcttcaagatccaaagttgatagctcaattagtggaacaagcactcactatgaatctaaatcaacaaatgaaacaagcagagaccatcccacagctgcagttgtctcatctactaccactagtaatgctgagagtaattcttctacttcaaaacttgaagaggaacttaaagttgcttctcggctgcgaaaatttacatttaatgatcttaagatggcaactcgaaactttagacctgaaagtcttcttggtgaaggtggttttggttgtgtgttcaaagggtggattgaagaaaatggaactgctccagtaaaaccaggaacagggcttactgttgctgtgaaaactctcaaccatgatggacttcagggacataaagaatggctggctgaagtgaatttccttggtgaccttgttcatcctaacttagttaaacttataggatactgtattgaagatgatcaaaggctgctagtctatgagtttatgccccgtggaagcttggagaaccacctctttaggaggtctttgcctcttccatggtctatcaggatgaaaattgctttaggtgctgcgaagggtcttgcctttcttcacgaggaagcagaaaggcctgttatatatcgtgattttaaaacttcaaatatcttattggatgcagattacaatgctaaactttctgattttggacttgccaaagatggtcccgaaggtgataaaacccatgtgtcaacccgtgtgatgggaacttatggttatgcagctccagaatatgtaatgaccggacatcttacgtcacggagtgatgtctatagttttggtgtggtgttacttgaaatgttgactggcagaagatcaatggacaaaaacagacctaatggtgaacataatctagtggagtgggctcggccgcatctaggagagagaagaaagttctacaaattgatagaccctcgacttgaaggccatttttcaatcaagggtgctcaaaaagctgcacaattagcctcgcattgccttagtcgagatccaaaatccagacctttaatgagcgaagttgtggaagtcttgaaaccactaccaaatttgaaggacatggcaagctcttcatactattttcagacaatgaatgcagaccgtgttgcctccagcccaaacgcaagaaatggtgtcagaacacaaggaggattgatgtcaagaaatgggcatcagcaaaggagtctctccattccacatggttcccatgcttctccatttcatcatcagtatccacatcaatcaccaaaacctaatggcaaggcataaggttgagttggaaaaaaccgtctctctgtttctcttcaccatcctcctcagcattcgtttctttttctcccccttcctcggtatagatgtatcttttgttaagaagcatttgttcttgaacaactgaaaaagcaacggagaaacaagctttctttggtgttgttgtgtttagagtggggcccctagaaaatgtaaagggagggagtaggagtaggagaagcttcatgagcagaatttctttctcttatgtcaatgtcatattgtttggaagcattgaaagattgttaccttctttcactatgtattctgttcaatcttattcccttaatcaatacaactccttgtttcatagtcaaacgcaacataagtaggccttcattcatttgtaaagttatatatttctaactgttgtctcaatcttaattggttgaccatggactatggggttctcttcacttaagcttcagctcatatgtcattatactagttttccacacctttaaattactacttgtattgttcgaattttgaaatagcagattaattttattttcgatagaaaaatgacagattaacttgaaatga

SEQ ID NO: 9758 - DNA, 2281 bp, Citrus sinensis
gctgtaaactcatttcttgtatctttatagcaatacatttcgtgggtttaactgagatttgtttgtttctgcttttattctattttatttttgttgttgcgagatcaagcttgtttgttgataccaaagtaaagtacttcagttttgagttcagacaaaaacttgatcaatctcaagttacatccttttttatctagttcatgtgatctagctcttacctcaacagggttagtttttttatttttttcctcttttgcatttttttcacttggttttgtcttttggtgggttttgaagtgaaagaaaagcttaaattttgaaactttttggtggctcttaagtgtgaggtgagagtaaagaagtgattttttgagggggggttgatgagttttagggtttgttgagagacaaaagaatggggtttgatggtgaaaatgggaaagtgaagaaggcttcttgggattcgagcaaatcaaaggcaaagaagaagaagaagaaagttgaagatgaagttgaagttgaagaagaagaagaaactgggtgttgggtcaagttgagattttttggaagctgcatttcttcaagatccaaagttgatagctccgtgagtggcaccagtacccattatgaaagtaaatctacaaatgatacaagtagggaccaaccggcagctgctgttatctcatctacaaccactagtaatgcagaaagtaattcctccacttctaagcttgaagaagagctaaaagttgcttctcggctacggaaattcacatttaatgatcttaagttggcgacacgaaattttaggcctgagagtcttcttggagaaggtggttttggttgtgttttcaagggctggatagaagaaaatggaactgctccagttaaacctggcacgggacttactgttgcagtaaaaacccttaaccatgatggtcttcagggtcacaaggaatggctggcggaagtgaattttcttggtgatcttgttcatcttaacttggttaaattaatcggttattgcattgaagatgatcaaaggctgcttgtctatgagtttatgcctcgaggaagtttggagaaccaccttttcagaaggtccttgcctcttccatggtccataagaatgaaaattgcactaggtgctgcaaagggtcttgcttttcttcacgaggaagccgaaaggccggtgatttatcgtgatttcaaaacctccaacattctattagatgcagattataatgccaagctctcggacttcggacttgcaaaagatggtcctgagggtgataaaacccatgtatcaacccgtgtgatggggacttatggctatgcagccccagaatatgtaatgacaggacatcttacatcaaggagtgatgtctacagctttggagttgttctgcttgaaatgctgactggcagaagatctatggacaaaaaccgacccaatggagaacataatcttgttgaatgggctcggccacatctaggagagagaagaaggttctatagattgattgaccctcggcttgaaggtcacttttcaatcaaaggtgcacagaaagctgcacaattggctgctcattgccttagccgggatccaaaagccagaccgctcatgagtgaagtcgttgaagctttaaagcctttgcctaacctaaaggacatggcgagctcatcatattatttccagacaatgcaagctgaacgaataggatcaagcccaaatacaagaaatggtatccgagcacagggaggatcactttcgaggaacggacagaggagcctttctattccaaatggttcttatgcctctccatatcaccatcagtttccccatccatcaccaaaacccaatggtaaaccataacgtgacattgggttaattgtccctctcactctgacccctcttcattttttttttttcttttccccctttttcacttgagtatagatggaatttctgtcaaagcatttgttcttggacaactgaaaaagcaacagaggaacatgcttttaatgttgttagaattggccccccagggggtaaggctttcggcacatgtgaagtttatggagcaaaatgtcttctgtcaacgatatgttgctttaatctatttggaaatattaaagaaattagtatcttgtgctcttttctttcttgacgtgggtggcaagggatgtggggttcagatttgaccatttttatttattaattgtatatccttatctgcacaggctcttgattccccatccagcaaaccactcattccaa

SEQ ID NO: 9759 - DNA, 2286 bp, Citrus clementina
gctgtaaactcatttcttgtatctttatagcaatacatttcgtgggtttaactgagatttgtttgtttctgcttttattctattttatttttgttgttgcgagatcaagcttgtttgttgataccaaagtaaagtacttcagttttgagttcagacaaaaacttgatcaatctcaagttacatccttttttatctagttcatgtgatctagctcttacctcaacagggttagtttttttttttttctttttttcctcttttgcatttttttcacttggttttgtcttttggtgggttttgaagtgaaagaaaagcttaaattttgaaactttttggtggctcttaagtgtgaggtgagagtaaagaagtgattttttgagggggggttgatgagttttagggtttgttgagagacaaaagaatggggtttgatggtgaaaatgggaaagtgaagaaggcttcttgggattcgagcaaatcaaaggcaaagaagaagaagaagaaagttgaagatgaagttgaagttgaagaagaagaagaaactgggtgttgggtcaagtttagattttttggaagctgcatttcttcaagatccaaagttgatagctccgtgagtggcaccagtacccattatgaaagtaaatctacaaatgatacaagtagggaccaaccggcagctgctgttatctcatctacaaccactagtaatgcagaaagtaattcctccacttctaagcttgaagaagagctaaaagttgcttctcggctacggaaattcacatttaatgatcttaagttggcgacacgaaattttaggcctgagagtcttcttggagaaggtggttttggttgtgttttcaagggctggatagaagaaaatggaactgctccagttaaacctggcacgggacttactgttgcagtaaaaacccttaaccatgatggtcttcagggtcacaaggaatggctggcggaagtgaattttcttggtgatcttgttcatcttaacttggttaaattaatcggttattgcattgaagatgatcaaaggctgcttgtctatgagtttatgcctcgaggaagtttggagaaccaccttttcagaaggtccttgcctcttccatggtccataagaatgaaaattgcactaggtgctgcaaagggtcttgcttttcttcacgaggaagctgaaaggccggtgatttatcgtgatttcaaaacctccaacattctattagatgcagattataatgccaagctctcggacttcggacttgcaaaagatggtcctgagggtgataaaacccatgtatcaacccgtgtgatggggacttatggctatgcagccccagaatatgtaatgacaggacatcttacatcaaggagtgatgtctacagctttggagttgttctgcttgaaatgctgactggcagaagatctatggacaaaaaccgacccaatggagaacataatcttgttgaatgggctcggccacatctaggagagagaagaaggttctatagattgattgaccctcggcttgaaggtcacttttcaatcaaaggtgcgcagaaagctgcacaattggctgctcattgccttagccgggatccaaaagccagaccgctcatgagtgaagtcgttgaagctttaaagcctttgcctaacctaaaggacatggcgagctcatcatattatttccagacaatgcaagctgaacgaataggatcaagcccaaatacaagaaatggtatccgagcacagggaggatcactttcgaggaacggacagaggagcctttctattccaaatggttcttatgcctctccatatcaccatcagtttccccatccatcaccaaaacccaatggtaaaccataacgtgacattgggttaattgtccctctcactctgacccctcttaattttttttttttcttttccccctttttcacttgagtatagatggaatttctgtcaaagcatttgttcttggacaactgaaaaagcaacagaggaacatgcttttaatgttgttagaattggccccccaggggtaaggctttcggcacatgtgaagtttatggagcaaaatgtcttctgtcaacgatatgttgctttaatctatttggaaatattaaagaaattagtatcttgtgctcttttctttcttgacgtgggtggcaagggatgtggggttcagatttgaccatttttatttattaattgtatatccttatctgcacaggctcttgattccccatccagcaaaccactcattccaa

SEQ ID NO: 9760 - DNA, 2145 bp, Vitis vinifera
cttccttgagtccatttccgatatttgttcaatctctgagagcagacatttttgagggtgggtgaactgagattttctgctgaaaaaaagctacttgtcccaggtgatcaatcctcacttttgtatctccaccatgtgatctgactatgttgatctgcttctctccgattttgtgacctgggtttgagttttttcatctgatttcctcggtttttgggacaaatttctcaaattggagcactttgtgggttttctttttgagggtagatattttaaatagaaggggtggtggaggaggaggaggtggtgggaggttgggggcgattttgggatttggggtgtttttgatggtatgttgatttgggtctagggtttgtgaaagatgggattgggtggtaatgatgtgaaagtggagtcttgggaagttggcaaatccaagggaaggaagaagaaagatggtggggaagaggagactgggtgttgttgggttaagctcaggtttatggccagctgcatttcttcaagatctaaagttgatagctccattagtggaaccagtactcattatgaaaatagatctacaaatgatacaagcagagaccaaccggttgctccagtagtctcatctacaaccactagtaatgcagaaagcaattcatccacttccaaacttgaagaggaacttaaagttgcttctcggcttagaaaattctcatttaatgatcttaagatggcaacacggaattttagacccgagtctcttcttggtgaaggtggttttggctgtgtatttaaggggtggattgaagagaatggaactgctccagtgaagcctggcacagggcttactgttgctgttaaaacgctcaatcatgatgggcttcagggtcataaagaatggctggctgaagtgaatttccttggtgacctcattcatcctaatctggtcaaactgattggttattgcattgaagatgatcaaaggttgctagtttatgagtttatgcctcgagggagtttggagaatcatctgtttaggagggccctgcctcttccatgggccataaggatgaaaattgcactaggtgctgctaagggtcttgcatttcttcatgaggaagcagaaaggccagttatatatcgtgattttaagacctccaacatcctattggatgcagagtacaatgccaaactttctgattttggacttgctaaagatggtcccgagggagataagactcatgtatctacccgtgttatgggaacttatggatatgctgcccctgaatatgtgatgacaggacatttgacatcaaggagtgatgtctatagttttggtgtggttctactagaaatgctgactggcagaagatccatggacaaaaaccggccaaatggggaacataaccttgtggaatgggcaagaccccatctaggagaaagaagaagattttaccgtctgatagacccacggcttgagggtcatttttcaataaaaggtgcccagaaagctgcccagctggctgctcactgcctcagccgggacccaaaagtgaggcccttaatgagtgaagttgttgaagccttgaagcctctgccaaaccttaaggacatggcgagttcatcttattatttccaaaccatgcaagctgagcgcattggttccagcccaaatgctcgaaatggtgtccgaacacagcaaggaatactttcaaggaatggccatcagcagcagaggagtctttcaataccaaatggttctcatgcttccccgtatcaccagaaccaatacccctatcaatcacccaaacccaatggtaaaccgtagcattgggttatcgtgtttctaattatccttgtgttttcccccacgccccctctttctttctttttttttctttttttttatcatcaatgcctctacctttttttcttccttttcctttttaaatatagatatattttctgttgaagcatttgttcttggacgactggaaaagcaacagagaacatgtttgctttaatgttgttgtgatcctttcagagtggtaacctcctttccttgttagggggagaatggcagggaaaagtgaaattctggagcaaatcatgatgtcaagccccatatgttgcttttagttttaa

SEQ ID NO: 9761 - DNA, 1764 bp, Gossypium hirsutum
gatggtatgagaaatttttagggttagaagaagagagaagatgggattaggttttcaggaaggaaaggtgaagtcttgggatacgtgcaaatcaaaggaaaggaagaagaagaaaaacagtggaaaagaagatcttgatgatgaagctgctgtggaagaaacagggtgttgggttaagttgagattcattggaagctgcatttcttcaagatccaaagttgatagttctgttagtgggaccagcaccaattatgatagcaaatctgcctatgatacaagtaaagatcaaccggcagctccagttgtctcatccacaaccactagcaatgctgaaagtagttcatctacatccaaacttgaagatgagcttaaagttgcatctcggttacggaagttcacatttaatgatctaaagttggcaacaagaaacttcagacctgagagtcttcttggtgaaggtggttttggatgtgttttcaagggatggattgaagaaaatggaactgctccagtaaaaccaggaactgggcttactgttgctgttaaaacactcaaccatgatggcctccagggacataaagaatggctggccgaagtgaattatctcggtgatctcatacatcctaacctggttaagcttattggttattgcattgaagatgatcagagactgttggcgtatgagtttatgcctcgtggaagcttggagaaccacctcttcagaagatcgttgcctcttccgtggtccataaggatgaaaattgcactaggtgctgcaaaaggtcttgcatttctccatgaagaggcagaaaggcctgtgatatatcgggatttcaaaacctccaatatcctactagatgcagactataatgcaaagctttctgattttgggcttgctaaagatggtcccgagggagacaaaacccatgtatcaacccgtgtgatgggaacatatggctatgcagcccctgaatatgtaatgactggacatcttacctcgagaagtgacgtctacagttttggtgtggttctacttgaaatgttgactggtagaagatccatggacaaaaaccggcctaatggagaacacaatcttgtggaatgggctcgacctcatcttggtgagagaagaagattctatagattgatcgatcctaggcttgaaggtcacttctctattaaaggtgctcagaaagctgcacagcttgctgctcactgtctaagccgtgatccaaaagctagacccctaatgagtgaagtggtggaagtattgaagcctctaccaaatctcaaggacatggcaagctcatcatattatttccagacaatgcaagccgaaagagtcggatccagtccactcactagaaatggtacccgagctcaagccagctcactttcaaggaatggacacaggagtctttccattccaaatggttcccatgcttctccctatcaccatcaatatccttatcaatcaccaaaacccaatggtaaaccataatgttgactagttaaattatctttttcccaacctcttttcatcaattatttattttcccccctttttctctcagtatagatgtattctatcaaagcgtttcttcctagacaatgggaaaaaacaacacggtaacatgtttgctgttatatcatgtttaggatgttagcctcccagcgggacggacagggcaagtaaaaagcttatggagcaaaatgccatgtttatcatctgttgttttaatctatttggaaatattaaaaaga

SEQ ID NO: 9762 - DNA, 2250 bp, Gossypium raimondii
agagtacattttcttgctttcaagtgagatttattaattccatctcctaaaataaagaacccaaaatggaaaaacaaagtaacaaacttgtttctctttaccatttccagattccataaaacattcctactctttttttttttggctctattttccctgcttaattttaatctgcgtctttccacaattgggtttctcttgttttagcttttccagccttttacttcttttttttttaagtgagggttttgggtatttaacattttttaaaatttgggttccttcagttttggtgggtttttgttttgctttttccgtaacgatggtatgagaaatttttagggttagaagaagagagaagatgggattaggttttcaggaaggaaaggtgaagtcttgggatacgtgcaaatcaaaggaaaggaagaagaagaaaaacagtgaaaaagaagatcttgatgatgaagctgctgtggaagaaacagggtgttgggttaagttgagattcattggaagctgcatttcttcaagatccaaagttgatagttctgttagtgggaccagcaccaattatgatagcaaatctgcctatgatacaagtaaagatcaaccggcagctccagttgtctcatccacaaccactagcaatgctgaaagtagttcatctacgtccaaacttgaagatgagcttaaagttgcatctcggttacggaagttcacatttaatgatctaaagttggcaacaagaaacttcagacctgagagtcttcttggtgaaggtggttttggttgtgttttcaagggatggattgaagaaaatggaactgctccagtaaaaccaggaactgggcttactgttgctgttaaaacactcaaccatgatggcctccagggacataaagaatggctggccgaagtgaattatctcggtgatctcatacatcctaacctggttaagcttattggttattgcattgaagatgatcagagactgttggcgtatgagtttatgcctcgtggaagcttggagaaccacctcttcagaagatcgttgcctcttccgtggtccataaggatgaaaattgcactaggtgctgcaaaaggtcttgcatttctccatgaagaggcagaaaggcctgtgatatatcgggatttcaaaacctccaatatcctactagatgcagactataatgcaaagctttctgattttgggcttgctaaagatggtcccgagggagacaaaacccatgtatcaacccgtgtgatgggaacatatggctatgcagcccctgaatatgtaatgactggacatcttacctcgagaagtgacgtctacagttttggtgtggttctacttgaaatgttgactggtagaagatccatggacaaaaaccgacctaatggagaacacaatcttgtggaatgggctcgacctcatcttggtgagagaagaagattctatagattgattgatcctaggcttgaaggtcacttctctattaaaggtgctcagaaagctgcacagcttgctgctcactgtctaagccgtgatccaaaagctagacccctaatgagtgaagtggtggaagtattgaagcctctaccaaatctcaaggacatggcaagctcatcatattatttccagacaatgcaagccgaaagagtcggatccagtccactcactagaaatggtacccgagctcaagccagctcactttcaaggaatggacacaggagtctttccattccaaatggttcccatgcttctccctatcaccatcaatatccttatcaatcaccaaaacccaatggtaaaccataatgttgactagttaaattatctttttcccaacctcttttcatcaattatttattttccccctttttctctcagtatagatgtattctatcaaagcgtttcttcctagacaatgggaaaaaacaacacggtaacatgtttgctgttatatcatgtttaggatgttagcctcccagcgggacggacagggcaagtaaaaagcttatggagcaaaatgccatgtttatcatctgttgttttaatctatttggaaatattaaaaagattagcttgttttttctttcctacttcccctgatgtatacaagtgcttgttccttggtagtatctaaatgactgaaagagtagagttgcatgtagctacaatggaattatcaacaccaagtcctaatcacatatggtttgtgattccatataaaattctgtggaaaa

SEQ ID NO: 9763 - DNA, 2367 bp, Cajanus cajan
ttcttcgtttccgtttcagcattggttcttagttgtactgggtcagcttgcacagcatcataggacttaggaggagaacccagacccatctcccagatagatgtctgtgtcttcctttcaccatagctttctgagttgagctacgttgtcgtgttcttttcgggtaaagggttggcattactctattttatttttccacgggttgatcaatctagggttcagggggattctcttcttttggagggattggggtgatctggttcatgtgatctgccccttgtgtcggcactttaaatttctgggtattttgggttttgttgttatgaggggttttgagtggtaaagttgtgatttttaggtttattttgggaatttatcgtctgggtctggggttgtcgagggtggatttggtggtggggggttgggcattgtagggggtgttagggatttggggtgggttggttttcatgatttgtgcttttgattctttggggcttgctttaaatggggttgggtgctgaaaatggtaaggtgatggtggagtctttggatgtgtgtaaatcaaaagggaggaagaagaagaagaaagaggatggggatatcgaagaggaagaagaaactgggtgttggtttaggctgaggttcatcgggagctgcatttcttcaagatccaaggttgatagctcagttagtggcaccagcactaattatgctgaaagtaaatcaactaatgatacaagtcgagatcaaccaactgtccctgtagtctcttcaacaaccactagtaatgcggaaagcaattcatctacttccaaacttgaagaggagcttaaagttgcttccaggctgcgaaaattcactttcaatgatcttaagttggcaacaagaaattttcggcctgaaagtcttcttggtgaaggtggctttggttgtgtattcaagggatggattgaagaaaatggaactgctccagtgaaacctggcacagggcttactgttgctgtaaaaaccctcaaccatgatgggctccagggtcataaagaatggctggctgaggtaaattatcttggtgatctagttcatccaaacctggttaaactgataggttactgcattgaagatgatcaaaggttgctagtatacgagtttatgcctcggggaagcctggaaaatcacttgtttaggaggtccctacctcttccgtggtctattaggatgaaaattgcactaggagctgcaaagggtcttgcttttcttcatgaggaagctgaacgaccagtgatatatagggatttcaaaacttccaatatactattggatgcagactacaatgctaagctctcagattttggacttgcaaaagatggtccagagggtgataaaacccatgtgtctactcgagtgatgggaacctatggttatgcagccccagaatatgtcatgacaggacatcttacatcaagaagtgatgtgtatagttttggagtagtactccttgagatgctgactggcagaagatctatggacaaaaatcggcccaatggtgaacacaaccttgtggaatgggctagaccacatctaggagagagaagaaggttttacaggttgatagatcctcggttggaaggtcacttctcgataaaaggagctcagaaagccgctcatctggctgctcactgccttagcagagatccgaaagcacgccccttgatgagtgaagttgtggaagccttaaagcctctgccaaacctcaaggacatggctagttcatcatattatttccagacaatgcaagctgaccgctttagtgcaagtccaaacactagaaatgggagaacacaaggagcattgctcaccagaaatgggcaacagcaaaggagcctatcaataccacatggtactcatgcatctccatatcaccaccagtttccccaaccatcaccaaaacccaatggcaaggcatagagttgatgagttttcattttctttctcacccttctttttcatcatttctcatttcctaagtatagatgttccttgtgtctagccatttgttcatggacaacttgagagcaaaagaagcatgcatgtgcatgcttctttatggtgtatgttcagtgttgaccttagggcaggtgaagcttattcagctactatgtcttgtgtcaaattgtcaaccaatatatgtttcttcaggttgtttcgaaatattcaagattattaactcctcaattttttttgaatttttttttcatttgccccaggaaatgtctcttggtttgtttaggcttatcaaacattgcggctccttaaattatctacaggcttttgtttatggaaagatgagaaagcagcttcattgcatta

SEQ ID NO: 9764 - DNA, 2360 bp, Amsonia hubrichtii
tagacacacccagacacatatacaaatagagtatatactataaaattttctattttttctttttcttgtcattgaactggtcagaataataatctctttagttgagatttcaatatctttgaggagcagacatttctggggggcacttttgaactgggattatctgataccagctttgctttgtattgtagtattgttttttcagtttttgctttgcttgcttgtactgtctatctatgcttgtcataccagggtaaagcattcggctttgaaggtcaagcatgcgatctgaatccttgagctcttttttgggtttttaatgtgatctttagttgattttggcaagtgggtctgagcaacttcagcaaattttgtgggttctgaaggattggtgtagaagtgggaggtatttttgtccacccctttgggctatttggattgtacagggaggtagttgaggtgggttttggaggatctttggcttatttattgaactgggtctgatctattttggaggatttttgtggaaaagagttcgagtgaaggactagtggggagaatattctgagtgggtgtggggaaagctgaggtgggtattgggtgaaaggtgtggttttggggataattttgatgatatttgagtttggttttggggcttgtcaaagatgggattaggtggtgatggtgaaaaagtggaatcttgggatgtggggaaatcaaaggggaagaagaagaagaagaaagatggcgctgtagagactggatgctgggttaaattaaggttcatcggcagttgtatttcttcaagatccaaagtggatagctccattagtggcatcagtactcactgtgaaagtaaatctgcaaatgacactagtcgagatcaaccggtcgctgcaattatttcatcaacggctacaagtaacggagaaagtaattcatccacctccaaacttgaagaggagctcaaagttgcttcacggcttcgtaaattcacatttaacgatcttaagttggccacccgaaattttagaccagagtctcttcttggtgagggaggttttggttgtgtattcaaggggtggatcgaagagaatggaacggcaccagtaaaacctgggacagggttaactgttgctgtgaaaaccctcaatcatgatgggcttcagggtcacaaagaatggctggctgaagtaagttttcttggagatcttattcatcctaatttggttaaactgattggctactgtattgaagatgatcaaaggctgctagtctatgagttcatgcctcgaggaagcttggagaatcatctattcaggagatctctgcctcttccatggtctatcaggatgaaaattgctctaggagctgcaaagggtcttgctttccttcacgaggaagcagaaaggccagttatatatcgtgactttaaaacctcgaacatcctgttagatgcagattacaatgccaaactctctgattttggtcttgccaaagatggtccagagggagataagactcatgtctctactcgtgtgatgggaacatatgggtatgcagcccctgagtatgtgatgacaggacatcttacatcaaaaagtgatgtttacagctttggggttgttctgctcgaaatgctaactggtagaagatccatggacaagaatcggcctaatggagagcataaccttgtagaatgggcacggcctcatcttggtgagagaagaaggttctatcgattgatagatcctaggcttgaaggtcatttctcaattaaaggtgcacagaaagctgcccagttggctgctcgctgccttagccgcgatccaaaagccagacctctaatgagtgacgttgttgacgccctaaaacctttgccagccctgaaggacatggcaagttcatcctactatttccaaacgatgcaagctgaccgtgttggatctagtccaaataccagaaatggcattagatcacatgcagcatcattttctaggaacggacagcagcatccgaggagtctgtcgataccaaatggttctcatgcttctccatatcatcatcagtttccacacaactcaccaaaaccaaatggtaaacgatagaggtagaccggcaacaaccgcttttctttcaccaatcttcattctttttctttcccccaactatgaacatatttggtcagctcattgtcgttagacgaaagagaaagggaataggagtacacagttcattaatgttgttgtgatcctgagtgatgtaagctccatttgggaagaatgtaatgtaagccagctgaagttaatggagaaaaatatttctgtatcgattttttgcaacttccttctcccagcgca

SEQ ID NO: 9765 - DNA, 2408 bp, Quercus alba
attcatagtcttattatgtaagtgatactatttatttttttttccaaattttcttctctttctagctttaaacgggtcagcttgtagaagagtccttgtctgagatttctgtatctttgagcagacatttctgggttccactgagatttgttgcttctctctggtttaagttaagtactttttttcttcttcttcttcttctatataattttccacaagttgatcaattttgggttttcaaaattttagtcaaaaatttgatctttaccttgtgatctagctgttttcccatctgggtttttctaatattgtcagcctaagtgggaaaaagccaaaaaggtgaaattttttagtggtatatggtaattttctaggtgggtttttgttggttaaggaagattgactaccggttgtggttgggggtggggagagatgagaaggctgtgatggtgtgttgggtttgagtgtttaggggttattgagagagagatgggattgggtggtgagaatggtaaagtggagagttgggaagtgggaaaatcaaaggttgtgaagaagaagaagaagaaggaagtggtggaagctaaaggtggtgtggaagaggaagaaattgggtgttgggttaggctaaggtttcttgggagctgcatttcttcaagatccaaagtggatagctcaatcagtggaaccactactcattatgctgaaagtaaatcaaccaatgatacaagcagagaccaacctgcagctccaattgtcccatcctcaaccactagtaatgcagaaagtaattcatccacttccaagcttgaagaagagcttaaagttgcttctcgtctgcgaaaattctcatttaatgatcttaagttggcaacaagaaattttagacctgaaagtcttctgggtgaaggaggttttggttgtgtgttcaaggggtggattgaagaaaatggaactgctccggtgaaacctggcacagggcttactgttgctgtaaaaactctgaaccatgatgggcttcagggtcataaagaatggctggctgaagtgaattttcttggtgatctggttcatcctaatctggtcaagcttattggttactgcattgaagatgatcaaaggctgctagtatatgagttcatgcctcgagggagcttggaaaaccatctatttagaagatccctgcctcttccatggtccattaggatgaaaattgcactaggtgctgcaaagggtcttgcttttcttcatgaggaagcagaaagaccagttatatatcgtgattttaaaacctccaacatcctgttagatgcagactacaatgcgaaactttctgattttggacttgccaaagatggtcctgagggtgacaagacccatgtttctacccgtgtgatgggaacctacggttatgcagccccagaatacgtcatgacaggacatcttacatcaaggagtgatgtctacagttttggtgtggttctacttgaaatgctgactggcagaagatctatggacaaaaaccgacctaatggtgaacataatctagtggaatgggctcggccacatctaggagagagaagaagattctaccggttgatagaccctcggcttgaaggtcacttttcaattaaaggagcccaaaaagctgcgcaactggctgctcactgccttagtcgggatccaaaagccagacccctgatgagtgaagttgttgaagtcttaaaaccactgccaaaccttaaggacatggcaagctcatcatattatttccagaccatgcaagctgaccgcgtggggtccagcccaaatgctagaaatggcatccgaacacaaggaggatccttttcaaggaatgggcagcagcagaggagcctttccataaatagttcccatgcttctccgtatcaccatcattacacttttcaatccccaaaacccaatggtaaaccatagcattcgctttggtaatatctgtttcttttctccaccccattggcttcttttttttccctcttcttcagtatagatgtatcttctgctaaagcatttgttcttagacaactgaaaaaaagcaacacagaaacatgtttgctttgatgatgtgtttagagtggtgaactccctgcgggggagaatgtaagggcaagtgaaagcttgttgagcaaaatgtcttatctcaaccaatgtatcttcagtttgttttttaatgttaaaagtgtattacactcccccatcccccgcccctctctctttttttcccccttttttggtcttcttttcatttcattcttgattaatacaagtctgctgtgttttatggtcaggaatggtgtgtatctgataatataaaccctgtaagcctgtatcatgtagacagactgcaaacaaatacagcattgtttttt

SEQ ID NO: 9766 - DNA, 2357 bp, Manihot esculenta
tgagggaaaaatttttatttctttgcttttaaactgatcagccttgtctgtgagggtctgtttttcggagagtactgcctttttttttccaaatatatttttaagatttctgtcaaatttagagcagacatttcctgatcttaaatggggctcgttggttctatttgttagcccaatttgtttacgagaaaaagaggaaatcgaatgaccaaaactatttttgctgtctgtctaaataattcctccgcttgattaatttttagtctcaaaagggtttgtaattttttactttcttcctgtgatctagttcttttgctctactgggttttggggttcaacagaaattgttaaatttcagtgcttttctgcctttctttttgttttctaatttccctttcccccctcttttttgggttccgtgaagattttggtgggggattggaagttgggggtatttggatgaaaagtgggtctgggtttttagggttttttgagagagaagagaatgggattaggcagtgaagatggagaagtgaaggcctctctggatgtgtgccaatcaaagggaaggaagaagaagaagaaagacggtggtgttggttgcagtggtgaggatgatgttgtggaggaggcagagactgggtgttggttcaagttcaggttcatagggagctgcatttcttcaagatccaaaattgatagctctgttagtggaaccagtggcgaaagtaaatcaactaatgatacaagcagagaccaaccagcagctcctgcaatttcatctacaaccacaagtaatacagaaagtaattcgtccacctctaaacttgaagaggaacttaaaattgcttctcgactgcgaaagttcgcatttaatgatcttaagttggcaacaagaaattttagacctgagagtcttcttggtgaaggtggttttggctgcgtgttcaaggggtggattgaagaaaatggaactgctccggtgaaacctggtacaggacttactgttgctgttaaaacccttaatcatgatgggcttcagggtcacaaagagtggttggctgaagtgaactttcttggtgatctagttcatcctaacttggttaaattgatcggttattgcattgaagatgatcagaggctgctagtgtatgagtttatgcctcgaggcagcttggagaaccacctatttagaagatctcttcctcttccatggtccataaggatgaaaattgccttaggtgctgccaagggtcttgcctttcttcatgaagaagctgaaaggccagtaatatatcgtgattttaaaacctccaatatcctactagatgcggattataattccaagctttctgattttggacttgctaaagatggtcctgagggtgataagacccatgtatcaacccgtgtgatgggaacatatggttatgctgccccagaatatgtgatgactgggcatctcacatcaaggagtgatgtttatagttttggtgtagttttacttgagatgatatctggcagaagatccatggataagaaccgacctattggagaacataaccttgtggaatgggctcggccacatctaggagagagaagaagattctacagattgatagaccctcggcttgagggccacttttccataaaaggtgcccagaaggcagcacaactggctgcccactgccttagccgggatccaaaagccaggcctctgatgagcgaagttgtggaggcactcaagcctctgccaaatctcaaggacatggcaagctcatcatattatttccagaccatgcaagctgatcgaattgcatccagcccaaatgccaaaaatagcagcagaatacaaggaggattattgaggaacggacagcaacagaggagtctttcaataccaaatggttcgcatccatctccttaccatcatcagtatccccatcaatcgccaaaaccaattggaaaaccatagaacagtctccagctgttttcatcattcatttgtttccccttgttcgcagtgtagatgtaattttctgtgcatttgttcttggaactggaaacagcaacgggaaacgtgtctactctatgttgtgttcagaaggatgagcggaccttccagcagggaagaatgttaggaaggtgaagcttatggagcaaaaatatgtgtcaacactctgttactacgcaatgtcttgaaatgtttaaagattattggctcctctgcgtcttttccgccatccttcatctccttgatgtaaacccgtaatcagcctgatttgcaatgctagtaaatttctcaaggcagctcctctctttttcttttttcttttgataaaatgcatggtttgatt

SEQ ID NO: 9767 - DNA, 2394 bp, Glycine max
tttccatttcagcattggttaggattgtactgggtcagcttggacagagcatcataggacttagagggtaggaggaggacacaaacacaaacccgtctcttagattgatgtctctgtgtgtcttcctttgagcaaagctttctgagttgagctaagttgtcgtgttctttttgggcaaaagggttggcattactctctttcggtgtttggtgtacccacaagctgatcaatctagggttcaaggggggtgtgtgatctgccccttttttcggcacttttaatttttgggtgttttgggttttgtggttatgaggggttttgagtggtacagttgtgatttttaggtctagtttgggaattggtcatctgggttgatggtggatttggtggtgggggtgtttgggcattgtttgtagggggtgctagggattttggggtgagttggttttgatgatttgtgcttttgattctttagggcttgctgctatagatggggttgggtggtgctgagaatggaaaggtggtggtggagtctttggatgtgtgtaaatcaaaggggaggaagaagaagaagaaagaggatggggaagttgaagagaaggaagagactgggtgttggttcaggctgaggttcattgggagctgcatttcttcaagatccaaggttgatagctcagttagtggcaccagcactaattatgctgaaagtaaatcaactattgatacaagtagagatcaaccaacagtcccagtagtctcttcaacaaccactagtaatgctgaaagcaattcatccacttccaaacttgaagaggagtttaaagtttcttccaggctgcgaaaattcacgttcaatgatcttaaattagcaacgagaaattttcggcctgaaagtcttcttggtgaaggtggctttggttgtgtgttcaagggatggattgaagaaaatggaactgctccagtgaaacctggcacggggcttactgttgctgtaaaaaccctcaaccatgatgggctccagggtcataaagaatggctggctgaggtaaattatcttggtgatctagttcatccacacctcgttaaacttattggttactgcattgaagatgatcaaaggttgctagtatatgaatttatgcctcggggaagcctggaaaatcacttgtttaggaggtccctacctcttccatggtccattaggatgaaaattgcactaggagctgcaaagggtcttgcttttcttcacgaggaagctgaacgaccagtaatatatagggatttcaaaacttccaatatactattggatgcagaatacaatgctaagctctcagactttggacttgcaaaagatggtccagagggtgataaaactcatgtgtctactcgagtgatgggaacctatggttatgcagcaccagaatatgtcatgacgggacatcttacatcaagaagtgatgtgtatagtttcggagtggtactacttgagatgttgactggcagaagatctatggacaaaaaccgacccaacggtgaacacaaccttgtggaatgggctagaccacatctgggagagagaagaaggttctacagattgatagacccccgcttggaaggccacttttccataaaaggggctcagaaagccgcgcatctggctgctcactgccttagcagagatccaaaagcacgacccttgatgagcgaggtcgtggaagctttaaagcctctgccaaacctcaaggacatggctagttcatcgtattattttcagacaatgcaagccgaccggtttagcgcaagtccaaataccagaaacgggagaacacaaggagcattgctcaccagaaatgggcaacagcaaaggagcctatcaattccacatggcacgcatgcatctccatatcaccatcagtttccacaaccatcaccaaaacccaatggcaaggcatagagttgacgatgatgatgagttttcattttctttgtcaccctttcttttttgtcatttctcattccccaagtatagatgtcacttgtgtctagccattttgttcatggacaactggagaccaaaagaagcatgcatgcatgtatgcatgcctctttatggtgtatgctgagtgttgaccttagggcaggtgaaagcttatcagctactactatctctagtgtcaaattgtcaaccaatatgtttcttcaggttgtttcgaaatattcaagattattaactcctcaattttattttattttttttccatttgcccccagaaatgtcgtctcttggtttggttagaggcttacttgtgctatcaaacattgcggctacttaaattgtctacaggctcttgcttatagaaagataggaaagaagcttcattgcattaaattata

SEQ ID NO: 9768 - DNA, 2328 bp, Glycine max
ttgtactgggtcagcttgcatagagcatcataggaggtaggaggaggacacgaacacaaacacatctctgagattgatgtctctgtgtgttttcctttgaggcttgagcatagcctttcttagttgagctaagttgtcgtgtttttttaggcaaaagggttggcattactctctttctttgtttggtgtacccacaagctgatcaatctagggttcaataggggtgtgtgtgatctggttcctgtgatctgcccctttttttggcacttttaatttctgggtgttttgggttttgtgtttatgagggggttttgagtggtaaagttgtgatttttaggtctagtttgagaattggtcatctgggtcgagggtggatttgaaggttggggtgttgggcattgcttgaaggggtgttagggattttggggtgggttggttttgatgatttgtgcttttgattctttagggcttgctgctatagatggggttgggtggtgctgagaatggaaaagtagtggtggagtctttggatgtgtgtaaatcaaaggggaggaagaagaagaagaaagaggatggggaagttgaagaggaagaagagactgggtgttggtttaggttgaggttcattgggagctgcatttcttcaagatccaaagttgatagctcagttagtggcaccagcactaattatgctgaaagtaaatcaactattgatacaagtagagatcaaccaacactccgagtagtctcttcgacaaccactagtaatgccgaaagcaattcatccacttccaaacttgaagaggagcttaaagttgcatccaggctgcgaaaatttgcattcaatgatcttaaattagcaacaagaaattttcggcctgaaagtcttcttggtgaaggtggctttggttgtgtgttcaagggatggattgaagaaaatggaactgctccagtgaaacctggcacggggcttactgttgctgtaaaaaccctcaaccatgatgggctccagggtcataaagaatggctggctgaggtaaattatcttggtgatctagttcatccacaccttgttaaacttattggttactgcattgaagatgatcaaaggttgctagtatatgaatttatgccacggggaagcctggaaaatcacttgtttaggaggtccctgcctcttccatggtccattaggatgaaaattgcacttggagctgcaaagggtcttgcttttcttcatgaggaagctgaacgaccagtaatatatagggatttcaaaacttccaatatactattggatgcagaatacaattctaagctctcagattttggacttgcaaaagatggtccagagggtgataaaacccatgtgtctactcgagtgatgggaacctatggttatgcagcaccagaatatgtcatgacgggacatcttacatcaagaagtgatgtgtacagtttcggagtggtactacttgagatgttgaccggcagaagatcgatggacaaaaaccggcccaacggtgaacacaaccttgtggaatgggctagaccacatctgggagagagaagaaggttctacaagttgatagacccgcgcttggaaggtcacttttccataaaaggggctcagaaagctgcgcatctggccgctcactgccttagcagagatccaaaagcgcgacccttgatgagcgaagttgtggaagctttaaagcctctgccaaacctcaaggacatggctagttcgtcttattatttccagacaatgcaagccgaccgatttagcgtgagtccaaataccagaaacgggagaacacaaggagcgttgctcaccagaaacgggcaacagcaaaggagcctatcaattccacatggcactcatgcatctccatatcaccatcagtttccacaaccatcacctaaacccaatggcaaggcatagagttgatgatgatgatgatgagttttcattttctttgtcaccaccctttatttttcatcatttctcattccctaagtatagatgtcacttgtgcctagccatttgttcatggacaacttgagagcaaaagaagcatgcatgtatgtatgcatgcatgcttctttatggtgtatgtttagtgttgaccttagggcaggtgaaagcttattctgctgctactatctctagtgtcaaattgtcaaccgaaatgtttcttcaggttgtttcaaaatattcaagattattaactcaattttttatttttttttcatttgcccccagaaatgtcgtctcttggtttggttatgcttacttgtgctatcaaacaatgcggctccttaaat

SEQ ID NO: 9769 - DNA, 2480 bp, Glycine max
attggtattctctgtttccatttcagcatttttggagttgtactgggtcagcttgcatagagcatcataggaggtaggaggaggacacgaacacaaacacatctctgagattgatgtctctgtgtgttttcctttgaggcttgagcatagcctttcttagttgagctaagttgtcgtgtttttttaggcaaaagggttggcattactctctttctttgtttggtgtacccacaagctgatcaatctagggttcaataggggtgtgtgtgatctggttcctgtgatctgcccctttttttggcacttttaatttctgggtgttttgggttttgtgtttatgagggggttttgagtggtaaagttgtgatttttaggtctagtttgagaattggtcatctgggtcgagggtggatttgaaggttggggtgttgggcattgcttgaaggggtgttagggattttggggtgggttggttttgatgatttgtgcttttgattctttagggcttgctgctatagatggggttgggtggtgctgagaatggaaaagtagtggtggagtctttggatgtgtgtaaatcaaaggggaggaagaagaagaagaaagaggatggggaagttgaagaggaagaagagactgggtgttggtttaggttgaggttcattgggagctgcatttcttcaagatccaaagttgatagctcagttagtggcaccagcactaattatgctgaaagtaaatcaactattgatacaagtagagatcaaccaacactccgagtagtctcttcgacaaccactagtaatgccgaaagcaattcatccacttccaaacttgaagaggagcttaaagttgcatccaggctgcgaaaatttgcattcaatgatcttaaattagcaacaagaaattttcggcctgaaagtcttcttggtgaaggtggctttggttgtgtgttcaagggatggattgaagaaaatggaactgctccagtgaaacctggcacggggcttactgttgctgtaaaaaccctcaaccatgatgggctccagggtcataaagaatggctggctgaggtaaattatcttggtgatctagttcatccacaccttgttaaacttattggttactgcattgaagatgatcaaaggttgctagtatatgaatttatgccacggggaagcctggaaaatcacttgtttaggaggtccctgcctcttccatggtccattaggatgaaaattgcacttggagctgcaaagggtcttgcttttcttcatgaggaagctgaacgaccagtaatatatagggatttcaaaacttccaatatactattggatgcagaatacaattctaagctctcagattttggacttgcaaaagatggtccagagggtgataaaacccatgtgtctactcgagtgatgggaacctatggttatgcagcaccagaatatgtcatgacgggacatcttacatcaagaagtgatgtgtacagtttcggagtggtactacttgagatgttgaccggcagaagatcgatggacaaaaaccggcccaacggtgaacacaaccttgtggaatgggctagaccacatctgggagagagaagaaggttctacaagttgatagacccgcgcttggaaggtcacttttccataaaaggggctcagaaagctgcgcatctggccgctcactgccttagcagagatccaaaagcgcgacccttgatgagcgaagttgtggaagctttaaagcctctgccaaacctcaaggacatggctagttcgtcttattatttccagacaatgcaagccgaccgatttagcgtgagtccaaataccagaaacgggagaacacaaggagcgttgctcaccagaaacgggcaacagcaaaggagcctatcaattccacatggcactcatgcatctccatatcaccatcagtttccacaaccatcacctaaacccaatggcaaggcatagagttgatgatgatgatgatgagttttcattttctttgtcaccaccctttatttttcatcatttctcattccctaagtatagatgtcacttgtgcctagccatttgttcatggacaacttgagagcaaaagaagcatgcatgtatgtatgcatgcatgcttctttatggtgtatgtttagtgttgaccttagggcaggtgaaagcttattctgctgctactatctctagtgtcaaattgtcaaccgaaatgtttcttcaggttgtttcaaaatattcaagattattaactcaattttttatttttttttcatttgcccccagaaatgtcgtctcttggtttggttatgcttacttgtgctatcaaacaatgcggctccttaaattatctacaggctcttccttatggaaagatgagaaagaagcttcattgcattaaattatgtccaatgtttgttcctatatgtttagttaataccggcatttaatcccatttatgct

SEQ ID NO: 9770 - DNA, 2085 bp, Malus domestica
agcttgtgggagtccattttctgagatttctgcagacatttctgggttaaaactgaaaatttggctgttcctatctgataaaaaggacacttccctcttgggttttttttttttctttttccccacgagctgattgatttcgcttcaagggttcgtcgaatttgatctgctttccgcgtgatctatctgttttttcagccgggtcgtcttttttttcctctaaattcagtcgggtttttgtaaagttcggaaatttcagggattttggtgggtttttcgtatgggttgtgtcgacggcggatagaggcggttctgggtggttctgcgggggtgggaaggtggtgggtttgggtgtttgatggtatctggatttgatcgttttagggtttgtgagaaatgggtttgaaagctgaggatggtaaagtggaggcctgggacatctgcaaatcgaaggtgaggaggaagaagaagcagaaagctgatggggatgatgatgatgacgtggaggaggaggggagtgggtgttgggttaggctgaggtactttgggagctgcatttcttcaagatccaaagttgatagctcaatcagtgggaccagtaatactcactgtggtgaaactaaatctataaatgatacgagcagggaccaaccaacagctactgtagtctcttcatcaaccactagtaatacagaaagtaatgcatccacttccaaacttgaagaggaacttaaagttgcttcacggttgcgaaaattcacatttattgatcttaaatgggcaacaagaaatttcagacctgaaagtcttcttggtgaaggtggttttggttgtgtgttcaaggggtggatagaagaaaatggaactgctccagtaaaacctggcacaggtcttactgttgccgttaaaactcttaaccatgatggacttcagggtcataaagaatggctggctgaagtaaattatcttggtgaccttgtccatccaaacttagttaaacttgtaggatactgcattgaagatgatcaaaggctgctagtgtatgagttcatgcctcgagggagcttggagaaccatctatttaggaggtcgttgcctcttccatggtctattcgaatgaagattgcattaggtgctgcaaaaggccttgcttttctccacgaggaagcagaaagacctgtgatctatcgtgactttaaaacctccaacattttattggacgccgattataatgccaagctgtctgacttcggacttgccaaagatggtcccgagggtgataaaactcatgtctccacccgtgtgatgggaacttatggttatgcagctcctgaatatgtaatgactggacatcttacatccaggagtgatgtatatagttttggcgtggttttactcgagatgctgaccggcagaagatccatggacaaaaaccgacccaatggcgaacataaccttgtggaatgggcacggccacatctaggagaaagaagaagattctaccggttgatagaccctcggcttgaaggccacttttcgataaaaggtgtccaaaaagccgcacaactagctgcccactgccttagtcgagatccaaaagccaggcccctaatgagtgaagttgtggaagccttaaagcccctgccagccctcaaggatatggcaagctcatcatattatttccagacaatgcaaggtgaccgtgtcggttccagcccaaataccagaaacggcgtcagaccacaaggaggattgctgacgaggaacgggcatcatcagcagaggagcctttcgataccaaatggtacccatgcttctccatatcaccatcaatatccccatccatcgccaaaacctaatgtcaaaccgtaagatagggttggcagctgtctgtatcatttcccacctcctgtgagcaatcattttcttctttttcccccttttttcgcttcctcgatccgtacagatgtaattttcggttaaagcacttgttcttggaccaactggaaaagcagcagagattcatgtttgctttgatgttatgttttagaatgcaagggcaggtgaagcttctttgagcaaaaa

SEQ ID NO: 9771 - DNA, 2558 bp, Cicer arietinum
cagcaatagtgtttggagttatactgagtcagcttgcatagcataggactaaggagaacacaaacacagagacaaaccccatctctgagattgatgtgtgtgtctctctctcggagcatacctttctttgttaagctaacttgttctatatatctttttttcggttaaagggttggcattactctcttcatttttcttacaacctgatcaatctagggttcaagtaattttttttttcatttttcattttgtggggttttgattttcttcttcatgtgatctaccttccctcttttctcattttaaatttctgggatttttcagatttcctgttttgaagcttattgagtgataaagttgtgatttttaggttttatttgtgaattattcatctgggtttgttcttattttggttttaaggcattgtagggtgtatgggatttttggggttgttttttagttttgatgatttatgggtttgattatttagggcttaattgaaatggggttaggtggtgagaatgagaatggtaaggtgacagagtctttggatgtgtgtaaatcaaaagggagaaagaagaagaagaaacaagatggggtagttcaaaatgaagaagaaactggttgttggcttagtttcaggttcattggtagctgcatttcttcaagatccaaggttgatagctctgttagtggcaccagtactaattatgctgaaagtaaatcaactattgatacaagtagagaccaaccaatgcttccggtagtctcttcgacaaccactagtaatgctgaaagcaattcatccacttcaaaactcgaagaggagcttaaagttgcttccaggctgcgaaagttctgtttcaatgatcttaagttggcaacaagaaattttcggcccgagagtcttctcggtgaaggtgggtttggttgtgtgttcaaaggatggattgaagaaaatggaactgctccggtgaaacctggcacaggacttaccgttgctgtgaaaacccttaaccacgatgggctccagggtcataaagaatggctggctgaagtaaattatctcggtgatttagttcatccacacctcgtcaaacttataggctattgtatcgaagatgatcaaaggttgcttgtatatgaatttatgcctcgtggaagcctggaaaaccacttgtttaggagatcgttgcctctcccgtggtccattagaatgaaaattgcactaggagctgcaaagggacttgcttttcttcacgaggaagccgaacggccagtaatatatagggatttcaaaacttccaatatactattggatgcagattacaatgccaagctctcagactttggacttgcaaaagacggtccagaaggtgataaaacccatgtgtctactcgagtgatgggaacttatggttatgctgcaccggaatatgtcatgacagggcatcttacatcaagaagtgatgtgtatagttttggagtggtactacttgagatgataaccggtcgaagatctatggacaaaaaccggccgaacggtgaacataaccttgtggaatgggctagaccgcatctaggagagagaagaaggttctacaggttgatagaccctcgcttggaaggtcacttctcgataaaaggagctcagaaagctgcccatttggctgctcactgccttagccgagatcctaaagcaagaccactaatgagtgaagttgtagaagccttgaagcctctaccaaaccttaaagacatggctagttcatcgtactatttccagacaatgcaagccgaccgttttagtgcaagtccgaatactcgaaacgggagaacacaaggagcattgctagctcgaaatggacaacaaaggagcctttccatatcacatggtactcatgcttctccatttcaccatcagtatcctcaacattcaccaaaaccaagtggaaaggcacaaagttgatgttgatgaaatttcttcatattttctttgtcatcatttcttaatttctcagtatagatgtaacttcttgtgaagccatttgttcatggacaacttgagagggaaaaagaagcatgttgcttgctttataattatgatgtatgttaatgcttcgaaatgaatcccctattgcacaatacaacagatgcggagaccagtagatttggtaagaaaacttctatctccaaatcaaactttcttcacaactgttgttgcactgagcagctgctataggggatccaaatccgtaattattgttgacccttttgaatttaagggcatgtgaagcttattgagcaaactatgtctattgcaaaattgtcaaccaatatgtttctttcaggttgttttgaaatattcaagattgttaattcctcaagtttaattttattttatttcatttgggctttgaaatgtttttatctcttttgatttatgtatgatttcattgtggtatcaaagagtgcggctcattaaattaataactgccttttttgtttatggaaagatgagaaagaagctttattgcattaatttatgtcagttgtgt

SEQ ID NO: 9772 - DNA, 2079 bp, Fragaria vesca
ccttcttcttttgttgttttcctcacaaggctttgatcaaagtttggagctttcatggtttgtttgatctacttcctatgtgatctgccttcttttctcaactgggtcatctttttctgagccaaattgtgttgggtgtggaggaatgttttgaaatttggaaccttcttttggtgggttgtgttgggttgtgggggagaggttgaggtagtttgactggttttttgtgtgtgggggaaggctggtgggtttttggggcttttgatggtaattgggtttcagtgttttagggtttgtgagagatgggtttgggagctgagaatgggcaaatgaaagtgcaggcttgggatataagcaaatcgaaagtgaggaggaggaagaagaagaacgtagtggatgatggtgatgatgatgtggaggaaggggagactgggtgctggcttaggctgaggttttttgggagctgcatttcttcaagatccaaagttgatagctcaattagtggtaccagtactcactgtgaaatcaaatctacaaatgatacaagcagagaccaaccgatggctactgtagtgtctaactcaaccactagtaacgcagaaagtaatgcatccactgcgaaatttgaggaggaacttaaagttgcttcacggttgagaaaatttgcttttaatgatcttaaattggcaacaagaaatttcagacctgaaagtcttcttggtgaaggtggttttggttgtgtgttcaaggggtggatagaagaaaatggaaccgctccagtcaaacctggcacagggcttactgttgcggttaaaactctgaaccatgacgggcttcagggtcataaagaatggctggctgaagtaaatttccttggtgaccttgtccatccaaacttagtaaaacttataggatactgcattgaagatgatcaaaggctgctagtgtatgagttcatgcctcgagggagcttggagaaccacctatttaggaggtccttgcctcttccatggtctattagaatgaaaattgcattgggcgcggcaaaaggtcttgcttttcttcatgaggaggcggaaagacctgtgatttatcgtgactttaaaacctccaacatcttattggatgcagattacaatgccaaactatctgattttggacttgccaaagatggcccagagggtgacaagactcatgtctctacgcgtgtgatgggaacttatggttatgcagctccggaatatgtaatgactggacatcttacatcaaggagtgatgtctatagttttggcgtagttttacttgagatgctgacgggaagaagatctatggataaaaatcgacctaatggtgaacataacctggtggaatgggctcgaccacatctaggagatagaagaagattctaccgattgatagaccctcggctggaaggtcatttttcaataaaaggtgtacagaaagctgcacaattagctgcccattgccttagtcgagatccaaaagcaaggcccctaatgagtgaagttgttgaagcattaaaaccattgccaaaccttaaggatatggcgagctcatcttattatttccaaaccatgcaaggtgaccgagtaggatccagtccgaataccagaaatggtgtcagaacacaaggaggattgcttacaaggaatgggcacaggagcctttcaataccaaatggctcccatgcttctccatatcaccatcaatttccccatccatcaccgaaacctaatggaaaaacttaaggtagggttggcagctgtttgtgctagtcggcattcattttcccttctcttttctctttcacttcctcagtatagatgtatcatctgttaaattatttgttcctggacaactgaaaaggcaacagagagacgtgcttgcttgatgttatgtttagaggggtgacccctgggtagggaaaatgtaaaggcaggtgcggcttattgagcaaaatggctgtcatattggttaccaagattgttacctccctttacattgtatcctttgtcatcttatcccttcgattaatacaagtccctgtttcatagtcaa

SEQ ID NO: 9773 - DNA, 1897 bp, Rosmarinus officinalis
ataatcactattatttttactattttcatttgattccagctttgcttgttgcacagtgcaaactttttgtcaagcatgtgatctgcaatcactgaactcttcgtactccatctcagagtgaatttcagctcatattttcaactgggccgagttgatctttgagcttttttgtcccctaatttctatttcttttgggattttactaagagaaaaatcgttcattggagatttgggtttcttgaaaagagataaaaaagaaagttttctgcagtgatatttgacttatttttctgagatgagtctgagttgtttgaggtgattctgtggtatttgaatgattattggactactatttaaggaggaggtggaaaatttgggaaatctcggtagcttttgatgatttttgcttctgtggaagatgggattagctgatgatggcttaaaggttgaatcttggggtgttgagaaatcaaaagggaggaaggagatagatgatgatgcggtggaggagactggttgttggataaaattgaggtttattggtagctgtatttcttcaagatctaaagttgataactctcttagtggcatcagcactcatgaaagtaaatctacgaacgggacaagtatagatcaaccggttgccccggtaatcccatccaccaccaccagcaatgccgaaagcaattcttccagcagcaaactagaagaagaacttaaagtttcttctcggctgcggaagttcacgtttatcgaccttaagttggcaactagaaatttcagaccagaatccctcctcggcgaagggggctttggttgcgtgttcaaggggtggatcgaagagaacggcacagctccagttaaacctgggactggactcacagtcgccgtcaaaaccctgaatcacgatggacttcagggtcacaaagaatggctggctgaagtaagttttcttggtgatcttattcatcctaatttggttaaactgatcggttactgtattgaagatgatcagaggctgctagtctatgagttcatgcctcgcggaagcttggagaatcacctattcagaaggtctctgcctcttccgtggtctatcaggatgaaaattgctctcggtgctgcaaagggtcttgctttccttcatgaggaagcggaaaggccagttatctatcgtgatttcaaaacctccaacatcttgttagatgcagattacaatgccaaactctctgattttggtcttgccaaagatggcccagagggagataagactcatgtctctactcgtgtgatgggaacatatggttatgcagcaccggaatatgtgatgacagggcaccttacatcgaagagtgatgtctatagctttggggttgttctgcttgaaatgctaactggtagacgatccatggacaagaatcggcctaatggagagcataaccttgtagaatgggcaaggcctcatcttggagagagaagaaggttttatcgattgatagatcctaggcttgaaggtcatttttcaattaaaggtgcacagaaagctgcccagttggctgctcgctgcctcagccgcgatccgaaagtgagacctctaatgagcgaagttgtcgaagccttaaaacctttgccagctctgaaggacatggcaagctcatcctactatttccaaacgatgcaagctgaccgtgttggatccagcccaaataccagaaatggcattagatcacaggcagcaacattttcaaggaacgggcagcagcataggagtctgtcaataccaaatggttctcatgcttctccgtatcatcatcagttcccgcaaaactcacctaaaccaaatggtaaacaatagatgtagacgggcaagaatgcgtcacattcaccaatcttcatt

SEQ ID NO: 9774 - DNA, 2387 bp, Solanum lycopersicum
ctttttcttattgtgagaagccaagaactggtcagcactcagaatatttgagtcttttgttgagatttcaatatctttgagggagcagacatttttgggggttgcactttttttgaagtgggattatctgattacagcttagcttccacagtgtttggtgcttccaagtttattgctttgtaaggtcaagacaacaaagcatgtgatctgaagcaaagtttagctctttttgggactttgaatgtcatattatcttgatttttttccagttgggtctgagctattttatcggttttatgcttttaatcatctggggttgttgaaaaattgagtcttggagaagtggggtggatatttttttggaaattttctgttgcccctttgtgtatttccttctttttgagtgaatttagggaagtggggttttgattatttgtttgattttaggggtttttggtgattttaaggtgaagggtagagaaaagttgacatttttgtggagttgaggaggttgatgagggtgggtgggagggaggtggggttgttggtggggttttcatgatatttgagtttgattttaggtattgcaaaatatgggattaggtggtgatggtgaaaagggggagtcttgggatgtagagaaatcaaagggaaagaagaaagaggttgttgaagaggaaactggatgttggactaagttgtggtttattggtagctgtatctcttcaagatctaaagttgatagctccataagtggcatcagtactcactgtgaaagtaaatctacaaatgacacaagcagagaccaacctgttgcaccaattatctcatctacgactaccagcaatgcggaaagtaattcatccacctccaaacttgaagaggagcttaaagtttcttctcggcttcgaaaattcgcatttaacgatttgaagttggcaacaagaaacttcagaccagagtcccttcttggtgaagggggtttcggatgtgtcttcaaggggtggatcgaagagaatggcacagctcctgttaaaccagggacagggcttactgttgctgtgaaaacactaaatcatgatggacttcagggtcacaaagaatggctggctgaagtgaatttcctgggtgatcttgttcaccctaatttggttaaactgattggttactgcattgaagatgatcagagactgttagtttatgaatttatgcctcgaggaagcttggaaaatcatctattcaggagatccatgcctcttccttggtctatccgcatgaagattgctctgggtgctgcaaaaggtcttgcttttcttcacgaggaagcagaaagaccagtaatatatcgtgatttcaaaacatccaacattctactagatgcggattacaatgccaaactttctgattttggtcttgccaaagatggtcctgagggtgataagacacatgtttctactcgtgtcatgggaacgtatggttatgcagcccctgagtatgtgatgacagggcatctaacgtcaaagagtgacgtctacagttttggggtagttctacttgaaatgataacaggtaggagatcgatggacaagaaccgaccaaatggggaacacaaccttgttgaatgggcacggcctcatcttggtgaaagaagaaggttttacagattggtagatcctagacttgaaggtcatttttcaataaaaggtgctcagaaagctgcacagttggctgctcgttgccttagtcgtgatcccaaagttaggcctatgatgagtgaagtggttgaagccttgaagccattaccaaatcttaaagacatggccagctcatcctactatttccagacaatgcaagcagaccgagttggatcaagtccaagtaccaaaaatggcgttaggacacagggatcattctcgaggaatggacaacaacatcctagaagtctttcaatcccaaatggttctcatgcttctccataccatcagcagtttcctcagaactcaccaaaaccaaacggcaaaacttagtattattggattgacaagtaatctgtttctatcattcttttcgttttctctccagctatgaatatattttgttggccacctcccgttttgtcgttggatgaactggcaaaagggaaggagtgcacaattaacttaagttgtgatctttgaaaatgctgaactcccacttgaaaagaatgtattgtaagcggagctcaagtccatggagtaaatattgtgtcgaatgtacctctccctcagctgattttcgcaaatattcctattttcggcctatattttgatcttgttccttttaggcctgaaaacgtttaatgtttgttcatatatttttcaaccttacatatcaatatttgactgttg

SEQ ID NO: 9775 - DNA, 2117 bp, Capsicum annuum
gaatatttgagtcttttgttgagatttcaatatctttaagggagcaaacattttttttttgggaggtgttgcactttttttgaagtgggatttattatcttgattccagctttgcttttgcacagtgttttgttgcttcaagtttttctgctttttgatctgaaatcaaagtttagctctttttgaacactttgaatggaatattttcttgattttttcacttgggattcttgaaaatttggttcttggtgaagttgggacttctttttgatttttctttgtccctttttgtgtgtttttgttctttttgagtggattttgggaagtggggttgtgattatttgtttgattttaggggttgaggaggttgatgagggtggttgggagggttgtggggttgaaagttgagttctttgtgggtttttgatgatatctgagtttgattttagggattgcaaaatatgggattaggtggtgatggtataaagggggagtcttggaatgtagagaaagcaaaagggaagaagaagaaagacatttctgaagaggaaactggatgttggactaagttgtggtttattggtagctgtatttcttcaagatctaaagttgatagctccatcagtggtatcagcactcactgtgaaagtaaatctacgaatgacacaagcagggaccaacctgttgcaccaattatctcatctacgactaccagcaatgcggaaagtaattcatccacctccaaacttgaagaggagcttaaagtttcttctcggcttcgaaagtttgcgtttaatgatttgaagatggcaacgagaaacttcagaccagagtcccttcttggtgaaggaggttttggatgtgtcttcaaggggtggatcgaagagaatggcacagcacctgttaaaccagggacagggcttactgttgctgtgaaaactctaaatcatgatggacttcagggtcacaaagaatggctggctgaagtgaatttcctgggtgatcttgttcatcctaatttggttaaactgattggttactgcattgaggatgatcagagactcttagtttatgaatttatgccgcgaggaagcttggaaaaccatctgttcaggagatccatgcctcttccttggtctatccgcatgaagatagctctgggtgctgcaaaaggtcttgcttttcttcatgaagaagcagaaagaccagtaatataccgtgatttcaaaacatccaacattctactcgatgcggattacaatgccaaactttctgatttcggtcttgccaaagatggtcctgagggtgacaagacacatgtttctactcgtgtcatgggaacgtatggttatgctgctcctgagtatgtgatgacagggcatctaacgtcaaagagtgacgtctatagttttggtgtagttctacttgaaatgataacaggtaggagatcaatggacaagaaccggccaaatggggaacacaaccttgttgaatgggcacggcctcatcttggtgaaagaagaaggttttacagattggtagatcctagacttgaaggccatttttcaataaaaggtgcccagaaagctgcacagttggctgctcgttgccttagccgtgatcccaaagctaggcctatgatgagtgaagtggtcgaagccttgaagcctctgccaaatcttaaagacatggccagctcatcctactattttcagacaatgcaagcagaccgagttggatcaagtccaagtaccaaaaatggcgttagaacacaaggatcattctcgaggaatggacaacaacatcctagaagtctttcaatcccgaatggtactcatgcttctccataccatcagcagtttcctcagaactcaccaaaaccaaatggcaaaacttagtattattggattgacagtttatctgtttctaccattcttttcttctctccccagttatgaatatattttgttagccacctcccgttttgtcgctggatgaactggcaaaagggaaggagtgcacaattaatttagttgtgatctttgaaaatgctaaactcccaacttgaaaagaatgtactgtatgcggagctcaagtacatggagtaaatacttgtg

SEQ ID NO: 9776 - DNA, 1743 bp, Solanum phureja
gggttgttggtggggttttcatgatatttgagtttggttttaggtattgcaaaatatgggattaggtggtgatggtgaaaagggggagtcttgggatgtagagaaatcaaaggggaagaagaagaaagaggttgctgaagaggaaactggatgttggactaagttgtggtttattggtagctgtatttcttcaagatctaaagttgatagctccatcagtggcatcagcactcactgtgaaagtaaatctacgaacacaagcagagaccaacctgttgcaccaattatctcatctacaactaccagcaatgcggaaagtaattcatccacctccaaacttgaagaggagcttaaagtttcttctcggcttcgaaagtttgcatttaacgatttgaagttggcaacaagaaacttcagaccagagtcccttcttggtgaagggggtttcggatgtgtcttcaaggggtggatcgaagagaatggcacagcacctgttaaaccagggacagggcttactgttgctgtgaaaacactaaatcatgatggacttcagggtcacaaagaatggctggctgaagtgaatttcctgggtgatcttgttcaccctaatttggttaaactgattggttactgcattgaagatgatcagagactgttagtttatgaatttatgcctcgaggaagcttggaaaatcatctgttcaggagatccatgcctcttccttggtctatccgcatgaagattgctgtgggtgctgcaaaaggtcttgcttttcttcatgaggaagcagaaagaccagtaatataccgtgatttcaaaacctccaacattctactagacgcggattacaatgccaaactttctgattttggccttgccaaagatggtcctgagggtgataaaacacatgtttccactcgtgtcatgggaacgtatggttatgcagcccctgagtatgtgatgacagggcatctaacgtcaaagagtgacgtctacagttttggtgtagttctacttgaaatgataactggtaggagatcgatggacaagaaccgaccaaatggggaacacaaccttgttgaatgggcacgacctcatcttggtgaaagaagaaggttttacagattggtagatcctagacttgaaggccatttttcaataaaaggtgctcagaaagctgcacagttggctgctcgttgccttagtcgtgatcccaaagctaggccgatgatgagtgacgtggttgaagccttgaagccattaccaaatcttaaagacatggccagctcatcctactatttccagacaatgcaagcagaccgagttggatcaagtccaagtaccaaaaatggcgttagaacacagggatcgttttcgaggaatggacaacaacatcctagaagtctttcaatcccaaatggttctcatgcttctccataccatcagcagtttcctcagaactcaccaaaaccaaacggcaaaacttagtattattggattgacaagtaatctgtttctaccattcttttcgttttctctccagctatgaatatattttgttggccacctcccgttttgtcgttggatgaactggcaaaagggaaggagtgcacaattaacttaagttgtgatctttgaaaatgctgaactcccacttgaaaagaatgtattgtaagcggagctcaagtccatggagtaaatattgtgtcgaatgtacctctccctcagctaattttcgcaaa

SEQ ID NO: 9777 - DNA, 1715 bp, Nicotiana benthamiana
ttggtttgattttaatgatatctgagtttgattttagggattgaaaaatatgggattaggtaatgatgatggtgtaaaaggggagtcttgggatgtaaagaaatcaaaggggaagaggaagaataaagaagttactgaagaggaaactactggatgttggactaagttgtggtttattggtagctgtatttcttcaagatctaaagtcgatagctccatcagtggcatcagcagcaccaactgtgagagtaaatctacgaatgacacaagcagagatcaacctgttgctccaattatttcatctacaactactagtaatgctgaaagtaattcatccacctccaaacttgaagaggaacttaaagtttcttctcggcttcgaaagtttgcatttaatgatctgaagatggcaacaagaaacttcagaccagaatcccttcttggtgaagggggttttggttgcgtcttcaaggggtggattgaagagaatgggacagcaccagttaaaccagggacagggcttactgttgctgtgaaaacactaaatcatgatggacttcagggtcacaaagaatggctggctgaagtaaatttccttggtgatctcgttcatcctaatttggtcaaactgatcggttattgtattgaagatgatcagaggctattagtttacgaatttatgcctcgaggaagtttggaaaaccatctgttcaggagatccatgcctcttccttggtctatccgcatgaaaatagctctgggtgctgcaaaaggtcttgcttttcttcacgaggaagcagaaagaccagtaatataccgtgatttcaaaacatccaacattctgctagatgcggattacaatgccaaactttctgattttggcctcgcaaaagatggtcctgagggtgacaagacacatgtttccactcgtgtcatgggaacatatggttatgcagctcctgagtatgtgatgacaggacatcttacgtcaaagagtgacgtctacagttttggagtagttctacttgaaatgataacaggtaggagatcgatggacaagaaccggccaaatggagaacacaaccttgttgagtgggcgcggcctcatctaggtgaaagaagaaggttttacagattggtagatcctagacttgaaggacatttttctataaaaggtgctcagaaagctgcgcagttggctgctcgctgccttagccgtgatcccaaagcgagacctatgatgagtgaagtagttgaagccttgaagccgttgccaaatcttaaagacatggccagctcatcctactattttcagacaatgcaagcagaccgagttggatcaagtccaagtaccagaaacggcgttagaacacaaggatcgttctcgaggaatggacaacaacatcctagaagtcttccaattccaaatggttctcatgcttctccataccatcatcagtttcctcagaattcgcctaaaccaaatggcaaaacttagtattggattggcaattatctgtttctaccattctttttcttttctcctctagctatgaatatattttgtccacccccctttttgtcattggatgactggcaaaagggaaggagtacacaatttatttaagttgtgatttttggaaatcctgaactcccacttgaaaagaatgtattgtaagcagttgtcaagtccatggagtaaatatttgtgtcca

SEQ ID NO: 9778 - DNA, 2330 bp, Ricinus communis
gattagtgaatgcttatgcttctgtctatctaatagtcttgttctttattcttttagagatttatttctgttttctttggagcagacatttcctggtctttactgaggtttgttggttctgtttattaactaaaagaaaaccttttttctttcaaacgaagaaaaaaaagaaagaccaagattacgttccttgttgttgtttatctaaaatagttttcaccaacttgattacatttttaactcttaaaaattcaaaaaaggggttgtcattttggaccctgttcttgtgatctagccttttctctctcaactgggtttatttttctaagagaagtaattgttaaaatttggtttctttttccattttttaccctttccccttttgggttttgttaaagattagatttcttttggtgggggaagtgggatttgggagtggttgttttaatgaaaagtgggtctgggtgtggttctgagaatttagggttttctgaaaggagtagaggatgggattaggcagtgaagatgggaacagagcaaaagcatcttcttgggaagtgtgcaaaccaaagggaaggaataaaaagaagcaagatgttagtaatagcagcggtggtgctagccctggtgatgttgtagaggaggcagagacaggttgttggttcaagttcagatttataggaagctgcatttcttcaagatccaaagttgatagctccgtcagtggcactagtactcactgtgaaagtaaatctacaaatgatacgagcagagaccagccaactgctcccacaatctcatctacaactacaagtaatgctgaaagtaattcatccacttccaaacttgaagaggagcttaaaattgcttctcgactgcgaaaattcacatttaatgatcttaagttggcaacaagaaatttcagacctgagagtcttcttggcgaaggtggttttggttgtgtgttcaaagggtggattgaagagaatggaactgctccggtgaaacccggtacagggcttactgttgctgttaaaacccttaatcatgatgggcttcagggtcacaaagagtggttggccgaagtgaattatttgggtgatcttgttcatcctaacttggttaagctgatcggttactgcattgaagatgatcaaaggctactagtatatgagtttatgcctcgaggaagcttggagaaccacctatttagaagatctctgcctcttccatggtccataaggatgaaaattgcgctaggtgctgcaaagggtcttgcctttcttcatgaagaagcagagaggccagtcatatatcgtgattttaaaacctctaatatcctattagatgcggattataatgccaagctttctgattttggactcgccaaagacggtcctgagggagataagacccatgtatctactcgcgtgatgggaacatatggctatgcagcccctgaatatgtgatgactgggcatctcacatcaaggagtgatgtctacagttttggtgtggttttactggaaatgataacgggtagaagatctatggataagaaccgacccattggagaacacaaccttgtggaatgggctcgacctcatctaggagagagaagaagattctacagattgatagaccctcggcttgaaggccacttttctattaaaggtgctcagaaagcagcacaactggctgctcactgcctcagccgagatcccaaagccaggcccctgatgagtgaagttgtggaggtgctcaaacctctacccaatcttaaggacatggcaagctcatcttattattttcagtccatgcaagctgacaaaatagcatccagcccaaatgccaaaagtagcaaccgaacacaaggaggattattgaggaacggacagcaacaaaggagcctttcaataccaaatggttcccacgcgtctccttaccaccatcaatacccctttcaatccccgaaacccaatgggaaacagtagcacagggtcagtaatcatctgcatttcacgccccttttcaacattcatttctttttccccatgttcccagcatagatgtctcttctgtgaaagcaattgttcttggacataggaaaatgcaacagaggaacatgtctgctctatgttgtgtttagaatgatgccatcctggcaggggtagaatgttaggcaggtgaagcttatagagcgaaatgtctgtcagccatatgggtactacagaatgtcttgagatgtttaagatttttagctcattataacattttatccctttccaccaactgtcgtcctctttgtataaatctgaaatttaactgag

SEQ ID NO: 9779 - DNA, 2210 bp, Fagus grandifolia
cttagctttaaactggtcagcttgtaagagtccttgtctgagatttctgtatctatgagcagacatttctgggttccactgagatttgttgcttcactctggtttaagcttggtgtcttttttttctttttttttgtcttcttctttgtcaaaatctagttttttaacaagctgatctaattttgggtatttctaagttttagttaaaaattttgattcttttccttgtgatctagctctttcctcatctgggtttgtctaattttgtcagtctaagagggaaaaaaggtgaattttttagtactgtatggtaatttcctatgtgggatttgtttggtaaagaaagattgactagtggtggtgtggagggaggtgatgttttgggatttgagggttgtgatagtatgttgggtttgagagtttagggttagtgagagatgggattgggaggtgagaatggtaaagttgagacttgggaagtgggcaaatcaaagggtgtgaagaagaagaagaagaaggaggtagtggaagcaaaaaggtggtgtgggagaggaggagattgggtgttgggttaggttgagattccttgggagctgcatttcttcaagatccaaagttgatagctcaatcagtggaaccactactcattatgctgaaagtaaatcaacaaatgatacaagcagagaccaaccggcagctccaattgtctcatcctcaaccactagtaatgcagaaagtaattcatccacttccaaggttgaagaggagcttaaagttgcttctcgtctacggaaattttcatttaatgatcttaagttggcgacaagaaattttagacctgagagtcttcttggagaaggtggttttggctgtgtgttcaaggggtggattgaagaaaatggaactgctccggtgaaacccggcacagggcttactgttgctgtaaaaactctcaaccatgatgggcttcagggtcataaagaatggctggctgaagtgaagtttcttggtgatctggttcatcctaacctggtcaaacttattggttactgcattgaagatgatcaaaggctgctagtgtatgagttcatgcctcgagggagcttggaaaaccatctatttagaaggtccctgcctcttccgtggtccattaggatgaaaattgcactaggtgctgcaaagggtcttgcttttcttcatgcggaagcagaaaagccagttatatatcgtgattttaaaacctccaacatcctgctagatgcagactataatgcgaaactttctgattttggacttgccaaagatggtcctgagggtgacaagacccatgtttctacccgtgtgatggggacctatggttacgcagccccagaatatgtcatgacaggacatcttacttcaaggagtgatgtctacagttttggtgtggttctacttgaaatgctgactggcagaagatctatggacaaaaaccgacctaatggtgaacataacctggtggaatgggctcggccacatctaggagagagaaaaagattctaccggttgatagaccctcggctcgaaggtcacttttcaattaaaggagcccagaaagccgcacaactggctgcccactgccttagtcgggatccaaaagccagacccctgatgaatgaagttgtcgaagccttaaaacctctgccaaaccttaaggacatggcaagctcatcatattatttccagaccatgcaatccgaccgcatggggtccagcccaaacactagaaatggcaatgctagaaatggcatccgaacacaaggaggatccttttcaaggaatgggcagcagcagaggagcctttccataaatggttcccatgcttctccatatcacaatcattacccttatcaatcacctaaacccaatggtaaaccatagtattgcctttggtaatatatctgtttctttttccaccccattggcatcactcatttcttctttctttttttcctccctcggtatagatgtatcttctgttaaagcatttgttcttagacaactgaaaaaaagcaacagagaaacatgtttgctttaatgttgtgtttagagtggtgaactcccagcaggggagaaaatgtaagggcaagtgaagcttgttgagcaaaatgtgttatctcaaccaatgtatcttcagtttgtttttaaatatcaaagtgtattacatcctc

SEQ ID NO: 9780 - DNA, 2010 bp, Glycine max
acgagatgttgttggtgcagaagaggaggaccccatatctgtaactttgagagcggagattactgagttcagctcagtttcaatttctggggtttgtgggttacccggttttatgggttgttggcgtgtaaagttgtgatttttaggttatatttgggaatttgctatctggggttgtggtttttggaattgatggtatctgggtttctagggattgattgattggtagagatagagatagatggggttgggtggtgagaatggcaaggtggtggagtcttgggatgtgtgtaaatcaaaaggtgggaggaagaagaagaagaaaggggatgcagaagaagtggaagaaggggctgaggctgaggctgggtgttgggttaggttgaggtttattgggagctgcatttcttcaagatccaaggttgatacctcagtcagtgccagtggcatcagtactcattatgctgaaagtaaatcaactaatgatactagtagagaccaaccaacagctccagcagtctcttctacaaccactagtaatgcagaaagcaattcgtccacttccaagcttgaagaagagcttaaaattgcttccaggctgcgaaagttctctttcaatgatctcaagtcagcaacaagaaattttcggcctgagagttttcttggtgaaggtgggtttggttgtgttttcaaggggtggattgaagaaaatggaactgctccagtgaaacctggcacagggcttacggttgctgtaaaaaccctaaaccatgatgggctccagggtcataaagaatggctggctgaagtgaattttctcggtgatctagttcatccaaaccttgttaaacttgtaggttactgcattgaagatgatcaaaggttgctagtgtatgaattcatgcctcggggtagcctggaaaaccacttatttaggagatccatgcctcttccatggtccattagaatgaaaattgcactaggagctgctaagggtcttgcttttcttcatgaagaagctgaacgaccagtaatatatagggattttaaaacttcaaacatattactagatgcagactacaatgccaagctctcagactttggtcttgccaaagatggtccagaaggtgataaaacccatgtgtctactcgggtgatgggaacctatggttacgcagcaccagaatatgtcatgacaggtcatcttacatcaaaaagtgatgtgtacagttttggagtggtactacttgagatgttgaccggcagaagatccatggacaaacaccgacccaatggtgagcataaccttgtggaatgggctcgaccacatctaggagagaggagaaggttctacaggttgatagaccctcgcttggaaggtcatttttcggtaaaaggagctcagaaagctgcccagctggctgctcactgccttagtagagatccaaaatccagacccctaatgagtgaagttgtagaagctttaaagcctttgccaagcctcaaggacatggcaagctcttcatattatttccaggcaatgcaagctgaccgatttggagcgagcccgaacacaagaaacgggcgaatgcaaggtgcattgctcacccgtaatggacagcagcaaaggagcctttcaataccaaatggtacttatgcatctccatatcaccatcagtttccccaaccatcaccaaagcccaatggcaaagcctagagccagtgaaaattttctttttctccttcaccctttacaccatttcttagtttcttcttatagatgttccttctttcaaagcatctgctgctttatgatgttatgttaacttatgggagttgaccccctttagcttgaaagaatgtgagggttgagagcaaatgaagcttattattgagctactatgtcttgtctcaaactgtcattcaatattttcttcagggtgcttggaaatattgaaaactatcaaatcctcatccttatttttattttgtttttcacatttgtccccg

SEQ ID NO: 9781 - DNA, 2293 bp, Glycine max
ctctcatgtctcatcatccaacaataatagcagcaaccaacgaacgagatgttgttggtgcagaagaggaggaccccatatctgtaactttgagagcggagattactgagttcagctcaggtgctgttctctctgttctttctgccccctactctactcactttccattttccaattcccaatccatataccctccaaggttttttttttttttttacttaatgtgatccgttacttttgcccttttcagtttcaatttctggggtttgtgggttacccggttttatgggttgttggcgtgtaaagttgtgatttttaggttatatttgggaatttgctatctggggttgtggtttttggaattgatggtatctgggtttctagggattgattgattggtagagatagagatagatggggttgggtggtgagaatggcaaggtggtggagtcttgggatgtgtgtaaatcaaaaggtgggaggaagaagaagaagaaaggggatgcagaagaagtggaagaaggggctgaggctgaggctgggtgttgggttaggttgaggtttattgggagctgcatttcttcaagatccaaggttgatacctcagtcagtgccagtggcatcagtactcattatgctgaaagtaaatcaactaatgatactagtagagaccaaccaacagctccagcagtctcttctacaaccactagtaatgcagaaagcaattcgtccacttccaagcttgaagaagagcttaaaattgcttccaggctgcgaaagttctctttcaatgatctcaagtcagcaacaagaaattttcggcctgagagttttcttggtgaaggtgggtttggttgtgttttcaaggggtggattgaagaaaatggaactgctccagtgaaacctggcacagggcttacggttgctgtaaaaaccctaaaccatgatgggctccagggtcataaagaatggctggctgaagtgaattttctcggtgatctagttcatccaaaccttgttaaacttgtaggttactgcattgaagatgatcaaaggttgctagtgtatgaattcatgcctcggggtagcctggaaaaccacttatttaggagatccatgcctcttccatggtccattagaatgaaaattgcactaggagctgctaagggtcttgcttttcttcatgaagaagctgaacgaccagtaatatatagggattttaaaacttcaaacatattactagatgcagactacaatgccaagctctcagactttggtcttgccaaagatggtccagaaggtgataaaacccatgtgtctactcgggtgatgggaacctatggttacgcagcaccagaatatgtcatgacaggtcatcttacatcaaaaagtgatgtgtacagttttggagtggtactacttgagatgttgaccggcagaagatccatggacaaacaccgacccaatggtgagcataaccttgtggaatgggctcgaccacatctaggagagaggagaaggttctacaggttgatagaccctcgcttggaaggtcatttttcggtaaaaggagctcagaaagctgcccagctggctgctcactgccttagtagagatccaaaatccagacccctaatgagtgaagttgtagaagctttaaagcctttgccaagcctcaaggacatggcaagctcttcatattatttccaggcaatgcaagctgaccgatttggagcgagcccgaacacaagaaacgggcgaatgcaaggtgcattgctcacccgtaatggacagcagcaaaggagcctttcaataccaaatggtacttatgcatctccatatcaccatcagtttccccaaccatcaccaaagcccaatggcaaagcctagagccagtgaaaattttctttttctccttcaccctttacaccatttcttagtttcttcttatagatgttccttctttcaaagcatctgctgctttatgatgttatgttaacttatgggagttgaccccctttagcttgaaagaatgtgagggttgagagcaaatgaagcttattattgagctactatgtcttgtctcaaactgtcattcaatattttcttcagggtgcttggaaatattgaaaactatcaaatcctcatccttatttttattttgtttttcacatttgtccccggaaatgttatctcctgatttatttaggcttttcttgtgatatcaaaccctgcatctccccttaaattaatcactagctttttgtttatgaaaagatgagaaagaagcttt

SEQ ID NO: 9782 - DNA, 2316 bp, Phaseolus vulgaris
gaaaaatcataaatttttgttgagcatgttgtgtgtgctggtgcgaatgttgcagaggaggacccatatcagttatgtatgtttaagcggagattactgagttcagccaggtgctgttcactctgttctttctgcccccactctcctcacttcactttttatttcccaatacccaatccatctacccttcaagttttcttctttcctttttgttttgggtattttcacttcttaatgtgatctgttacttttccccttttcggtttttatttctgggtcttgtgggttactcggtttcaagggttgttgggttgtaaagttgtgatctttaggttttacttgggaatttgccatctgggctcgtgggagggtaggaggaggtggtattctgaattgaggatatctgggtttggttgtctaggaacttgcagagatgggcttgggtgctgagaatggtaaggtggtggagccttgggatgtgtgcaaatcaaaggggaggaagaagaagaaaggggatgaggaagtggaaggggctgggtctggttgttggcttaggctgaggtttattggcagctgcatttcctcaagatccaaggtcgatacctctgtcagtggcagtggcaccagtactcattatgctgaaagtaaatcaactaatgatactagtagagaccaaccaacggctccagcagtctcttctacaaccactagtattgcagaaagcaattcatccacttccaaacttgaagaggagcttaaaattgcttccaggctgcgaaagttccctttcaatgatcttaagttagctaccagaaattttcggcctgaaagttttcttggtgaaggtgggtttggttgtgttttcaagggttggattgaagaaaatggaactgctccagtgaaacctggcacagggcttactgttgctgtaaaaaccctcaaccatgatgggctccagggtcataaagagtggctggctgaagtaaattttcttggtgacctagttcatccaaaccttgttaaacttgtgggttactgcattgaaggtgatcaaaggttgctagtgtacgagttcatgcctcggggtagcctagaaaatcacttgtttaggagatccctgcctcttccatggtccattaggatgaaaattgccctaggagctgcaaagggtcttgcttttcttcatgaagaagccgatcgaccagtgatatatagggattttaaaacatcaaatatactattagatgcagagtacaatgccaagctctcagactttggtcttgccaaagatggcccagaaggtgataaaacccatgtgtctactcgagtgatgggaacctatggctatgcagctccagaatatgtcatgacaggtcatcttacatcaaaaagtgatgtgtacagtttcggagtggtgctacttgagatgttgactggcagaagatccatggacaaacacagacccaatggtgagcataaccttgtggaatgggctcggccacatctaggagagaggagaaggttctacaagttgatagaccctcgtttggaaggccacttttcggtgaaaggtgctcagaaagctgcccaactggctgctcactgcctttgtagagatccaaaagccaggcctctgatgagtgaagttgtagaagctttaaagcctttgccaaatctcaaggacatggcaagctcttcatattattaccagacaatgcaagctgaccgcattggagcgagcccgaacacacgaaacgggcgaacacaaggagcattgctcacccgcaatgggcaccagcaaaggagtctttctataccaaatggtacctatgcatctccttatcatcatcggtttcctcaaccatcaccaaaacccaatggcaaagcgtagtagagctggtgaaaattctcttttttccctttcaccttttatgtcatttcttaggttttccttgtagatgtaccttctgtcaaagcatctgttcatggagatgttgaaagaaaaagaagcatgttgctttatgatattatgttatggctttcgcttgaaagaatgtctggttgggagcaaatgaagcttattgagctactatctcttctgtcaaattgttattcaatattttcatcaggttgtttgaaaatattgaaaattatgaaatcctcatccttattttattttgtttttcacatttgtgatcggaaaatgttatctcctgatttatataggatttgcttgtgatatcaaaccctgcagctccttaaattaatcactgtctttcgtttataaaatgatgagaaagaagctttattggttaa

SEQ ID NO: 9783 - DNA, 2338 bp, Medicago truncatula
tggaattgtactgagtcagcttttctttgcacaacacaaacataaacacaaaccccatctccgagtttcatgtatctgtctctctccgaccatacctttctctgttaagctaacttgttctcttcttttctaccaaaactgttcccattactctcttcaatctaggtttcaaaagggtttcattttttgtttttattacattttagggcttttgatctgcttcatttgatctaccttccctgttttgccatttttaatttctgggttttgttggattttgtgttttatccgttattgagtgataaagttttgatttttaggttttatttggaaattaatcatctgggtcagtgtgttttgtggtggttaggcattgtagggtttgagggtgttttggttttgatgattgtttagggttttgatgaaaatgggattaggtggtgataatggtaaggtgattgagtctttggatgtgtgtaaatcaaaagggtggaagaagaagaagaaacaagatggggttatggaagatgaagaaactgaaactgggtgttggcttagttttaggtttattggaagctgcatttcttcaagatccaaggttgatagctctgttagtggcaccagtactaattatgctgaaagcaaatccaccattgatacaagtagagaccaaccatcggttccagttgtctcttcaacaaccactaccactagtaatgctgaaagcaactcatctacttcaaaagttgaagacgaaattaaagttgcttccaggctgcggaaattctctttcaatgatcttaagttggcaacaagaaattttcggcccgagagtcttctcggtgaaggtggatttggttgtgtgttcaaaggatggattgaagaaaatggaactgcaccagtgaaacctggcacaggacttactgttgcagtcaaaacccttaaccatgatggcctccagggtcataaagaatggctggctgaagttaattatcttggtgatttagttcatcaaaaccttgtcaaacttataggctactgtatcgaagatgatcaaaggttgctagtatatgaatttatgcctcggggaagcttggaaaaccacttgtttaggagatccttgcctcttccatggtccattaggatgaaaattgcgctcggagctgcaaagggacttgcttttcttcacgaggaagccgaacgacctgtaatatatagggatttcaaaacttccaatatattattagatgcagagtacaatgccaagctctcagactttggacttgcaaaggatggtccagagggtgataaaacccatgtgtctactcgagttatgggaacttatggttatgcagctccagaatatgtcatgacagggcatcttacatcaagaagtgatgtgtatagtttcggagtggtactacttgagatgataaccgggcgaagatccatggacaaaaaccgaccgaatggcgaacataacctcgtggaatgggctagaccgcatctaggagagagaagaaggttctacaggttaatagaccctcggctggaaggccacttctcgataaaaggagctcaaaaagccgcccatctggctgcccactgccttagccgagatccaaaagctagaccactaatgagtgaagttgtagaagctttgaagcctctcccaaaccttaaggacatggctagttcatcatactatttccagacaatgcaagctgaccgttttagtgcaagtccaaatactcgaaacggtagaacacaaggggcattcacgcgcaatggacaacaacaaagaagtctttccatatcacatggtactcatgcttctccgtttcatcatcagtatcctcaaaattcaccaaaaccaacaggaaaggcacagagttgatgaacttctcacaccttgctttttcatcgtttcttattttctaagtatagatgcaacgacttcttgtgaagccatttgttcatgggcaacttgagggtaaaagaagcatgctgctagctttatgttctattatgttaattggtgtcgacccctttgaatgtaatggccagcgtagcttattaagctaactatgtgcatgtttggaattacgacgagtttgacaagattataaccgcaccgtgattttgttgaagctcgacattgcagcttcatctaaaatcacggtgacacactatgattctggcaaactcaccgtcaattcaaatatgtattatgatgtcttttggaaattgtcaaccaatatgtttctttcaggttatttagaaaatattgaagattgttaactcctcaagttttattttattttatttcaattggccc

SEQ ID NO: 9784 - DNA, 2862 bp, Theobroma cacao
ttcatcaagaaagttactcaactatgccattctttcttctggaaagttaatgacagtcctgttaaggtgctcgtatcagttgggatttcatctgtcatcccaaatctaaaggtcttggggctgaaaaacttaaaggagtggagcaaaccatgtattctgaagaatacttggctaattcttatcaagtctggttctttatgggtggcttggacttcagcctatatcttggaaggcaggagcgaactttggctaggacagttatctgtcaggggcattctaaatttcatgtcaggactgtttgccagtgctattaggggggaaacaaatgaaggtctgactggcaaaaacttgtttggttcccttgtcaaattcccaaaggcactccctcattgcttggatgactgactctttgtcaggatattttgcacatgtctggtttacagaagcaaactggagattgacatcaagaatgctgttatctacttcacttggagggaaaggaactgcagacatttcttgggtcagaaagctaatacagtttcaggaaatcctggaagttcattgcagaaactatcagaggggaagctgagcagttttacaggcattgcaaagggatagtgtgaacaaatgctctctgtaactgtttttactgccaatgtgcatgtttttagctgtgaattctagttgctgcttctcagtattcaattgtagcaggccccctggttcgagtcaccgtgattgcaaaggatttatacttaaaaatatgtaaaagtatttgtattaaaaaatatttatatattatcacttaaacacaagtattatttataaatcttttaaatgtgtaaaataagtgaaaatacttattaaaaacaaaatggaaaagggaggcatgaatttttcaatgtcgacgcgcgcgttggcgtccgcccaccgaagtcggacacgtcaccatccaaggctagaagaagagagaagatgggattaggtttggaggaaggaaaggtgaagtcttgggatatgtgcaaatcaaagggaaggaagaagaagaaaaacagtgaaaaagaagatcttgatgatgaagctgtggtagaagaaacagggtgttgggttaagttgaggcttattggaagctgcatttctgcaagatccaaagttgatagttctgttagtgggaccagtactcattatgtcttgttgcgtggaaagataggtcttggaaacattgtgaaaactctcgttcttagcactagagctgattatagcaaatctgcgaatgataccagtagagatcaaccaacagctccagttgtctcgtctacaaccactagcaatgcagaaagtaatgcatctacttccaaacttgaagaagagcttaaagttgcatcccggttacggaagttcgcatttaatgatctaaagttggcaactagaaacttcagacctgagagtctccttggtgaaggtggttttggttgtgttttcaaagggtggatcgaggaaaatggaacagctcccgtaaaaccaggcactgggcttactgttgctgttaaaacactcaaccatgatggcctccagggtcataaagaatggctggccgaagttaattttcttggtgatctcgtccatcctaacttggttaaacttattggttattgcattgaagatgatcagagattgctagtgtatgagtttatgcctcgcggaagcttggaaaaccaccttttcagaagatccttgcctcttccgtggtccatacggatgaaaattgcactaggtgctgcaaagggtcttgcctttcttcatgaagaggcagaaaggccagtaatatatcgggatttcaaaacctctaacatcctactagatgcagactataatgcaaagctttctgattttggacttgccaaagatggtcctgagggagacaaaacccacgtatcaacccgtgtgatgggaacatacggatatgcagccccagaatacgtaatgactggacatcttacatcaagaagtgatgtctacagttttggtgtggttctacttgaaatgttgactggtagaagatccatggacaaaaaccgacctaacggagaacacaatcttgtggaatgggctcggcctcatctaggagagagaagaaggttctataggttgatagatcctaggcttgaaggtcacttctcaattaaaggtgctcagaaagctgcacagctggctgctcactgtcttagccgcgatccaaaagccagacctttaatgagcgaagtggtggaagccttgaagcctctaccgaatctcaaggacatggcaagctcatcgtattatttccagacaatgcaagcagaacgcatagggtccagtccgaatgctagaaatggtatccgaactcaagccggattgctttcaaggaatgggcagaggagcctttccattccaaacggttcccatgcttctccctatcaccataagtatccctatcagtcaccgaaacccaatggtaaaccataatgttgggtagttaattatcctttttttcctcgacctcttctcatcattttacttccttttccctttcttttttctcggtatagatgtattctgtcaaagcatttgttcccagacaatggaaaaagcaacagtgaaaacatgcttgcctcatgttgtgtttaggatgatagcctccccagcaggatagtcatggcaggtgaaagcttgtagagcacaatgccatgttaaccatctgttgctttaatctatttggaaatattaaagatttgctctctctcctttctgttttttcttccttgatgtacacaaagtgcttgtttcttggtagcatccgcttggctgtaagagttgcctgta

SEQ ID NO: 9785 - DNA, 2129 bp, Solanum phureja
gggccagcagacattttttgggggcactttttgaagtgggattatctgatacagtgttttgggacaagttttcttctttgaaggtcaagatggggttgttgatctgaatcaaaattagcttttttttggattcaatgtcatattttcttgaattcttgaactgggtctgagctatttcatctgtatatttattatttttgtctttttttccctgggtgttggaggattttgctctaaaggaagtgtatatatttggaattccctttttgggtctccattaggtcatgtttgtgctaattaggcaactttggttcagttgtttagctgataatttaagggtttggaaaaagatcagatttttggggtttgtgtgagggggttgatttgaagttggtaccttggagggtgagtgggggtgggatttgatgatttttgagtttgtttgttagtattgttaaactatgggattaggtggtgatggtgtaaagggggagtcttgggatgtagagaaatcaaagggaaggaagaaaaaagaaggggatgaggaggagactggctgctggatgaagttgaggtttattagtagctgtatttcctcaagatctaaagttgataactccatcagtggcatcagcactcgctgtgaaagtaaatcgacaaatgatacaagcatagaccagcctgttgctccaattatctcatccacaactacaagtaatgctgaaagtaattcttccacctccaaactcgaagaggaactaaaagttttttcgcagcttcggaagttcacattcaatgatttgaagttggctacaagaaactttagaccagaatcccttctcggtgaagggggttttggttgtgtctttaagggttggattgaagagaatggaacggcacctgttaaaccaggaacagggcttactgttgctgtgaaaactctaaatcatgatggacttcagggtcacaaagaatggctggcggaagtaaatttccttggcgatctcattcatcccaatttggttaaactaattggttactgtattgaagatgatcagaggttgctggtttacgaatttatgcctcgaggaagcttggaaaaccatctgttcaggaggtccctgcctcttccgtggtccatccgcatgaagatagcattgggtgcagcaaaaggtcttgcttttcttcacgaggaagcagaaagaccagtgatataccgtgatttcaaaacgtccaacattcttctagatgcggattacaatgccaaactttctgattttggacttgccaaagatgctccagagggcgacaagacccatgtttctactcgtgtcatgggaacatatggttatgcagctccagagtatgtgatgacaggacatttgacatcaaagagtgatgtctacagtttcggtgtagttctgcttgaaatgatgacaggtaggagatccatggacaagaaccggccaaacggggaacacaaccttgttgagtgggcacggccacatttgggtgaaagaagaaggttttataaattgatagatcctagacttgaaggccatttttcaataaaaggcgcgcagaaagctgcacagttggctgcacgatgccttagccgggatcccaaagtcagacctatgatgagtgatgtggtcgaagccttgaagcctttgccaaacctcaaggacatggccagctcctcctactatttccagacgatgcaagcagaccgagttggatcaagcccaagcccaaatacaagaaatgtccttagaacgcaaggatcattctcaaggaatggacaacaacaacaacaaccaagaagcctatcgattccaaatggtgctcatgcttctccataccgtcatcaactttctcagaattcgccaaatccaaatggcaaaccatagaattggattctgcagtgatctgtttttaccattcttttcctcaaccctctatgaatatattttgttgtgccaacatttatgcttgggtgattgacaagggaataggagtacacatcttacatgttgtgatctatgagagtgcttaactccttgaaaagagtgtggtgtaagcaccatggagtaaatatatttgtgtcagataaatcactcttcctattt

SEQ ID NO: 9786 - DNA, 2219 bp, Panax ginseng
gaaggggtgggtggaggggaaggaagggggttggcaatcatgggctttcagggctttgatgatatccgggtttgattatatagggtttgtgaaaaatggtattaagtggtgatggtgttaaagtagagtcttgggaagtgggcaaatcaaaagacaggaagaagaaagatggtgatgtggaagagagtggctgttggattaagttgaggtttattggcagctgtatttcatcaagatctaaagttgataattctattagtggcatcagtacgcactgcgaaagtaaatctacaaatggcactagcaaagaccaaccagctcctgtaatctcatcaactacaaccagtattgcagaaagtaactcttccacttccaaactagaagaggaactcaaagttgctactcggcttcggaaatttgcttttaatgatcttaagatggcaacaagaaattttagaccagagagtcttcttggtgaaggcggtttcggttgtgttttcaagggatggattgaagagaatggaactgcacctgtgaaaccaggcactgggcttactgttgctgtgaaaacgctcaatcatgacgggcttcagggtcataaagaatggctggctgaagtgaattttcttggtgaccttattcatccaaatttggttaagctgattggttattgcattgaagatgatcaacggctgctagtttatgaattcatgcctcgaggaagcttagagaaccacctgtttaggaggtccctgcctcttccatggtctatcaggatgaaaattgctcttggtgctgcaaaaggtctcgcttttcttcacgaggaagcagaaaggctagttatatatcgtgatttcaaaacatccaacattctactagatgcagaatacaatgcaaaactttctgattttggtcttgccaaagatggtccagagggagataaaactcatgtatctacccgcgtgatgggaacctatggttatgctgctccagaatatgtgatgacagggcatcttacgtcaaaaagtgacgtttacagctttggcgtggttctgcttgaaatgctgaccggtagaagatcaatggacaaaaaccgcccaaatggggaacataaccttgtggaatgggcaaggccacatctgggagaaagaagaaggttttataagttgatagaccctcggcttgaaggtcatttttcaataaaaggtgcccagaaagctgcacatctggctgctcgctgccttagccgggacccaaaagtcaggcctgttatgagtgaagtagttgaagtcttgaagcctctgccaaacctgaaggatatggcaagctcatcttactacttccagaccattcaagttgaccgggttgggtctagccctaatactagaaatgggttgaatggcattagatcacaggcgggatcattttcaagaaacggtcagcaacatccaaggagcctctcaatacggaacggttctcatgcttctccgtatcatcttcaccagttcccacatcattcaccaaaaccagagggtaaaccatagatagcactaggctgctgggaatatctgcgtcttttcccacaccttggactgtttcttcttcttccttattatgaaatatgttttggcggcccatttgatcttgtacttttgacaaagaaacggagaaagaaacacatgaattatgttgttatctttagagtgaccccttctgccaatgtaagaggaactgaagttcattgaagtaattgcttctgttttctgacaactattttaaaagtttttttttttttcccttttttttttttttttttttttttttatttttttttttttttttttttctttttttttttttttttttttttagtttttttttttttttttttttacttttttttttttttaaggtaactttaaaaaggttttaatttttttactttacgttatactttactactttaacaacctaaacgataacctctacgtacttagtaacttaacttacgtaaataactaaaatacgtacggtacctccctagtaccttactttttcactacttacctactttaaccttaaccaaaccctaaaaacctacctaaacttaaactaaactaactaaccccgtacttaaccgtttctttaccttttttaccttcctttacttttcttttttctttacgtttctttactcttagacttacactgtccgcttg

SEQ ID NO: 9787 - DNA, 2233 bp, Solanum lycopersicum
atctttttctgattgaggaggcagaaatggtcagcatatttgagtccttttgttaagatttcagtatctttggggcagcagacattttttgggggcactttttgaagtgggattatctgatacagtgttttttcctttgaaggtcaagatggggttgttgatctgaatcaaagttagcttttttttttggattcaatgtcatattttcttcaattcttgaactgggtctgagctatttcatctgtatatttattgtatttttgtccttttttaatacttggtgttggagggttttgctctaaaggaagtgtatatatttggaatttcctttttgggtctccattgggtcatgtttgtgctaattaggaaactttggttcagttgtttagctgataatttaagggtttggaaaaagatcagatttttggggtttgtgtgagggggttgatttgaagttggtatcttggaggggtgggtaaggtgggatttgatgatttttgagtttgattgttggtattgttaaactatgggattaggtggtgatggtgtaaagggggggtcttgggatgtagagaaatcaaagggaaggaagaaaaaagaaggggatgaggaggagactggctgctggatgaagttgaggtttattagtagctgtatttcctcaagatctaaagttgataactccatcagtggcatcagcactcgctgtgaaagtaaatcgacaaatgatacaaaaatataccagcctgttgctccaattatctcatccacaaccacaagtaatgctgaaagtaactcttccacttccaaactcgaagaggaacttaaggttttttcgcagcttcggaagttcacatttaatgatttgaagttggctacaagaaactttagaccagaatcccttcttggtgaagggggttttggttgtgtctttaagggttggattgaagagaatgggacggcacctgttaaaccaggaacagggcttactgttgctgtgaaaactctaaatcatgatggactacagggtcacaaagaatggctggcggaagtaaatttccttggcgatctcattcatcccaatttggttaaactaattggttactgtattgaagatgatcagaggttgctggtttatgaatttatgcctcgaggaagcttggaaaaccatctgttcaggaggtccctgcctcttccgtggtccatccgcatgaagatagcattgggtgcagcaaaaggtcttgcttttcttcacgaggaagcagaaagaccagtgatataccgtgatttcaaaacgtccaacattcttctagatgcggattacaatgccaaactttctgattttggacttgccaaagatgctccagagggcgacaagacccatgtttctactcgtgtcatgggaacatatggttatgcagctccagagtatgtgatgacaggacatttgacatcaaagagtgatgtctacagtttcggtgtagttctgcttgaaatgatgacaggtaggagatccatggacaagaaccggccaaacggtgaacacaaccttgttgagtgggcacggccacatttgggtgaaagaagaaggttttataaattgatagatcctagacttgaaggccatttttctataaaaggtgcacagaaagctgcacagctggctgcacgatgccttagccgggatcccaaagtcagacctatgatgagtgatgttgttgaagtcttgaagcctttgccaaacctcaaggacatggccagctcctcctactatttccagacgacgcaagcagaccgagttggatcaagcccaagccctaatacaagaaatgtccttagaacgcaaggatcgttctcaaggaatggacaacaacaaccaccaagaagcctttcgattccaaatggttctcatgcttctccataccgtcatcaactttctcagaattcgccaaatccaaatggcaaaccatagaattggattctgcagtggtctgtttttacctttcttttcttcaaccctctatgaatatattttgttgtgcctacaatttatgcttgggtgattgacaagggaataggagtacacattttacatgctgtgatctatgagagtgctcaactccttgtaaagagtgtaatgtaagcaccatggagtaaatatatttgtgtcaagataaatcactctgcctatttctcttcagcccacatcacaaggtgaactagcaaataaaag

SEQ ID NO: 9788 - DNA, 2329 bp, Rosmarinus officinalis
tcccttctttcagcaattgaagcagtcagcataattttgtgttttccgctgagattttgataccttttttcaagaggagacatttctggggtggtggcactgttttatttttatatttttccttctttccaagtgagattatagtcactattatttttactatgctcatttgattccagctttgcttgttgcatcgtggaaactttttgtcaagcatgtgatctgcaatcactgagctattcaccccatctcagagtgattttcagctcatattttcaactgggttttcagctattccccgattttttgttgtggatttgataggaaaaataattgttcttggaggtgggaagaatattctgtaatctttgtggtgtttggcccaagctgatctctgagccttttttgtcccctaatttctatttcttttgggagaatttaataagagaaaaatcgtttattggagattggggtttcttgtatagagataaaaagaaaaagagagttttcttcagtgatatttgactaatttttgtgagatgcgtctgagttgtttgaggtggtgattctatgggatttgaatgattattggagtactatttaaggaggaggtggaaaatttgggaagtcttggaagcttttgatgatttttgcttctgtggaagatgggattagctgatgatggcttaaaggttgaatcttggggtgttgagaaatcaaaagagaggaagaagatagatgatgatgcggtggagactggttgttggataaaattgaggtttatcggcagctgtatttcttcaagatctaaagttgataactctcttagtggcatcagcactcatgaaagtaaatcgacaaatgggacaactatagatcaaccggctgccccgggaatcccatccaccaccactagcaatgccgaaagcaattcttccagcagcaaactcgaagaagaactcaaagtttcttctcggctgcggaagttcacgtttattgaccttaagttggcaactagaaatttcagaccagaatctctccttggcgagggggggtttggttgcgtgttcaagggatggatcgaagagaatggcacagctccagttaaacccgggacgggacttaccgttgccgtcaaaaccctgaatcacgacggacttcagggtcacaaagaatggctggctgaagtgaactttttaggcgatctcgttcaccctaatttggttaaattaataggctactgtatcgaagatgatcagaggctgcttgtctacgagttcatgccacgaggaagcttggagaaccacctattcagaaggtcacttccgcttccttggtcgatcaggatgaaaatagctcttggagctgctaaggggctcacatttctccacgaggaggcggaaagaccagtgatataccgcgattttaagacatctaatatcttgctagatgctgaatataactccaaactttccgatttcggacttgctaaagatgctcccgacgaaggaaaaactcacgtgtctacacgcgtgatgggaacttatggttatgctgccccagaatacgtcatgacaggacaccttacgtcaaaaagcgacgtatacagcttcggcgttgtcctactcgaagtggtcacaggtcggagatcaatggacaagaaccggccaaacggggagcacaacctcgtggaatgggcacggccgcatctcggtgaccggaaacgcttctaccgtttgatagatccccgactcgaaggccacttctccatcaaaggcgcccaaaaggctgccctgctggcagctcgttgcctcagccgcgaccccaaagcgcggcctctaatgagcgaggtggtcgaggccttgaagcctctcccgaacctcaaagacatggctagctcgtcgtactacttccggacgatgcaagcggaccgggtcagctccagccccaacggcaagaacgggctgagaacacacggttctttctcaagaaacgggcagcatcagcagcacccgagaagcctctctataccgaatggctcccacgcctcgccgtaccaccagtttgctcataactcgcccaaaccaaatggtaaaccatagggtcgtcttctctgcgcgtctctcattgggcccaatatggatatagtctgtgttgtttgtggaaaaagtaatgagtgaagaagacgttatattgtggtaagaaaacgagattttagtgttgtagatagtgcatgtctcgtggtggtggggcttcgaccattctttgcccttaatttatacactttcaaatgtttttgattgattttctaattcagttttgccatctc

SEQ ID NO: 9789 - DNA, 1593 bp, Trifolium pratense
tttgagttttgatgatttttgggtttgattgtttagggcttgatacaataaaatggggttagatggtgtgaatggtaaggttatagagtctttggatgtgtgtaaatcaaaagggaggaagaaaaagaagttacaagatagggtaatggaagatgaagaaaatgaaactggttgttggcatagctttaggttcattggtggctgcatttcttcaagatccaaggttgatagttctgttagtggtaccggtactaattatgctgaaagtaaatcaactcttgatacaagtagagaccagccatcggttccggtagtctcttcgacgacgacgactactaccactactactagtaatgctgaaagcaactcttctacttcgaaaattgaagaagagcttaaagttgcttccaggctgcgaaagttctgtttcaatgaccttaagttggcaacaagaaattttcggcccgagagtcttcttggtgaaggtgggtttggttgtgtgttcaaaggatggattgaagaaaatgggactgctccggtgaaacctggcacgggacttaccgttgctgtcaaaaccctaaatcatgatgggctccaggggcataaagaatggctggctgaagtaaattatcttggtgatttagttcatcaaaaccttgtcaaacttataggctactgtattgaagatgatcaaaggttgctggtatacgaatttatgcctcgaggaagcctggaaaaccacttgtttaggagatccttgccacttccgtggtccataaggatgaaaattgcgctaggagctgcaaagggacttgcttttcttcacgaggaagctgaacgaccagtaatatatagggatttcaaaacttccaatatactattggatgcagagtataatgccaagctctctgactttggacttgcaaaagatgggccagagggtgataaaactcatgtgtctacccgagttatgggaacttatggatacgcagcaccagaatatgttatgacagggcatcttacatcaagaagtgatgtgtatagttttggagtggtattacttgagatgataaccgggcgaagatccatggacaaaaatcggccaaatggcgaacataaccttgtagaatgggctagaccgcatctaggtgaaagaagaaggttctacaggctgatagatcctcgattggaaggccacttctcgataaaaggagctcaaaaagccgcccagttggctgctcactgccttagccgagatccaaaagcaagaccactaatgagtgaagtcgtagaagctttgaagcctctcccaaacctaaaggatatggctagttcatcatactatttccagacgatgcaagctgaccgatttagtgcaagtccaaatactcgaaatggtagaacacaaggaggatccgcccgaaatggacaacaacaaaggagcctttcgatatcacatggtactcatgcttctccatttcaccatcagtatcctcaacattcaccaaagccaactggaaaagcgcagagttgatgaattttctgtcaccctactttttaatcatttcttattttctaagtatagatgtaaca

SEQ ID NO: 9790 - DNA, 2195 bp, Cicer arietinum
gcagcatagtgtttgtgtttgtgttgcagacgaggaggaccccatctccgatatttcatttttctcgagcggaagatttcttagttcacttcactttcttctcttaccacttcttcactctccacttcccaactattttcatcaaaatccaccctttcaagtttcgatttctgggttttcttagtttcaaggttttgatcttttttggattgtaaagttttgatttttagctttttcttttaaatttgtcatctggggttgttgtttttagggtggtgtgagtgtagggcattgaagggtgtttgaaattgtgtgttgttttttatgatatttaggttttggttcttttggtgttgttagagatggggttgttgggtggtggtaatggtgaagtagtggagtcttgggatgtgtgtaaatcaaagggggtgaagaagaggaagaagaataagaaaggtaaagagaatgagggtgttgttaaagaggaagaaactgggtgttgggttaggttatggttaattggtagctgcatttcttcaagatccaaagttgataactcggtcagcggtacaagtactcattatgctgatagtaaatcaactaatgatacaagtagaggccaacctaccgctacggtaatctcttctacaaccactagtaacacagaaagcaattcgtccacttctaaacttgaagaggagcttaaaattgcgtccaggctgcgaaaattctctttcaatgatcttaagttggcaacaagaaatttccggcctgaaagttttctcggtgaaggtgggttcggttgtgttttcaaaggttggatcgaagaaaatggaacggctccagtgaaaccgggcacagggcttactgtcgctgtgaaaacccttaaccatgatggacttcagggtcataaagaatggctggcagaggtaaattttcttggtgatctagttcatcaaaaccttgttaaactcataggttactgcattgaagatgatcaaaggctgctagtgtatgagttcatgcctcgtggaagcctggaaaatcacttatttaggagatccctgcctcttccatggtccattaggatgaaaattgcactaggagctgcgaagggtcttgcctttcttcatgaagaagctgaacgaccagtaatatacagggattttaaaacgtcgaatatactactagatgcggactacaatgccaagctctcggattttggtctcgccaaagatggtcctgaaggtgataaaacccatgtgtctactcgagtgatgggaacctatggttacgcagcaccagaatatgtcatgacaggtcatcttacatcaaaaagtgacgtgtacagtttcggagtcgtactacttgagatgttgtccggcagaagatctatggacaaacaccgacccaacggcgagcataatcttgtcgaatgggctcgaccgcatctaggagagcgaagaaggttctaccgactaatagaccctcgtcttgaaggccacttttccataaaaggagctcagaaagccgctcaactcgcagctcactgtctcagtagagatccaaaagccagacccctaatgagtgaagttgtggaagctttaaagcctctaccaaaccttaaggacatggcaagctcttcatactatttccaaacaatgcaagccgaacggttcggagcgagtccaaactctagaagtgtacatgcacaaggaccgttcgcccggaacggtcaacagcgaaggaccctttcgataccgaatggcactcatgtgtctccttatcaccataagtttccgcaacaatcgcctaaacctaatggcaaagcgtagagatggcgaaaattttccttttattttttatccatatagatgtatgtactatgtttcttcagattgtttggaaatattgaaacattattttactttgttttaatttttttccattttcacttggaaatgttatctttgatttctttaggatttgcttgtgatgtcaaacactatggttctttaaattaatcacaaggcttttgtttatagaaagatgagaaaggaactttaatgtatattaatttatgttagttgtatgttccctataagatctaggaaatgattggttgctttatttaactataaggtgctctttattatgctttatagcatagcatgttctaatagttgaaaattcaa

SEQ ID NO: 9791 - DNA, 2228 bp, Trifolium pratense
accgtcgatagcttagcactttgaaaccgtctctgtgtcgtctcccgccgtgaccaccggcctcaactctccgtcgtcctgccgctccggcgaacttcaacctgatcaatctagggttcaacatatttttgtttattagggcttttgatctgcttcatttgatctaccttccctctttcctcattttcaatttctgagttttgttggatttcatgttttgagcgttattgagtggtaaagttgtgatttttagattttatttgggaatttttcatctgtgtttgtggttgttgttgtggtggtggtggttactggctagtggctttatagggtgtttgagttttgattatttttgggtttgattgtttagggcttgataaaaaaaatggggttaggtggtgtgaatggtaaggtgatagagtctttggatgtgggtaaatcaaaagggaggaagaaaaagaagttacaaaatggggcaatggaagatgaagaaaatgattctgggtgttggcatagctttaggttcattggtaactgcatttcttcacgatccaaggttgatagttctgttagtggtaccagtaataattatgctgaaagcaaatcaactattgatacgagtagagaccagccatcagttccagtagtctcttcgacgactactactactagtaatgctgaaagcagctcatctacttcgaaacttgaagaggagcttaaaattgcttccaggctgcgaaagttctctttcaatgatcttaagctggcaacaagaaattttcggcccgagagtcttcttggtgaaggtgggtttggttgtgtgttcaaaggatggattgaagaaaatggaactgctccagtgaaacctggcacaggccttactgttgcagtcaaaaccctaaaccatgatgggctccagggtcataaagaatggctggctgaagtaaattatcttggtgatttagttcatcaaaaccttgtcaaacttataggctactgtattgaagatgatcaaaggttgctggtatatgaatttatgcctcgaggaagcctggaaaaccacttgtttaggagatccttgccacttccgtggtccataaggatgaaaattgcgctaggagctgcaaagggacttgcttttcttcacgaggaagctgaacgaccagttatatatagggattttaaaacttccaatatactattggatgcagagtacaatgccaagctctcagactttggacttgcaaaagatggtccagagggtgataaaactcatgtgtctacccgagttatgggaacttatggttacgcagcaccagaatatgtcatgacagggcatcttacatcaagaagtgatgtgtatagttttggagtggtactacttgagatgataaccgggcgaagatccatggacaaaaaccgtccaaatggtgaacataaccttgtagaatgggctagaccgcatctaggagagagaagaaggttctacaggttgatagaccctcgattggaaggccacttctcgataaaaggagctcaaaaagccgcccagttggctgctcactgccttagccgagatccaaaagcaagaccactaatgagtgaagttgtagaagctttgatgcctctcccaaacctaaaggacatggctagttcatcatactatttccagacgatgcaagctgaccgatttagtgccagtccaaataatcgaaatggtagaacacaaggaggatccgcccgaaatggacaacaacaaaggagcctttccatatcacatggtactcatgcttctccatttcgccatcggtatcctcaaaattcaccaaagccaactggaaaagcacagagttgatgaattttctatcaccctactttttaatcatttcttattttctaagtatagatgtaacaacttcttgtgaagccatttgttcatgggacaacttgagggtaaaagaagcatgctgcttgctttatgatctattatgttaatgagtcttgacccctttgaatagttattgagctaactatgtgtatgtttggaatcacagtgagttcaacgacattacagtagtaccatgattttgttgaagctcgaagttgtagctttagttaaaatcatggttgcacactgtgcttctgccgaactcaccgtaattccaaacatgaactatgtgttttgcaaattgtcaaccaatgtttctttcaggttgtttggaaatatt

SEQ ID NO: 9792 - DNA, 2489 bp, Panax ginseng
ccgggcagttccgatttgcttttgttagtcttcgattctatagtttaaaaagtataggaagtaggaattgataaattcactcctcaaatttcattttcatttgagaaatttatatatctaatatatgtatatgtatatatgatgatttttgaggtttgaattggagttcttctttttctttttttatagagatttcagtatctttgcggagcagacatcagtgtacttttgaagtgagattgattttccgatacagcttgcaccgtgtcttgtgcttgttgggcatgtgatctgaatttgcttaaactctttgtggaggtgttaaaaatatcatctttatgcgaaatcttgaattgggtctgagtaatttcatcggatgtttgttgggttttcggagaaacattggttttctgcaagtcaaaagattattcttagtttcagctatgtgaggggtgctggaggctttactattatcttttgctgattgatgaactggttttcagttatttttgccagattatttgggtattgagaaaaatattcttagggcgaaggactggtaaccgcaggaaactctttttgtggttgcgtgtaaggggagggggctggaggggaatttttggatttggggctttgatgatatcttggtcctattatagggttgtgaaaaatgggattgagtggtgatggtgttaaagtagagtcttgggaagtgggcaaatcgaatgataggaagaagaaagatggggatgtggaagagactggctgttggattaagttgaggtttattggcagctgtatttcatcaagatctaaagttgataattctataagtggcatcagtacacactgtgacggtaaatgtacaaatgacaccggcaaagaccaaccagctcctgtaatctcatcaactacaactagcattgcagaaagtaactcatccacttccaaacttgaagaggaacttagagttgcttctcggcttcggaaattcgcttttaatgatcttaagatggcaacaagaaattttagaccggagagtcttcttggtgaaggcggttttggttgcgtatttaaggggtggattgaagagaatggaacggcacctgtgaaaccaggcactggtcttactgttgctgtgaaaaccctcaatcatgatggacttcagggtcacaaagaatggctggctgaagtgaattttcttggtgatctcattcatccaaatttggttaagctgattggttattgcattgaagatgatcaacgattgctagtttatgagttcatgtcacgaggaagcttagagaaccacctgtttaggaggtcccttcctcttccatggtccatcaggatgaaaatttctcttggtgctgcaaaaggtcttgcttttcttcacgaagaagcagaaaggctagtgatatatcgtgatttcaaaacttctaacattctattagatgcagaatacaatgcgaagctttctgattttggtcttgccaaagatggtccagaaggagataaaactcatgtatctacccgtgtgatgggaacctatggttatgctgctccagaatatgtgatgacaggacatctgacatcaaaaagtgacgtctacagctttggtgtggttctgcttgaaatgctgactggtagaagatcaatggacaagaaccgcccaaatggggaacaaaaccttgtggaatgggcaagaccacatctgggagaaaggaagaggttttataggttgatagaccctaggcttgaaggtcatttttcgataaaaggtgcccaaaaggctgcacacctggctgctcgctgccttagccgagacccaaaagtcaggcctctaatgagtgaagtggttgaagccttgaagcctctgccaaacctaaaggacatggcaagttcatctttttacttccagaccattcaagctgaccggattgggtctagcccaaatactagaaatgggtcaaatggcattcgatcacaaggtggatcattttcaagaaatgggcagcaacatccaaggagcctctcaataccgaacggttctcatgcttctccatatcatcatcagttcccgcattattcaccaaaacctcaaggtaaaccataggtagcggctaggctgggatttgtgtttcttttcccacacactgtaccgtactctaccctcttttttgttctttctttgcaaccccccttttttctgattataaatatatttagtccgcccatttggtcttggacgtctgggaaagaataggatgaacacatgaataatgttgggatctttagagtgactactcccacccagtgcgggagaatgtaatgtaagaggagctgaaattcattgaagtaaatgcttctgtttggattataaattgtaatctacctatttttggggatgtgttatgaattacgaagttaacctagccactcatcatccttcataagcctcggatgctaatgatgtctatttcttaaaa

SEQ ID NO: 9793 - DNA, 2416 bp, Rosmarinus officinalis
atttttatatttttccttctttccaagtgagattatagtcactattatttttactatgctcatttgattccagctttgcttgttgcacagtgcaaactttttgtcaagcatgtgatctgcaatcactgaactcttcgtactccatctcagagtgaatttcagctcatattttcaactgggttttcagctattcgcagatttcttcttgtggatttgataggaaaataattgtttcttggaggtgggaagaatattctgtaatcttttgtggtgtttgcgccgagctgatctttgagcttttttgtcccctaatttctatttcttttgggattttactaagagaaaaatcgttcattggagatttgggtttcttgaaaagagataaaaaagaaagttttctgcagtgatatttgacttatttttctgagatgagtctgagttgtttgaggtgattctgtggtatttgaatgattattggactactatttaaggaggaggtggaaaatttgggaaatctcggtagcttttgatgatttttgcttctgtggaagatgggattagctgatgatggcttaaaggttgaatcttggggtgttgagaaatcaaaagggaggaaggagatagatgatgatgcggtggaggagactggttgttggataaaattgaggtttattggtagctgtatttcttcaagatctaaagttgataactctcttagtggcatcagcactcatgaaagtaaatctacgaacgggacaagtatagatcaaccggttgccccggtaatcccatccaccaccaccagcaatgccgaaagcaattcttccagcagcaaactagaagaagaacttaaagtttcttctcggctgcggaagttcacgtttatcgaccttaagttggcaactagaaatttcagaccagaatccctcctcggcgaagggggctttggttgcgtgttcaagggatggatcgaagagaatggcacagctccagttaaacccgggacgggacttaccgttgccgtcaaaaccctgaatcacgacggacttcagggtcacaaagaatggctggctgaagtgaactttttaggcgatctcgttcaccctaatttggttaaattaataggctactgtatcgaagatgatcagaggctgctcgtctacgagttcatgccaagaggaagcttggagaaccacctattcagaaggtcgctgccgcttccgtggtcgataaggatgaaaatagctctaggagccgctaaggggctcgcgtttctccacgaggaggcggaaagaccggtgatttatcgagattttaagacatctaacatcttgctagatgctgaatataactccaaactttccgatttcggacttgctaaagatgctcctgatgaaggaaaaactcacgtgtctacacgcgtgatgggaacttacggttatgcagccccggaatacgtcatgacaggacaccttacatcaaaaagtgacgtatacagcttcggcgttgtcctacttgaagtggtgacaggtcggagatcaatggacaagaaccggccgaacggggagcacaacctcgtggaatgggctcggccgcatctcggagacaggaaacgcttctaccgtttgatagatccccggctcgaaggccacttctccatcaaaggtgcccaaaaggccgcccagttggcagctcgttgcctcagccgcgaccccaaagtgaggcctctgatgagcgaggtggtcgaggccttgaagcctctcccgaacctcaaagacatggcaagctcgtcgtactacttccagacgatgcaagctgaccgagtcagcgccagccccaacgggaagaatgggctgagaacacaagggtcgttcttgagaaacgggccgcatcagcatcagcagcatccgagaagcctctcgataccgaacgggtcccacgcctcgccataccaccagtttgctcataactcgccaaaaccgaacggtaaaccatagcgtcgtcctctctctcacatggcgcccaatatggatatagtttgtgttgttgatgggggaaaaaggaatgagtgaagaagacgttgtattgtggtaaaaaaacgagattttagtgttgtagatagtgcatgtctcgtggtcgttgggcttcgaccattctttgccctcaattcatacactattgattttctaattcattttgccgtctcactctatgaagggatgatttcttgttaaaagatgatcacttttatatcgcatgctaatccagaaattttaattacaatatgaaataaaaaccggattaatttgaaaatagacccaatacattggatggaattctgaaagactagcaataaatatgcccgatgattattgaaaactaaattcgaaacaatcaagagcaaacctaaggaatc

SEQ ID NO: 9794 - DNA, 2339 bp, Panax ginseng
gagaaatttatatatctaatatatgtatatgtatatatgatgatttttgaggtttgaattggagttctttttcttttctcttttatagagacttcagtatctttgcggagcagacatcactgtgtacttttgaagtgagattgattgtccgatacagcttgcaccgtgtcttgtgcttgttgggcatgtgatctgaatttgcttaaactctttgtggaggtgttaaaaatatcatctttatgcgaaatcttgaattaggtctgagtaatttcatcggatgtttgttgggttttcggagaaatattggttttctgcaagtcaaaagattattctcagtttcagctatgtgaggggtgctggagggactttactattatcttttgctgattgatgaactggttttcagttatttttgccagattatttgggtattgagaaaaatattcttagggcgaaggactgctaaccgcaggaaactctttttgtggttgcgtgtgtaaggggagggggctggaggggaatttttagatttggggctttgatgatatcttggtcctattatagggttgtgaaaaatgggattgagtggtgatggtgttaaagtagagtcttgggaagtgggcaaatcgaatgataggaagaagaaagatggggatgtggaagagactggctgttggattaagttgaggtttattggcagctgtatttcatcaagatctaaagttgataattctattagtggcatcagtacacactgtgcagacagtaaatgtacaaatgacaccggcaaagaccaaccaactcctgtaatctcatcaactacaactagcattgcagaaagtaactcatccacttccaaacttgaagaggaacttagagttgcttctcggcttcggaaattcgcttttaatgatcttaagatggcaacaagaaattttagaccggagagtcttcttggtgaaggcggttttggttgcgtatttaaggggtggattgaagagaatggaacggcacctgtgaaaccaggcactggccttactgttgctgtgaaaaccctcaatcatgatggacttcagggtcacaaagaatggctggctgaagtgaattttcttggtgatctcattcatccaaatttggttaagctgattggttattgcattgaagatgatcaacgattgctagtttatgagttcatgtcacgaggaagcttagagaaccacctgtttaggaggtccctccctcttccatggtccatcaggatgaaaatttctcttggtgctgcaaaaggtcttgcttttcttcacgaagaagcagaaaggctagtgatatatcgtgatttcaaaacttctaacattctattagatgcagaatacaatgcaaagctttctgattttggtcttgccaaagatggtccagaaggagataaaactcatgtatctacccgtgtgatgggaacctatggttatgctgctccagaatatgtgatgacaggacatctgacatcaaaaagtgacgtctacagctttggtgtggttctgcttgaaatgctgactggtagaagatcaatggacaagaaccgcccaaatggggaacaaaaccttgtggaatgggcaagaccacatctgggagaaaggaagaggttttataggttgctagaccctaggcttgaaggtcatttttcgataaaaggtgcccaaaaggctgcacacctggctgctcgctgccttagccgagacccaaaagtcaggcctctaatgagtgaagtggttgaagccttgaagcctctgccaaacctaaaggacatggcaagttcatcttattacttccagaccattcaagctgaccggattgggtctagcccaaatactagaaatgggtcaaatggcattcgatcacaaggtggttcattttcaagaaatgggcagcaacatccaaggagcctctcaataccgaacggttctcatgcttctccgtatcatcatcagttcccacattattcaccaaaaccgcaaggtaaaccataggtagcggctaggctgggatttgtgtttcttttcccacacactgtaccgtactctaccctcttttttgttctttctttgcaaccccccttttttctgattataaatatatttagtccgcccatttggtcttggacgtctgggaaagaataggatgaacacatgaatgatgttgcgatctttagagtgaccactcccacccagtgcgggagaatgtaatgtaagaggagctgaaattcattgaagtaaatgcttctgtttggattataaattgtaatctacctatttttggggatgtgttatcttatgaattaccaa

SEQ ID NO: 9795 - DNA, 2344 bp, Panax ginseng
atttatagtatgatgatttattgaggtttgaactggtcagcttattggagtgtttttgttgagatttcagtatctttgaggagcagacatcagtgtacttttggagtgagattgtctgatacagcttacacctgtgtaatgtgcctgggcatgcgatctgaatctactcacctatttttattggcgttgaaaaaaaattcatctttatgtgaaattttgaattgggtctgattgattaatttcatcttatatctttgtgggttttaagagagaaaacattggtgtttctgcaagtcaaaaagttcttctttttctgtttctgctatgtgagggatggtggagggggctttagcattatcttttgctgatttctgagctgggttttcaattattttacccgattatttgaggatattgagaaagattttctgaaggtgaaggactggtaggaaattctttttgtgggtggtccgaaggggtgggtggaggggaagaagtgggttggcaatcatgggctttcagggctttgatgatatccgggtttgattatatagggtttgtgaaaaatggtattaagtggtgatggtgttaaagtagagtcttgggaagtgggcaaatcaaaagacaggaagaagaaagatggtgatgtggaagagagtggctgttggattaagttgaggtttattggcagctgtatttcatcaagatctaaagttgataattctattagtggcatcagtacgcactgcgaaagtaaatctacaaatggcactagcaaagaccaaccagcttcctgtaaatctcatcaactacaaccagtattgcagaaagtaactcttccacttccaaactagaataggaactcaaagttgctactcggcttcggaaatttcgcttttaatgatcttaagatggcaacaagaaattttagaccggagagtcttcttggtgaaggcggtttggttgccgtatttaaggggtggattgaagagaatggaacggcacctgtgaaaccaggcactggccttactgttgctgtgaaaaccctcaatcatgatggacttcagggtcacaaagaatggctggctgaagtgaattttcttggtgatctcattcatccaaatttggttaagctgattggttattgcattgaagatgatcaacgattgctagtttatgagttcatgtcacgaggaagcttagagaaccacctgtttaggaggtccctccctcttccatggtccatcaggatgaaaatttctcttggtgctgcaaaaggtcttgcttttcttcacgaagaagcagaaaggctagtgatatatcgtgatttcaaaacttctaacattctattagatgcagaatacaatgcaaagctttctgattttggtcttgccaaagatggtccagaaggagataaaactcatgtatctacccgtgtgatgggaacctatggttatgctgctccagaatatgtgatgacaggacatctgacatcaaaaagtgacgtctacagctttggtgtggttctgcttgaaatgctgactggtagaagatcaatggacaagaaccgcccaaatggggaacaaaaccttgtggaatgggcaagaccacatctgggagaaaggaagaggttttataggttgatagaccctaggcttgaaggtcatttttcgataaaaggtgcccaaaaggctgcacacctggctgctcgctgccttagccgagacccaaaagtcaggcctctaatgagtgaagtggttgaagccttgaagcctctgccaaacctaaaggacatggcaagttcatctttttacttccagaccattcaagctgaccggattgggtctagcccaaatactagaaatgggtcaaatggcattcgatcacaaggtggttcattttcaagaaatgggcagcaacatccaaggagcctctcaataccgaacggttctcatgcttctccgtatcatcatcagttcccacattattcaccaaaaccgcaaggtaaaccataggtagcggctaggctgggatttgtgtttcttttcccacacactgtaccgtactctaccctcttttttgttctttctttgcaaccccctttttcttgattataaatatatttagtttcgcccactttggttcttggacggtctgggaaggaataggatgaacacatgaatgatgttgcgatctttagagtgaccactcccacccacgtgcgggagaatgtaatgtaagaggagctgaaattcattgagtaaatgcttctgtttggtattataaattgtaatctacctattttagttcgtgggagggcaaggcacacagggggagtaggggg

SEQ ID NO: 9796 - DNA, 2022 bp, Lotus japonicus
ttgtgtgtgatgcagagagagagagagagaagaggaccccatatctgaattctctctgtaatctttgagcggagatttctgagttcacttcagctcagctcagctgcttccgtttctcttcactctgctttttcctttccttgttttttttttcctcggttttatttcggaatttgtcatctggggttgtggtttcatggttgtggtagtgggagggtaaggcattgaagggtggttttgatgatatttgggtttggttctctaggtcttgctagagatggggttgggtgctgagaatggtgctaaggtggtggtggagtcttgggatgtgagtaaatcaaaagggaggaagaaaaagaagaaggaggttgagggggtggtggaagaggaagaaactgggtgttgggttgggtttaggttcattgggagctgcatttcttcaagatccaaggttgatagctcggtcagtggccccagctctcattatgctgaaagtaaatcaactaattatacaagtagggaccaacaaacagctccagtagtcccttctacaaccactagtaatgcagaaagcaattcatccacttccagacttgaagaggagcttaaaattgcttccaggctgcgaaaattttgtttcaatgatcttaagttggcaacaagaaattttcggccagagagttttcttggtgaaggcgggtttggctgtgttttcaaggggtggatcgaagaaaatggaactgctccagtgaaacctgggacagggcttactgttgcggtaaaaaccctgaaccatgatgggcttcagggtcataaagaatggctggctgaagtaaattttcttggtgatctagttcacccaaaccttgttaaacttgtaggttactgcattgaagaggatcaaaggctgctagtttatgagttcatgtctcggggaagcctcgaaaaccacttatttaggagagccctgcctcttccttggtccattagaatgaaaattgcactaggagctgcaaagggtcttgcttttcttcatgaagaagctgagagacctgtaatatacagggattttaaaacctctaacatactacttgatgcagactacaatgccaagctctcggactttggtcttgccaaagatggtcctgaaggtgataaaacccacgtgtctactcgagtgatgggtacctatggttatgcagcgccagaatatgtcatgacaggtcatctcacatcaaaaagtgacgtgtacagttttggagtggtgctccttgagatgttgactgggagaagatctatggacaaacaccggcccaacggtgagcacaaccttgtggaatgggctcgaccacatcttggagagaggagaaggttctatcggttgatagaccctcgtctggaaggtcacttttcaataaaaggagctcagaaagctgcccaactagctgctcactgccttagtagagatccaaaagccagacccctaatgagtgaagttgtggaagccttaaagcctctgccaagccttaaggacatggctagctcttcgtattatttccagacaatgcaagctgagcgcttcagagcgagtccaaatactagaagcacgccaacacaaggatcattgctcacacggaacggacagcagcgaaggagcctttcaatggcaaatggtactcatgcatctccttatcaccatcaatttccccaactatcaccaaaacccaatagcaaagcatagagctgttgaaaattttcttctttttcaccatctcttgttttctccatatatgtaattcatgaacaacttgagagcaaaagaagcatgctgatttgtgatgtatgttatgagtgttgaccccttttagcagggaagaatttcaagagagaggggtggtgaagcttattgtgctactatttcttatgtcaaattgtcagccaatatgtttcttcaggttgtttggaaaaattaaacattgtcaaattgtcatccttattctactttatcaggctttggttgtg

SEQ ID NO: 9797 - DNA, 1942 bp, Chenopodium quinoa
catttttctgggtgttgtcctttcaagtgagagaaggagtctagctctaaaaaccccacaattttttcaattttaagggcttatcttctgatctgaatcatttttatttcttttttgagctcttcaatccaatttttctggtaaaattttatgtgggtttgtgttatttcatcagattttgggtttttgagttaaaaatcaatagggtatgaattatttggggctaaaattattgggtattttgtaatttgagtcttttgggtggtgggtggaaaaggggttttagggattttgatgaatttgaaaatttaagggtttgtaattcatagggtgacatgggatttggtagtgatgtagctaaagtggaaacttgggatgtcgaaaaatcaaaaggaggaaaaaagaagaaagatgaagatgattctggtgaagatactggttgttggattaagctcagattcataggaagctgcattacttcaagatccaaagttgattcttctgtcagtggaacaagtactaactatgctgaaagcaaatcaacaatcgatgcaagcagagatcaaccggttactgcagttgtctcatcaacaacaacaagtaatgctgaaagcagcacatcaacatccaagctagaagaagaactcaaagtttcctcccgacttcgtaaattcgcatttaacgacttaaaattagcaactagaaacttcagacctgaaagtctacttggtgaaggtggttttgggtgcgtgtttaagggatggattgaagaaaatggtactgctccagtgaaacctggtacaggtcttactgttgcagtaaagacactcaatcatgatggacttcagggtcacaaagaatggctggctgaagtgaattatttgggtgatcttattcatcaaaatttggtcaaactaattggctattgtattgaagatgatcaaaggcttctagtctatgaattcatgccccgaggaagcttggagaatcatctttttcgaagatctttacctctcccatggtccattaggatgaaaattgctcttggtgcagctaagggtcttgcctttctccatgaagaagctgaaaagcctgtgatatatcgtgatttcaagacctcaaatattttattagatgcggaatacaatgcaaagctgtcggattttggacttgcaaaagatggtcctgaggaaggtaaaactcatgtatctacccgcgtgatggggacatatggttatgcagcccctgagtatgtgatgacaggccatctgacttcaagaagcgatgtttacagctttggagtagtgctgctggaaatgattactggcaggagatctatggacaaaaaccgacccaatggggagcataaccttgttgaatgggcaaggccacatcttggagaccgaagaagattttatcgtctgatagatcctcggcttgaaggtcacttttccattaaaggtgctcaaaaggctgtgcagttggctgctcattgccttagccgggatccaaaagtccgccctttaatgagtgaaattgtagatgccctgaagcctttacctaacctgaaagatatggctagctcgtcctactatttccaaaccatgcaagcagaccgagttagggccagcccaaatgctcgtaatggtcaacctataggtccccaccaaaggaacgggcagcaaccaggtctaaggagcctttcaatcccacatggctcacacgcttcaccatatcatcatcatcaataccatccatcacctaaaccaagtgggaaatcctaacctcagttcagtcggtcctcttcttgctctgcaagcagttcatcattcttttctccccagcttctgatcgttttcatgaagtcatcagctaattaagtatgtgatcctgatatcaaggttctttgctccttgatcaaagatgaaacaggatagggagg

SEQ ID NO: 9798 - DNA, 1988 bp, Trifolium pratense
acacaaaccccatctctgagtttgatgtttgtgtccctctcttcgaccatagctttctgtgttacgctaacttgttctgttctttaagaggctaaataaaagggttcgcattactctcttcactttcatcacaacttaatcaatctagggtacagcatattctcatttcttagggcttttgatctgcttcatttgatctaccttccctctttcctcattttcaatttctgggttttgttggatttcatgttttgagcgttattgagcggtaaagttgtgatttttaggttttatttgggaatttttcatctgggtttgtgctttttgtggttgttagagacattatagggtgtttgagttttgatgattgttgggtttgattgtttagggcttgataaataaaatggggttagatggtgtgaatggtaaggtgatagagtctttggatgtgagtaaatcaaaagggaggaagaaaaagaagttacaagatagggtaatggaagatgaagaaaatgaaactggttgttggcatagctttaggttcattggtggctgcatttcttcaagatccaaggttgatagttctgttagtggtaccggtactaattatgctgaaagtaaatcaactcttgatacaagtagagaccagccatcggttccggtagtctcttcgacgacgacgactactaccactactactagtaatgctgaaagcaactcttctacttcgaaaattgaagaagagcttaaagttgcttccaggctgcgaaagttctgtttcaatgaccttaagttggcaacaagaaattttcggcccgagagtcttcttggtgaaggtgggtttggttgtgtgttcaaaggatggattgaagaaaatgggactgctccggtgaaacctggcacgggacttactgttgctgtcaaaaccctaaatcatgacgggctccaggggcataaagaatggctggctgaagtaaattatcttggtgatttagttcatcaaaaccttgtcaaacttataggctactgtattgaagatgatcaaaggttgctggtatacgaatttatgcctcgaggaagcctggaaaaccacttgtttaggagatccttgccacttccgtggtccataaggatgaaaattgcgctaggagctgcaaagggacttgcttttcttcacgaggaagctgaacgaccagtaatatatagggatttcaaaacttccaatatactattggatgcagagtataatgccaagctctctgactttggacttgcaaaagatgggccagagggtgataaaactcatgtgtctacccgagttatgggaacttatggttacgcagcaccagagtatgtcatgacagggcatcttacatcaagaagtgatgtgtatagttttggagtggtactacttgagatgataaccgggagaagatccatggacaaaaaccggccaaatggcgaacataaccttgtagaatgggctagaccgcatctaggtgaaagaagaaggttctacaggttgatagatcctcgattggaaggccacttctcgataaaaggagctcaaaaagccgcccatttggctgctcactgccttagccgagatccaaaagcaagaccactaatgagtgaagtcgtagaagctttgaagcctctcccaaacctaaaggatatggctagttcatcatactatttccagacgatgcaagctgaccgatttagtgcaagtccaaatactcgaaatggtagaacacaaggaggattcgcccgaaatggacaacaacaaaggagcctttcgatatcacatggtactcatgcttctccatttcgccatcagtatcctcaacattcaccaaagccaactggaaaagcgcagagttgatgaattttctatcaccctactttttaatcatttcttattttctaagtatagatgttccaaacaacttcttgtgaagtcatatgttcatgggacaacttgaggg

SEQ ID NO: 9799 - DNA, 2351 bp, Lupinus angustifolius
aggttgcatatttgccctcacaacaagtgctaccaaaaatcaatgaatctttgacattttggattaaatctagtagaacattatactactcgattacatctgcctataatattttgtttgtttgttttagcttttgcagcattgttgttatgtgttgtgttgcagaggaggaccccatcactctctcagttttttctgtttcttttgaacttagatttatgatttcacttctcaggttctgtctatctttttttcctgccactactctcttcactttccatttcaaatttcaaccctcatcaatttaggattcaaggccccctttcccctttttgggaatttgatctgtccccctttgtctttttctgttttaatttctgggttttctttgttacccatttctgagctgttttagtatataaagttgtgatttttatggtatttttcatctggggttgtacttgacttactggtggtgattgtagtagtgatagggcattgaagagtgtttggaatttggaattctgtgtttggtttgttctgtaggtgttgttactagagatggggttgggtggtgttgagaatggtaataaggttgtggagtcatgggatgtgagcaaatcaaaggggaggaagaagaagaagaagaaagaagatgatgtagaggtagtggtggaggaagaggaagatattgggtgttgggttaggttgaggttatttggtagctgcatttcttcaagatccaatgttgatggctcactcagtggcaccaacactcattatgctgaaagtaaatcaactaatgacactagtagagaccaaccaacagttcctgtagtgtcttctacatctactagtaatacaagcaattcgtcgagttcaaaacttgaagaagagcttaaagtttcttcgaggctgcgaaagttcgctttcaatgatcttaagttggcaacaagaaattttcggcctgaaagtcttcttggtgaaggtgggtttggttgtgtattcaagggatggatagaagaaaatggaactgctccagtgaaacctggaactgggctaactgttgctgtaaaaaccctcaatcatgatgggctccagggtcataaagagtggctggctgaagtaaattttcttggtgatctagttcatccaaaccttgttaaacttataggatactgcattgaagatgatcaaaggttgttagtgtatgagttcatgccccggggaagccttgaaaaccacttgtttaggagatcgttgctgcttccatggtccattaggatgaaaattgcactaggagctgctaagggtcttgctttccttcatgaagaagctgaacgaccagtaatatatagagattttaaaacttcaaatatactattagatgcagagtacaatgccaagctctcagactttggtcttgccaaagatggtccagaaggtgataaaacccacgtgtctacccgagtgatgggaacttatggatatgcagcaccagaatatgtcatgacaggacatcttacatcaaaaagcgatgtgtacagtttcggagtggtactacttgagatgttgactggcagaagatctatggacaaacaccgtcccaatggtgagcataaccttgtggaatgggctcgaccacatctaggagatagaagaaggttctacaggttgatagaccctcgtcttgaaggtcacttttccgtaaaaggagctcagaaagctgcgcaggtggcttctctttgccttagtagagatctgaaagcccgaccgttaatgagtgaagttgtggaagctttaaagcctctgcctaaccttaaggacatggcaagctcttcctattatttccaaacaatgcaagctgaccgctttcgagcgagcccgaatgctagaaacgggcagacacaaggaggagcattgctcacccggaattggcagcagcaaaggagcctttcaataccaaatggtactcatgtatctccatatcatcaccagtatccccaacaatcaccaaaacccaatgtcaaagcatagagctggtgatctttttctgtcaccctttcattttctcggtatagatgtacacctaatttgttcatgaatagctttagagcaaaagaaatcatgttgctttatgatgtatattattaatgtcgacccctttagcaatgaagaatatcatgtgagggcaagttaagcttgttgagtaactatctcttatgttaaattgtcaaccaatatgtttcttcaggttgtttgaacatattgaacattattaaaaatcctcatccttgtcttatttttcacatttgttcctgaaattttaatgggattagttgtttctgaaa

SEQ ID NO: 9800 - DNA, 1799 bp, Arachis hypogaea
gaggaacaagagactgggtgttgggttaggcttaggttatttgggagctgagaatggtaaggtggtggagcatttggatgtgtgtaaatcaaagggtgggaaaaagaagaagaagaaagagagtgggatagttgaagaggaacaagagactgggtgttgggttaggcttaggttatttgggagctgcatttcttcaagatccaaggttgatagctctgttagtggcaccagcaccaattatgccgaaagtaaatcaactattgacacaagtagagaccaaccaacgcttccagttgtctcttctacaacaactagtaatgctgaaagcaatgcatccacttccaaacttgaagaggagcttaaagttgctttgaggctgcgaaagttcactttcaatgatcttaagttggcaacaagaaattttcggcccgagagtcttcttggcgaaggtgggtttggttgtgtgttcaagggatggatcgaagaaaatggaactgctcctgtgaaacctggtacggggctcactgttgctgtaaaaaccctcaaccatgatggactccagggtcataaagaatggctggctgaagtaaattttctgggtgatctagttcatccaaaccttgttaaacttataggttactgtatcgaagatgatcaaaggttgctagtatatgagttcatgcctcggggaagtctagaaaaccacttgtttaggagatccctgcctcttccatggtccattaggatgaaaattgcactgggagctgcaaaaggtcttgcttttcttcacgaggaagcagaacgaccagtaatatatcgggatttcaagacttccaatatactattggattcggactacaatgccaagctctctgactttggactcgcaaaagatggtcctgagggtgataaaacccatgtctccactcgagtgatgggaacctatggttatgcagcaccagagtatgtcatgacaggacatcttacgtcaagaagtgatgtgtatagtttcggagtagtactacttgagatgttgactggcagaagatctatggacaaaaaccgacccaatggcgaacataacctcgtggaatgggctagaccgcatctaggagagaaaagaaggttctaccggttgatagaccctcgtttggagggtcacttctccataaaaggagctcagaaagcagctagtttggctgcacattgccttagtagagatccaaaggcaaggcctctcatgagtgaagtcgtagaagctttaaagcctctgccaaacctcaaggacatggctagttcatcatattatttccagacaattcaagctgaccggttcagtgcaagcccgaatactagaaacggacgaacacaaggcgcattactgacgcggaacgggcagcatccgaggagcctttcgataccacatggtacacatgcatctccatatcaccatcagtttccccaacaatcaccaaaaccaaatggaaaggcacagagttgatgaaattttccattttctttgctacccttcttcgtttcattatttctaagtatagatgtcagttcagtcaatcaagccatttgttcatggaaaacttgagagcaaaagaagcatcttttgttttataatgtgttatgaagaagaatgtaagggaaggtgaatcttattgagcaactttgtcctgtcaaaattgtcaacctatgtgtttcttcaggttgtttggaaaatattcaagattattattagcacctcaaatttatattcttttgcttaaacaatttcttttccccatttgcca

SEQ ID NO: 9801 - DNA, 1668 bp, Olea europaea
tgattctaggtttgttaaagatgggacttggtggtgatagcttgaaggcagaatcttgggatgtggtgaaatcaaaggggacgaagaagaagaaaatggtgatgctgtgggggagatggggtgttgggttaagttgaggtatattggcagctgtatgtgttcaagatctaaagttgatacctctattagtggcatcagtgcccgcgaaagtaaatcagcgaacgatactagcagagaccaaccagcttccctggtacttccatccaccacgacaagcaatgctgaaagcaaatcttccagcttcaaacttgaagaggaacttaaagtatcttctcggcttcgaaaattcacatttaatgacctgaagctggccacaagaaattttagacctgaatctcttcttggtgaagggggatttggttgtgtattcaaggggtggattgaagaaaatgggacggcaccggtgaagcctggaacaggacttactgtagctgtgaagacactcaatcacgatggacttcagggtcataaagaatggctggctgaagtaaattttctcggtgatcttgtccatcctaatttggttaaattaattggttactgtatagaagaagatcagaggctgttagtttacgagttcatgcctcgggaagcttggagaaccaccttttcagaaggtctttgcctcttccatggtctatcaggatgaaaattgctcttggtgctgcaaagggtcttgcttttcttcatgaggaagcaaaaagacctgtgatatatcgtgattttaagacatctaacatcctgttaaatgctgaatatgatgccaagctttctgattttggacttgctaaagatgctccagatgaaggaaaaactcatgtttctacccgtgtcatgggaacctatggttatgctgccccagaatacgtcatgacagggcatcttacctcaaagagtgatgtctatagctttggggttgtcttgctcgagatgctcacaggtagaagatcaatggacaagaatcggcctaatggggagcataaccttgttgaatgggctaggcctcatctgggcgagaggaaacgcttttatcgtctaatggaccccaggctcgaggggcacttttctataaaaggtgcccaaaaagctgcacagttggctgcacgctgccttagccgagatccaaaagcccggcctctgatgagtgaagttgttgaagccttaaagcctttgccaagtctaaaggacatggcgagctcatcgtactattttcagaccgtgcaaactgagcgtgttggtttgagtccaaatgttaaaaatggccttagaacacaagggtcattctcgagaaatgggcagcaacacccaagaagcctctcaataccaaatggttctctagcctcgccctatcattatcagtttgctcggaattcaccaaaaccaaacggtaaaccatagaattggttcggaaatctgtgtttcttttcctactcttctaacattcttggatatggaaatatttttgttgttgattgtccataggttaatgaaaaagcaatgatagtatacatttataacatgtttagtaaggctgatcggatagtattgaacaatgaattttgttatttgtacccagatgttgatatgtccggttcacacccctcatag

SEQ ID NO: 9802 - DNA, 1769 bp, Euphorbia esula
gggtctagatacatagatttttgtgaggatgggattaggtagcagtgaagatggaaaagaaaaaattagagtggatgtgataaaatcaaagggaagtaagaagaagaagaaagatgttaattgtaatggagaagaagatggagaagaagaggcagcaggaacaggatgttggttcaagtttaggtttattggaagctgcatttcttcaagatccaaagttgatagctctgttagtgggaccagtacccattctgtattaacagaaggtaaatctacaaatgatacaagcatagagcaacctgctgctcctgtgatctcctcaactaccacaagtaatgcagagagtaattcttccactgccaaactagaagaggaactaaagattgcatctcgattgagaaaattcgcttttaatgatctgaaattggcaacaagaaattttagaccggagagtcttctcggggaaggtggttttggttgtgtgtttaagggatggattgaagagaatggaactgccccagtaaaacccggaacaggattaactgttgctgttaaaacccttaatcatgatgggcttcagggtcacaaagagtggctggctgaagtgaatttccttggggatcttattcatcctaacttggtgaaactgattggttattgcattgaagatgatcagagactgcttgtatatgagtttatgcctcgaggaagcttggagaatcacctatttagaagatcactgcctcttccgtggtccataaggatgaaaattgcgttgggtgctgccaagggtctagcttttcttcatgaagaagcagaaagaccggtcatttatcgtgattttaagacctctaacatcctattacacgcggaatataatgccaagctttctgattttggacttgcaaaagatggtcctgagggagataagacccatgtatccactccagtaatgggaacttatggctatgctgctcctgaatatgtcatgactgggcatctcacatcaaagagtgacgtgtacagtttcggagtggttttactagaaatgataaccgggagcagatccatggacaagaaccgacccatcggagagcataacctcgtggaatgggcccggcctcatctattggaaagaaggagattctaccgattaatagatcctcgactcgaaggacacttttccataaaaggggcacagaaagcaacacaactagctgcccactgccttagccgggaccccaaggccaggcccctaatgagtgaagttgtggaggccctgaagcctctaccaaatctcaaggacatggccagctcatcatattatttccaaaccttgcaagcagaccgaagtgcatcgaatagccctaatgggaagaatagcccgaacgtgaaaaatggggcccggactcccggaggattaatgaaaaatgggcagcaacaaagaagcctttctataccaaatggttctcaggcgtctccttatcaccatcaatacccgcaccaatcgccaaaaccgggtggtaaagtgtaaggaaatagagggttagtaaattgtctgaattttcttgccattattcatttgctttttcctcatgttcccattgtagatgtaattttctgtgaaagcattttgttgttggaaagtggaaaaagcaatatgttgagaaattggaaagatgagctctctcatccattcccagcaggagataatgttcatatggaattacagaatgtgttggaatgttaaaagattattgattggctcc

SEQ ID NO: 9803 - DNA, 1721 bp, Vinca minor
ctgatgatatttgtagtttgtattttggaggttgtaaaagatgggagttaggtggtggtggtgaaaaggtggaatcttgggatattgggaaatcaacgaaaggggggaagaagaagaagaagaaagttgttgatgatgatgatggtggtgtagaaactggatgttggactaaattaaggttcattggcagttgtatttcttcaagatccaaagttgatagctctatcagtggcatcagtactcactgtgaaagtaaatctgcaaacgacactagtcgagatcaacctgttgctgcaattatttcattaacggctacaagtaatggagaaagtaattcatccacttccaagcttgaagaggagctcaaagttgcttcacggcttcgtaaatttacatttaatgatcttaagttggcaaccagaaattttagaccagagtctcttcttggggaaggaggttttggttgtgtattcaagggctggatcgaagagaacggtacagcaccagtaaaacctgggacaggactaacagttgctgtgaaaaccctcaatcacgatgggcttcagggtcataaagaatggctggctgaagtaagttttctcggtgatcttattcatcctaatttggttaaactgattggttactgtattgaagatgatcaaaggttgctagtctatgagttcatgcctcgtggaagcttggagaatcacctattcagaaggtctctgcctcttccctggtctatcaggatgaaaattgctctaggtgctgcaaagggtcttgctttccttcacgaggaagcagagaggccagttatttatcgtgacttcaaaacctccaacatcttgttagatgcagattacaatgcgaaactctctgattttggtcttgccaaagatggtccagagggagataagactcatgtctctactcgtgtgatgggaacatatggttatgctgctcccgagtatgttatgacagggcatcttacatcaaagagtgatgtttatagtttcggggttgttctgctcgaaatgctaactggtagaagatctatggacaagaatcggcctaatggggaacataaccttgtagaatgggcaaggcctcatcttggtgagagaagaaggttttaccgattaatagatcctagacttgaaggccatttctcaatcaaaggtgcacagaaagccgcccaattagctgctcgttgccttagccgcgatccaaaagctcgaccactcatgagcgaagttgtcgaagccttaaaacccttaccagctttaaacgacatggcaagctcgtcgtactatttccaaaccatgcaagctgatcgcattggatctagtccgaataccagaaacgggattagatcacaggcagcaacgttttcaagaaatccgaggagtctgtcaataccgaatggttctcacgcttcaccatatcatcatcagttccctcaaaaatcacctaaaccgaaaggtaaacaatagagattttgatgattcgccaatctgaatgattctttttctttcgccccgtgctcatcatcggcaaccatgaacatattttgatcaggtcaattgttgtttagagatgaaaagagaaggggaaataggagtactacatagtttgatgattaatgttgtttgtgaatgaatccttgagagtgatgtaatctccaccgggtaagaatgtaatgtaatggctcagctcaagtt

SEQ ID NO: 9804 - DNA, 1864 bp, Aquilegia formosa
gaatcattctcaatggctttcatagctactcttctcagctcaatttttgctttcaaaccatttatttatacttttcttaagtgatataatcaagtaataatgagtaaatttttttttttgctttgaaatggtcagctatgtacttctatgaatcatttacaagatagcttttttgaagttttgggattttttgagcaaattcttcattttatgtagataccctttgttatgatctgggttttaaggagttttgaagtgatttctggatatggggttgtattaattgtggtgattatgggaatttattgataaaaattgtatcttgagaagaattgagcaagttagtgctggaaaaaggaaaagggtgtttgggtttttggagaaatggatatttgattttaaggatttgagggatgggattagttcctgaagttattcagttagatgcttgggatatcgaaaagtcgaaaggaaagaagaagaagaaagatggtcttgtgaaagaaccttttggatgttgggtaaatttcaggtttattggcaattgtataacttcaaaatctaaggtggagaactccataagtggcactagcactcattatgaaagtaaatctacaactgatactagcagagaccagccagttgctcaggtaatatcatcttcaacgacaagtaatgcagaaagtaacccttctaccccaaaagtaggtgaggaactgaaaattgcctcccagcttagaaaatttgcatttaatgagctgaagtcggcaactagaaattttagaccggaaagtcttcttggagagggtgggtttggttgtgtattcaaagggtggattgaggaaaatggaaccgcacctgtgaaacctgggacaggccttactgttgcagtcaaaactctcaaccatgatggacttcagggtcataaagagtgggtggctgaagttaactttcttggtgatctcctccaccctaatttggtaaaattgattggctactgcattgaagatgatcaaagactgcttgtatatgagttcatgcctcgaggaagcttggagaaccatctttttaggaggtccctgccccttccatggtccatcagaatgaaaattgcacttggtgctgcaaagggtcttgcttttcttcatgaagaagctgaaaggccagtgatatatagagactttaagacatctaacattctattagatgcggattacaatgcaaagctctcggacttcggacttgccaaagatggtcccgagggagataaaactcatgtgtctactagagtgatgggaacctatggttatgcagctccagagtatgtgatgacaggacatttgacctcaaagagtgatgtgtacagctttggggtggttctgcttgaaatgcttactggcagaagatccatggacaaaaaccgaccaaatggggaacacaacctggtggaatgggcacggccacatcttggcgagaggcgacgattttaccgtctgatagaccctcgtcttgaaggccacttttcaatcaaaggtgcacaaaaggcagctcaactagcacatcactgtctgagcagggatcctaaagtcagacctctcatgagcgaagttgttgaagtcctcaagcctctattgaatctcaaagacatggccagctcttcgtactattttcagaccatgcaagcagagcgcactggggtcaacttgaacagcctcaattctagaaatggcctaagaatgcaagctgggttcgtatcaaggaacggccaaccaataagaagcctctcaatcccaaagggttcacatgcttctccttaccatttccaacatccatcaccaaagcagaatgacaaacaaacatagca

SEQ ID NO: 9805 - DNA, 2178 bp, Chenopodium quinoa
atttgctgtacagccatttttctaggtgttgtcctttcaagtgagagaaagagtatagctctaaaaaccccactaattttttttttcaattttaaaggcttatcttctgatctgaatcatttctatttctttttcagctcttcaatccaatttttctggtaaaatttcatgtggggttgtgttatttcatcagattttgggtgtttgagttataaatcagtagggtaagaattattaggggctaaaattattgggtattttgtaatttgagtcttttgtgggtggtgggtggaaaaggggttttagggattttgatgaatttgaaaatttaagggtttgtaattcatagggtgacatgggatttggtagtgatgtagctaaagtggaaacttgggatgtcgaaaaatcaaaaggaggaaaaaagaagaaagatgaagatgattctggtgaagatactggttgttggattaagctcagattcataggaagctgcattacttcaagatccaaagttgattcttctgtcagtggaacaagtactaactatgctgaaagcaaatcaacaattgatgcaagcagagatcaaccggttactgcagttgtctcatcaacaacaacaagtaatgctgaaagcagcacatcaacatccaagctagaagaagaactcaaagtttcctctcggcttcgtaaattcgcatttaacgacttaaaattagcaactagaaacttcagacctgaaagtctacttggtgaaggtggttttgggtgcgtgtttaagggatggattgaagaaaatggtactgctccagtgaaacctggtacaggtcttactgttgcagtaaagacactcaatcatgatggacttcagggtcacaaagaatggctggctgaagtgaattatttgggtgatcttattcatcaaaatttggtcaaacttattggctattgtattgaagatgatcaaaggcttctagtctatgaattcatgccccgaggaagcttggagaatcatctttttcgaagatctttacctctcccatggtccattaggatgaaaattgctcttggtgcagctaagggtcttgcctttctccatgaagaagctgaaaagcctgtgatatatcgtgatttcaagacctcaaatatcttattagatgcggaatacaatgcaaagctgtcggattttggacttgctaaagatggtcctgaggaaggcaaaactcatgtatctacccgcgtgatggggacatatggttatgcagctcctgagtatgtgatgacaggccatctgacttcaagaagcgatgtttacagctttggagtagtgctgctggaaatgattactggcaggagatctatggacaaaaccgaccaaatggggagcataaccttgttagaatgggcaaggccagatttggagaccgaagaagatttatcgtctgatagaccctcggcttgaaggtcacttctccatcaaaggtgctcaaaaggctgtgcagttgctgctcattgccttagccgggatccaaaagtccgccctttaatgagtgaagttgtagatgccctgaagcctttacctaacctgaaagatatggctagttcgtcctactatttccaaaccatgcaagcagaccgagttagggccagcccgaatgctcgaaatggtcaacctattggtcctcaccaaaggaatgggcagcaaccaggtttaaggagcctctcaatcccacatggatcacatgcttcaccatatcatcatcatcagtaccatccatcacctaaaccaagtgggaaatcctaacctcgggccagtcggtgcacttcttgttctgcaagtggttcatcattcttttctcccagcttctgatcgttttcatgaagtcatcaactaattaagtatgtgatcctgatatcaaggttctttgctccttgatcaaagatgaaacaggattagggaagggggaaaaaaaaaaacagaacagaaaaagaggcaacagaagacaatgtatgaattgtgcaaactattatctttcagtcaggctctctgtaaaggagttaaatgtaagaagaggtgaagctttgtgggccagaaatttcatgtcaaacctcataatgttacgttagtcaagcttgaaaatatgaaaaatgaagtttcaccaattgttgcctcaattatcc

SEQ ID NO: 9806 - DNA, 1615 bp, Olea europaea
tgtactaatttctgaaatgatttgagtaattttaggtgattcttggggctggaggaaataatactggaagtgaagggttatttggtaaaggtttttccaggtggagggaggtgggctaggattttggtttgtaaaacatgggattaggtggtgatgcattgaagaaggagtcttgggatgtggggaaatcaaaggggagaaagaagaaagatggtgactctgaggaggagaccgggtgttggattaaattgaggtttattggcagctgtatgtcatcaagatctaaagttgatagctccattagtagcatcagcactcactgtgaaagcaaaactatgaatgatacaagcagagaccaaccagttgcccccataatctcttcctccacaacgagcaattcggaaagcaattcttccagctccaaacacgaagaggaacttcaaatttcttctcggcttcgaaaatttgcttttaatgatcttaagttggcaacaagaaattttagaccagaatcacttcttggtgaaggaggtttcggttgtgtatttaaggggtggattgaagagaatggaacagcaccagtgaaacctgggacaggacttactgttgctgtgaaaatcctcaatcacgacgggcttcaaggtcacaaagaatggctggctgaagtaaatttccttggtgacctcattcatcctaatttggttaaactaataggatcctgtattgaagatgatcaaaggctgcttgtgtatgagttcatgcctagaggaagcttggagaaccacttattcaggaggtctctgcctctaccatggtctattaggatgaaaattgctttaggtgctgcaaagggtcttgcttttcttcatgaggaagcagagcggccagtgatatatcgtgattttaagacatctaatattctgttagattctgaatataactccaaactttctgattttggacttgctaaagatgctccggatgaaggaaagactcatgtttccacccgtgtgatgggaacgtatggttatgcggccccagaatatgtcatgacagggcatcttacatcaaagagtgatgtctacagctttggtgttgttttgctcgaaatactcagtggaagaagatcaatggacaaaaatcggcctaatggagaacataaccttgtagaatgggctcggcctcatctgggtgagaggagacggttttatcgtctaatagaccctagacttgaaggtcatttttctataaaaggggcccaaaaagctgcacagttggtcgcacactgtcttaacagggatgccaaagcaaggcctttaatgagtgaagttgtcgaagctttaaagcctctgccaaatctcaaggatatggccagctcgtcatactatttccagtcgatgcaagctgatcgtgtgggatcgagcccaaatgctagaaatggccttagaacgcagggctcattctcgagaaatggtcagcttcatccaagaagtctctcgttccataatggttctcatgcttctccatatcacaataagtttgtccaatcaccaaaaccaaatggtaaagcatagaatggatcagcgattatggtgcttcttttcatagtggtcag

SEQ ID NO: 9807 - DNA, 2022 bp, Glycine max
gtgcttgtgtttttgttgttgctgcatagagaggaccccatatctgttatgtagcggagattactcagttcagctcagtttcaatttctggggtttgtgggttacccggtttcaagggttgttggcatgtaaagttgtgatttttaggtttcatctgggaatttcccatctgggggttgtggtctttggtatttgatggtatctgggtttctagggattgattgatcattgattggtagagataatagatggggttgggtgctgagaatggcaaggtggtggagtcttgggatgtgtgtaaatcaaaggggaggaagaagaagaagggggatgaagggggtgaggctgaggctgggtgttgggttaggttgaggttcattgggagctgcatttcttcaagatccaaggttgatacctcagtcagtggcagtggcaccagtactcattatgctgaaagtaaatcaactaatgatactagtagagaccaaccaacagccccagcagtctcttctacaaccactagtaatgctgaaagcaattcatcatccacttccaagcttgaagaagagcttaaaattgcttccaggctgcgaaagttctctttcaatgaactcaagttagcaacaagaaatttccgacctgaaagttttcttggtgaaggtgggtttggttgtgttttcaaggggtggattgaagaaaatggaactgctccagtgaaacctggcacaggacttacggttgctgtaaaaaccctaaaccatgatgggctccagggtcataaagaatggctggctgaagtgaattttcttggtgacctagttcatccaaaccttgttaaacttgtaggttactgcattgaagaggatcaaaggttgctagtgtatgagttcatgcctcggggtagcctggaaaaccacttatttaggagatccattcctcttccatggtccattagaatgaaaattgcactaggagctgctaagggtcttgcttttcttcatgaagaagctgaacgaccagtaatatatagggattttaaaacttcaaacatattactggatgcagtaagtgtcaaaaactacaataagattgcatttccccctttttatcagtctaatattgtaccgattcaggagtacaatgccaagctctcagattttggtcttgccaaagatggtccagaaggtgataaaacccatgtgtctactcgagtgatgggaacctatggttatgcagcaccagaatatgtcatgacgggtcatcttacatcaaaaagtgatgtgtacagtttcggagtggtactacttgagatgttgaccggcagaagatccatggacaaacaccgacccaacggtgagcataaccttgtggaatgggctcggccacatctaggagagagaagaaggttctacaggttgatagaccctcgcttggaaggccatttttcggtaaaaggagctcagaaagctgccctactggctgctcactgccttagtagagatccaaaagccagacccctaatgagtgaagttgtggaagctttaaagcctttgccaaacctcaaggacatggcaagctcttcatattatttccaggcaatgcaagctgaccgcattggagcgagcccaaacacaagaaatgggcgaatgcaaggagcgttgctcacccgcaatggacagcagcaaaggagcctttcaataccaaatggtacttatgcatctccatatcaccatcagtttccccaaccatcaccaaaacccaatggcaaagcatagagctgatgaaaattttctttttctttttctctttcaccctttacaccatttcttagtttcttcttatagatgtaccttctcttaaagcatagcatatgctgctttatgatgttatgttaacttatgggtgttgaccccctttatcttgaaagaatgtgagggtgagagcaagtgaagcttattgagctactatgtcttatctcaaattgtcattcaatattttcttcaggttgcttggaaatattga

SEQ ID NO: 9808 - DNA, 2323 bp, Daucus carota
cacacacagctgtgtgtatttgtgtgtgcatataaatgatgatttttatgagctttcaaggggctagattgtgtcaaaattgaatcttttggtgagttgcagacacccactaagcacttattgtcttattgaagttaaatacatgtatgagacagcttgcactatgtgtaatgtgcttatttaggtgatctgaatctgcttatattttcttttggtgcttaaagattgaatctttatgtgacatcttgaattgggtttgtgttatttgtgtgatattttgtgggtttttgagaaaacggttggtgggtgtttcttgaagtcaaaagttgctgctttttgatgtttaggcttgttttggggttgtttgaggggtggtggaggggagtttgatcttttttgaggtgatttttgagctggggtttcgattttgtttgtcgaatcaaggaggatattcttggaagtgaagggcttgtaggtgattttgggctttgggggggggggggggggggggggggggggggggggggggggggttttgatgatatcaggatttgatcacaagagttcttgacaaatgggattgagtggtggtgatggtgttaaggtagagactagtgaagtggggaaattgaaggatcgaaagaaggataaagggagtgatgttgaagatattggatgttggactaagttgaggttcattggcagttgtatttcatcaagatctaaagttgataattctatcagtggcattactactaattgcgaaagtaaatccataaatgagaccaccaaagaccaaccaccaccagtaatctcatcaactacaactagtatcgcggaaagtaattcatccacttcaaaacttgaagatgaacttaaagtttcttctcgacttcttaagtttgcttttaatgatcttaagacggcaacaagaaattttagaccagagagtcttcttggtgaaggtggttttggatgcgttttcaagggctggattgaggagaacggtactgcgccagtgaaaccaggtaccgggctcactgttgctgtaaaaaccctcaaccatgatggacttcagggtcacaaagaatgggtggctgaagtaaattttcttggtgacctcattcatccaaacttggtgaagctgattggttattgcattgaagatgatcagcggctgctggtatatgaatttatgccacgaggaagcttagaaaaccacctcttccggagagcgttgcctcttccatggtctattaggatgaaaattgctcttggtgctgcaaaaggtcttgcttttcttcatgaggaagcagcaaagacagttatttatcgcgatttcaaaacttcaaacattctactagatgcagaatacaatgctaagctttctgactttggtcttgccaaagatggtccagagggagataaaactcatgtatctacccgcgtgatgggaacatatggttatgcagctccagagtatgtgatgacaggacatctcacatcaagaagtgatgtatacagctttggggtggttctacttgaaattttgaccggtagaagatcaatggacaagaaccgtccaaatggtgaacataatcttgtggaatgggcacggcctcatctaggagagaggagaagattttacaagttgatagaccctcgccttgaaggtcatttctcgataaaaggtgcacaaaaagctgcacatctggctgctcggtgccttagccgggacccaaaagtcaggcctttaatgagtgaagttgttgaaatcatgaagcctctaccaaaccttaaagacatggctagctcatcatactactttcagaccgtccaagccgaccgaactggatcgagcccaaataccagaaatgggtcgaatggcgttagaacaccggcaggatcattttcaagaaatggccagcagcatccaaggagcctctcaatacctaacggttctcatgcttctccctatcatcatcagttcccgtcgccaaaacctcaaggtaaaccgtaactagcatttggttggggaatatctgcttcttctccaacacttgcactgtactatttttctttctcggttataagatatatattttgtcggcccatttgcaaagaattggaggaatgcttgaagatgttgatgctagatctagagtaaccactcctatctagtgaaggagattgtaatggaagaggaactgaggtcactgaagtaatttattttgtttgaaaagataacctctttgtatctatccattttttacggtccacaatattttacccatcattaacaagattatcgtcgacgaccaat

SEQ ID NO: 9809 - DNA, 1766 bp, Aristolochia fimbriata
ggcgaaagaagaaagatgcggattctgaagaaactggatgttggattaagttcaggtttattggaagttgcatttcgtcaagatctaaagttgataactctatcagcagcagcagtaccaattatgcggagagtaaatcaacaaatgaagctagtagagaccagccaactgctgctgtggtctcctcgacaaccacaagcaatgcggaaagcaacccatctacgccgaaagtgggtgaggaactgaaagttgcttctcagctgcgaaaattcacatttaatgagctcaaagctgcaactagaaattttagaccagagagtcttcttggtgagggtggatttggctgtgtatttaaaggttggattgaggaaaatggaacggctcccgtgaagcctggcacagggctaactgttgctgttaaaacgctcaaccatgatggacttcaggggcacaaagagtggcttgctgaagtcaattttcttggtgatcttctccatcctaatttagtgaagctgattggctattgtattgaagatgatcaaaggttgctagtatatgaatttatgccccgaggaagtttggaaaaccatctcttcagaaggtccttgccacttccgtggtctatcagaatgaagattgctcttggtgctgcaaagggtcttgcttttcttcacgaggaagctgaaaggccagttatataccgcgatttcaaaacctccaatatcctgttagatgcggattacaatgctaaactctctgattttggacttgctaaggatggtcctgagggtgacaaaactcatgtttctactcgtgtaatgggtacatatggctatgctgcaccagagtatgtgatgacggggcatctaacatcaaggagtgatgtctatagttttggagtggtcctccttgagatgcttactggtcgaagatccatggataaaaaccggccaaatggggagcacaacctggtagagtgggctcgcccccatcttggagagcggagacgtttctttcgccttatagacccgcgccttgaggggcatttctccatcaaaggagcgcagaaagctgctcagttggctcaccattgcctcagccgggatccaaaagccagaccactaatgagcgaagttgttgaagcccttaaacctctgataaatctcaaggacatggccagctcctcatattacttccagaccatgcaagccgaacgaacaggggcaaactctaactcgaatgcaaggaccggagtcaagacacaaggtgtcatggtgagaaatggacaactgcctgtgaggagcctctcaaacggtgcacatgcctcgccttaccaccaccaatctccaaagcctaatggtaaacttccttgaggcggggtaggtcgagtttttcaatttttgttcttatgggatttggttctgtaagagagctgctcaaaattgtggggagtctgttgatttgcggtgatgtgtctttgttaatgttttgtgggcttcaagaggtggctgctgtagagaagaggccaatgagatattggtgccacctgatgtttcataatcttttaatttgaaattataaccctgaagaacaattgatattgttgtcactcattgtttgatgatagcacctgtatatgtagcttggtcgtgctaaggagtgacggctagttagggctaaatgctgccacatcccttccgctctctcaatcatcttacgaccagatgcatctttctattgtaccatttagtagcactaaacttctc

SEQ ID NO: 9810 - DNA, 2684 bp, Eucalyptus grandis
cgttgagcgaaagagatttttcttctttaaaaaaaaattgcagaagagagagaaagaagagagagaaagcagggagacgagagagagggaggcgatatataattcaatcgaaatccccacattttttcttgttcgttcgctcgcccccactttttctttttaaacggtcagctttttcgcgtcctttgctcccccccgctgcgattttctcgttccctcccttcccctcacatttttttcaccgcatcggcattattactcttcctctgcacttctttctctctcctccttttcctttcttttttctggggctccggagcttggaggggcgttcttctttcgggagtgtgtgagtgtgatcgcgtcggtcagttccgcccctcttcaaaattcgcgagctcgaggcgccggtaaatatctcgccttttccccccccgccggcggatttcgagcttgttgctccggtcgccgcggcggcgccggcgtcggcggtgagcatgatctgggtcgtcgctcgttcgtgatctcggagctcccgccgttcgtttcgcagccttgcagtcagctggtattctcaggtgccccgcgcaagcgacggcgaggagctctccgccgccgccgcccccctcctcctcctcctccgcccgcccggctgtttgtcaggttccgatgcttttgagggccgacggttacgagtctcgtggtttcgaattggaggggggtgggggggttcttgggtcccggggttgatgatttgggggattttccgcggttagggttccagagagatgagcgtcgtcactggcagcggcggcggcggcggagctgggggtgggggcgacaatggcaaggtcgaggcttgggactcgggcgagtcgatggggaggaagaagaagaagagcaaggacggcggcgagcggaagaaagcgggaggtggccgggaagacggtctcggcggcgacgacgacgacgatagcgtgggggtgaaggaaagcggttgttgggttaggttgaggttcatagggagctgcatctcctcaagatccaaagtcgatagctccatcagtggtaccagtactaattacgcagaaagtaaatttacaaatgatacgagcagagaccagcctgctcctcctgcggtttcatctacgaccactagcaatacagaaagtaactcttcgacttccaaacttgaagaggaacttaaagttgcctctcgcctgcgaaagttcaacttcaatgatcttaagttagctacaagaaactttagacctgaaagtctacttggggaaggtggttttggctgcgtcttcaagggttggatcgaagaaaatgggactgctcctgtgagacctggcactgggcttactgttgctgttaaaactctcaatcatgatgggcttcagggtcacaaagaatggctggctgaagtgaattttcttggtgatctagtgcatcctaatttggtgaaattaatcggatattgcatagaagatgaccaaaggctgctagtgtatgagtttatgccaagggggagcttggagaaccacctctttagaagagctctgcctctcccttggtctatcaggatgaaaatagcgctaggtgctgcaaagggtcttgcttttcttcatgaggaagcggaaaggccggtgatatatcgtgatttcaaaacttccaatatcctgttagatgctgactacaacgccaagctttctgattttgggcttgcaaaagatggtcccgagggagataagactcatgtctcaacacgtgtcatgggaacatatggctatgctgccccagaatacgtgatgaccgggcaccttacttcaaggagtgatgtctatagttttggtgtggtgcttttggaaatgctgaccggaagaagatccatggacaaaaatcgacctaatggcgagcataacttagttgaatgggctcggccacatcttggagagagaagaagattctacagattgatagatccacggcttgaaggtcacttctcgataaaaggtgcccaaaaggccgcgcagttggctgctcactgccttagccgagatcctaaggctcgtcccctgatgagtgatgttgttgaagctttgaagcctctcccaaatctcaaggatatggcaagctcatcatactattttcagaccatgagggcggagcgcatagggtcgagcccaaatgctagatatggcattcaatcgcaagcaggagcgaatgcaaggaataggagtctttcgataccgaatgggacccatgcatccccataccaccatcagtatcctcatcaatctccaaaaccgaatagtaaaccatagtgatgggtttagacttagccgccccatattcaacccctctccccccaatttatttccttttcttatcttttctcagtataggagttgattttcacctaaacatttgcgcttgattactgaaacggtgacggagaaaaatgtgcttgaatggtgatgtgttttgacatccttgagcagaggatgtctggaaaggtgaagcgtttctggcagtgtctattttgacccatatggaactcctttggagatatgctgaagcttgttgcctcatttcccttgcttctttttcctccttagctttgctctcatattaccctcaatacaatggcacggtttatgcgagaagaaaaaaagacc

SEQ ID NO: 9811 - DNA, 2362 bp, Lupinus angustifolius
gagatagaatcgataatttggagtgtgtaataagagtaacatcaatattattatttttgtatcttacatcgaacaaaaaataaacagtagataatacaatattgttgtaaatgtgtatatcattttctctgtctcttttatttttgcttgtgcagctttgttgttatgtgttgtgttgcagaggaggaccccttcactctctgagatttttctgtttcttttgaacggagatttatgaattcacctctcaggtgctgtctatcttcttttcctgccacttctctcttaactttccaattccaaccctcatcaatctagggttcaaggggcccccttgtcccttttgggaatttgatccatttcatttgtcccccttcgtattttctgttttagtttctgggttttctttgttacccacttttgaagtgttttaggatataaagttttgatttttatggaatttgtcatctggggatgtacctgatttaatgtagtgattgtggtagtgatggggcattgagtagtttttggaattctgggtttggtttattctaagggtgtttttgttactagagatggagttgggtggtggtaagaatggattgaatgttactaaggtggtggagtcttgggatgtgagtaaatcaaaggggaggaagaagaagaagaagaaagaggatgaggtaaaggtactggtggaagaaaaggaagatactaggtggtgggttaagctaatgttatttgggagctgcatttcttcaagatccaaggttgatagttcaaccagtggcaccagtaatcattatgctgaaagtaaatcaactaatgatacaagcagaggccaaccaatagttcctgtagtgtcttctacatccactagtaatacagaaagcaattcatcgagttcaaaatttgaggaggagatgaaagttgcttccaggctgcgaaagttcgctttcaatgatcttaagttggcaacgagaaatttccggcctgagagtcttcttggtgaaggtgggtttggttgtgtattcaaggggtggatagaagaaaatggaactgctccagtaaaacctggaactgggctaactgttgcggtaaaaaccctcaaccatgatgggctccagggtcataaagagtggctggctgaagtaaattttctcggtgatctagttcatccaaaccttgttaagcttgtcggatactgcattgaagatgatcaaaggttgttagtgtatgagttcatgcctcgtggaagccttgaaaaccacttgtttaggagatccttgcctcttccatggcccattaggatgaaaattgcacttggagctgctaagggtcttgctttccttcatgaagaagctgagcggctagtaatatatagagattttaaaacttcaaatatactattagatgcagagtacaatgccaagctctcagactttggccttgccaaagatggtccagaaggtgataatacacatgtgtcgactcgagtgatgggaacctatggatacgcagcaccagaatatgtcatgacaggacatcttacatcaaaaagtgacgtgtacagttttggagtggtactgcttgagatgttgacaggcagaagatctatggacaaaagtcgacccaatggtgaacacaaccttgtggaatgggctcgacaacatataggagagaggagaaggttctacaaattgatcgaccctcgcttggaaggtcacttttccataaaaggagctcagaaagctgcacaactggctgctcactgccttcgtagagatccaaaagccagaccattaatgagtgaagttgttgaagctttaaagcctctcccaaaccttaaggacatggcaagctcttcttattatttccagacgatgcaagcagaccgcttccgagcgagcccgaatactagaaacaggcagacacaaggaggagcattgcttacccggaatgggcagcagaaaaggagcctttcaataccaaatggcactcatgcctctccatatcatcatcagtatcctcaacaatcaccaaaacccgatgtcaaagcatagagcttggtgataatcttttttctttttcactctttcgatttcgccatttttatattcttggtatagatgtacaccttatgtcaaaccaatttgttcatggacaaaaacttgagagcaaaagaaggcatgctgctctataatgtatgttattaatgtcatgtgagggaaagttaagcttattgagcaactatgtcttatatcaaattctcaaccaattatgtttcttcatgttgtttggaaatattgaacattattaaaaatcctcatccttatcttaattttcccatatgttcctatga

SEQ ID NO: 9812 - DNA, 1964 bp, Glycine max
aggacacaaacacaaacccgtctcttagattgatgtctctgtgtgtcttcctttgagcaaagctttctgagttgagctaagttgtcgtgttctttttgggcaaaagggttggcattactctctttcggtgtttggtgtacccacaagctgatcaatctagggttcaagggggggcttgctgctatagatggggttgggtggtgctgagaatggaaaggtggtggtggagtctttggatgtgtgtaaatcaaaggggaggaagaagaagaagaaagaggatggggaagttgaagagaaggaagagactgggtgttggttcaggctgagcatcattgtgtgggagtttcttcacctccttgagtggggggacgagttcatgaatcagacaattgcattcatgactcgtaaagttggaagtatcaaggtctatcaccttcttaccatgtatacgtctgaaagtaaatcaactattgatacaagtagagatcaaccaacagtcccagtagtctcttcaacaaccactagtaatgctgaaagcaattcatccacttccaaacttgaagaggagtttaaagtttcttccaggctgcgaaaattcacgttcaatgatcttaaattagcaacgagaaattttcggcctgaaagtcttcttggtgaaggtggctttggttgtgtgttcaagggatggattgaagaaaatggaactgctccagtgaaacctggcacggggcttactgttgctgtaaaaaccctcaaccatgatgggctccagggtcataaagaatggctggctgaggtaaattatcttggtgatctagttcatccacacctcgttaaacttattggttactgcattgaagatgatcaaaggttgctagtatatgaatttatgcctcggggaagcctggaaaatcacttgtttaggaggtccctacctcttccatggtccattaggatgaaaattgcactaggagctgcaaagggtcttgcttttcttcacgaggaagctgaacgaccagtaatatatagggatttcaaaacttccaatatactattggatgcagaatacaatgctaagctctcagactttggacttgcaaaagatggtccagagggtgataaaactcatgtgtctactcgagtgatgggaacctatggttatgcagcaccagaatatgtcatgacgggacatcttacatcaagaagtgatgtgtatagtttcggagtggtactacttgagatgttgactggcagaagatctatggacaaaaaccgacccaacggtgaacacaaccttgtggaatgggctagaccacatctgggagagagaagaaggttctacagattgatagacccccgcttggaaggccacttttccataaaaggggctcagaaagccgcgcatctggctgctcactgccttagcagagatccaaaagcacgacccttgatgagcgaggtcgtggaagctttaaagcctctgccaaacctcaaggacatggctagttcatcgtattattttcagacaatgcaagccgaccggtttagcgcaagtccaaataccagaaacgggagaacacaaggagcattgctcaccagaaatgggcaacagcaaaggagcctatcaattccacatggcacgcatgcatctccatatcaccatcagtttccacaaccatcaccaaaacccaatggcaaggcatagagttgacgatgatgatgagttttcattttctttgtcaccctttcttttttgtcatttctcattccccaagtatagatgtcacttgtgtctagccattttgttcatggacaacttgagtgttgaccttagggcaggtgaaagcttatcagctactactatctctagtgtcaaattgtcaaccaatatgtttcttcaggttgtttcgaaatattcaagattattaactcctcaattttattttattttttttccatttgcc

SEQ ID NO: 9813 - DNA, 2141 bp, Lupinus angustifolius
gttttgttgtacttggtagcagcttgcataggaggaacacaaaacataccaacaacacaccatttcttatattactctgtcttttcttcacttcatcttactttctctcttcttcttttatcttcacattcttctcttcctcacttttctcaacaatctagggttacttcaagggtttttttctttttgtttttgatctgcttcttctgatctaacccctttatttttatcactttaaaattctgggttttgttgtgattctacttttgacgtgttttgagtggtaaagttatgatttttagttgctatttggttgtggaatttatcatcctgttcttgggttgaatgtgattttggtaggtttgggcattgtgggtcagttttttttttggttttgatgattttttagggaatttggtagagatgggtaaggtggtggagtctttagatgtgtctaaatcaaagggtaacaagaagaagaagaagaaaaaggaagagaatgttttggaagaggaaacagtgtctgggaggtgttggcttaggttcagattctttgggaactgcatttcttcaagatccaaagttgatagctcagttagtggcacaagtactaattatggtaaccttttttctctctttagaacaattattgtgcttactatgttattagagattccatcttcagatattaaatcaactatagatacaagtagagaccaaccaacagttcctgtagtctcttctacaaccaccagtaatactgaaagcaatgcatccacttccaaacttgaagaggagcttaaagttgcttcaaggcttcgaaaattctctttcaatgatcttaagttcgcaacaagaaattttcggcctgagagtcttcttggtgaaggtggttttggttgcgtgttcaaaggatggatcgaagaaaatggaactgcaccggtgaaacctggaacagggcttactgtagctgtgaaaaccctcaaccatgatgggctccagggtcataaagaatggctggccgaagtaaattttcttggtgatcttgttcatccaaaccttgttaaacttataggttactgcattgaggatgatcaaaggttgcttgtgtacgagttcatgcctcggggaagcctggaaaaccacttgtttaggagatcccttcctcttccgtggtccattaggatgaaaattgcactaggtgctgcaaagggtcttgcttttcttcacgaggaagctgaacgaccagtaatatatagggatttcaaaacttcaaatatactattggatgcagactacaatgccaagctctcggactttggacttgcaaaagatggtccagagggtgataaaacccatgtgtctactcgagtgatgggaacctatggttatgcagcaccagaatatgtcatgacgggacatcttacatcaaggagtgacgtgtatagtttcggagttgtactgcttgagatgttgactggcagaagatcaatggacaaaaaccggcccaacggtgaacataaccttgtggaatgggctaggccacacctaggagagagaagaaggttctatcggttgatcgaccctcgcttggaaggtcacttttcgatcaaaggagctcagaaagctgctcatctagctgctcactgccttagtagagatccgaaagccagaccattaatgagtgaagtcgtagaagctttgaagcctctgccaaaccttaaggacatggctagctcatcttattatttccagacaatgcaaggcaaccacttcagcacaagcccaaatactagaaacgggcgaacacaaggcggcacattgctcagccggaatgggcagcagcaaaggagcctttcgatatcacatggtactcgtgcatctccttatcaccatcagtatcctcaacaatcaccaaaacccaatgcgaaagcatagatacagttgatggattttccccatcatttcttatttcctaagtatagaagtaacctatgtgttgagtgttgatccaatgtaagggaaggtgaggcatattaagctactatcaaacagttctgattaaatcaattggcttagtttatatcatcttagtctttaacaattcaaactttaatccattgatcccatcaattctttta

SEQ ID NO: 9814 - DNA, 1706 bp, Trigonella foenum-graecum
catggttttgagttgatttgtgtgtaagtttgattttagctttaatttggaattttcatccgggtttgtgattttgaggtagttggagggtatggcattgaagggttgtgttgtagtgatgtttggaattatgggtggtttttgaattttgatgattttaggttttgttagagatggggttgtttggttctctgaatggtaaaatggtggagtcttgggatgtgtctaaatcaaaggggggtaagaacaagaagaataaggagaatgagggtgtggttgatgttgaaaaagcaaaaactggatgttgggttgggttgaggtttattggtagctgcatttcttcaagatccaaagttgatagctcactcagtggcagtggtactagtactcattatgctgaaagtaaatcaactaatgatacaagtagaggccaacgaacagctccggtaatttcttccacaaccactagtaacacagaaagcaattcctccacgtctaaacttgaagaggagcttaaaattgcttccaggctgcgaaaattctctttcaatgagcttaaattgtcaacaagaaatttccggcccgagagttttcttggcgaaggtgggttcggttgtgttttcaagggttggatcgaagaaaatggaactgctccagtgaaacctggcacagggcttactgttgctgtcaaaacccttaaccatgacggccttcagggtcataaagaatggctggcagaggtaaattttcttggtgatctagttaatgaaaatcttgttaagctcataggttattgtattgaagatgatcaaaggctgctagtgtatgagttcatgcctcggggaagccttgaaaatcacttatttaggagatccgcgcctcttccatggtccattaggatgaaaattgcactaggagctgctcagggtcttgcttttcttcacgaagaagctgaacgaccagttatatatagggattttaaaacatcgaatatactattagatgcagactacaatgccaagctctcagactttggtcttgccaaagatggtccagaaggtgataaaacccacgtgtctactcgggtgatgggaacatatggttatgcagcaccagaatatgtcatgacaggtcatcttacgtcaaaaagtgacgtctacagttttggagtcgtactacttgagatgataagcggaagaagatctatggacaaacaccgacccaacggcgagcataaccttgttgaatgggctcgaccacatctaggagagcgaagaaggttctaccggttgctagaccctcgtcttgaaggtcacttttccgtaaaaggagctcagaaagccgctcagatagctcatcactgcctaagcagagatccaaaagccagacccctaatgagtgaagttgtcgaagctttagagcctctacaaaacctaaaggacatggcaagttcttcttactatttcaaatcaatgcaagctgcgagtccaaattctagaagtgtgcctgcgcaaggagcatcgcttgctcgaaacggacagcaacgaaggagcctttcgataccgaatggtacacaagcatctccttataacaataagtatcctcaacaatcacctaaacctaatgtcaaagcataaagctggtgaacattttccatctctttatgtttcttcaggttgtttggaaatattgaaatattattaaac

SEQ ID NO: 9815 - DNA, 1956 bp, Arnica chamissonis
cttctggggaagattgaattggtcattcttttgttgaaatttctttaatcttttttttctttaatctctttgagtgcttttgaactgagattatatctcacacaacttgcacaaaacacacacacacagtgtgatctgattcttttgtttactgttgcaaaacattaaatttcccaaatttgtgtcattttctgttacaaaacagaattgggtataccagttttgataaaaaaaaatccaatcttggtgaagggttttgttgtatgcaagtcaaagttccaatctttctctccttcagccatgtaagggtttgttttgaaagatgaaatctggtgataaaaaaggggtggaatcttgggatgttgtaaaaatcaaaggttaagaagaagaagaagaataaacataagaaaggtgatgagattggtgatgaggggactcccactggatgttggaacaggtggaagttgattggcagctgtatttcttcaagatctaaagttgatacttcaatcagtggcatcagtactcactatgaaagtaaatcaacaaatgatacaagcaaagatcaaccggtagtccaagtagtgtcgtcaactaccacgagtaccggagaaagcaattcatccacccaaaagtttgaagaggaattaaaagtggcctcccgccttcggaaatttgctttcaatgatttaaaaatggcaacacgaaattttcgacccgagagtcttcttggtgaaggagggttcggttgtgtatttaaaggatggattgaagagaacgggactgcaccagtcaaaccaggcacagggctcacggttgcagttaaaaccttaaatcatgatgggcttcagggccataaagagtggctggcagaagttaactatttaggtgatctcattcatccaaatttggttaaattgatcggttactgcatcgaagatgatcaaaggctgcttgcttatgagttcatgcctcgagggagcttggagaatcatttgtttagaaggtctttgcctcttccatggtccatcaggatgaaaatcgcacttggggctgcaaagggtcttgcttttcttcatgaagaagcaaaaagacccgtgatttatcgtgatttcaaaacctcaaacattttgttagatgcagaatataatgcaaagctttctgattttggtcttgctaaagatgcccccgagggcgataaaactcatgtatccactcgagtcatgggaacttacggttatgcagcgccagaatatgtaatgacaggacatctcactgcaaagagtgacgtatatagtttcggtgttgttttacttgaaatgttgaccgggagaaggtcaatggacaaaaaccgtccaaacggtgaacacaatcttgttgaatgggcccgaccgcatttaggagagaggaggaggttctataagctcatagaccctcggctcgagggtcatttctctataaagggagcccagaaagcggcccagctagcagcccgttgcctgagccgggaccctaaagtcagaccactaatgagtgaagttgttgaatctttaaagccattgccagccctaaaggacatggcaagctcatcatattacttccagaccatccagtctgaacgggtcgggtcaagcccaaatgggcgaaacggtcttcgaattcaacatgggtcgttttcaagaaacgggtcacagcatccaagaagcctatcgatatcaagtagcacacgtgcatccccttttcaccagcaatcgactcaaaactcaccaaagccgaaagagaagcaatagagaatggcgggtttggtatgctaatcatcggtttctttttcctagtattattattaatttttttcttcttaaaatttagttctaattgtcaaaggaaattgtaacgggtgtacctgacgctattcctgtaataggatcacctttggtagaattattgcgcggaagt

SEQ ID NO: 9816 - DNA, 2890 bp, Mimulus guttatus
ttttcttgtttgagtactgtgcatttgtactcagcgagttgcgagtctttcgttgaaaatttcggcatctttttttgcgggctgagagagagagagtattattattatctatgtatctatcgccactgtaattattaataatagtgtgtgattccagcttcgcttgttgcacagtgccgatgaccaaagttttatccctgctttgaaggtcaagcaagcatgtgatctgtaatcactctgcaccctctcactctgggtttttctgctccactttccaactgggttttcgttaatttcatcgattacatctgggtttcaatttcaatcggaaatttgttattgcagctattcggattgagcagctggctccaagttttgttgggtgttttgaattgcctttttttcttttggcgatttgggttttcttgattgtggaagaaaggttccccttttcttactttcgatttattttctgtaatgggttcgagttgttctaggtaattctgtgggattcactcaaatttagggattaatttggtatattcaggaggtgggatcgatcaaaatttttttaatttttttttatttttttttaatttgtgggaattttgtatgaaattttgtatgtgaagagatgggattaggtgatgaaggattaaaaggggagtcttgggaagttaagaaattgaaggagaagaagaaaaaaaatgataatgctgctaagaagagtggatgttgcattaggtttaggtttattggcagctgtattacatcgagatctaaagtcgatagctctataagtggcatcagcagcactcaagaaagtaaatctacgaatggtactagcagagaccagcccgttgtgcccgtaatcccgtccacctccacaagcaatgctgaaagtagttcatcgagctccaaaccagaagacgagctcaaagtttcttctcgcctcagaaaatttacgtttaacgaccttaaattggccacaagaaatttcagaccggaatcacttctcggtgaaggagggttcggttgtgtgttcaaaggatggatcgaagagaacggtacagcaccggttaaacccggtacaggactcacggttgctgtcaaaaccctaaatcacgatggactacaagggcacaaagaatggctggctgaagtgaattttttgggtgacctggttcatccgaatttggttaaattaatcggttactgcatcgaagatgaccagaggctgctcgtttatgagttcatgcctaggggaagcttggagaaccatctattcagaaggtcgctgccacttccttggtctataaggatgaaagtggctcttggtgctgcagaggggctcgcttttctgcacgaggaagcggaaagaccggttatatatcgggattttaagacatctaacatcctattggatgctgaatataatgccaaactttcggattttggacttgctaaagatgccccggatgaaggaaaaactcatgtttctacacgtgtgatgggtacctatggttacgcagccccagaatatgtcatgacgggacatctcacatcaaaaagcgacgtatacagcttcggagtagtcctcctcgagatgctaacaggtagaagatcaatggacaaaaaccgtccaaacggggagcacaacctcgtggagtgggcccggccccacctgggcgagcggaggcggttctaccgcctgatagatcctcgtctcgaaggccacttctccatcaaaggtgcccaaagagccgcccacctggcggcacgctgcctgagccgtgactcgaaatcgaggcctctgatgagtgaagttgtcgaagctttgaagcctctgcccagcctcaaagacatggctagctcgtcttactacttccagaccatgcaagctgaccgagtcaactcgagcccgaacggtaaaaacgggctccgaactaacgggtctttctcgaggaacagccaccagaatattcagaggcggctctcgattcccaatggtggtgctcatgcttcaccgttgtttcatcagtttactaataattcgcccaaaccgagcggcaaaccgtaagatatggacatggtgtttttggaacgcctcggtcgctcttgtaagatatacgtcacacgtttttaacgatttggaagtgaattattaaatgtatgtataattcttgaagatgcgtagtgtacatcggagattattatggttcatcttcctcttatgtcttatctccctccatatgggtctaatttgtatttctttttttatgaattttatgaaaattttaacttttcgaagagttttatgcacaagaagaaaaaaaacgagggtgaaatctgcgaaccgacgtcgaggtctacctggagtagattagcattagcaacaacaatttgtgtttcttgttattcatacttattgagtcagaaagtggttcttagttaacaatttatttataaacagtagcttatttagtaacgataaacgggcatactagacatcgaacatagtatattagtgtttactgagtcacacggacttcctggtaagctgatcgatagatgtgctctcgaatatcttgtctgcatttccaacctcaaaaccgtctctcctatgaaactcttccacctatgcaaagggaacaaaattaatcatcagtgctcgagaaattaaataatacgtagaatggcaaaaggttcagctaaaggataaaaaaccaaaaagaaaaaaaccttattctccggtagatctttgaactcaggaagtacgaggcgttcggcaaactcaatgtatgagcaaggaatcgattccgtgattccttcagcaaattggaatgaagctgaatctgccaccgttgaactttgtaacaagagaccatca

SEQ ID NO: 9817 - DNA, 1501 bp, Chelidonium majus
ggattaggtcctgatgctattcaagtggaagcatgggatgttggaaaatcaaaggagggaaaacagaagaaagatgaagcagaagaagaagaggaggagattgggtgttggaataagtttaggtttatggtttgcctttcctcaagatccaaggttaatagctctataagtggaacaagtactcattatgctgaaagtaaatctacaaacgataccagcagagaccacccagttgccgctgtaggatcttcatcaactactagtaacgcagagagtaaccctgatactcctaaagtacgcgaggaactgaaagttgcttctcagcttagaaagttcacatttctcgaccttaagtcagcaacaagaaattttagaccagagagtcttcttggtgagggagggtttggttgtgttttcaagggatggattgaggagaatggaactgctcctgtaaacctggcacagggcttacggttgcagttaaaacccttaaccatgatggacttcagggtcataaagagtggatggctgaagttaactttcttggtgaccttcttcatcctaatttggttaaattgattggttactgcatagaagatgatcagagactgctagtatatgagtttatgcctcgcggaagtttggagaaccacctctttaggaggtccctgcctctaccgtggaccatcagaatgaaaattgcacttggtgctgcgaaaggccttgcttttcttcatgaggaagctgaaagaccagtcatatatcgtgattttaaaacgtctaacatcctgttagatgcggattacaatgccaagctctcggactttggacttgccaaagatggtcctgaaggagacaagactcatgtatctactagagtgatgggaacttacggctatgctgccccagagtatgtgatgacaggacatctgacatcaagaagtgatgtctacagctttggtgtagtattacttgagatgctgactggcagaagatccatggacaaaaatcgtccaaatggggaacacaacctggtggaatgggcccgtcctcatcttggggagaggagacggttttaccgtcttatagaccctcggttggaaggtcacttctccattaaaggtgcacagaaggcttcccaactggctcacaactgtcttagccgtgacccaaaatcccgacccctcatgagcgaggttgtagaagctctgaagcctctccagaatctgaaagacatggcgagttcgtcctactatttccaaaccatgcaagcagaacgaactggagccaacaccaacaactcgaatactagaaacggcggcttaagaacacatggagtgtttgtatctagaaacgggcaacccctaaggagcctctcgagttcaaatgggtcaactaagtctccatatcaccctcatcagcaaccatcaccaaagcctaatggtaaacagccatagcactagttcctcttccatcagcttcaccctcccattttctatga

SEQ ID NO: 9818 - DNA, 1620 bp, Daucus carota
cttttgctgattttttcaactggagttttgttaaatttgccttatgattttggggttttgtatttgattgttggggttctgatgggctgttgattagggcttattgttgagttctgtgagaaaatgggattaagtgatgctaaaagtgagccttgggaggtgggcaaatctaagaacaaggtgaagaaagatgatgctgatggggaagttactggttgttggattgcgttgaggtcaattcgcagctgtataacatcaagatctaaagttgacaactcaattagtggcatcagtttacatgaaagcaaatatgctaacagtagaaaagaccaaccatctactgcaatttcatcaactacaaccagtactgcagaaagtagttcatccacttccaaacttgaagaggaacttaaaattgcttctcggcttcggaaatttgcttttaatgatcttaagatggcaacgaggaattttaggcctgatagtcttcttggtgaagggggatttggttgtgtattcaaggggtggattgaagagaatgggacggcacctgtaaaaccaggcactggccttactgttgctgtgaaaactctcaatcatgatgggcttcagggtcacaaagaatggctggctgaagtcagttttctaggtgacctcattcatccaaacttggttaagctgattggttattgtatagaagatgatcagcggttgctggtttatgaatttatgtctcgagggagcttggagaaccacctttttaggaggtctctgcctctcccatggtccatcaggatgaaaattgctcttggtgctgcaaaaggtcttgcttttcttcatgaggaagcagcaaagacagttatttatcgcgatttcaaaacttcaaacattctactagatgcagaatacaatgctaagctttctgactttggtcttgccaaagatggtccagagggagataaaactcatgtatctacccgcgtgatgggaacatatggttatgcagctccagagtatgtgatgacaggacatctcacatcaagaagtgatgtatacagctttggggtggttctacttgaaattttgaccggtagaagatcaatggacaagaaccgtccaaatggtgaacataatcttgtggaatgggcacggcctcatctaggagagaggagaagattttacaagttgatagaccctcgccttgaaggtcatttctcgataaaaggtgcacaaaaagctgcacatctggctgctcggtgccttagccgggacccaaaagtcaggcctttaatgagtgaagttgttgaaatcatgaagcctctaccaaaccttaaagacatggctagctcatcatactactttcagaccgtccaagccgaccgaactggatcgagcccaaataccagaaatgggtcgaatggcgttagaacaccggcaggatcattttcaagaaatggccagcagcatccaaggagcctctcaatacctaacggttctcatgcttctccctatcatcatcagttcccgtcgccaaaacctcaaggtaaaccgtaactagcatttggttggggaatatctgcttcttctccaacacttgcactgtactatttttctttctcg

SEQ ID NO: 9819 - DNA, 2380 bp, Panax ginseng
agtaatttatagtatgatgatttattgaggtttgaactggtcagcttattggagtcttttgttgagatttcagtatctttgaggagcagacatcagtgtacttttggagtgagattgtctgatacagcttgcacctgtgtaatgtgcctgggcatgcgatctgaatctgctcacctatttttattggcgttgaaaaaaatatcatctttatgtgaaatcttgaattgggtctgattgattaatttcatctgatatctttgtgggttttaagagagaaacattggtgtttctgcaagtcaaaagttcttcttttttatgtttctgttatgtgagggatggtggagggggctttagaattatcttttactgagctgggttttcaattattttacccgattatttggggatattgagaaagaatttctgaaggtgaaggactggtaggaaagtgaaggggtgggtggaggggaagaagggggttggcaattttgggctttcagggctttgatgatatccgggttgattatatagggtttgtgaaaatggtattaagtggtgatggtgttaaagtagagtcttgggaagtgggcaaatcaaaagacaggaagaagaaagatggtgatgtggaagagagtggctgttggattaagttgaggtttattggcagctgtatttcatcaagatctaaagttgataattctattagtggcatcagtacgcactgcgaaagtaaatctacaaatggcactagcaaagaccaaccagctcctggaatctcatcaactacaaccagtattgcagaaagtaactcttccacttccaaactagaagaggaactcaaagttgctactcggcttcggaaatttgcttttaatgatcttaagatggcaacaagaaattttagaccagagagtcttcttggtgaaggcggtttcggttgtgttttcaagggatggattgaagagaatggaactgcacctgtgaaaccaggcactgggcttactgttgctgtgaaaacgctcaatcatgacgggcttcagggtcataaagaatggctggctgaagtgaattttcttggtgatctcattcatccaaatttggttaagctgattggttattgcattgaagatgatcaacgattgctagtttatgagttcatgtcacgaggaagcttagagaaccacctgtttaggaggtcccttcctcttccatggtccatcaggatgaaaatttctcttggtgctgcaaaaggtcttgcttttcttcacgaagaagcagaaaggctagtgatatatcgtgatttcaaaacttctaacattctattagatgcagtaggtgactaaaacttgggtaattatgcttttgccttcataattgtcatctttctaatgacaccttttattccaggaatacaatgcgaagctttctgattttggtcttgccaaagatggtccagaaggagataaaactcatgtatctacccgtgtgatgggaacctatggttatgctgctccagaatatgtgatgacaggacatctgacatcaaaaagtgacgtctacagctttggtgtggttctgcttgaaattctgactggtagaagatcaatggacaagaaccgcccaaatggggaacaaaaccttgtggaatgggcaagaccacatctgggagaaaggaagaggttttataggttgatagaccctaggcttgaaggtcatttttcgataaaaggtgcccaaaaggctgcacacctggctgctcgctgccttagccgagacccaaaagtcaggcctctaatgagtgaagtggttgaagccttgaagcctctgccaaacctaaaggacatggcaagttcatctttttacttccagaccattcaagctgaccggattgggtctagcccaaatactagaaatgggtcaaatggcattcgatcacaaggtggatcattttcaagaaatgggcagcaacatccaaggagcctctcaataccgaacggttctcatgcttctccatatcatcatcagttcccgcattattcaccaaaacctcaaggtaaaccataggtagcggctaggctgggatttgtgtttcttttcccacacactgtaccgtactctaccctcttttttgttctttctttgcaaccccccttttttctgattataaatatatttagtccgcccatttggtcttggacgtctgggaaagaataggatgaacacatgaatgatgttgcgatctttagagtgaccactcccacccagtgcgggagaatgtaatgtaagaggagctgaaattcattgaagtaaatgcttctgtttggattataaattgtaatctacctatttttggggatgtgttatcttatgaattaccaag

SEQ ID NO: 9820 - DNA, 2039 bp, Cichorium intybus
gtctctttgaatcatttctgaatcgtggttgtgatctgaatatcttatttacccttgcaaaaacattaaagtttctaatttttgtcattatctgttaaatttcagaattgggtgtatctgtttttcattaaaaatccattttggtggggtttgtttgagggattttttctgttgtatacaagtcaaagtctattctttctccttttcagccatgtgaggtgagtgtttaaccaaaggcgtgtcactatctcccatcttttcttcagatggctctttgattattacatctgattatcgttttcccatcgcaaattcgtttcaaaactgggaaattccgttgtaatttggggattttcatgatacccgtccagtttgattttagggtttgttttaaaagatgaaatccggtgatgaaaaaagtgtggggtcttggcatgttgtgaaatcaaaggggaagaacaataagcctaagaaaagcaatggaacctgtctggaaacggaggaggggactaccgccgggtgttggaacaggtggaaagttatcggcagctgtatttcttcaagatctaaagtcgataattcaatcagtggcatcagtactactcactgcgaaagtaaatcgacaaacgacgtaagcaaagatcaaccggtgattccggcggtctcatcaaccaccacaagcaccggagaaagcatttcatccacccaaaaactagaagaagaactcaaaatcgcttctcgtcttcgcaaatttgcgttcaatgatcttaaaatggcaactcgtaacttcagacccgaaagtcttcttggtgaagggggatttggttgcgttttcaaaggctggattgaagaaaacggaactgcaccggtgaaaccaggcaccggacttacagttgccgtgaaaaccctcaatcatgacggacttcaaggccataaagagtggctggcagaagtaagttatttaggcgatcttattcatccaaacttggttaaattaattggttactgcattgaagatgatcaaaggctgctagcttatgagttcatgcctcgagggagtttggagaatcatctgtttagaagatctttgcctcttccatggtccatcagaatgaaaatagccctcggggctgcaaagggccttgcttttcttcacgaagaagcaaaaagacccgtaatttatcgcgatttcaaaacatccaacattttattagacgcggaatacaatgcaaaactttccgatttcggccttgcaaaagacgccccggagggcgacaaaactcacgtatcaacccgagtcatgggaacatacgggtacgccgccccggaatacgtaatgacaggacatttgacttcaaagagtgatgtatatagtttcggtgtggtcttactcgaaatgttgaccggaagacggtcaatggacaaaaaccgcccaaacggcgaacacaatcttgtcgagtgggcccgcccacatttaggtgaaagaaggcggttttatcggttaatcgacccgcgactcgagggtcatttttccataaagggggcccaaaaagcggcccaattagcggcccgttgcttgagccgtgacccaaaagtgagacctttaatgagtgaagttgtggattctttaaaaccattgccagccttgaaagacatggcaagctcttcatattatttccagactattcaatctgaacgggtcgggtcgagcccaaatggaagaaatggtacccgggttcaaggcgggccgggtttgagaaacgggtcacaaaatgcgaggagtctttcggtttcgaatagtacacgggcttcaccttatcaccagcagttttcaccaaagccgaatgagaagtgatagaaaattgttgggttgttttgttagtagtgtttattggtgtttgttatttttttgggaaatgtagttttaattgtctaaagaagtataaggaacaagggaaacagatgtggggtttatgttgttgtgatgaatttagagtgatcatggcagtgtaatttatgaggagctgtgaatttcattc

SEQ ID NO: 9821 - DNA, 2067 bp, Cichorium intybus
ggggtgtatctcatacagcttccaccacttcgtctctttgaatcatttctgaatcgtggttgtgatctgaatatcttatttacccttgcaaaaacattaaagtttctaatttttgtcattatctgttaaatttcagaattgggtgtatctgtttttcattaaaaatccattttggtggggtttgtttgagggattttttctgttgtatacaagtcaaagtctattctttctccttttcagccatgtgaggtgagtgtttaaccaaaggcgtgtcactatctcccatcttttcttcagatggctctttgattattacatctgattatcgttttcccatcgcaaattcgtttcaaaactgggaaattccgttgtaatttggggattttcatgatacccgtccagtttgattttagggtttgttttacaagatgaaatccggtgatgaaaaaagtgtggagtcttggcatgttgtgaaatcaaagggaaagaacaataagcctaagaaaagcaatggaatctgtctggaaacggaagaggggactaccgccgggtgttggaacaggtggaaagttatcggcagctgtatttcttcaagatctaaagtcgataattcaatcagtggcatcagtactactcactgcgaaagtaaatcgacaaacgacgtaagcaaagatcaaccggtggttccggcggtctcatcaaccaccacaagcaccggagaaagcatttcctccacccaaaaactagaagaagaactcaaaatcgcttctcgtcttcgcaaatttgcgttcaatgatcttaaaatggcaactcgtaacttcagacccgaaagtcttcttggtgaagggggattcggttgcgttttcaaaggctggattgaagaaaacggaactgcaccggtgaaaccaggcaccggacttacagttgccgtgaaaaccctcaatcatgacggacttcaaggccataaagagtggctggcagaagtaagttatttaggcgatcttattcatccaaatttggttaaattaattggttactgcattgaagatgatcaaaggctgctagcttatgagttcatgcctcgagggagtttggagaatcatctgtttagaagatctttgcctcttccatggtccatcagaatgaaaattgccctcggggctgcaaagggccttgcttttcttcacgaagaagcaaaaagacccgtaatttatcgcgatttcaagacatccaacattttattagacgcagaatacaatgcaaaactttccgatttcggccttgcaaaagacgccccggagggcgataaaactcacgtatcaacccgagtcatgggaacatacggatacgccgccccagaatacgtaatgacaggacatttgacctcaaaaagtgatgtatatagtttcggtgtggtcttactcgaaatgttgaccggaagacggtcaatggacaaaaaccgcccaaacggtgaacacaatcttgtcgagtgggcccgcccacatttaggtgaaagaaggcggttttatcgtttaatcgacccgcgactcgagggtcatttttccataaagggggcccaaaaagcggcccaattagcggcccgttgcttgagccgtgacccaaaagtgagaccgttaatgagtgaagttgtggattctttaaaaccattgccagccttgaaagacatggcaagttcttcatattatttccaaactattcaatctgaacgggtcgggtcgagcccaaatggaagaaacggtaaccgggttcaaggcggggcgggtttgagaaatgggtcacaaaatgcgaggagtctttcggtttcgaatagtacacgggcttcaccttatcaccagcagttttcaccaaagcctaatgagaagtgatagaaaattgttgggttgttttgttagtagtgtttattggtgtttgttatttttttgggaaatgtagttttaattgtctaaagaagtataaggaacaaaggaaacagatgtggagtttatgttgttgtgatgaatttagagtgatcatggcagtgtaatttatgaggagctgtgaatttca

SEQ ID NO: 9822 - DNA, 1622 bp, Ambrosia trifida
ataatagtaatataataataagttaaaaaagtgatgagataggtgtagatggagagactcaaactggatgttggtgcagatggaaattaatgggcagttgtatttcttcaagatctaaagttgatacttcaatcagtggtatcagtactcattgtgaaagcaaatcgacaaatgatacaagcaaagatcaaccagtaacccaagtagtgtcatcaactaccacgagtacaggagagagcaattcatccacccaaagatttgaagaggagttaaaagtgtcttctcgccttcggaaatttgctttcaatgatttaaaaatggcgacacgaaattttagacccgaaagtcttcttggcgaaggagggttcggttgtgtgtttaaaggatggatcgaagagaacgggactgcacccgtcaaaccaggcacagggctcacggttgcagttaaaccttaaatcatgacggacttcagggccataaagagtggctggcagaagtaaattatttaggtgacctcattcatccaaatttagttaaattgatcggttactgcattgaagatgatcaaaggttgctagcttacgagttcatgcctcgagggagcttggagaatcatttattcagaaggtctttgcctcttccatggtccatcaggatgaaaattgcgctaggggccgcaaagggtctcgcttttcttcacgaagaagcaacaagacccgtaatatatcgcgatttcaaaacctccaacattttattagatgcggaatataatgcaaagctttctgattttggtcttgctaaagacgctcccgagggtgataaaactcatgtatctacacgagtcatgggaacgtatggttatgcagcgccggagtatgtaatgacaggacatctcacttcaaagagtgatgtatatagttttggtgtcgttttacttgaaatgttgaccgggagaaggtcaatggacaaaaaccgtccaaacggtgaacacaatcttgttgaatgggcccgaccacatttaggagagaggaggaggttttataagctaatagaccctcgactcgagggtcatttctctataaaaggagcccaaaaagcggcccagctagcagcccgttgcctgagccgggaccctaaagttagaccactaatgagtgaagtagttgaatctttaaagccattgccagccctaaaggacatggcaagctcatcatattacttccagaacatccagtctgaacgggtcgggtcaagcccaaatggccgaaacggggtccggagctcaaaacggatcgttgtcaagaaacgggtcacatcatccaagaagcctctcgatatcaagtagcacacgtgcatcgccttttcatcagcagttgattcaaaactcaccaaagccgaatgagaagaaatagacaacggtgtgtttggtatgctgatcattggtttcttttcctagtattgttattaattgtttcttctggaattaagttctgattgttaaaagcagtataagaaacaacagaaacagatgtgggatttatgttgtgatggatttagagtgatcatcatgacattgtaatttatgaggagctgtgaaattgagttgaaagaaatttctgcta

SEQ ID NO: 9823 - DNA, 2183 bp, Tragopogon dubius
tcggggtggaagatttgaatgggtcgttcttttgttaagatttcttttgagaacagtaaacataagtatgcttttgaactgagattatatctgatacagcttgcagtttctctgtgtgcgtatctttgaatcctttctaaatctttgggtgtgatctaaatttcttatttaccgtttcaagaaccttaaatttcctaaattttgtcattatgtgttaaattccagaattgggtacatgagttttcgttaaaaatccagtcttggtggggtttctttgagggattttttttttctgttgtagacaagtcaaagtctattctttctcttcttcagccatgtgaggtgagtgtataaccaaaggcgtgtcaccatctcccatcttttcttcagatgggttttgattattacatctagttttttcgttttctcatcaagaacttgtgtcaagactggaatatttcgttgaaatttggggattttgatggttcgtctttagggtttgttccgaaagatgaaatccggcgatgaaaagggtgtggagtcttggcaagtcgtgaaatcaaaagggaagaagaagaagaacaataagcctaaggaaagtaatgaaattggtcttgtcggagatgaggaagggactaccaccgccgggtgttggaaccggtggaaaattatcggcagctgtatttcttcaagatctaaagtcgatagttcaatcagtggcatcagtactactcactgtgaaactaaatcgacaaatgacacgagcaaagatcaacccgcagttccggcaacagtctcatcaaccaccacaagcaccggcgaaagcgtttcctccacccaaaaactagaagtagaactcaatattgcttctcgtcttcgtaaattcgcattcaatgatctcaaaatggcaacacgaaacttcagacccgaaagtctgcttggcgaaggtggatttggatgcgtatttaaagggtggattgaagaaaatggaaccgcaccagtgaaacccggcacaggacttactgttgcggtcaaaacccttaatcacgatgggcttcaaggccataaagaatggctggcagaagtaaattatttaggtgatcttattcatccgaatttggtaaaattgattggttactgcattgaagatgatcaaagactgttggcttatgagttcatgcctcgagggagcttggagaatcatttgtttagaaggtctttgcctcttccatggtcaatcagaatgaaaattgcacttggggctgcaaagggccttgcttttctgcatgaagaagcaaaaagacccgtgatttatcgcgatttcaaaacctccaacattttgttagatgcggaatacaatgcaaagctttctgattttggtcttgctaaagatgccccggagggcgataagactcatgtatcaactcgagtcatggggacgtatgggtatgcagcccccgaatacgtgatgacaggacatttgacttcaaagagcgatgtatatagttttggagtcgttttgctcgaaatgttaaccggaagaaggtcaatggacaagaaccgtccaaacggtgaacacaatcttgtggaatgggctcgaccacatttaggagagagaagaaggttttatcggctaatagaccctcgtttggagggtcatttctccgtaaaaggagcccagaaagccgcccaattagcagctcgttgtcttagccgggacccgaaagcccgacctttaatgagtgaagttgtagactgcttaaaaccattgccagccctaaaagacatggccagctcatcgttttactttcaaactatccaatctgaacgggtcgggtcgagcccaaatgggcgaagtgggatccgagttcaaggcgggtcgttttcaagaaacgggcaacaaaatccgaggagtttatcgatatcgaatagcacgcgggcttcaccttataataaccagcagtactcgccaaagccgaacgagaagcaatagagaaaagggtgtttggttttgtttggttatggtgatgtgatcggtttgttttgctagtaatattattattattgttaatttttttcttaaatttagttctaattatctaaaagcagtataagaagaaacaacagaaacagatgtggaatttatgttgtaatgaatttagagtgatcatggcagtgtaatt

SEQ ID NO: 9824 - DNA, 1912 bp, Flaveria ramosissima
tttttgtcattttctggtaaaattcaagattgggtatacaagattacgatctttcactaaaaatccaatctttgtggggtttttttgggtggttttttgttgtatgcaagtcaaagttcattgcttttctccttcaaccatgtggagatgagtgtttatccaagggtgtgtcaccatctaccatatgttcttcagatgggtctcgattattacatctgatttggggttttcttgtataaaattggggattttgatgatacccactgggtttgattctagggtttgttttgaaagatgaaatctgctgatgaaaaaggggtgggatcttgggatgttatgaaatcaaagggtaagaagaagaataagcataaagaatgtgatgatattggtttagatggaggtgggggatggggctaccactggatgttggagcagatggaaacttattggaagctgtatttcttcgagatctaaagttgatacttcaatcagtggcatcagtactcactgtgaaagtaaatcaacaaatgatacaagcaaagatcaaccgacagttcaagtagtgtcatcaaccaccacaagtacaggagaaagcaattcatctacccaaaagttagaagatgagttaaaagtgtcttcccgccttcggaaattcgcttttaatgatttaaaaatggcaacacgaaattttagaccgaagtcttcttggtgaaggagggtttggttgtgtattcaaaggatggattgaagaaaatggaactgcaccagttaaaccgggcacagggctcactgttgctgtgaagacccttaatcatgatgggcttcaaggccataaagagtggctggcagaagttaattatttaggtgatctcattcatccaaatttggttaagctgattggttactgcatcgaagatgatcaaaggctgctagcttatgagttcatgcctcgaggaagcttggagaatcatttgtttagaagatctttacctctaccatggtcaattagaatgaaaattgcacttggggcggcaaagggactcgcctttcttcacgaagaagcaaaaagacccgtgatttatcgtgatttcaaaacctccaacattttgttagatgcagaatataacgctaagctttctgattttggtcttgctaaagacgcccccgagggtgataaaactcatgtttccactagagtcatgggaacatacggttatgcagccccagaatacgtaatgacagggcatctcactgcaaagagtgatgtatatagttttggtgtcgttttacttgaaatgctgactggtagaaggtcgatggacaaaaaccgtccaaacggtgaacacaatcttgttgaatgggctagaccacatttaggagagaggaggaggttttataagctaattgacccacggcttgagggtcatttctctataaagggagcgcagaaagcggcccagctagcatcgcgttgcctgagccgggacccaaaagtcagaccattcatgagtgaagttgttgaatctttaaagccattgccagctctaaaggacatggctagctcatcatattacttccagaccatccaatctgaacgggtcgggtcaagcccaaacggccgaaacagggtccaagctcaaaacgggtcactttcaagaaacgggtcacagcatccaagaagcctttcaatatcaagtagcacgcgtgcatcaccatttcatcaacagtcgactcaaaactcaccaaaaccaatcgagaagaattaaggatggcttgtttggcatacgatgattatggatatcttctcctagtactgttattatttatttttttttctaaatttcgaagatttagttctaactgtctaaggcagtataagaaacaacagaaacagatgtggaatttatgttgt

SEQ ID NO: 9825 - DNA, 1518 bp, Arnica chamissonis
agatgatgatgatggcactaccactggatgttggaataagtggaatctaattggaagctgtgtttcttcaagatctaaagttgatacttcaatcagtggcatcagtactcactgtgaaagtaaatcgacaaatgatacaagtaaagatcaaccggttgttcaagttgtgtcgtcaactaccacaagtacaggagaaagcaattcatccacccaaaaactagaagatgaaataaaagtggcttctcgccttcggaaatttgcttttaatgatttaaaaatggcaacacgaaattttagacccgaaagtcttcttggtgaaggagggtttggttgtgtatttaaaggatgggttgaagaaaacgggactgcaccagttaaaccaggcacagggctcacagttgctgttaaaaccttaaatcatgacgggcttcaaggccataaagagtggctggcagaagttaattatttaggtgatctcattcatccaaatctggttaaattgattggttactgcattgaagatgatcaaaggctgctagcttatgagttcatgcctcgagggagcttggagaatcatctgtttagaaggtctttacctctaccctggtcaatcagaatgaaaattgcactcggggctgcaaagggacttgcttttcttcatgaagaagcaaaaaggcccgtgatttatcgtgatttcaaaacttccaacattttgttagatgcggaatataatgcaaagctttctgattttggtcttgctaaagatgcccctgagggtgataaaactcatgtatctactcgagtcatgggaacatacggttatgcagccccagaatatgttatgacagggcatctcaccgcaaagagtgatgtatatagttttggtgttgttttacttgaaatattgactggtagaaggtcaatggacaaaaaccgtccaaacggtgaacacaatcttgttgagtgggctagaccacatttaggagagaggaggaagttttataagctaatagacccacggcttgagggtcatttctctataaagggagcgcagaaagcggcccagctagcatcccgttgtctgagccgggacccaaaagtcaggccactcatgagtgaagttgttgaatttttaaagccattgccagctttaaaggacatggctagctcatcatattacttccagaccatccaatcggaacgggttgggtctagcccaaatggccgaaacggggtccgagttcaaaacgggccgctttcaagaaatggatcacagcatccaagaagcctctctatatcaagtagcacacgtgcatcgccgtttcatcagcagttgactcaaaactcaccaaagccgaatgaaaagaattaaggtgtctttggtatatgataattatcgatttcttttcctagtattatcattaattttttttcttccaaaatttagttccaattgtctaaagcagtataagaaacaacagacagatgtggaatttatgttgtgatgaattagagtga

SEQ ID NO: 9826 - DNA, 2195 bp, Daucus carota
cttttaggacaagatagatggctagatagatgctactgtgtactttaaacaagtgttttaagtgtgttttgtatgtctaggcatgtgatttgatttacccctatgctcttgggggggggggggggggggggggggggggggggggggggggggggggggggggggggggggggggggggggggggggaaattttgaattggttttcacttatttcatctatatatttggtgggtatttttcttttgtctaaagattctagcttttcttgtgttttagctgtttgtagggttgaatcattttcttttgctgattttttcaactggggttttgttaaatttgccttatgattttggggttctgtatttgattgttggggttctgatgggctgttgattagggcttattgttgagttctgtgagaaaatgggattaagtgatgctaaaagtgagccttgggaggtgggcaaatctaagaacaaggtgaagaaagatgatgctgatggggaagttactggttgttggattgcgttgaggtcaattcgcagctgtataacatcaagatctaaagttgacaactcaattagtggcatcagtttacatgaaagcaaatatgccaacagtagaaaagaccaaccatctactgcaatttcatcaactacaaccagtactgcagaaagtagttcatccacttccaaacttgaagaggaacttaaaattgcttctcggcttcggaaatttgcttttaatgatcttaagatggcaacgaggaattttaggcctgatagtcttcttggtgaagggggatttggttgtgtattcaaggggtggattgaagagaatgggacggcacctgtaaaaccaggcactggccttactgttgctgtgaaaactctcaatcatgatgggcttcagggtcacaaagaatggctggctgaagtcagttttctaggtgacctcattcatccaaacttggttaagctgattggttattgtatagaagatgatcagcggttgctggtttatgaatttatgtctcgagggagcttggagaaccacctttttaggaggtctctgcctctcccatggtccatcaggatgaaaattgctcttggtgctgcaaaaggtcttgcttttcttcacgaggaagctgaaaggccagtgatatatcgtgatttcaagacttccaacattctgttggatgcagaatacaatgccaagctttctgattttggtcttgcaaaagatggtccagagggtgataaaactcatgtatcaactcgagtaatgggaacttatggttatgctgccccggaatatgtcatgacagggcatcttacatcaaaaagtgatgtatacagctttggtgtggttatgctcgaaatactgagtggtaggaggtcaatggacaaaaatcgtccaaatggggaacataaccttgtggaatgggcaagacctcatctgggggaaagaagaaaattttataagttaatagatcctcggcttgaaggtcatttttcagtaaaaggtgcccagaaagctgcgcatttggctgctcgctgccttagcagagacccaaaagtaaggcctcgtatgagtgaggtagttgaagcactgaagcctttgccaaacctgaaggacatggcaagctcatcttattattttaagaccatgcaagctgatcgagttgcatccagcccaaacacaagaaatggatcaaatggcattatacgatcacaagcaggatcctttacaagacctgggcaacaaccgaggagcctctcgatgccgaaaggtacccaagcttctccatatcatcagttcccacataattcaccaaaaccacagggtaaatcatagatgatggtaatctgggctttgcttcataaactccaaatgttactctctctttcggtcccagattagaagtatatttggccttggatgccggacaaaggattggagaagctctcgtagtttacaccttataacttatgttgcaatctttgatcaagcactgtccatccagtgctggagaagtaatgtattaggagctgacgttcactgaagtaaatacttgcacttaaaacataaagatagcatcttttatatgtaaaagaatcctgaagttaaattgtgcttcattgttgttttttgaaattgggatgtcttttgcatgttaatattttaattcttg

SEQ ID NO: 9827 - DNA, 1953 bp, Cucumis melo
atcttcttctcaactgggtctcagctgggtgtattcttctttttgccctaagtgagagctggaaaatttcggtgatcttttggtaggtttttacttgtggtgttacgaggagaagttttaactagctggggttgaagtagcgactcgggggaggtgaggcactggatggtgtttcggattcgaggagttttgagattatctgtgttcttttgggtacttaaggcatggaggtaattgctgaagatgggaaagttgagtctcgggaagttagggaatcgaaggggaagaagaagcagaaaaacaacaaggaacaagttgaaaccgtggaagaggagactggttgttggattgctctgaggatttttggtagctgcatttcttcgagatccaaagttgatagttcgataagtgggactagtatcaactatgctgaaagcaagtctacggctgattcaagtagagaccaaccaactcctcgagagatatcttcaacaaacacaagtatgagtaatggagagagtaattcatcgacttccaaactagaagaggaacttaaaatttctcctcatctacggaaattttcatttaatgatcttaagttggctacaaggaacttcagacccgagagtcttcttggcgagggtggttttggtagtgttcttaagggttgggatgaagaaaacggaactgctccagttaaacctggcacaggactcactgttgctgttaaaaccctcaaccatgatggtcttcagggccacaaagaatggatggctgaagttaattttctcagtgatctcaaacatcccaacttggtcagacttattggttactgcaatgaagatgatcaaagactgcttgtatatgagttcatgcctagaggaagcctagagaatcatcttttccggagatctctaccacttccgtggtctattaggatgaaaattgcacttggtgctgccaagggtcttgcttttcttcatgaggaagcaaaaagacctgtgatatatcgtgattttaaaacatccaacattctattagatgccgaatacaatgccaagctttctgactttggacttgcaaaagatggacccgatggagataaaacccatgtctctactcgggtgatgggaacatatggctatgcagctccagaatacgttatgactggacatcttacatcaaggagtgatgtttacagttttggggtggttcttctcgaaatgttaactggcagaagatccatggataaaaaccgtccaaatggtgaacataaccttgtggaatgggcacggccatacctaggagagaaaaagagattctatcgcttgatagaccctaggcttgagggtcatttctcaataaaaggtgctcaaaaagcagtacaattagctgctcaatgccttagccgagatcaaaaggtcagacccttgatgagtgaagttgttgaagctttgaagcctctcccaaacctcaaggacatggcaagttcatcttattattttcagacaatgcaagctgaccgtgtaagatccagccccatggcgagaaatggctaccacacagcggctggaccagctccaaagaacgggcagcaactacgcagctattcaatcgccaatggttctcatgcttctccatatcatcatcagcagccccatccatctccaaaacccaatgtcaaagcctaagaattgggttgtttggtaattaattagtaattatctagttgtgttaacccatctcattttgtcgtcaaatagatctcccccttctacctcagtatagatagatgtttattttgcaaaacagcatttgctggtggatcattgaaaaatgctacaggcagagatgtctgcattatcatcatcttgttaaaatgggaaacctggcagaaagagtgtacgatagcagatgaattttgttcatcgattttcaatgtcatattgtttt

SEQ ID NO: 9828 - DNA, 2198 bp, Flaveria ramosissima
gaggattgaacttgtcattcttttgtggagaattgaaatttctttaatcttttgtgagcagtagacataactaggtggtggtgggtgcttttgaactgagattatacctgattacagcttgcactctctttgtgtgtgtctctttgaatccttagcctttgtgtgtgatctcaatctccgcttcactgttgcaaaaaccatcaaaattcccaaattcttttttgtcattttctggtaatttcaagattgggtgtacaagattacgatcttcactaaaatccaatctttgtgggtttttgggtggttttttgttgtatgcaagtcaaagttcattgcttttctccttcaaccatgtggagatgagtttttatccaagggtgtgtcaccatctcccatatggtcttcagatgggtctcgattattacatctgatttggggtttgttgagaaattggggattttgatgatacacactgggtttgattctagggtttgttttgaaagatgaaatctgctgatgaaaaagggattggatcttgggatgttatgaaatcaaagggtaagaagaagaataagcataaagaatgtgatgatattggtttagatggaggtggggatggggctaccactggatgttggagcagatggaaacttattggaagctgtatttcttcgagatctaaagttgatacttcaatcagtggcatcagtactcactgtgagagtaaatcagcaaatgatacaagcaaagatcaaccggtagttcaagtagtgtcatcaaccaccacaagtacaggagaaagcatttcatctacccaaaagttagaagatgagttaaaagtgtcttcccgccttcggaaattcgcttttaatgatttaaaaatggcaacacgaaattttagacccgaaagtcttcttggtgaaggagggtttggttgtgtatttaaaggatggattgaagagaatgggactgcaccagttaaaccgggcacagggctcactgttgcggttaaaaccttaaatcatgacgggcttcaaggccataaagagtggctggcagaagttaattatttaggtgatctcattcatccaaatttggttaagctgattggttactgcattgaagatgatcaaaggctgctagcttatgagttcatgcctcgaggaagcttagagaatcatttgtttagaagatctttacctctaccatggtcaattagaatgaaaattgcacttggggctgcaaaggggctcgcttttcttcacgaagaagcaaaaagacctgtgatttatcgtgatttcaaaacctccaacattttgttagatgcagaatataacgcgaagctttctgattttggtcttgctaaagacgcccccgagggtgataaaactcatgtttctactagagtcatgggaacatacggttatgcagccccagaatacgtaatgacagggcatctcactgcaaagagtgacgtatatagttttggtgtcgttttacttgaaatgctgactggtagaaggtcaatggacaaaaaccgtccaaacggtgaacacaatcttgttgaatgggctagacctcatttaggagagaggaggaggttttataagctaattgacccacggcttgagggtcatttctctataaagggagcgcagaaagcggcccagctagcatcgcgttgcctgagccgggacccaaaagtcagaccattcatgagtgaagttgttgaatctttaaagccattgccagctctaaaggacatggctagctcatcatattacttccagaccatccaatctgaacgggtcgggtcaagcccaaatggccgaaacagggtccaagctcaaaacgggtcactttcaagaaacgggtcacagcatccaagaagcctttcaatatcaagtagcacgcgtgcatcaccatttcatcaacagtcgactcaaaactcaccaaaaccaattgaaaaaaattaaggatggtgtgtttggcatacgatgattatcgatatcttctcctagtactgttattattattttttttcaaatttcgaagatttagttctaactgtccaaggcagtataagaaacaacagaaacagatgtgaatttatgttgtgatgaattttaaaagggatcataggagtgtaatttatgaagagttgtgaagttgatttaaaaagaagcagcaggttggtg

SEQ ID NO: 9829 - DNA, 2068 bp, Flaveria ramosissima
attcttttgtggagaattgaaatttctttaatcttttgtgagcagtagacataactaggtggtggtgggtgcttttgaactgagattatacctgattacagcttgcactctctttgtgtgtgtgtctctttgaatccttagcctttgtgtgtgatctgaatctccgcttcactgttgcaaaaccatcaaatttcccaaatcttttttgtcattttctggtaaaattcaagattgggtttacaagattacgatctttcactaaaaatccgatctttgtgggggttttttgggtggtttcttgttgtatgcaagtcaaagttcattccttctctccttcaccatgtgagatgagtgtttatccaagggtgtgtcaccatctcccatatgttcttcagatgggtctcgattattacatctgatttgggtcttcttttagaaattggggattttgatgatacacactgggtttgattccaaggtttgttttgaaagatgaactctgttgatgaaaaggggtgggatcttggcatgttatgaaatcaaagggtaagaagaagaatcagcataaagaatgtgatgatatgggtttagatggaggtggggatggggctgccactggatgttggggcaagtggaaacttattggaagctgtattcttcaagatctaaggttgatacttcaatcagtggcatcagtactcactatgaaagtaaatcaacaaatgatacaagcaaagatcaaccggtagttcaagtagtgtcatcaaccacaacaagtacaggagaaagcaattcctctacccaaaagttagaagatgagttaaaagtgtcttctcgccttcggaaatttgcttttaatgatttaaaaatggcaacacgaaattttagacccgaaagtcttctaggtgaaggagggtttggttgtgtgtttaaaggatggattgaagagaatgggactgcaccagttaaaccgggcacagggctcactgttgctgttaagaccctaaatcatgacggccttcaaggacataaagagtggctggcagaagttaattatttaggtgatctccttcatccaaatttggttaagctgattggttactgcatcgaagatgatcaaaggctgctagcttatgagttcatgcctcgaggaagcttggagaatcatttgtttagaagatctttacctctaccatggtcaattagaatgaaaattgcacttggggctgcaaaggggctcgcttttcttcacgaagaagcaaaaagacccgtgatttatcgtgatttcaaaacctccaacattttgttagatgcagaatataacgcgaagctttctgattttggtcttgctaaagacgcccctgagggtgataaaactcatgtttctactagagtcatgggaacatatggttatgcagccccagaatatgtgatgacagggcatctcactgcaaagagtgatgtatatagttttggtgttgttttacttgaaatgctgactggtagaaggtcaatggacaaaaaccgtccaaactgtgaacacaatcttgttgaatgggctagaccacatttaggagagaggaggaggttttataagctaattgacccgcggcttgagggtcatttctctataaagggagcgcagaaagcggcgcagctagcatcgcgctgcctgagccgggacccaaaagtcagaccactcatgagtgaagttgttgaatctttaaagccattgccagctctaaaggacatggctagctcgtcatattacttccagaccatacaatctgaacgtgtcgggtcaagcccaaatggccgaaacagggtccaagttcaaaatgggtcgctttcaagaaacgggtcacagcatccaagaagcctttcaatatcaagtagcacgcgtgcatcaccatttcatcaacagtcgactcaaaactcaccaaaaccaattgagaagaattaaggatggcgtgtttgacatacgatgatcatcgatatcttctcctagtactgttatgtatttttttcaaacttccaagtatttagttctaactgtctaaggcagtat

SEQ ID NO: 9830 - DNA, 1478 bp, Chrysanthemum coronarium
aaataagaagaagaggaataatattaataagaatgaaaaaagtgatgaagaaattggtgttgaggaaactactagtactggatgttggaataggtggaattttattggtagctgtgtttcttcaagatctaaagttgataactcaatcagtggcataagtgaaaataaatcaacaaacgatacaagcaaagatcagccgacagctcaagtaatctcatcaactacgactagtacaggggaaagcaattcatccacccaaaggtttgaagaggaactcaaagttgcttctcgccttcggaaatttgctttcaatgatctcaaaatggcaacacgaaactttagacccgaaagtcttcttggcgaaggagggtttggttgtgtatttaaagggtggattgaagagaatgggactgcaccagtgaagcctggtacagggcttaccgttgcggttaagaccctcaatcatgacgggcttcaaggccataaagagtggctggcagaagtaagttatctaggtgatctcattcatccaaatttggttaagttaattggttactgcattgaagatgatcaaaggctgctagcatatgagttcatgcctcgagggagcttggagaatcatttgtttagaagatctttgcctcttccatggtcaatcagaatgaagattgcacttggggctgcaaaggggcttgcttttcttcatgaagaagcaaaaagaccagtaatttatcgtgatttcaagacctccaacattttgttagatgcggaatataatgcaaagctttctgattttggtcttgctaaagatgcccctgagggtgataaaactcatgtatctactcgagtcatgggaacatacggttatgcagcccctgaatatgtgatgacaggacatctcactgcaaaaagtgatgtatatagttttggtgtcgttttgcttgaaatgttgacgggtagaaggtcaatggacaaaaaccgtccaaacggtgaacacaaccttgttgaatgggctcggccgcatttaggagagaggaggagattttataagctaatagaccctcggctcgagggtcacttctctataaagggagcccagaaagctgctcagttagcatcccgttgcttgagccgtgactccaaaatcagacctctaatgagtgaagttgtagagtccttgaagccactgccagccctaaaagacatggcaagctcatcatattacttccagactatccaatctgaacgggttgggtctagcccaaacgggcgaaatggggtcagagttcaaggcgggtcattttcaagaaatgggtcacaacatccacgaagcctctcaatatcaaatagcacacgcgcatcaccttttcaccaacagcttactcagaactcaccaaagccgaatgagaaacagtagagtaaggcgtgtgaagtatgtggtcatcagtgtatgttcctagtatgattattaatttttt

SEQ ID NO: 9831 - DNA, 2941 bp, Sorghum bicolor
gaaaggagcgcccagtaaccgagcactagcagaggcaagggaggggcaaagcagagtatagggagggaggagtaggcggaaacgaagcaacggaagcgtaagcgttaggagacgaggcgccgagggagggaggcaagcgaagaaggccccgccccgatcacaccaaacgcttcgtgctgctgccccgtctcttctcgtcgtgatctcagggcaggcagcggatcgatctcacggcggcggcggaggcggaggcgaccttcttaggcgcgccaccgccatcccagccgagcgcgcggcgatccagatccagtgctctggttgccgtgtgcactgaatcagtgatcgggcggagcaatacaaagcgggagggcctgatcatttgagctgcttttctagagaatgtcagagggtaacgtggatagcatcgagatatctgtcagtaatgatgagaggaggaatagggcagatgccgagatctcagaggatgagccgaggcacaccaggatgcggtcgctgaggaagaaagccctacatgcatcgacaaggctgacacactcgctaaagaagaggggaaagagaaaagtggactgcagagtgccaaggatagctatagaggatgtcagagatgctgaagaagagcaggcagtgagctcgtttcgggaggttttgtttgctaggggcttgttaccagtcaagcatgatgattatcatatgatgcttagatttttgaaagcgaggaagtttgattttgaaaaagcagcacagatgtgggcggacatgctgcagtggagaaaggagttcggtacagacaccatttttgaagattttgaatttcatgagctagaggaggtcctgcaatattatcctcatggttaccatggggttgacaaggaaggaaggcctgtgtacattgagttgcttgggaaagttgaacccaacaagcttgtacaaatcacgacagttgagcgctatattaagtatcatgtacaggagtttgagagagcttttcgggagaaattccctgcatgctcaatttctgccaaaaggcatatagatactacaactacgatattggatgtccatggtgtgggctggaagaactttagcaagatcgcgagggatttggtgcgttgtatgcaaaaaatagatggtgactattatcctgagacactacatcaaatgtttattgtaaatgcgggaccaggtttcaagctgatatggagcactgttaagggacttcttgaccccaaaacgtcatctaaaatacatgttctaggaacaaaatatcaaagcaaacttcttgaagctattgatgcaagccaattgccggagtactttggtggttcatgcacgtgttctaacctcggagggtgcctgaggtctaacaaaggcccctggagcgatccttcaatcatgaagcttgtacatagcatggagtcattgaaggaagttgggcaagtatctgatatagaagaaacatttacaggctccatgagattgcgtgctctcaagttaccagaacgaattagtgacacatcaaatgctgaatcaggttcagatgttgatgatcttggatcccctgtggctcctgaagatgttgaatatcctagtttggccccagttcgagaggaagtgagggaatcaggatctacaacgtacagtggtttgattggcatgtctcatacggcagataaagctgtaggatccaacaggagatacaactctactggaaatgaaattaggcaattcaacacagaacaaggttccctgataaatgggggtttacctgcgccagcaggtcggcgtgccccaaatgatggtgtaggcaatgatgatgggttcttgaaatatatatcaagaagagttgttgatgtatttcttagagtactatcatttttgcggttcttcattcgtcgacgacaacacttggaaaacgttcattcacatgctgcaactgcacccagtaatctggcagatcttcagacaattaaggaagatcgtgtaaatccttgccttgagcgtcttgatcgacttgagtcaatgtttaatcagctgagcagaaagcctccagagcttccacaggacaaggatcgggccatacaagattcttttgacaggataaagtccattgagtttgatctggagaagacaaagaaggtattgcatgcaacagttatcaaacaaatgcagatggcagaaaccttggaagctgtaacggagcctgatcttaggcggaggaaattttgtacataatacacttacctgcaatgtacagaaacaagagaaaaaaaatggcgatttactaatgtctgctgcctgacagagaattgaactacattgctttgtacatggtcgccttttgccgattatctttcccagcctactatagagatgagtgccatggcatgttagccgcaataacaacagatagtttacctgtgataaactgaagagatagtcatgaacagcgtcctggaaaatcaccagacactgaccaatctatagagctaaaggaattctgtgttatgctcctctaagcgctgagcctcctgatatgatactctgtagcatgatgattgatgaggaatgatgttcgtctacatcatgactccatgagctgtctgccaattgaagacgcatggaactgagctgtcaactactagaccacagccatttgccagagggtagacgtcgttttctgttagaagaagagaggacctgcgcggcgaggacgaatgggagcagcgcacatgctcgcgaggaaagaatcgctgaaggtccaactgcaaaccttttgaaactgtcaatatcgtgagaatctgggcacgaagccacgcatacacttgaagttcacggatagactcgtgtaattttgcttgccccctgatccagggtattaccaacaggtccgttttccacaacagacggaattaatccacca

SEQ ID NO: 9832 - DNA, 2492 bp, Zea mays
gagacgaggcgccgagggaggcaagccgatcacaccaaacgcttcgtgctgctgccccgtctcttctcatcgtgatctcagggcagtggatcgatctcacgtcggaggcgaccttcttaggcgcgccaccgccatccgagccgagccgcagcgatccagatccagtgttggggctgccttgtgcaccgaatcagtgatcgggcagcgtaatacaaagagggagcgcttgatcatctgagctggttttgtacagaatgtcagagggtaatgtggatagcatccagatatctgttagtaatgatgagaggaggaatagggcagatgccgagatctcggaggacgagccaaggcacaccaggatgcggtcactgaagaagaaagccttgcatgcatcgacaagactcacacactccctgaagaagagggggaagagaaaagtggactgcagagtgccaaggatagctatagaagatgtcagggatgctgaagaagagcaagcagtgaactcgtttcgggaggttttgtttgctaggggcttgctaccagtcaagcatgataattaccacacgatgcttagatttttaaaagcaaggaagttcgattttgaaaaagcagcacagatgtgggcggacatgctgcagtggagaaaggagttcggtacagacacaatttttgaagattttgaatttcatgaactagaggaggtcctgcaatattatcctcatggttaccatggggttgacaaggaaggaaggcctgtctacattgagttgcttgggaaagttgaacccaacaagcttatacaaatcacaacagttgagcgctacattaagtatcatgtacaagagtttgagagagctttccgggagaaattccctgcatgctcaatttctgccaaaagacatatagatactacaacgacgatattggatgtccacggtgtgggctggaaaaactttagcaagattgcaagggatttggtgcgttgtatgcaaaaaatagatggtgactattatcctgagacattacatcaaatgtttattgtaaatgcgggacctggtttcaagctgatatggagcactgttaagggacttcttgaccccaaaacgtcatctaagatacatgttctaggaacaaaatatcaaagcagacttcttgaagctattgatgcaagccaattaccagagtactttggtggttcgtgcacatgttctaaccatggagggtgcctgaggtctaacaaaggcccctggagcgatccttcaatcatgaagcttgtacatagcatggagtcattgaaggaaattgggcaagtatctgatatagaagaaacagttacaggctccatgagattgcgtgctctcaagttaccagaacgaattagtgacacgtcaaatgctgaatcaggttcagatgttgatgatcttggatcccctgtggctcctgaagatgttgaatatcctagtttggccccagttcgagaggaagcgagggaatcaggatctacaacatatagtggttcaattggcatgtctcgtatggcagataaagttgtaggatccaacgggagatacaactctactggaaatgaaactaggcaggtcaatgcagaacaaggttccctgataaatgggggtttacttgcgcccgcaggtcagcgtgccccaaatgatgctgtaggcaatgatgatgggttcttgaaatatatatcaagaagagtcgttgctatatttcttgaagtactctcttttttgcggttcttcattcgtcgacgacaacactcggaaaatgttcattcacatactgcaactgcacccagtagtctggcaaatcttcagacaattaaggaagatcgtgtaaatccttgtctggagcgtcttgatcgacttgagtcaatgtttaatcagctgagcaaaaagcctccagagcttccagaggacaaggaccgggccatacaagattcttttgacaggataaagtccattgagtttgatctgcagaagacaaagaaggtattgcatgcaacagttatcaaacaaatgcagatggcagaaaccttggaagctgtaacggagcctgatcttaggcggaggaaattttgtacataatacacttacctgcagtgtacagaaacaagaaaagatggcgatttactaatgtctgctgcctggcagagaattgaactacattgctttgtacatggccgccctttgctgattatctttctcagcttactatagagatgagtgcattggcatgttagcctcaatcagggggcctcaataacaacagatagttgacctgtgataaactgacgagataacagcgtcctggaaaatcaccggacactgcccaatctattgagctaaagagttctgtattatgcatcttttgtgtttcagaacagttagtttcacccataattcgatccattttttggttggtacatgtgaacatctgattgaacttggttttcttagaatttttgcaaa

SEQ ID NO: 9833 - DNA, 3568 bp, Panicum virgatum
tgtgccctgcccctgatctgcccgggagggaggagcggcaggagcttggggagggggtgccgccagcgggctcgggtgggatggccgaaggaggcgagacgcaatccgatttggagaccaccaaaaatgtgtgggcaacgtatctactatagaggatgcaaaacgaaggaatgcatgtcaattttgtgttatctggttgaagtcagtctgacgttgttaacttattgttaaacttgtcagagtgggtgccagtctcctcaaccgacatctggggcccacgctcagcgcccgcggtggaccctgcacgtgagcgtcggcgctcggtggctacgaaagcagtcacgcaacgcgggcgcgcggcgagcggagggagcgaggcaatcgcgacgcagcctcccgccacacacggcagccccgctgacgccgggccccggagcaacaagaactgggaaaaagaacgccgccgcccagtacccgagcactagcggcaaggcagcaagtaatagggggtgggaggagtaggcggaaacgaagcaacggaagcgtaagcgttaggagacgggcgccgagccgagggaagggaggcaagcggaggcccccgctccgatcacaccaaacgcttcgttcgtgctgctgtcccccgcctcctctcgccgtgatcccagggcggcggggtcggtctcgccgcggccgcggaggcgacccttttagtttgacgcgccaccgccatccgacgccgcgatccagatccatgtgggggttcgtgccacttgtatctgtatacacggaatcagtgatcgggcagagtgatacgaggagggagggcctgaccgtttgagctgcttttgtagagaatgtcaggaggggaatgcggatggcatcgagatattgatcggtaatgatgagaggagggacagagcagatgccgagatctcagaggacgagccgaggcacacgaaaatgcgggcgctgaggaagaaagcactgcatgcatcgacaaggctgacacactcgctgaagaagagggggaagaggaaagtggactgtagagtaccaaggatagcgatagaggatgtcagggacgctgaggaagagcaggcggtgagctcgtttcgggagattttatttgctaggagcttgttgccagtcaagcatgatgattaccatatgatgcttagatttttaaaagcgaggaagtttgactttgagaaggcagcacagatgtgggcagacatgctgcagtggagaaaggagtttgggacagacacaattttcgaagattttgaatttcatgagctagaggaggtcctgcaatactatccccatggttatcatggggttgacaaggaaggaaggcctgtatacattgagttgcttgggaaagtagaacccaacaagcttgtacaaattacatcagtggagcgatacattaagtatcatgtgcaagagtttgagagagctttccgtgagaaatttcctgcatgctcaattgctgccgaaaggcacatagataccgcaactacaatattggatgtccatggcgtgggctggaagaattttagcaagattgcgagggatctggtgcgttgcatgcaaaaaatagatggtgactattatcctgagacactgcatcaaatgtttatcgtaaatgctggacctggtttcaagctgatatggagcactgtgaagggacttcttgaccccaagacatcatctaaaatccatgttctaggaacaaaatatcagagcagacttcttgaagctattgatgcaagccaattgcctgaatactttggtggattgtgcgcatgccctaaccatggagggtgcctgaggtccaacaaaggcccttggagcgatccttcaatcatgaagcttgtacatagcatggagtcattgagagaaattgggcaagtgtctgatatagaagaaacagttacagggtctgtaagattgcgtgctctcaagttaccagaacgaattagtgacacatcaaatgctgaatcaggttcagatgtcgacgatcttggatcccctgtggctcctgagcatgttgaatatcctagtttggcgccagttcgtgaggaagcgagggaatcaggatctacgacttacagtggttctgatggcacgtctcatatggcggataaagtagtaagatccaatcaaagatacaatgctgctggaaatgaagctagacagtttaatggagaacaacgttccttagtaaatggggctttgcctgcgacagcaggtcggcgtgccctgaatgatggtgtgggcaatgctgatgatggggtcttgaaacatttatcaagaacagtcgttgctgtatttattaaagtactctcttttttgcggtttttcattcgtcggcgacaacacctggaaaatgtccgtccacatactgcaactgtgcccagtaatcaggcagatcttcagataattagggaagatcgtgtgaacccttgtctggagcgtcttgatcgacttgagtcagtgtttaatcaactgagcagaaagcctccagagcttccgcaggacaaggatcgggccatacaagattcttttgacaggataaagtccattgagtatgatctggagaagacaaagaaggtattgcatgcaacagttatcaaacaaatgcagatggctgagactttggaagctgtgaaggagtctgatcttagggtaagtatatcataattatgtacttccatcatcctgtccgcattggtgtttttcttcaaatccgtatgatgcagtttaattagactttgatagagctttaatgtctgaaagtgacacaaccacatcatgtgtactcatgcatggttcacatttttctgcctgaattagcatataaaatagatggttctgaaatcatcctgcagattataataattttataatttcaaaaaaatttataataattttatttgtctacactgatctttttttgttcttttggtgcagaggaggaaattttgtacataatacacctaattgcaatgtacagaaacaagaaaacaagttggcgacttactaatatctgatacccgacagaatcaaacaacattgctttgtacatggctgccctggtctacagagatgagcaaatagcgatggcatcgtagcctcaataacaacagatagttgtcgacctgtacactgaggaaatagtcaaaaacagcatcctggaaagtgcccagacaccgtccagtttcactcataattcaatccattttttggtttattactccatacatctatcacactttcatacatctgtttcgacttggtggtgttgaccggaatcagcggtgaacacgtctaaacctatttccgtcacgtccaatggtcaggtctttgctagtttgcatttatacaccgtcagcatgtcgaggaatgatgttcgcccgaatcatgagctgtctggcagtcgaagatgcatcgaactgagctgtcaagtagaccacagccggatgtcagatgggagacgccggattctggcagaataggagacctgggcagcgaagacgaggatgggtgagccgcgagcgcgcac

SEQ ID NO: 9834 - DNA, 988 bp, Panicum virgatum
gctaatatggcgggaaactttggcgccatctgttcccgcgccgccgcctccctatttagcccgcgccaccgccgccgcctcctcctcccctcaactccaactcctcccagaattctccccttctcccgccgccttcacccaggaaccctctcgaccacagccatggcctcatcgaacggcgccgccgccaccgacgccgtccaggagcctccccagaagatctccaagctcgcgcccctactcaaggtgaagaagctctccgacaaggccgtcctgccgtcccgcggctccgccctcgccgccggctatgacctctcgagcgcggcggagatggtggtgccggcgcgggggaaggcgctggtgccgacggacctcagcatcgccatcccggagggaacctacgcgcgcgtggcgccgaggtcggggctcgcgctgaagcactccatcgacgtgggcgccggcgtgatcgacgcggactaccgcggccccgtgggggtcatcctcttcaaccactcggacgcggacttcgccgtgaagcccggcgaccggatcgcccagatgatcatcgaggtgatcgcgacgccggaggtcgcggaggtggaggacctcgacgccacggtgcgcggcgagggagggttcggatccaccggcgtctgagccgtgtcggtctctccgctccgaggagggacggtagttcatcagtacccactctctaggttagtatggcgatgcgagtaggcagcattggtgtgtcttttgttggctgtaagagctcgtgatgttaaggtggcactatcctgcaattgaacatgtcgagaagtttagggttgcgtcggtagctgaatgcaggaaatgctaagaacctgtttcttcagtgatgttactgtgcacctagtagtgttgggggtcatttctgaatatctgcagaattgcctgcgtggctgcgtctggttttccaatctgaaacgatgaaatgaactggaagtag

SEQ ID NO: 9835 - DNA, 1712 bp, Panicum virgatum
acgcatgcttgaggatattcgaatttatatttgtattcattcagtttgacaatacggatgcaaatgagaaaagtgcactgtttaatccgttttccggccaacttgtaaaatgcatggacttcacggacttgttaatcatctggcgttccttgtttattaaacctctgctctgggaggagtgtcaggcataggcaaccacaaatccaagctaggaattttgctcatctcctgtcaatattgggaacatgagctttttcacttatacaaagtaaaaatacagcatttaaatctggaattatcatttgaaaatccaatcaaatttcatttaagaacaggccaatttgcagcagggattctttataagaaaagaatgactgatggcgttaaaacgggagaaagcggataccgagacggcgagaccaacccatgtacccaaccgcgcgagggaaattttgcgcgagcgagggcaaatatggcgggaaactttggcgccatctgttcccgcgccgccgcctccctatttagcccgcgccgccgccgcctcctcctcccctcaactccaactcctcccagatttctccccttctcccagcgccttcaccgaggaaccctctcgaccaccgccatggctgcttcgaacggcgccgccgccaccgacgccgtccaggagcctccccagaagatctccaagctcgcgcccctgctcaaggtgaagaagctctccgataaggccgtcctgccgtcccgcggctccgccctcgccgccggctacgacctctcgagcgcggcggagatggtggtgccggcgcggggcaaggcgctggtgccgacggacctcagcatcgccatcccggagggcacctacgcgcgcatcgcgccgaggtcggggctcgcgctgaagcactccatcgacgtgggcgccggcgtgatcgacgcggactaccgcggccccgtgggggtcatcctcttcaaccactcggacgcggacttcgccgtgaagcccggcgaccggatcgcccagatgatcatcgaggtgatcgcgacgccggaggtcgcggaggtggaggacctcgacgccaccgtgcgcggcgagggagggttcgggtccaccggcgtctgagccgtgacggtctctccgcgcgaaggagggacggtagttcgtcagtccccttactctctaggttaggatggcgatgcaagtaggcagccttggtgtgtcttttgttggctgtaagctctctctcgtgatgttaaggtggcactatcctgcaactgaacatgtcaagaagtttagggttgcgtcggttgctgaatgcaggaaatgctaagaacctgtttcttcagtgtcttactgtgcacctagtgtgttggggtcgtttctgaatctctgcagaattgcatgcgtgtggttttccattctgaaacgatgaaattaactggaagtagactgcgtttctgcagtccgaccgcctgcagaggagcagcactgccggatcatgaggcaacacacaactacacaagggagagcttttttgccaattactacgtgctgaactctgcattccgttatcctgaaaacatgaacatggccttttctccgatcaacatgaacaaattgctactgtggcattcactctgttttcgaccaacacaattcttaatctgcaaccgagtatctcgtctcccacacgatctgatcaacacaacggggc

SEQ ID NO: 9836 - DNA, 1172 bp, Sorghum bicolor
gagaccgaccgaacccggctgaagaaaattttcgagcgagcagggcagggcaaaagatggcgggaaagtttggcgccatctgctcccgcgccgccgcctgcctatttatcccccgcccccgcaatctcctcctccactcaaccccaactcctgccagatttctccccttcccccgccggctgcacccaagaagcctctcgaccttagccatggccgctaccaacggcgccgccaccgactccgtccaggagcatcccgccgccgccaccgagtccgtccaggagcctccccagaagatctccaagatctcccccctgctcaaggtgaagaagctctccgacaaggccgtgctgccgtctcgcggctccgccctcgccgccggctacgacctctcgagtgccgtggagatcgtggtgcccgcgcgtggcaaggcgctcgtgccgaccgacctcagcgtcgccatcccccacggaacctacgcgcgcatcgcgccgaggtcgggcctagcgctgaagcactccatcgacgtgggcgccggcgtgatcgacgctgactaccgcggccccgtgggcgtcatcctcttcaaccactcggacgccgacttcgccgtgaagcccggcgacaggatcgcgcagatgatcatcgaggtgatcgcgacgcctgaggtcgcggaggtggaggacctcgacgccaccgtccgtggcgagggagggttcggatccaccggcgtctgaaggaccttgactgacggctccttccttcactcaggagagaggagggattcggtatctagattaggatggtgatggtgatgcaacctttggtgtcttttgttggctgcaagaactcgtgatgttcaagtcccgctatcctgcgattagtagtaagattagtagtacgtcgtcgaagtttaggttgcgtaggtaactgaatgcaggtattgtcgagaactcgagttgattctgtgatctttattgtgcaccaatcgtgttgatcgtttctggagttccgtggaattgcatccacttgtcgttttcagtctgataaaaagatgaattaactggaagttgactgtttccgcggattaactgcccacgtaattgcagaaagcatcaatatgtatccggaggtgctgacatctgattgatagcagtaattatgctgcagtatcc

SEQ ID NO: 9837 - DNA, 965 bp, Pennisetum glaucum
agacaagttgccatctgaaagctccaaaacaaatcaacccttctctgcctcccctcaactccaactcctcccagatttctccccttctcccatcgccttcacccaagcaccctatcgaccatcgccatggccgcttccaacggttcctccgccactgacgccgtccaggagcctcctcagaagatctccaagatcgggcccctgctcaaggtgaagaagctctccgagaaggccatcctgccgtcccgcggctccgccctcgccgccggctacgacctctcgagcgccgcggagatggtggtgccggcgcgggggaaggcgctggttcccaccgacctcagcatcgccatcccggagggcacctacgcgcgcgtcgcgccgaggtcggggcttgcgctgaagcactccatcgacgttggcgctggcgtgatcgacgctgactaccgcggccccgtgggtgtcatcctcttcaaccactcggatgtggactttgccgtcaagcctggggaccggatcgcgcagatgattatcgaggttatcgcgacgccggaggtcgcagaggttgaggacctcgacgccaccgtgcgcggcgagggagggtttggatccaccggcgtctgagctgagccttgacggccctcttcgctccaaggaggatggtagtttcatcagtctctagattaggatggcggtgcgaccttggtgtctgtagttggctgtaagcgctcctgaagtcgtgatgctagcgtgcgtttggttaagggataccctgcaactgaacgtgtcgagaagtttagtttgggtcggttgatgattgcaggaactgttaagaacttgtttctttggtgatcttgttgcgcaccttgtgtgttggtcgtttcagaatatctgcctaattgcgtgcataagttgtcattccaatctgaatcgatgaattaactggaactagtatgctgcatttttgc

SEQ ID NO: 9838 - DNA, 5804 bp, Sorghum bicolor
gctacaatatcaatttctcaaaaattttcgaaactaaacgaggccctagccccgcctattcaaacggttcgaatcaaaccaccggtgccaccttcacacgcgacgacgcgtgggccctttgtacagtcaggacaacctcacgaaatctcacggctcccgctctcgatttcgaaacactcgccactcttcccctcccattccccactccccagcccaaacccctccgcctccccctccccatcctccgctcgccggcgtcctcccgcggccagatggccccgccgttcgtgttcccgtcgagcctgcgggatctggagcgggacaccgacggcgacggagacgaggagccctcgctccggccgcagaatcccgtcgccgtcgccaccctccgcgccgccgacctcgaggagttcgtcaagggtgcatcatttgatctttctgataaggagctcttctgcattgaggaacaggaggtgttcgatgccatctattctattgttcgtgatttcaattgcttacccccagcccttaagtttaacattgttgagaccttgcgctccaacctcagtgtccttctacccaacatagactcactttcccgggcatccatgtcatccccttctgatactaccccgatcactgatcgcattgcctcacaccgcaatgccctcaagatctactccttctttatcatttctattgttctcacagaggaatctgctgctgaaagcggcacaggggctaaggtgacagcacacggtcgaaagaagaatcatgtatatgcttggaattgggaagctcaaagaggcaggatcatgagtctagttgccaattctcttgaagctgacctttcactgctttttggtcctggaggaactgatgaacgatatctctctttcgtttcaaagtgtacttttgtcctctgtgaaaatcagaatgtgttaaaagatgaggatacaagaaatggtctgtgccggataattggagcaattgccacaaagcatcagagagtttctcaaatcagtgcatctgtctcgcatctgatccacaaatttgatttcactgttcctcatcttgcagaagcagttgcttccgcagagaaaaagtttggtgacggaagcctcgcaatttccctggttagggaaataggtcgggctgacccaaaagaatacgcaagagatagtgttggtgctgataatgttgggagattccttgtagaacttgcagaccgcttgccaaagcttatgtcaaccaacattggtgttttgatacctcactttggtggtgagtcatataagatcagaaatgctcttgttggagttttgggaaagctggctgcaaaggctttcaaggatgttgagggtgatagcaatgctcggcttcgaagtaagcaggctatgctagagattttgattgagcgctgtagggatgtgtcagcatacacaaggagtcgtgtgcttcaggtgtggtctgagctttgtgaagaaaattctatctcaattggcctgtggaatgaagtggcttcagttgcttcagggagactggaggacaaaagtgctattgtgagaaaatcagcactacagcttctcatcacaatgctgcaacacaacccttttggacctcagttaaggactgcaacctttgaggcaactctagaaaagtacaaggaaaaattacaaggaatggagccctcaaatccagacaaagatgaggttgcaaacgattgttcgcctggtgaagtgatcctggggcaagatgaaagtgtcagtgatagctgtttagcatcaagtcaggatcagaatgatcatgatgctacgattgtggatataacaaatttggaacaaataagagctttagttgcatcacttgaagctggtctgcggttttcaaagtgtataacttcgttaatgccaattcttgttcagttgttggcatcatcctcagctactgatgttgagaacaccatccttttactgatgagatgcagacaatttcagatcgaaggatcagaagcagctctcaggaaaatgttacctctggtattttctcaggataagtcaatatatgaagcagtggagagtgcattcattactttatacacaaggaaaagcccaacagaaacggcgaaacgtttgttagaccttgccattgattgtagcattggtgacctcgctgctctcgagagcttagttagttccttagtttcaaaagcagaaatttcatccagcacggtatcagcactgtgggactatttttgctttaacataaacggagtcagaccagtgcaaagccgtggagctctatcaattctttgtatggctgctaagtcgtctcccagcattttgggtgctcacttgcaagatattattgacattgggtttggacgctgggctaaggaggagcctctgcttgctagaactgcatgtcttgctttgcagagattatcagatgaagacaagggcaaactgataaatactagtagtagagtatttgctgcattgcaaggtttggtaacaagcttctcaattcctgagaaaatatggtatggagctgcagataaagctataagcaccatctacaccctacaccctgctcctgaaatttttgctactgagactgcaaagaagtccctcagttctgtattcagtgttttaggaaacgaggatgtgtcaaatggaattgaaactgagaatgatgcctctctgtcatcagtatcaccttcaaagctgggtagatttctttttgttattagccatatagcactaaatcatttggtgtacattgagaattctgttaggaaagttcagaaacagatacggaagaatgaaaaatctcagtccactgtggatctccagtctgacgtgtctaaaagtacggaggcacaaggcataaatgccgaactgggacttggtgcaaccatagatattgcaatcgagtcccttgctgaaagagcagaaaaggaaattgtttgctgttcttctaaaaagaatctcataggacattgtgggccatttctctcaaaactctgcaggaatcttacattgctgcaaaagttcccagacctacaagcttctgcaatgcttgctctttgcaggctaatgatcattgatgcagagttctgcgaagcaaatcttcaaatcttgtttactgttgctgaaagtgcaccttctgaaattgtccgatccaactgcactatagcgcttggtgatttagcagttcgcttcccaaacctcttagaaccttggacagagtatatatatgcccggttacgtgatccttcagtgtcagtgaggaagaacgctgtgctggtcatttctcatcttatattgaatgatatgatgaaggttaaagggtatataaatgaaatggctgtaagaatagaagatgaagatgagaggatatcaagcctggccaaactcttctttcatgagttgtcaaaaaaaggaagcaacccaatttataatcttcttccggatatcttgggtagactgtgcaatcaacacctgaaagaagaaaccttttgcaatattatgcagttcttaattaattcaattaagaaggacaaacaaatggaagctcttgtggataagctgtgcaataggtttgctggagtaaatgatgtcagacagtgggagtatatctcttattgcctttctcagctaaccttcactgaaaagggcctgaaaaaactcatcgataattttaagatgtttgagcatgcattgtctgaagattctgtgatgaaccacttcagaagcgtaatatcaaagtgcaagaagtttgcgaaacctgagctaaaagtttgcattgaggaatttgaggagaaacttagcaaggttcatcaggaaaagaaagaacaggaggaaacaaccaaaaatgctgaggcacacagacagagaattggctcacttgatgaatttctggctactaaggaagttagtcagaacagtgggaattctactgaagaagaaactagcgaggtagttgatccttcggtggatagcagcaccgaacataaggagaacacaccagaatgcagtgaccatactagtacggagaattttcagacatcaccccaagctacagaatcgggtggcgctggagagattcaatcaacacaaactgttcgcaaaggcgtgtcacagttaagggcaaagaaaaccagagatccggttgcagatccttcggtggatagcagcaccgaaaataaggagaacacaccagaacacagtgcgaatactagcacagagaattctcagacatcagccccacttacaggatcagaaggtggcgatgaggagattcagtccacacaatctgttcgcaaaggggcgtcacggtcaagggcaaagaaaaccagagatcccgttgtagaggactcagcagtcagtggtccagttagacgcgccacgcgctcaaccagaagacaaggaaggtgatgtttcagcagtgctcccaccaagcggcagctccatttatagcattccgttccgtgacgatctcgccttgagatcccagaattcggatacactgactggtgcacttgacgattacttaacctggatgtctgactccgacggcggctgttgtatctttttagcatgatgcgtgtcggtcttaatttagctcgctgaatcccggtcggccaataattttctcccatgaaactgtcaaggagagtctgttaactgctccttgtaaggaccacttgtgtttggttgttgcagtagctcggctttgaaatggattgtctgcaactggcttgatatttcaggcctgatgctatgatattttcaacatgttgttcttacgaatccaggctcagctgatgcccagtgtttcagtacgaccacaaaattccatctctcctgatgttcgagtccacacaatagcaataatggatctacggcaagtgccgaaaacgattgtgcaaatccgtctgctgactaagacgacaatcgatcctagtgactgaggactcggaagccgcgaaactgttctcaacatcgacacgtcgtcacagtcacccccccataaggataggatatctggataggaagagaatccaggaaagcaaagctgtaagccgttaatctccccgggtggggaccaccctgacgccggctggccggagagcggtggagcatccatggccggccacgaccatcttccccgccctgacctggctgcagccgagaaagcaggaccggtcgggccacttgcgccatctcggagcgatccgatcgatccttttcgtcacctggaccaccgctcctcctacccaccgcagccgcagacgcgcctccacctccaagaatttgatcgcgcgctggcgggcgcgcggcacgagcacgactcggccccgctaccgcgacggcgacggcgacccccgtcgtgtgccctgctcctcccccgccgcacgttccccccggctcgtctgccaccactggttttctagtggcgcaggcgatgttttccctccctttccctctttttctgaattcgagggtgccgagtttttcttgtcaagctgtgctgtgctgtgctgtgcaggcgcgtgtgtaggtcagcgcggaaattcgagcgacgagagcgttttccgcgaggcggcctgcgtggttttcctgctacggcacggttttggcgtcacaaagcttatccgtagatggctgcgccgttgcagaacacgatgtgctgtaagcgttcaagtaacagccgcgtatttgtggtcgtcatgcactcatgtaatctgaatcttctctctttctttctctctctctaaacaagaaagagtttacgtggcc

SEQ ID NO: 9839 - DNA, 4659 bp, Setaria italica
acactcttcccaaacaggacctgatccgtggaccgtcactgggggactaacggtcaatactagctaggcgtgtattcaaaccacccatgggccatggcatgtggcacctttatctttctatatgacgcgtgggtcctccctgtcatacgggggattcgctcacaaaatttctcgcctcccgctctcgatttcgaaacactccccaactcctccgctcccattccccaacccaaacccctccactcccccgacccccatctcctgctctcgccggcgtccgcccgcccgcggcgagatggccccgccgttcgtgttcccctcgagcctgcgggatctggagcgggacaccgacggcgacgacgagccctcgctccggccgcagaaccccgtcgccgtcgccaccctccgcgccgccgacctcgaggagttcgtcaagggtgtatcatttgatctctctgacaaggagctcttctgcattgaggaacaggaggtgttcgatagcatctattctgttgtgcgtgatttcaactgtctgcccccaggccttaagtttaacctcgttgagaccttgcgctccaaccttagtgtccttctacccaacatagactcactttctcgtgcgtccatgtcatcgccttctgatgctaccccaatcactgatcgcattgcctcgcaccgtaatgccctcaagatctactccttctttctcctttccatcgttctcatggaggaatctgctgctgaaagctgcacaggggctaaggtaacagcacatggtcgaaagaagaatcctgtatatacttggaactgggaagctcaaagaggcaggatcctgaatctaatagctaattctctagaagctgacctatcactactttttggccctggagggacggatgaacgatatctctcttttgtttcaaagtgtacttttgttctctatgagaatcaaaatgggttaaaagatgaggatacaagaaatggcctgtgcaggataattggagcaattgccacaaagcatcagaggatttctcaaatcagtgcatctgtcttgcatttgatccacaagtttgatttcactgttgctcatcttgcggaaacagttgcttctgcagagaaaaagtttggtgatggaagccttgcaatttccctgattagggaaataggtcggactgatccaaaagattatgtaagggatagtgttggtgctgataatgttgggagattccttgtagaactagcagaccgcttgccgaagcttatgtcaaccaatatcggtgttctggtgcctcactttggtggtgactcatataagatcagaaatgctcttgttggagtcttgggaaagctggctgcaaaggctttcaaagatgttgagggtgataacactgctcggctcagaagtaagcaggctatgctagaaattttgattgagcgctgtagggatgtgtcagcatacacaaggagtcgtgtgcttcaggtgtgggcagagctgtgtgaagaaaactctatctcaattggcctgtggaatgaagtggcttcagttgcttcggggagattggaggacaaaagtgctattgtaagaaaatcagcgctacaacttctcatcaccatgctgcaacacaacccttttggacctcagttaaggacttcaacctttgaggcaactctagaaaagtacaaggaaaaattagaaggaatggatcctccaaatccagaccaagatgaggttgtggatgatagttcgcccggtgaagtggtcatgggccaacccgatagtgtcagtgatagctgtgtagctaatagtcaggatcagaacaatcctgatcccacgattgtggaaataacaaaccttgaacagatcagagctttagttgcatcacttgaagctggtctgcggttttcaaagtgtataacttccttaatgccaactcttgttcagctgttggcatcatcttcagctactgatgttgagaacaccattctattactaatgagatgcagacaatttcagatcgaaggatcagaagcagcactcaggaaaatgttacctctggtattttctcaggataagtcaatatatgaagcagtggagagtgcattcattactatatacacaaggaaaagtgcaacagaaacggcgaaaagtttgttaaacctagccattgattgcagcattggtgacctggctgctcttgagtgcctagttagctcgttagtttcaaaagcagaaatttcatctagcacggtatcggcactgtgggactatttttgctttaacatcagtggagtgaaaccagtgcaaagccgtggggctttatcaattctttgtatggcagcaaagtcgtctcccagcattttgggtactcacttgcaagatattattgacattgggtttggacgctgggctaaggaggagcctctgcttgctagaactgcatgtcttgctctgcagagattgtcagaagaagacagaagcaaactgataagtactaatagtagagtatttgctgcgctgataagtttgacaacaagcttctcgctacctgagaaaatatggtatggagctgcagataaagctataagcaccatctataccttacaccctgcacctgaaatctttgctactgagattgcaaagaagtgcctcagttcagtattcagtgttttaagaactgaggatgtgtcaaatggagatgaaactcagaatgatgcctttctgtcatcactaccaccttcaaaactgggtaggtttctttttgttattagccatattgcactgaatcatttggtgtacatcgaaacttctgttagaaaaattcagaaacagaagcgaaagaatgagaattctcaacccatcagtgaggatcctcagttggatgcatctaaaagttcggaggcacaaggcataaatgccgaactgggactgggtgcaacaatagatatcgcaattgaatcccttgctgaaagggcggaaaaggagattgtttgctgttcttcagaaaagaatcttataggacattgtggaccatttctgtcaaaactctgcaggaatctgactttgctgcaaaagttcccagagttacaagcttctgccatgcttgctctttgcaggctaatgatcattgatccagaattctgcgaagcaaatcttcaaattctgtttactgttgctgaaagtgcaccttctgaaattgtccgatccaattgcactatagctcttggtgatttagcagttcgcttcccaaacctcttggaaccttggacagagtatatatatgcccgattgcgtgacccttcagcatctgtcaggaagaatgcagtgctggttatttctcatcttatactgaatgatatgatgaaggttaaaggttatataaatgaaatggctgtaaggatagaagatgaaaatgagaggatctcaagccttgcaaaactcttctttcatgagttgtcaaagaaaggaagcaatccaatttataatcttcttccggatatcctgggcagactgtgcaatcaacacctcaaagacgaaacatttcgcaacattatgcagttcttaattagctctattaaaaaggaaaaacaaatggaagctcttgtggataagctctgcaataggtttgctggtgtaaatgatgttagacagtgggagtatatctcttattgcctctctcagctaaccttcactgaaaagggtctgaagaaactcatcgacaattttaagatgtttgagtatgcattatctgaagattctgtgatgaaccacttcagaagcgtgatatcaaagtgcaagaagtttgcgaaacctgagctcaaagtttgcatcgaggaatttgaggagaaacttagcaaggttcatcaggaaaagaaagaacaggaagagacaaccaaaaatgctgaggcacacagacagagaattggctcgcttgacgaagttctggctagtaaggaagttgggcagagttgtggacattctgttgaagaagaaactagtgagatagttgatccttcagtggatggcagcactgaagataaggagaacatgccagaatgcagtggcaatatttctacggaaaattgtcagacatcaacatctacaggatcagaagatggtggcgaagagattcagtcaaagcaacctgtccgcaaaggcttgtcaagatcaagggcaaagaaaaccagagatcctgtcgtagaggactcagcagacagtgctccagttagacgctcaactaaaagacaaggaaggtgacgctccaacgctccttgaatttattgcgagtccagcttttgggtaatatggacctagtggcaactccttttgtggctgtgcattgtgttggccacttggccttactcagtgatgatctcgccttgagatcctggaataccggatgtgctggtgcccttgacgattcctcaacactggaaatctaaatccaacggtggcgatctcccgtgaaattgtacgaggaagtctgttaactgctccttgtaacttgtaaggggcacttgtatctgtatttgttggttgcattagttctcctttcaaatcgactgcatgcttccgaaggacctgcgtgtatctggcctgatccttcactcccgtgttacgatgttttgaatgccctgttctcatcgtcaatctagactcaa

SEQ ID NO: 9840 - DNA, 663 bp, Saccharum officinarum
ccggattggttaagattctcaagaaatacgacaagagaactggagccctgatccggctgcccttcatccagaaagttcttcagcagcctttcttcaccactgatctcctgtacaagcttgtgaagcagtgtgaagccatgctggagcagctccttccggttagtgaggcatctgtatcaagtgaagatgtaaaaggagacagtaatgatgaagagaagctggcaaagccaagttcttccttggtaaatggtggtggcattccagagttagatgagattgagtacatggagagtatgtacatgaagagcaccgtcgcagcccttaggtcactgaaggagatccggagcaagagttcaactgtcagtatgttctcgttgccacctcttcagggcaacaatgcacagggcagttaccagatccgggcagagcaaaccaaactagatgaggagccagataggtggagcaaagtaacagtgatagagcaggcggccaaatgacagggcgaatgtgcaacatctgatgcctcattcgtcacaaatttagacttacatttgctggagatgagactgggatctcaatctcctggcgtatattcagtttgtatgaattcaggattcctaacaactgtaaaatggtggaaatgttaaatcatagaatcccagc

SEQ ID NO: 9841 - DNA, 559 bp, Saccharum officinarum
caccattgatttcctgtaaaagttgttaaaccagtgtaaacccatgctggagcagctccttccggttagtgaggcatctgtatcaagtgaagatgtaaaaggagccagtaatgatgaagagaaactggcaaagccaagtttttccttggtaaatggtgggggcattccaaagttaaatgagattgagtacatggagagtatgtacatgaagagccccctcgcagcccttaggtcattaaaggagatccggagcaaaagttcaactgtcagtatgtttttgttgcccccttttcagggcaacaatgcacagggcagttaccagatccgggcagagcaaaccaaattaaatgaggagccaaataggtggagcaaagtaccagtgataaagcaggcggccaaataacagggggaatgtgcaacatttgatgccccaatttgtcccaattttaaacttacatttgctggaaataaaactgggatctcaatccccccgtggaaaattttgtatgaattcaggattcctaacaactgtaaaatggtggaaatgttaatgccggcc

SEQ ID NO: 9842 - DNA, 1421 bp, Zea mays
ctcaattctaattgtccattttcccagggagaacatattggatggtattgtggtgtttacccttctttttgggagcgagctgttcgaggactatattagccatcttgcaatggcaacaatggcttcctctaagttgacaagtgataaggacaaccctaaaaagcttcaggataggctcaagtatgttcgtggagacaaagaaggatttgctaatcgtgctgaagccgaggcaaagaggctcccaatgcacctcatctggattggatattcttcgcaccattggatatgtctaccatggagggtcaacaatgctctgtcgcaggacccgcacgtggtccgcctgctcgacctcaagcagggcgtcaacaaggaggggcagaccatcctgtacctcgtcttcgagtacatggacaccgacctgaagaagttcatccggggctatcgcgccaaccacgagaagatccccgcacaaaccgtcaagatcctgatgtaccagctgtgcaagggcgtgggttttgttcacggccgcggggtgctccaccgtgatctgaaaccgcacaacctgctcatggaccgcaagaccatggcgctcaagatcgctgacctcggactcagccgtgccatcaccgtccctgtaaagaagtacacgcacgagattctgacgctgtggtacagggcgcccgaggttcttcttggcgccacacactactccacgccggttgacatttggtccgtggggtgcatatttgctgagttggttactaatcagccacttttccctggcgactccgagttgcagcagctcctccacatcttcaagttgctgggcaccccaaatgaggagatgtggccaggagtaggcaagctgccgaactggcacgtgtacccccagtggaagcccactaagctgtccactcttgtccctggtcttgactccgatggctatggtttacttgaggtcagtgaaaattctagagacacggcctttgagtccttaagagaggatactatcattttcgagttgttgacaaagaaataataagaaaataggatctactgaggggctctccctcccattgtatagacgaaatggtttatttctgtgaaggttgttttatatcatcatggggattaaaagagaagatgaagaaaggcatctgtgtcgattaccatgcaaagtcctctttactcttggttcaaggaaagccaagaacattgcagttggaaagcatccgaaagtttgtatgatggtttacagaaactggctgaaagtaaactttatgctttgcttccaagatcaaacagtacaatacatcatctctgaaattgaactgctgcccatcaagtgggttcgtagcaaatgctgcttagaaatcgagtgcccaaaaaagcactcaagtagttacaatctgtacaattga

SEQ ID NO: 9843 - DNA, 659 bp, Saccharum officinarum
tgttgttgaagcaagggatgagcttcaccgaatgctgaatgaggatgagttgcgtgacgctgtgttgcttgtgtttgctaacaagcaagatcttccaaatgctatgaatgccgctgagattactgataagcttggactgcattcacttcgccagcgtcattggtacattcaaagcacttgtgctacaactggtgagggattgtacgaaggcctggactggctgtccagcaacattgcaagcaagtcctaaattttcaagcgaggtttggatcatctaggagcttttggatgatgatggtgctggatatttagggttgggttgatatttccgtatgtaagatgtatgccctgagctcaacagttattgagctctgcttaagatttcacagttaaattgttttatgtaatttgggccttgagatgtttctgaaccaaacagctaaaaagagttcagttgagttattggttgccattacattccaagattctttcatggtccatatgttcaacagaatcacatcaaaatggtagcgttttcgccaatggcatggattctgcacatctgctggtgtattgaaatgcatggcataaattgttttatgtaatttggaccttgagatgtttttgagccaagcagctaaaaagtgttcagttgagtt

SEQ ID NO: 9844 - DNA, 685 bp, Cenchrus ciliaris
cagacctctctggaggcattacttccagaacacacagggccttatcttcgttgtggacagcaatgaccgtgaccgtgttgttgaagccagagatgagctccacaggatgctgaacgaggatgagctccgtgatgctgtgctgcttgttttcgccaacaagcaagatctgcccaacgctatgaatgctgctgagatcactgacaagcttggattacactccctgcgtcagcgacactggtacatccagagcacttgtgccacaactggcgagggtctgtatgagggtctggactggctgtccagcaacattgctagcaaggcttgaggggcctggctttggatatcaactgcgaactgactaggagctccggatgtatcatggaaacttaggacagaatcgcctctgcaacctgttaggtgtcttctgttggcacgatatattttttgtttggaatatgtaatgatgtcactgttaaatgtttgttctaccctacttctactgttgaatgttctttggacctgttcattttgcacaaggattggagttccaatatcatgctacttttggtgaaaaagctattgtatacattcgtgattagtacatcgtctggttcaacaattattatcttgcctctagagtgtagaggcgtgcttgtatgtacttcagaatcgttgaacgtctaaa

SEQ ID NO: 9845 - DNA, 899 bp, Panicum virgatum
ctagttgctttgctttatcatatatttgtctttgtccttattttaacttccatgcaacatttctctgcaaaaataagccagaaaatattatatatttattttggagatccttattttcttccttaacattctgtttggaaaatctattagaagttagttgcactttgcaaaatccaacacttttgtggcttggcattaattggaatccattttgtattatgatggcaggatgagctacgtgatgctgtgctgcttgtttttgccaacaagcaagatcttcccaacgctatgaatgctgctgagatcaccgacaagcttggattacactccctgcgccagcgacactggtacatccagagcacttgtgccacaactggtgagggtctgtatgagggcctggactggctgtccagcaacattgctagcaaggcttgaggcattgctttggatatcaactgcgaactgactaggagctccggatgtatcatggaaacttaggacagaatcgcctctgcaacctgttaggtgtcttctgccggcacgatatattttttgtttggaatatgtaatgatgtcactatcgaatgtttgttctaccctactctactgttggatgttctttggacttgttcattttgcccaaggattggagttccaatatcatgatactttgggaacttattatatattgcattcctatacctgattagtagtagccaaggaactcccatatcatgttacatgtgaatgtagatctggattcctctgagatctggttcaacagtcaaaattattccatcctgaagttaaggtgtgctcgtagaaacatgtatccctgatccagatgtaaaatttatggttgccgattactgtacgttttagtatcactttcttttgaa

SEQ ID NO: 9846 - DNA, 1007 bp, Panicum virgatum
tgttttgggtatggtgtatgaataatctgttggagatgctctaagatttgatgtggtatgacatttgattgacaacagaattctttactgatgagtagctaccatttttgagcaaattattctgagaaatggaatgctagttgctttgctttatcatatatttgtctttgtccttattttaacttccatgcaacatttctctgcaaaaataagccagaaaatattatatatttattttggagatccttattttcttccttaacattctgtttggaaaatctattagaagttagttgcactttgcaaaatccaacacttttgtggctatgcattaattggaatccattttgtattatgatggcaggatgagctacgtgatgctgtgctgcttgttttcgccaacaagcaagatcttcccaacgctatgaatgctgctgagatcaccgacaagcttggattacactccctgcgccagcgacactggtacatccagagcacttgtgccacaactggtgagggtctgtatgagggcctggactggctgtccagcaacattgctagcaaggcttgaggcattgctttggatatcaactgcgaactgactaggagctccggatgtatcatggaaacttaggacagaatcgcctctgcaacctgttaggtgtcttctgccggcacgatatattttttgtttggaatatgtaatgatgtcactatcgaatgtttgttctaccctactctactgttggatgttctttggacttattcattttgcccaaggattggagttccaatatcatgatacttcgggaacttattatatattgcattcctatacctgatttgtagtagccaaggaactcccatatcatgttgcatgtgaatgtagatctggattcctctgagatctggttcaacagtcaaaattattccatcctgaagttaaggtgtgctcttagaaacatgtatccctgatccagatgtaaaatttatggttgccgattact

SEQ ID NO: 9847 - DNA, 890 bp, Secale cereale
ccggaaagaccacccatcctctcaaagactgaagcttggagagatcgttaccactatcccaacccatcggggtttcaatagttgaaactgtcgagtacaagaacattagcttcactgtttgggattttggggggtcaggacaagatcagacctctctggaggcattacttccagaacacacagggtcttatctttgttgtggacagcaatgatagggacccgtgttgttgaagccagagatgagctccacaggatgctgaatgaaggatgagttgcgcgatgctgtgttgcttgtctttgccaacaagcaagatcttccaaatgctatgaatgctgctgaaattactgataagcttggattacattcccttcgccaacgtcactggtacatccagagcacatgtgctacatccggtgagggtctgtatgagggcctggactggctatctagtaacattgccagcaaggcttgaggcttggaattttgattgtggagctggctagagctgtggatgtatcacttcatacttaagacgaattatatgttcgaatctgttatgtgcctttggcaagctcagtacttttctaatgatgtcccagttaaatgcttccttatggatgctctttctacttgttgatattttgcacaatgatttcaaatatcatatgtttttgactagttatcatgtccaattagttatacaaatgaggccaaaatattatttatttgatatgacgagcagcaatttattgtattgatgttaggcttctttcttgaaaagtacgggcgacttgtatcgaatattgtctttggaggctgagctccatggagcttggttttagaaaattaaaaataaaattaaaatttacggaaaaaacaaaaaaaaaaa

SEQ ID NO: 9848 - DNA, 509 bp, Lotus japonicus
tttctatctgcagatccgtccactgtggaggcactacttccagaacactcagggacttatttttgtggttgatagcaatgatagagaccgtgttgttgaggcaagggatgagttgcacaggatgttgaatgaggatgaacttagagatgccgtcttgcttgtttttgccaacaaacaagatcttcccaatgcaatgaatgctgctgaaataactgacaagcttggacttcattcactccgccaacgccactggtatatccagagcacttgtgcaacatctggagagggtctctacgagggtttggactggctttccaacaacattgccagcaaggcatgagacatttgaaatttttggtgtggtctggccttttcatgcgggtctggcggttcttggagaaggatgcttttcctttctagtgaatgttgtaatagcagaatgtttgttagaaatattcacttttttagtgtaacttgggtttgtatgattacttaaatcagctaatact

SEQ ID NO: 9849 - DNA, 655 bp, Eragrostis curvula
atccccaccatcggattcaatgccgaaactgtggagtacaagaacatcagcttcactgtctgggatattgggggtcaggacaagatcaggcctttgcggaggcattacttccagaacacgcaaggtctcatttttgtcgtggacagtaatgatagggaccgtgttgttgaggccagggatgagctccacagaatgctgaatgaggacgagttacgtgatgcggtgttgcttgtgtttgctaacaagcaagatcttcccaacgccatgaatgctactgaaattactgataagcttggactgcactcacttcgccagcgtcactggtacattccaagcacatgtgctacaactggggaaggattgtacgaaggcctggactggttgtccagcaacattgccagcaagtcctaaattttcgagtgatttggaccggctaggaggttttgatgatgatacttggggatatttagggatggactgctattccagtatgtaaaatgtatttcctgagctcaatagttattgagctttggtgaaggtttcagttattgctttctgtaatttgagcgttgcacgtttctgtatcgaacagctaatgggatttctgttgaattaatcagcttgaagaatgtgtgctgctgctctgtaaaaaaaa

SEQ ID NO: 9850 - DNA, 685 bp, Avena sativa
gtcaccaccatcccaaccatcgggttcaatgttgaaactgttgagtacaagaacattagcttcactgtgtgggatgtcgggggtcaggacaagatcagacccctttggaggcattacttccagaacacacagggccttatctttgttgtggacagcaatgatagggaccgtgttgttgaagctagagatgagctccacaggatgctaaatgaggatgagttgcgtgatgctgtgttgctcgtctttgccaacaagcaagatcttccaaatgctatgaatgctgctgaaattactgataagcttggattacattcccttcgccagcggcactggtacatccagagcacctgtgctacatccggtgagggtctgtatgagggcctagactggctttccagcaacattgctagcaaggcttgattggaatttcgactgggagctgactagctgtggatgtatcaattcatatgtaggacgaattatttcttctggtctgttacgtgcctttggcaagccctatatttttgtaatgatttcttggttaaaatgtttcggtatgaatgttctttgtacttgatttccaatataatttttcgttgaaaagttgttgtgtctaattgccgtgttctcatggagccaaaatatcactggagtactatacctctgttcagaaataaagtgtcac

SEQ ID NO: 9851 - DNA, 742 bp, Avena sativa
ttcaccgtttgggatgtcggaggtcaggacaagatcaggcccctgtggaggcactacttccagaacacccagggcctcatttttgttgtggacagcaatgacagagagcgtgttgttgaggccagagatgagcttcaccggatgctcaatgaggatgagctgcgtgatgctgtgcttctggtgttcgcaaacaaacaagatcttcctaatgccatgaatgctgctgaaatcactgacaagcttggcctgcattccctgcgccagcgacactggtacatccagagcacatgtgctacctctggagaggggttgtacgagggccttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaattgtcggtggcgcgctttgttttccctgcccatcaatgtctcattatgtccactctgtactttgtaccccgtacctgcaactcctgagacttgagacattgtagtattgacttgtcatggcatagcttcttgtcagtgtggtctattatgtttcttcctaattgttatgcctgatgttgatttcatgctgaacggtgatatctttgaaatccacaa

SEQ ID NO: 9852 - DNA, 654 bp, Petunia hybrida
gcctggacttatcggcacgagggtcagacaagattcgacatgtggagacatgcttatttacacgcaaggacgcatcttcgtggtcgacagtaatgatagggaccgtgttgttgaggctaaggatgagctgcacaggatgttgaacgaggatgaactgagggatgctgtgctgcttgtgttcgccaacaagcaagatcttccgaatgctatgaatgctgctgagattactgataaacttggtcttcactccctccgtcaacgtcactggtacattcagagtacatgtgcgacctctggagaaggactttatgaagggcttgattggctctccaacaacattgcgagcaaggcttaggaggcatgatcgttagtttttgcagttatgtttgtttcatgtccttactgatgcttctttggcaaggggatttggcttttgcaaaatacttgtttagttaaccttcttcccgcccttcgttcaaacatgatggtactttgcagttgctttaggttaagattcatgtagtaatatttttgctttctggcttacatgatagcagccgcttgtcttttcatatattattttattgagtagggttcttctctggcattgcttaaataaagtttttaatttgctcttttatgctcttcgctatc

SEQ ID NO: 9853 - DNA, 676 bp, Petunia hybrida
catggtaggtctcgatgcagctggtaagacaacaatattgtacaagctcaaactgggagagattgttaccaccattcctaccattggatttaacgtggagactgtggagtacaagaacattagcttcactgtctgggatgttggtggtcaggacaagattcgaccattgtggagacattactttcaaaacacacaaggactcatcttcgtggtcgacagtaatgataagggaccgtgttgttgaggctagggatgagctgcacaggatgttgaacgaggatgaactgagggatgctgtgctgcttgtgttcgccaacaagcaagatcttccgaatgctatgaatgctgctgagatcactgataaacttggtcttcactccctccgtcaacgtcactggtacatacagagtacatgtgccacctctggagaaggactttatgaacggctggattggcactccaacaacattgcgaacaaggcttatgaagcatgattgtaaattcttgcagttatgtaagtgtcatgtgcttactgatgctcctctggcgcggggatatgtcgtttgcgacaatactcgtggtcgttgaacctcctgctcgccacttcgtttcagcacaatcactaacaacaacctgctcgttttcattatataattataatttgacctaagggggg

SEQ ID NO: 9854 - DNA, 632 bp, Podocarpus macrophillus
agagatcgtatagtggaagcaagggatgagcttcacaggatgttgaatgaggatgagttacgcgatgctgtgctccttgtgtttgcaaacaagcaggatcttccaaatgctatgaatgctgcagagattactgacaagcttggtttgcactctttgcgccagcgccattggtatatccagagcacttgtgctacatctggcgagggcttatacgaaggcctggactggctctccaacaacattgcaaacaaggcctgaaacaacattgcaaacaaggcctaagacagaagcatacacggtttatcgttatcgttgcatttttacagggttgtttttgaaaacattgtaggatctcgttggtattcagtttttaggacgtgtttgacagtggatgaagctgaaatctctgataaattcatttctaggttattttttggtcaatacttgttctgcaatatactcggaaagtggtggtttatacgtatcgagtagcattttaatgattgaaaagcaacctatttatatgccacactattacatggattatttgataaaattgtatgctgtggttttgagatgtttcaaatccatgtttcttggaaatgcttccatgttatttctattttattttt

SEQ ID NO: 9855 - DNA, 519 bp, Triticum aestivum
gagtacaagaacatcagcttcgactgtctgggagtgtcggggtcgaggacaagatcaggccgactgtggagggcaattacttccagaacacacagggtctcatctttgttgtggacagcaacgatagggaccgtgtgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccaactaaggtcccttaaaattttccgtcaagtatttttaggaaggtagctaggagcgctttggatggacgattgaatcaccgggtccaggattgtgttggatgggatggtgctatgctattccgtatgtattgtgttattttcccgagat

SEQ ID NO: 9856 - DNA, 654 bp, Zamia vazquezii
tggacagcaatgacagagaccgtattgttgaggcgagagatgagtggcacaggatgctgaatgaggatgaattacggggatgcagttctgcttgtgttttgcaaacaagcaagatcttcccaatgcaatgaatgctgcagagattactgacaagcttggtttgcactctctacgccaacgtcattggtatatccagagcacatgcgctacatctggtgaaggcttgtatgagggcctggattggctttcaaacaacattgcaaataaggcttgaggatcaactgtttacatatctcacggtttagagatgtggcacatttttatgggacagtgatgaatgggtttgctcatccttgttgcatgttgtcttgagggtttaggatgagaatgagcttcatggtggcccaagagccccagttcacttatcaattattttgttcttattgatttgcttattttaattttgtaatcaattataaggacttggagattttgaattgtattcttatattgtcaagtttgaagaagcaacctcttaatgtagtgcatactctggatactttcatcgtgtttttgaatattttttgtgtgaagcagcaaacaattaatgtagagcataatcgaaggatttgcataaaaaaaaaaaccggtagc

SEQ ID NO: 9857 - DNA, 302 bp, Conyza canadensis
gttgaggcaagggatgagctgcacaggatgttgaatgaggatgagttgagagatgctgtcctcctggtatttgctaacaagcaagatcttccaaatgctatgactgctgcggagattactgataagcttggtctcaactcccttcgtcagcgtcattggtatatccagagcacgtgcgccacttctggtgaaggtctctacgaaggactggattggctgtccaacaacattgctagcaaggcttagatggcaggatatgcccggctgagcgtaggatgagaatatgtgtggattttgcagca

SEQ ID NO: 9858 - DNA, 1165 bp, Pinus taeda
acttttagcttttacaattttctatttttaggcctgctaaagtttctcttcaatttcattctggtttccatgaatatgtgcaaatatatattgtccttttctattacaaggctgtctaattgtcctttcttccaatagtatattgcttatgcttgtttatttttaaattttgctcgtattttgttttatactcttctgtttgacttgaaatgtctcacgtcctggtctgctcttttaatttgtgttttaaacagatccgtccactatggagacactacttccaaaatactcagggtctcatctttgtggttgatagcaatgatagagaccgtgttgtagaagcaagggatgaactacatagaatgctgaatgaggatgaactacgtgatgctgtattgcttgtgttcgcaaataagcaagatcttccaaatgctatgaatgctgcagagataactgacaaacttgggctgcattcccttaggcagcgccactggtatatccaaagcacttgtgccacttctggcgagggcttgtatgagggcttggattggctctctaacaacattgcaaacaaggcttgaagaaatatggtgaactgggttcctggaattttgtagggcaatgtcgtcatatttcatttttgtcagagacagtttggagaaataagtgcagtcaaactgacttttgactactattcaatttcttctatgggtttgattgtgccaatctgctaggaatgaactaatttatatatagctcattatgcttaaatggcaaagcatgagtagttattataaatgtatttgatgattatgatattgccttttgtgtggggagcatagacattactataggaatgttccggctgatttgaaacttgtattcttatttctagctttattgtctcatattacactcaaattcattctaccagataataaatacacaggttggtttgtaattttggaatacattattgaaattcttttagctgtgtttattatgtttattactttcaagaatcttcatggggcacgaacatcttgcttattgatattcaacaaaaaatcttgaagttgtttattctatgttcttttaacgaccgctgaagaccatctatggtgtgctttccttggttttagttttacttaaatgtataatgggg

SEQ ID NO: 9859 - DNA, 757 bp, Amorphophallus konjac
tcgttatgttgggcgttgtacgcagctggtagaacgaccatcctctacaagactcaagactggggtagagtcgtcaccaccactaccaccgtatcggttttaattagtggtagacgtagtggaagtattaagaataatttagtttctactgtttggggtagtgttggtgggtcaggacaagatcaggccactttggaggcactacttccaaaatacacagggcctcatttttgttgttgacagcaatgatagagatcgtgtgttgaggcaagggatgaactgcacaggatgctaaatgaggatgagttacgagatgctgtgttgcttgtatttgcaaacaagcaagatcttccaaatgcaatgaatgctgctgaaatcactgataagcttggacttcactccctacgccaacgacattggtatatccagagcacctgtgctacttctggtgaggggctgtatgaggggttggattggctctccagtaacattgccagcaaggcttgatgttctcatggtgtcaacatagaagcatatcagaggtttccaacatggttaatatctgagaaactgactcataaaaacctttttctggttttgctactgaattttctcttccgtcattttggatttcttccctttttgttgttgcttgcaccaatgttggaaaattctgtcactttcaaaagaaatgttggaaatttctgtagtaatggtaatattttggttgcatgacaattatattttcttatccaaa

SEQ ID NO: 9860 - DNA, 683 bp, Amorphophallus konjac
cgatgttgggtcgttcgatagcgcccggtaacgacgaccagactttactaagactcaagactcggagagatcgtcaccacccatcccacccacgcggtttttaacgtagagactgtggagtacaagaacattagttttcactgtctggggatgttggtggtcaggacaagatcagacccactctggagacactacttcccagaacacacaaggccttatttttgttgtggacagcaatgatagggatcgtgttgttgaggcaagggatgagcttcacaggatgctgaatgaggatgagctgcgagatgctgtgttacttgtctttgcaaacaagcaagatcttccaaatgcaatgaatgctgctgaaatcaccgataagcttggtctgcactccttacgtcaacgacactggtatatccagagcacttgtgccacttctggtgagggtttatatgagggacttgattggttatccagcaacatcgtcagcaaggcttgaaccttttatggcgtcaagagtaggagaagtgcttgaagactctggacaggattgctgctgctgcatttcttactgccatttggatttcttcgaatccgttgcctgttgatttgctaaagacttgtctttgtagtgattgagatgcctggtctacattataggttatgtttatggagttaatttg

SEQ ID NO: 9861 - DNA, 946 bp, Musa acuminata
cttgaatgtgtttttggcattcttcatctacatttattaccttttttcctaaaatgattaattgtatgagtcagattaattacttaatgctttaatgcagggttcaatgtggagactgtggagtacaagaatattagcttcactgtttgggatgtcggtggtcaggacaagatcagacccctgtggaggcattacttccagaacacacagggccttatttttgttgtcgacagcaatgatagggatcgtgttgttgaggcaagggatgagcttcacaggatgcttaatgaggatgagttgcgggatgctgttttgcttgtttttgctaacaaacaagatcttccaaatgcaatgaatgctgctgaaatcactgacaagcttggtctgcattcccttcgccaacgacactggtacatccaaagcacctgcgctacatctggtgagggtttgtacgaggggctggattggctctccagcaacattgccagcaaggcttaaatttccaggagaacatgagttgagataattctcccactatgctagtcttgaatgctttttggacgagagccaacagaacttttagagtgacctgtgtgggttatttcacctcagcctttgtattttaaaacgtcacaacttttgcttgtccagaaatatagatgtatttgctacctgccttatttgttggtttctagttaattattatctaacagatgatttgcttgagttattactcgtggataatctatttatgggctacttcttgcaggcctttcactagtattttgttttcatgtcgaatctgctttacgtcgtcacttatactggacaggcacaagttgtgcataagtagattgatttgaacttggttgcaattttagctttgcttttgcttgtaattgttttaaccgaagttttgggaaaagaaaccacaaattttctttta

SEQ ID NO: 9862 - DNA, 654 bp, Vaccinium corymbosum
agggtctcatttttgtggttgatagcaatgacagagaccgtgttgtcgaggcaagggatgaattgcatcgcatgttgaatgaggatgagttgcgagatgcagtgttgcttgtgtttgctaacaaacaagatcttcctaatgcaatgaacgctgctgaaattaccgacaagcttggtctccactctctccgacagcgtcactggtacatccagagcacctgcgcaacctctggggaggggctatacgagggattggattggctctccaacaacattgctaacaaggcttgaggtaacgcaaaacacattctggtggcatgatcctggatgcagggcagtttttatctatattctttttcctgttttttgtcaaacaatatgtggttctgaattcgtttattggaaggcgtttcactttatcgagaatttcgcagttgatatgtgtagtcgattgttgtgcggatataacatgctgtatttgttcttgggaatggttaggtttgattgaatatgagtacttgttcttgggaatggttaggtttgttcttggaaatgttaggtttgttcttggaaatggttaggtttgattgaatatgagtacttgttatagtaactgagattattttgttgccgacgttgtttgagacagttcaat

SEQ ID NO: 9863 - DNA, 1171 bp, Cocos nucifera
ccattttaatttgctagctgagaaaacacattttgagtttctcaatgggacatccaaagatacgaagtctgcttggattattctcaaaattgatatggtgtagctctccatgaggaaaacatgaaaatgattggagaatgtatcatgtggctgcagcttcagaaggtgaagattgagtttcagaatgtggttgtatacaaattctctggggttggatgggtttggttacggggaggggtggataactccatatttgttgctgtaagctgggaacactcctagttattgtcaatcttactggcttttgatatataattgagtcaatcaactgcatatgcttatagaatacggtaacaattacgaggaattattattttggcttttaatgcaggatttaatgtggagaccgtggaatacaagaatattagcttcactgtgtgggatgttggtggtcaggacaagatcagacctttgtggaggcattacttccagaacacacagggccttatttttgttgttgacagcaatgacagagatcgtgttgttgaggcaagagatgagcttcacaggatgctaaatgaggatgaattacgggatgctgttttgcttgtctttgcaaacaaacaagatctgccgaatgcaatgaatgctgctgaaataacagataagcttggtctgcattccctgcgtcagcggcactggtacattcagagcacctgtgctacatctggtgaaggtttgtatgaggggcttgactggctgtccaacaacattgccaacaaggcttgaaatttcaaggtgcttgagagtactagagaatcgttattggaatattccttcatagactacatatggattcttttgggatatttagatcttcagaacttctagattgttattcacgtgatttgctctttttcctcagttttcacgtttgaaaaactgtggatttaacaattaaagtgatggaaatttgtattgaccactgaatgacttctattatgtttttctgtcccaattatcgatagaatgcttcatcatcaaatttgtgatatatagatggttctgtactatctgttttgtcattcgttgggccttggccattgtcctccaatttgatgtcccgacgttggttttgcctgtatttaattgctctgaagttgattcatcc

SEQ ID NO: 9864 - DNA, 773 bp, Festuca arundinacea
cgagtacaagaacattagtttcacagtttgggatgtcgggggtcaggacaagatcaggcccctgtggaggcactacttccagaacacccagggccttatttttgtggtggacagcaacgacagagagcgtgttgttgaggccagagatgagcttcaccgaatgctcaatgaggatgagttgcgtgatgctgtgcttctggtgtttgcaaacaaacaagatcttcctaatgccatgaacgctgctgaaatcaccgataagcttggcctgcattcccttcgccagcgacactggtacatccagagcacatgtgctacctctggggagggtttgtacgaggggcttgactggctgtccaacaacattgccaacaaggcttgaagcatctcggcagggcttctattgatctggataagctggatgatattcggactaatactgcctttacgtattataaactatatagtcttgacagataatgtgggtgttttgggaagataaagctcttttgttcaaagggctagctatcagattgttttcgtgggtgttaattgtccgtggcactgtttgtttgccctgccaattaaaggtcgtactatgtcaactctgtactccgtacttgccactctgagtctcgagacattgtagtattgacttgtcttgccatagattgttgtcagtgtgtgggatacgattcggtgtggtttacctagtagctgttccaagtacaaaaaaaaaagaaaaaaaaacaaaagtactctgcgttgataccact

SEQ ID NO: 9865 - DNA, 758 bp, Festuca arundinacea
gatcgtcaccaccatccccaccatcggatttaatgttgaaactgtcgagtacaagaacattagtttcacagtttgggatgtcgggggtcaggacaagatcaggcccctgtggaggcactacttccagaacacccagggccttatttttgttgtggacagcaacgacagagagcgtgttgttgaagccagagatgagcttcaccggatgctcaacgaggatgagctgcgtgatgctgtgcttctggtgtttgcaaacaaacaagatcttcctaatgccatgaacgctgctgaaatcaccgataagcttggcctgcattccctacgccagcgacactggtacatccagagcacatgtgctacctctggtgagggtttgtacgaggggcttgactggctgtccaacaacattgccaacaaggcttgaagcatcttggcagggcttctattgatctggataagctggatgatattcggactaatactgcctttacgtattataaactatatagtcttgacagataatgtgggtgttttgggaagataaagcccttttgttcaaagggctagctatcagattgttttcgtgggtgttaattgtacgtggcgctgtttgtttgccctgcccatcaaaggtcttactatgtccaccctgtactctgtacttgctactctgagacttgagacattgtagtattgacttgtcttgaccaaaaaaaaagaaaaaaaaaacaaaaaagtaactctgcgttgataccact

SEQ ID NO: 9866 - DNA, 1217 bp, Gossypium raimondii
cctccagagtttggagccagcagcacagtagtgaaccaccttggccttgtctagctcaatgttctcaggtggcgccatagcatggccatcaccaggttgtaaatgggagggatgggcctgtaaatgtccctaaagtacatgttcagataatcctactccgcaaatggggtaggaggggtgactttgagggtagtcaagaggtccacatatgtagaaaggctaggttcatatacaaacattccagcgttgaagtaaagaggaggtttaggaccaagctgcgaaggccattggaccttatcagggcactgctacctttcccagggtttaatgtggaaactgtggaatataagaacattagcttcaccgtttgggatgttggaggtcaggacaagattcgacctttgtggaggcactacttccaaaatactcaggggctaatctttgttgtggatagcaatgatcgtgatcgtgttgttgaggccagggatgagcttcaccgtatgctaaatgaggatgagctgagggatgctgtgctgcttgtatttgcaaacaagcaagatttaccaaatgctatgaatgctgctgagatcactgataaacttggtcttcattccctccgtcagcgccactggtatattcagagtacatgcgctacctctggtgaagggttgtatgagggtctggactggctctccaacaacatagctaacaaggcttgaggtggttggtagaaggtcggtgacatttacatttggggtagcaatctttgtggaattcggatatgtatatttctattttatgatatgttgcgttattggggttttgtttttttgtttttgctcgacaacttttaaatgaaatggatgagcttgtgtttagatatgctttgtagatggaattcattgttcagagttaattaacgaattcattgttgacatttcataggaacatgttacattttttacttgtggggggtatcaatactatgttgattcttgtttgttcaagaaaagttttaagcaagtagagctgaggtggggaagagtgaggccatttcattttattttgcgtaagtctccttcacttcttaggatctcggccatttcacatgtttataccttagagacattaaagtagttttgttttggacaatgtgactggtttgtttgctgcaaggttaaagccacaaagcacctaaccattgaggacaagaggag

SEQ ID NO: 9867 - DNA, 1232 bp, Primula obconica
aataagatgagtttataaaccatgacagaacaactcttaaatctttactaactttataacgtgacctaacacctacttttctgatcttgttttacatatcaacttactgggacaacttctttagtttttactttgtaacagggattgacatttttcgaaacagatgacatcgtgcattaagcaacagaagaggggagcataaaacatggaaaacacaattcatatatacataaatttatgtacaccaacttcacacgctcagatatatatagtcatggccatgttgcgagacaattcaaataacagaacttgagaataattacgctagtatatgaatgcaagtggtaggactcttagaaggtcttcttcaaaaagaaaaccgctggaaagagtaagataaccttcatctgtaccttacactatatggcttgaattggagagtccttgagtaacacgtcatcatcaccatcatggtctactacgtggcaccctttgttcttgcaatcaggaatctcctcaaactgcttagctggcaacttctgagacaaagccccgacccgaaactcgatcatacccgaacccggatcagccttaatacccgtaacagagacccaaataaaaagcttcttggcctgaatacccgacacgccagtaaccgacccgaaactgagtttccctctgatccgtttatcgtagtacactaactggtcttgaggcaagagatgagttgcaccgcatgttgaatgaggatgagttgcgagatgcagtactgctggtctttgctaacaaacaagatcttcccaatgctatgaacgctgctgaaataacagacaagcttggtctccactctcttcgacagcgccactggtacatccagagcacttgtgcaacatctggcgagggtctgtatgaggggttggattggctctccaacaacatagctaataaggcttgagtacggtgattcatcctgtgggagtaacactggatatgcagctttcttatctagtctgtttcgttcccttatatttcttgtccgaaaatttgttgttatcgatttaattttgtaagtgttttttctgattaagaattttgcggctctctattacaatggggtttgttgaaatcatgatgcaccatcaaaattctgcagatttgactatgaatgcatgtgatatgtagtacctttgttttttgtgctatcgatatggttaaatgattttcatttccag

SEQ ID NO: 9868 - DNA, 723 bp, Secale cereale
atcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggctttactatgtccgctctgtgtactctgtactcgccactccgacagacttgagacattgtagtattgacttgtcttggcatagtttgtcagcgtgagggtaccatgtctcttctgaattgctatggcttgtagatttcatgtgcaaagtacattttccatcccgaaacaacgtgatcaactggaagtgacccgtat

SEQ ID NO: 9869 - DNA, 1003 bp, Secale cereale
accgactcccgaaccgagggacggaaccggcgcgagggggacgaaggaagagaagagaagaggagaccgcgacccgagcgcgcgaccgcacgcacgaggacagcacgcgccgcgactcccgcgcaggagcggagagtggggctctacgttcaactaagcgttgttcacggccggcttcttccgaccaaggaaggagatggaggactcctcatgggtcggtctcgatggcggcgtaggtaacgaccaccactcctctaacaagctacaagcgtcggagagatcgtcaccacccctccccaacagttacggtttaattgttagaaactgtagagtaacaagaactatttagttcctaccggttggatggtcgggggtcaggacaagatcacggccctgtggaggcactacttccagaacaccagggtctcattttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaattactgacaagcttggcctgcattctctgcgccagcgacactggtacatccagagcacatgtgctacctctggagaggggttgtacgaggggcttgactggctgtccaacaacattgccaacaaggcttgaagcatctcggcaggggcttctatggatctggataagctggatattcggactaatactgcctttacgtattataaactatatagtcttgactgataatgtgggtgttttggaaagataaagctctctgtcaaagagctagctatcagattgttttcgtgggtgttaaattgtccgtggcgctgtttgtttgtccatcatggttttactatgtccgctgtgtgtactctgtactcgccactccgacagacttgagacattgtagtattgacttgtcttggcatagtttgtcagcgt

SEQ ID NO: 9870 - DNA, 380 bp, Trigonella foenum-graecum
tccattgtggaggcattacttccaaaacacacaaggactcatttttgtggttgatagcaatgatcgtgatcgtgtggtcgaagccagggatgagttgcacaggatgttgaacgaggatgagttgagggatgctgtgctgctggtatttgcaaacaagcaagatcttccaaatgctatgaatgctgccgagatcactgacaagcttggccttcattctctccgtcagcgccactggtacatacagagcacatgtgccacttccggtgaaggactgtatgagggactggattggctctcaaacaacattgcgaacaaggcttaaatgaacaattgaaccgacggtcacactaacaatggccccattttgatgttctggatgt

SEQ ID NO: 9871 - DNA, 503 bp, Avena sativa
cctagaacacacagggtcgttattctttgttgttggtacgagcaatgataggaccggtgttgttgtaagctagagatgagctccacaggatgctaaatagaggatgagttgcgtgatgctgtgttgcttgtctttgtccaacaagcaagatcttccaaatagctatgaatgcggctgaaattactgataagcttggattacattcccttcgccagcggcactggtacatccagagcacctgtgctacatctggtgagggtctgtacgagggcctagactggctttccagcaacattgctagcaaggcttgattgaaatttggactgggagctgtctaggagctgtggatgtatcaatttatatgtaggacgaattatttcttctcatctgttatgtgccttcggcgagcccaatatttttgtaatgatgtcttggttaaatgtttccgtatgaatgttctttgtacttgctccttttgcacaacgatttccaatatcatattt

SEQ ID NO: 9872 - DNA, 563 bp, Trifolium pratense
cgtcccttgtggaggcactacttccagaacactcagggtcttatatttgtcgttgacagcaatgacagggatagagttgttgaggccagagatgagttacataggatgttgaatgaggatgaattgagagatgcagtattgcttgtttttgccaacaaacaagatcttccaaatgcaatgaatgctgccgaaattactgacaagttgggtcttcattctctgagacagcgccactggtacatccagagcacttgtgcaacatctggggagggtctttatgaaggtttggactggctttccaacaacatagccaataaggcttaatgcttattgggagtatttggattggcgattctggatgcaggggtgaatattatctagctttgctttttgagtcatgtggatcggtaattctggatgcaggggcaaatattatctagcttttatttcttggtcatcttctgaaacaacttgaatttgtgttcatgtattgtggtttaggatgtcttggtggctaaaattgtagtaggaatatgtttcatgggatttgtaatatttctgac

SEQ ID NO: 9873 - DNA, 543 bp, Secale cereale
ctcaagctcggagagatcgtcaccaccatcccaccaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaattactgacaagcttggcctgcattctctgcgccagcgacactggtacatccagagcacatgtgctacctctggagaggggttgtacggaggggcttgactggctgtccaacaacattgccaacaaggcttgaagcatcgtcggcgaggggcttctagtggatcgtggataagcgtggatagttcggactaatactgtcctttacgtattaataaactatatagtcttgacagataa

SEQ ID NO: 9874 - DNA, 306 bp, Amaranthus tuberculatus
gggacgagctgcataggatgttaaacgaggatgaattaagggatgcagtgctgttggtgttcgctaacaagcaagatcttccaaatgcaatgaatgctgctgagatcaccgacaagcttggcctccattctttacgtcaacgtcactggtatattcagagtacatgtgccacctccggagaaggactttacgagggcctggactggctctcgaacaatattgctagcaaggcttaaatgtaacaaatcacaaatcgagttacgctagctgttctcagggatgagaaggctggagttagggcgagga

SEQ ID NO: 9875 - DNA, 456 bp, Amaranthus tuberculatus
ccgtgtgggatgttggaggtcaagacaagattcgacctttgtggaggcattatttccaaaacacccaaggtctcatctttgtggtggatagcaatgatcgtgatcgtgttgttgaggcgagggatgaactgcataggatgttgaatgaagatgagctgagggatgctgtcctgctggtatttgccaacaagcaagatcttccaaatgcaatgactgctgctgagattaccgacaaacttggtctccactccctccgtcagcgtcactggtatatccaaagcacatgtgctacttctggtgaaggtttatatgagggattggactggctgtcaaataacattgccaacaaggcatagagtacaggttcagcctgactgaagcttaggatgaagtacatgcaattgcagcccctgctcaagtgggtagaaatcaagtcttttggcctttgttttcttg

SEQ ID NO: 9876 - DNA, 413 bp, Ambrosia trifida
tcctaccatcggcttaattgtggtagactgttgaatacaaaacaatcagcttcactgtgtgggagtgtggggggtcaggacaagatccgtcccctttggaggcactacttccaaaacacacagggtcttatctttgtggtcgatagcaatgatagggatagagttgttgaggcaagagatgagttgcacaggatgttgaacgaggatgagcttagggatgcagttcttcttgtctttgccaacaaacaagatctgcctaatgcaatgaatgctgctgaaatcaccgacaagcttggccttcactctcttcgacagcgccactggtacatccagagcacatgtgccacctccggggaaggactttacgaggggttggactggctctccaacaacattgctaacaaggcatgagg

SEQ ID NO: 9877 - DNA, 379 bp, Brassica juncea
taatgacagagaccgtgttgttgaggctagagatgaattgcacagaatgctcaatgaggatgagctgcgtgatgctgttctgctcgtgtttgctaacaagcaggatcttccaaatgccatgaacgcagctgagatcaccgataagcttggtctccactctctccgtcagcgtcactggtacatccagagcacatgtgccacttcaggagaggggctttacgaaggtcttgactggttgtccaacaacatcgccggcaaggcgtagagggaaagattgtggttgagctgattttgctgggcaaatctggatgcaggggcaaacattatctgagtttttctattccggttatcttatattgtttttgtttttttttcgggt

SEQ ID NO: 9878 - DNA, 431 bp, Brassica juncea
tggaggcactacttccaaaacactcaaggtctcatcttcgtggttgatagcaatgacagagaccgagttgttgaagccagagatgaacttcacagaatgttgaatgaagatgagcttcgggacgcagtgttgcttgtctttgccaataaacaagatcttcctaacgccatgaatgctgctgagattactgataagcttggccttcactcactccgacaacgccactggtacatccaaagcacatgcgcaaccaccggtgaagggttgtacgaaggtctcgactggctctccaacaacattgctaacaaagcttgaagcttatctcaaccagatatttttgtgagtggatcgaaagcttcttctttggagagatcatcacctttgtttcttgtggtttaagacttattcgtggagtcatatttgtttaattt

SEQ ID NO: 9879 - DNA, 654 bp, Vaccinium corymbosum
tttccagaacacacagggtctcatttttgtggttgatagcaacgacagagaccgtgttgttgaggcaagggatgaattgcaccgcatgttgaatgaggatgagttgcgagatgcagtgttgcttgtgtttgctaacaaacaagatcttcctaatgcaatgaacgctgctgaaattaccgacaagcttggtctccactctctccgacagcgtcactggtacatccagagcacctgcgcaacctctggggaggggctatacgagggattggattggctctccaacaacattgctaacaaggcttaaggtaacacggaacacattctggtggcatgatcctggatgcagggcggtttttatctatatctttttcctgtttttgtcaaacaatctgtggttctgaattcgtttattggaaggcgtttcactttatcgagaatttcgcagttgatatgtctagttgattgttgtgcggatataacatgttgtatttgttcttgggaatggttaggtttgattgaatatgagtacttgttcttgggaatggttaggtttgttcttggaaatggttaggtttgattgaatatgagtacttgttatagtaactgagattattttgttgctgacgttgtttgagacagttcaatgcatatttt

SEQ ID NO: 9880 - DNA, 561 bp, Chrysanthemum coronarium
accattggatttaacgtggagactgtcgaatacaaaaacatcagttttactgtctgggatgtcgggggtcaagacaagatccgtccactatggaggcactacttccagaacacacagggtctgatctttgtggttgatagcaacgatagggatagagttgttgaggcaagagatgagttgcacaggatgttgaatgaggacgagctaagagatgcagttcttcttgtgtttgccaacaaacaagatctgcctaatgcaatgaatgctgctgagattactgataagcttgggctccactctcttcgacaacgccactggtacatccagagcacctgcgctacttctggcgaaggactttatgaggggttggactggctctccaacaacattgctaacaaggcatgaggtgatgattaaattgtatcgtgagcttggaataccagcggcaagttttgcttttcatttggtcaggtcactttcgcgtcctgtcgttcttgcggccggtgcaagcagttatggaactttgtttgttaaaaaggctttttgcatttgatatatagg

SEQ ID NO: 9881 - DNA, 774 bp, Echinochloa colona
acacgacgactgaaactgttgagtacaagaacattagcttcactgtttgggatgtcggtggtcaggacaagatccggcccctgtggaggcactacttccagaacacccagggcctcatttttgttgtggacagcaatgacagagagcgtgttgttgaggctagagatgagctccatcggatgctcaatgaggacgagctccgtgatgctgtgcttctggtgtttgcaaacaaacaagatcttcccaatgccatgaatgcagctgaaatcactgacaagcttggccttcactccctgcgccagcggcactggtacatccagagcacatgtgcgacctctggtgagggtttgtacgaggggcttgactggctttccaacaacattgcaaacaaggcttgaggcatcttggcagggctccgatcaatgcaaatactttggatatcggagcgcatactgcctttaccatactgctatgaactatatagtcgtgacagtgacagataatgtggggtgttttggggagtataaggctccttggtgaaggagctagctatcagatgtttctgtgggtattgttaattgtccgtgcatctgttttggtttgtgcaaggtatatgctatgcccgtctttgatctgtgtactcgtcagtctgaggcgttgaggcgttgtagtatggatttgcctcttggcattgctagcttaatggttgcctaattgtcgtgtgcagcatatccttcctctcgcgtttgctgtgccgtttttgaggtttgttgt

SEQ ID NO: 9882 - DNA, 624 bp, Fagopyrum esculentum
gagacattatttccaaacacccaagggcttatttttgtggttgacagcaatgaccgtgaccgtgttgtggaggcaagggatgagctgcatagaatgctaaatgaggatgaactacgtgatgccgtgctgcttgtgtttgcaaacaaacaagatcttccaaatgcaatgaatgctgctgaaatcactgacaaactaggccttcactccctacgccaacgccactggtatatccagagcacatgtgccacttctggggaaggtttgtacgaaggactggactggctctcaaacaacattgctagcaagtcttaaaatctttttccggtgacagtttatagaatggatgattatattccaaaaggttgtgcctggcttctacatcatttatcaaggtttagattctggtttctgtacggtggtgaaaatactgttcttatttcttgctcatgctatattttgtctaaatacatgcactcagttgccaggttctcttatttgtacttgatcacaacattgctcatagaggatggtttatacagaacttgcatatcaaacaacgatttatgttccaagttgtgctgtgcttttgtgactgtatagatcattcgtcctggttatttcaga

SEQ ID NO: 9883 - DNA, 550 bp, Festuca arundinacea
gagacgagctccacaggatgctgaatgaggatgagctgcgtgatgctgtgttgcttgtatttgcaaacaaacaagatcttcctaatgccatgaatgcggctgaaatcactgacaagcttggtctgcactcccttcgccagcggcactggtacattcagagcacttgtgctacatctggcgaaggattgtacgaggggcttgactggctctccaacaacattgccaacaaggcttgaaatgtctccacaacgcttcaaggaacaaaggctctggttgtctgaagaactcactgctaccatttttcatattgtgatatatatacatttacagcagatagtatgtgtccttatgtgatgacagaagctctccttcgagtgagctagtatccggttgtttcttcgtgtggttattatcagtgtttatgttcgtttttttacaaggtttactgtgtcgaccatgtatgtgcccctatgttttgagatatagtaaaattgaggtgcgatgccaaaaaaaaagaaaaaaaacaaaagtactctgcgttgataccact

SEQ ID NO: 9884 - DNA, 576 bp, Festuca arundinacea
agtggtatcaacgcagagtacggggagacgagctccacaggatgctgaatgaggatgagctgcgtgatgctgtgttgcttgtatttgcaaacaaacaagatcttcctaatgccatgaatgcggctgaaatcactgacaagcttggtctgcactcccttcgccagcggcactggtacattcagagcacttgtgctacatctggcgaaggattgtacgagggacttgactggctctccaacaacattgccaacaaggcttgaagtgtctccacaacgcttcaaggaacaaatgctctggttgtctgaagaactcattgctattattttacatattgtgatatatgtacatttacagcagatagtatgtgtccttatgtgatgacagaagctctccttcgagtgagctagtatcaggttgtttcttcgtgtgggtattgtcagtgtttaagttcggttttttaaaatgtttactgtgtcaaccatgtgtatgtacccctatgttttgagatctagtaaaattgaggtgcgttgaccaaaaaaaagaaaaaaaacaaaagtactctgcgttgataccact

SEQ ID NO: 9885 - DNA, 710 bp, Festuca arundinacea
gttgagactgtcgaatacaagaacatcagcttcactgtttgggatgtggggggtcaagacaagatcaggcccctgtggaggcactacttccagaatacgcagggactcatctttgttgttgacagcaatgatagggagcgtgttgttgaggccagagacgagctccacaggatgctgaatgaggatgagctgcgtgatgctgtgttgcttgtatttgcaaacaaacaagatcttcctaatgccatgaatgcggctgaaatcactgacaagcttggtctgcactcccttcgccagcggcactggtacattcagagcacttgtgctacatctggcgaaggattgtacgaggggcttgactggctctccaacaacattgccaacaaggcttgaagtgtctccacaacgcttcaaggaacaaaggctctggttgtctgaagaactcactgctaccattttacatattgtaatatatatgcatttacagcagatagtatgtgtccttatgtgacagacagaagctctccttcgagtgagctagtatcaggttgtttcttcgtgtgggtattatcagtctttatgtttggtttttacaaggtttactgtgtcaaccatgcgtatgtacctctatgtttttgagatatagtaaaattgaggtttgttgaccaaaaaaaaaagaaaaaaaaacaaaagtactctgcgttgataccact

SEQ ID NO: 9886 - DNA, 603 bp, Flaveria ramosissima
tgagtacaaaacaattagcttcacagtgtgggatgttggggtcgaggacaagatcgtccattgtggaggcactatttccagaacacccagggtcttatctttgtggttgatagcaatgacagggacagagttgttgaggcaagagatgaattgcacaggatgttgaatgaagatgagttgagagatgcagttctccttgtgtttgctaacaaacaagatctcccaaatgcgatgaatgctgctgaaatcactgataagcttggtctccactcactccgacagcgtcactggtacatccagagcacttgtgcaacctctggggagggactttatgaaggattggattggctttccaacaacatagcaaacaaggcatgaggcaacgagagggtggatgtcggcagtttgtgttactggttttggaagttgtttgaaagggtaatttgcttctgatataatacattgtttttatgtttggaccgaaagtatgtgtttggtaggttggctattattctttaatctgaagttgttgagtttatgtggtggttagaattcttatgtagtctgttggtatgctattattatatgatatgttaatttcag

SEQ ID NO: 9887 - DNA, 654 bp, Setaria italica
actgtcttgatttttttcgcattgcctgaaaacagatcatgccgctgtggaggcattacttccagaacacacagggtctcatcttcgttgtggatagcaacgatagggatcgtgttgttgaagccagggatgagctccaccgaatgctgaatgaggatgaattacgtgatgctgtgttgcttgtgtttgctaacaagcaagatcttccgaatgctatgaacgctgctgagattattgataagcttggacttcactcacttcgccagcgtcactggtacattcaaagtgctacaactggtgagggattgtatgaaggcctagactggctgtccagcaacattgccagcaagtcctaaattttcgagaggtttggaccatctaggagcctttggatgatgatattgctggatatttagggttgggttgctattcccgtatgtaaggtgtatgccctgagctcaatagttattgagctttggttaagattttgcagttaaattgttttgtgtaatttggatccttgagatgtttccgaaccaaacagctaaagagagttccgttgagttaattggttgggggaatgcgtgctggtatgcagtatcacattgctgttgtgagattctttcatgctccataggttgaacaccatccgaa

SEQ ID NO: 9888 - DNA, 589 bp, Panax ginseng
ggtggtcaggacaagatccgaccgttgtggaggcactacttccaaaacacacaggggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctcgtggggaagggctgtacgaggggctggactggctctccaacaatattgctaacaaggcttgatggcatgcttttccatgacattttgagctgaagttacgtctaaatggagttactattgtgtttcttggcagtttgtaatttgttcttcccgtgaataatatttttatcgtgttcagtttattggttcttgttagttttgcaccgacttttgttgatttatattcatgtttattcttcatagggttaggacaagtacagtggtgcttaatgcatgagtttgtgtaagcatttgctattgtattgagg

SEQ ID NO: 9889 - DNA, 589 bp, Panax ginseng
cccccacgtacacatcgtaccacctcaagcttgggagatcgtgacacaatccctacattggcttaatgttgagactgttgaatcaaaacattagcttcactgtctgggatgtcgaggtcaggacaagattcgtccattatggaggcactacttccaaaacacacagggtcttatatttgtggttgatagcaatgatagagaccgagttgttgaggtgaaggatgagctgcatagaatgttgaatgaggatgagctgcgagatgcagtgttacttgtatttgccaacaaacaagatcttccaaatgcaatgaatgctgctgaaataactgataagcttggcctccactcccttcggcagcgtcactggtacatacagagcacctgtgcaacctccggggaaggtctttctgaggggttggattggctttccaacaacattgctaacaaggcatgagctgatgtagacgttttttgatggagttgattctggatgcagggttattttatctagtctatttctttttctttccctctccaactctcagaattttctccctgtgggcaatgtttggtcatgagattcaaccaa

SEQ ID NO: 9890 - DNA, 657 bp, Panax ginseng
agaacatcagcttcactgtttgggacgttggtggtcaagacaagattcgacccttgtggagacactactttcagaatactcaaagggcttatctttgtggttgacagtcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgattttccatgacattttgagcggaagttacgtctaaatggagttactattgtgtttcttggcagtttgtaatttgttcatcttacttcccgtgaatgatatttttatcgtgttcagtttattggttcttgttagttttgcacagacttttgttgatttatattcatgtttattcttcatagggttaggacaagtacagtggtgcttaatgcatgagtttgtctaagcatttgctattgtgttgaggttattattagtaaatgaaatgaagctctttt

SEQ ID NO: 9891 - DNA, 675 bp, Panax ginseng
gggggcgtgtgtaggagctcaagctcggagagatagtcacaacaattcctaccattgatagcggatcgagtgtttgacctcctgatatgttgttcttacagatccgtccttttgtggagacattacttccaaaacactcagggcctcatctttgtggttgacagcaattatcgagatcgtgtgattgaagccagggatgagctgcacagaatgctgaatgaggatgagttgagggatgctgtgctacttgtatttgcaaacaagcaagatcttcccaacgcaatgaatgctgctgagattactgataaacttggccttcactctcttcgtcagcgccactggtatatccagagcacttgtgccacttctggtgaagggttgtatgaggggttggactggctctcaaacaacattgcgaacaaggcgtagacggcttatctgagtttggatcgtcaccacaaccaaattagagtttttcgtgctcttttttgttcagaaatctgtaccatgttgatgtttacctcattactattttgaggtcccatttccagatattgatatttgtttcctttagtttcagaataattcacattatttttgttttattcaccatgtttctccatatctttgatattctatgcaagtacaatcctaaccttagagaaactattcccc

SEQ ID NO: 9892 - DNA, 620 bp, Lolium multiflorum
gtggggggccaagacaagatcaggcccctgtggaggcactacttccagaatacgcagggactcatctttgttgttgacagcaatgatagggagcgtgttgttgaggccagagacgagctccacaggatgctcaatgaggatgagctgcgtgatgctgtgttacttgtatttgcaaacaagcaagatcttcctaatgccatgaatgctgctgaaatcactgacaagcttggtctgcactcccttcgccagcggcactggtacattcagagcacttgtgctacatctggcgaaggattgtacgagggacttgactggctctccaacaacattgccaacaaggcttgaagtgtctccacaacgcttcgaggaacagaggctctggctgtctgaagaactcactgctaccattttacatattgtgatatataaatatatacactctacaacagatagtatgtatgcttatgtgacagaagctctcctttgagtgggctagtatcaggttgtttcttcgtgtgggtattatcagtgtttgcgtttggttttacaaggtttactgtgtcaaccatgtgtatgtacctcggccgcgaccacgcttcgagcggccgccgggcaagggt

SEQ ID NO: 9893 - DNA, 558 bp, Pisum sativum
caccgtgtgggatgtcgggggtcaggacaagatccgcccattgtggaggcactacttccagaacactcagggtcttatttttgtggttgatagcaatgatagagatcgagtggttgaggcaagggatgagttgcacaggatgttgaatgaggacgaacttagagatgctgttttgcttgtttttgccaacaaacaagatcttcccaatgcaatgaatgctgcagaaataacggacaaacttggtcttcattcactccgtcaacgccactggtatatccagagcacctgtgcaacttctggagagggtctatacgagggtttggactggctttctaacaacattgcaagcaagacatagagacatttgaattttttttgggtctatatgatcgtttcctgtcagtctggtggttcttgaagaaggatgcttttcctttcaagtgaatgttgtaatagaggaatgattgttagaaatattatcctcttgagtgttacttgggtttgtatgattgcttaaatgagctaatacttttagctacaattggaactcttgcaatc

SEQ ID NO: 9894 - DNA, 753 bp, Secale cereale
atttaacgtcgaaactgtcgaatacaagaacatcagcttcactgtttgggatgttggggggccaagacaagatcaggcccctgtggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcaccgacaagcttggtctgcactcccttcgccagcggcactggtacattcagagcacttgcgcgacatctggagaagggttgtacgagggacttgactggctctccaacaacattgccaacaaggcttgaagcgtctcgacaagtgcttcatcaagaaacaaacgtgctggatgtctcaacaactcactgctaccatttttacatattgtgatatatatatacactgtacaagagatagtatgtgtgcgtatgtgacagacagaagctctcttctttaagtgagctagtatcaggtcaggttgtttttttgtatggatattatcagtattcccgcgtcgtggttttacaaggtttactttgtcgaccatgtgtgcatgaacccctatctttttgagttgtagtaagattgaattgtggttgccaatgttggttggttcagttgagtgatgtggatggggtacatgttgataacatacttatgtga

SEQ ID NO: 9895 - DNA, 555 bp, Zinnia violacea
ggacaagatccgtccactttggaggcactacttccagaacacgcagggtcttatctttgtggttgatagcaatgatagggatagagttgttgaggcaagagatgagttgcacaggatgttgaatgaggatgagctaagggatgctgttcttcttgtatttgccaacaaacaagacttgcctaatgcaatgaatgctgctgaaataactgataagcttggccttcactctcttcgacagcgtcactggtacatccagagcacctgtgccacctctggtgaaggactttacgaaggtttggactggctttccaacaacattagctaacaaggcatgaggcggaggctgaatggtcttttggcggttcagaaaccggaagcaagttttgctatctgtatggtcaagtcgctttacttgatggttctcgtacttccgtgactgaagtaccagtggctatggaacttggttgaaagtggcttttgaattttatatatatagggcatgtatgataccatctttgggttagaactgtgctggtgttgtttatgcatatgttt

SEQ ID NO: 9896 - DNA, 491 bp, Echinacea purpurea
cgagatcgtgttgttgaggctagagatgagctgcataggatgttaaatgaggatgaattgagggatgctgtgttgctagtttttgctaacaaacaagaccttccaaatgctatgaatgctgctgagataactgacaagctaggacttcactctctccggcaacgccattggtacatccagagtacatgtgccacctctggggaagggctatacgaggggctggactggctctcgaacaacattgccaacaaggcttaagaattaagaagaaaagatgctggatgatttttggtgactgaatgaagatttagattttcgttatcatttgcgtctttgattcaaaccaattatgtacttagataacgtctttctgtctcgtattatgtacattgatactcattttatatagtttctgcaattatgttatgtcaagacatccttttttccaggttacttattgaaatatcgagtaactgcacttgctagtcgac

SEQ ID NO: 9897 - DNA, 517 bp, Arachis hypogaea
cagcaatgacagggaccgtgttgttgaagcaagagatgagctacataggatgttgaatgaggatgagttgagggatgccgtgcttctagtttttgctaacaaacaagatcttccaaatgctatgaatgctgctgagataactgataagcttggtcttcattctctccgtcagcgtcattggtatatccagagcacatgtgctacctctggtgaagggctttacgaaggacttgactggctctccaacaatattgcaaacaaggcatagagttctaccagttatcatgaaggactccagtcagtggttacggtctcgcatatctgattttcttgccgttcctttagatttttcattgttcgagcatgtattattttgttttgataaaagaacatcattcggttacatagcccgaagaataatttgacattttttcccctgtataaccaaatatatagaattgttacccattcatttatgaagccaacttaatcgttggaaaaaaaaaaaaaaaaaaaa

SEQ ID NO: 9898 - DNA, 537 bp, Secale cereale
gatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggttggtacgaggggcgttgactggctgtccaacaacattgccaacaaggcttgaagcatctcggcaggggcttctatggatctggataagctggatattcggactaatactgcctttacgtattataaactatatagtcttgacagataatgtgggtgttttggaaagataaagctctctgtcaaagagctagctatcagattgttttcgtgggtgttaaattgtccgtggcgctgtttgtttgcccatcatggctttactatgtccgctctgtgtactctgtactcgccactccgacagacttgagacattgtagtattgacttgtcttggcatagtttgtcagcgtgagggta

SEQ ID NO: 9899 - DNA, 1902 bp, Conyza canadensis
gtctgggatgtagggggtcaagacaaggtgtgaatattttttggtttacactttttggttggggtccagtgatccattttataggtggaaatcttgaccccatacttatgattggttgatttgggttgtgttttatcatatgattcaaataaaaaagttagctgagaaaggaatgggtaaagtggtttgcaagctgcctaatgtctgttatggcgtacaactttctataattgttttataggacatattagtttataaatatggtttttacagtagtagtattacggttccagttcaaataaaacaagtgttaaagttaaacaaataacacaattcgtttctcttaattgaaaatcattgtgcatcatgaaaatcttcattcttcagtgtatatacttgtatgaattctccatcagttttatcataatggtcaagatcttatcctatttactttactttaatacttgtcttaaaataaccagccccatagtattacacattggctatcttttatcataatggtcaagatcttatcctatttgctttactttaatacttgtcttaaattaaccagccccatagtattaaacattggctatctaggctatctatatgaaattaatcaagcatggataagtaattgttggtgggtcaacctgttccttttttagtgatactaataaatacaccttgtttcaaattgaacatgttctgattcgttaagcattctgcctaattctccatcttgctacctctaatttaattgtatattagtatctgagatctgcaaagaactagcttttaaactccccatcggtgattttcttgtctgaagcatgattatgtttctagagttgtatcgttatctctgtttctttctcaagacacatttatattgctgcttaagtacatatacacgtaaaatgctaataactaaacattttaaatgtagattcgaccactatggaggcactactttcagaacacacaaggtcttatctttgtggttgatagcaatgacagggatagagttgttgaggcaagagacgagctacataggatgttgaacgaggatgagcttcgagatgcagtcttgcttgtgtttgctaacaaacaagatcttccaaatgcaatgaatgctgctgaaatcactgataagctcggtctccattccctccgacagcgccactggtacatccagagcacctgcgcaacctctggagagggactctacgagggtctggactggctttcaaacaacattgctaacaaggcatagggtgatattgaatgtggaccttggatgtgagcttttgctttaggtggtgatgttcttgtcctccactttatctcttgttcttgtctgagctgtgtgcgattatgggattccttcgttaaacagctttttgtgcttttgtggtagcaatgtgtctgatatgatatatggttgtattgcaagtatctttaaaagtattgttgcgtaggttttgcttcataaacctaaaagtgtaacagaggttaattttgactgtgttctatatgtctcccagataatatttttgcttatatgctattctcagttcattttgcagaaagacgagatgtgactgttaattagaaatttgttttacacttccacctaacgaattatgttttcttcttgaaattatattatttggcatttgtctaccaaactaggtgctaggtctaatagttcataatatggtttgatagacaacaaaattgtcttaatgtggatcatggctagtgactgggtcctctgagaacgatctatggtcctttcatagaaacggtccaaataggttgcatttattcagaaactgatgaataatagttctgtgatgtgtctaaacttgtacctaaataaattggtcctttccg

SEQ ID NO: 9900 - DNA, 730 bp, Pinus taeda
agacagctcctggtatcgacatttatacggtttccatttgaatgcgttattgaatggtatttgaatgcgttattgaatggtattaacgttgtggtactgaatggtgtcaacgttgcgttattgaatggtatcaacattttattgaatggtatcaatgctgtggtattaatgttgtggagtacaagaatattagctttactgtttgggatgtcggaggtcaggacaagatccgaccactatggagacattactttcagaatacccagggtcttatatttgtggttgatagtaatgacagggaccgtgttgttgaagcaagagacgaattgcataggatgctgaatgaggatgagttgcgagatgctgttctcctcgtatttgcaaacaagcaggatcttcccaatgcaatgaatgctgctgagataactgataagcttggcctgcattctttgcgtcagcgtcattggtatatccagagtacctgtgctacttctggtgaaggactgtatgaaggtttggattggctttctaacaacattgcaaacaaggcataatgttgaagcatcgtaatgacgctatgaagcctttgagaatgggctggtttccatgccttttgaatattggttggattaggatactttctgcagtgtagtggacgtgtttcatgcttctcctagtaaattgaagtagataaatagttaaggggggttgaggatctattcttgtggtg

SEQ ID NO: 9901 - DNA, 572 bp, Amaranthus tuberculatus
cgtgtcgttgaggccagggacgaattacataggatgttaaacgaggatgagttacgggatgcagtcttgttggtgtttgctaacaagcaagatcttccaaatgcaatgaatgctgctgagatcactgacaagcttggtctccattctctacgtcagcgtcactggtacatacagagcacatgtgccacctccggagaagggctttatgagggtttggactggctctcgaacaatattgctagcaaggcttaaatgaaagaaatggagtaacgttagctgttctcagatgagatgctgaaataggctgaggagtctgtcagtactgctggtgttgccctttttatttttgtcattctatgttctcatttttggtttctaaaaggacaaaaggatatatctttctgttgtttatgttgacatgttataataccctactttttagcttatgagatcttctgaattgtgaacttattatttttagatattttgaacatctcttcccggtccatccgtcacactacaagcttacgtatcggtggcataatacctcgtagactagccaaggacgacac

SEQ ID NO: 9902 - DNA, 542 bp, Cenchrus ciliaris
tgttgttgatagcaatgacagagatcgtgttgttgaggcaagggatgagctccacagaatgttaaatgaggatgagttgagggatgctgtcttgctcatttttgctaacaagcaagatctgccaaacgcaatgaatgctgctgatattaccgataagcttggtctccattcccttcgccaacgccactggtatatccagagcacctgtgctaccacaggagaaggtttgtacgagggtcttgactggctctccaacaacattgcaaacaaggcctgattagacaattctgtggctccatggagtacatggcggttgcattttccgcacaaacagatccatgggtcgttttgaccttgagacttgattattatttcgttgggatgcttgtcaagtattgcatttctttgctaggcttttcagagagctggtttgtccttatgtggcgtgattatactctccaaatacctgtttcaatattaagacactgtaatttgccattggcactagatcgtttaccagtaatgcagttcatttcaaagta

SEQ ID NO: 9903 - DNA, 2405 bp, Chrysanthemum coronarium
tttacttgaaacacacaatgtaccaaactacatgcatgcaaaaagcatatgaacgcaagtttcatggaaacagaatacaagttaactgcctgcaataactaggttaaccaagtctcagtcaactcaagggtaacagttttcattttgcatattgcaaaagatagtattacagaaataaaggtgtacgaatactgcaagtgataatgtatacagtcttaagaaagccaagggaaatcacctattccttctcaacatatagataaaatgctaacaatgtttgtcataagacgtatactccatgttcatgcgagtccgttttaggccttgttagcaatgttgttggaaagccaatccagtccctcatatagaccttccccagaggtggcacaagtgctctggatataccagtgtcgttgtcggagagattgcaagccaagcttgtcggtgatctccgcagcattcatagcatttggaagatcttgcttgttggcaaaaacaagcaacactgcgtctcttagttcatcctcattaagcatcctgtgtagctcatctctggcttcaaccacacgatcacgatcattgctgtcaaccacaaagataagaccttgtgtgttctggaagtagtgcctccacaacggacgaatctaaataaaagtaatatcagtatttgatttcatagagataaggtggatacgtatcaggtttactgcctagcagaataaccaactttcccttgatttatgtgtagccctgtttaaaacctaaagttactgtctaaggtatgtgtacttaaaagggtttgaggttaccggcaacgatatcagtcttttccatggtttgagtcatgatatcattatacaaatactaattgggtacatagttaccttgtcttgacccccaacatcccacacagtgaagctgatgtttttgtattcaacagtttcaacgttgaatccaatagtagggatagtggtgacaatttctcccaacttgagcttgtacaaaatggtggttttaccagctgcgtcgagaccaaccatcagaatacgcatctccttcttagcaaacaagcgactgaataacttgccaaaagacagccccatcttcgtatgatcgccggcaaccggaaaaatgaggaaaagtttttgagatcggagccgtcgatcagcaaaatgtggatgcgatcaaagtggaaaggggaataagagagaggcgattgggtttgcgtaccgattgctctatttggaatctcaatctcaatctcaccgcctgcctcatttgttctccaattcttcttctatttgattaatggataacaacaactctaaagacgaaaaccctccttcttcttcacttgaagaaaatgtaaaccctaaccctaccagaacccctttcactaatctcagtcagattgatgctgatcttgcccttgctcgtactcttcaggatcaggaaagagcatatatgctgttgagaataaatgggaatgggaatgctgatgcgagtgacgatgatagttgggaaactggaagctataatgatgttgagtttgatcatcataataatagtgaacaatatgaagatgaagaagaagatgcttttgatgttcatgctcatcttgatgatgttggatctggacaaccaccagatgttcaggataataatcaacttcaattggacccctcttccttccctgatgacgaagcctacgctagagctttacaagatgccgaggatcaagaaatggctgctagactattggcccttactggaattcatgaaatggttaccgaggaagaagaagacgatgatgatgatcttgatgaccaaggtgttcgttctcaggatacatgggatgacgtcgacccagatgaactatcatacgaggaacttattgccttgggtgaagtggttgggactgaaagtagaggcctttccgctgattcaattgcttctttgcggtcaatcctatacaagacgcaaaacggtcaaattggaagcaatgaaacatgcgttatttgtcgcttagactatgaagatggtgacaatttgatcttgctttcatgcaaacactcgtaccattctgagtgcataaccaattggttgcaaataaacaaggtatgccctgtttgcagtaccgaggtctcggcatctagcactgctagttaatttatacattcatgatggtttcgtcagttgatgcaaactcaaggaagttatggttccagtatatcgttcactgtgtgaaatgaccataaattatcattcataacaatttagttgtattttagttagcaacctgtctcatgggattgtcattctgatttttcttaatgtttattggatgttggtttcagttgatgccagttataaaaatgtaacagtggagactgttgcttcatctt

SEQ ID NO: 9904 - DNA, 526 bp, Cirsium arvense
gtacaagctcaagcttggtgagatcgtgacaacaatccctaccattgggtttaatgtggagactgtcgagtacaagaacatcagcttcaccgtgtgggatgttggtggtcaagacaagattcgtccactatggaggcactacttccagaacacacaagggcttattttcgtggttgacagcaacgatcgagatagaattacagaagctagagacgagctgcacaggatgcttaacgaggatgaactaagagatgcagtgttgcttgtgtttgccaacaaacaagatcttccaaatgctatgaatgctgctgaaatcactgataagctcggcctccactccctccgacagcgccactggtacatccagagcacctgtgccacctccggggaaggactttatgaggggttggactggctttccaacaacattgcaaacaaggcataaggtgacaattgaatttgtattttgagggtggattctggaggcaagttttgctttatttggtgtagccactttcctgttctc

SEQ ID NO: 9905 - DNA, 551 bp, Conyza canadensis
gtcaggacaagatccgtccactatggaggcactatttccaaaatacacaaggtcttatcttcgtggttgatagcaatgacagggacagagtcgttgaggcaagagatgaattgcacaggatgttgaatgaggatgagttaagagatgcagttctccttgtatttgctaacaaacaagatctccccaatgcaatgaatgctgctgaaatcactgacaagcttggactccactccctccgacagcgccactggtacatccagagcacctgtgcaacctctggagagggactttatgagggattggactggctttccaacaacatagcaaacaaggcataaggcgttgattgatgtttctttttacgagggtggatcttgggcggtttctccttctagtgatacctgtagttttggaaactgttgtttgaaaagatgttttgcttttgatatagaggttatggatgtgtctaattgaatgaatacattgtttgtttgtctggatttgcatgtatgtctttaggaagttattattcttttatctgaagttgcaag

SEQ ID NO: 9906 - DNA, 560 bp, Curcuma longa
caaggacttatttttgttgttgatagcaacgatcgagatcgtgttgttgaggcaagagatgaactacacaggatgcttaatgaggatgaactaagggatgctgtcttgctcgtgtttgctaacaaacaagaccttccaaatgcaatgaatgctgctgaaatcactgataagcttggccttcattctctacgtcagcgacactggtacatacaaagcacctgtgctacatctggtgaagggttgtatgaagggcttgattggctctccagcaacattgccagcaagtaatcaaaacctgcttcgaaggttcatatcttaacatcagcagtgttcgcgtttgatgcttttgtggcaacggaagcaaggagactattaattttccacttggaacatcgttttcccctttcccttctgcatttaaaaacctaatacaagtctgtaaaacaaatatatgcttggttgttacccatttttcaatgttctgacgatggacgcagcaaacgacttcgtttctcttgttgtcatattttttccccctctatatttattttccatttatt

SEQ ID NO: 9907 - DNA, 721 bp, Cyclamen graecum
gtgggatgtcgggggtcaggacaagattcgcccattgtggaggcattatttccagaacacacaaggtctcatcttcgtagtggatagcaacgacagggaccgtgttgttgaggcaagggatgaactgcatcgcatgttgaatgaggatgaactgcgtgatgcagtgctgcttgtgtttgctaacaaacaagatcttcccaatgctatgaatgctgctgaaattaccgacaagcttggtctccactctctccggcagcgtcactggtacattcaaagcacgtgtgctacatctggtgaggggctctacgaggggcttgattggctctccaacaacatcgctaacaaggcttgaagcaggttgaggtattcgggggagtgatcctaaatgcaagttggcctttatctctgcaaaactcttctctttctttttttttgccttgcctggtgtgtggcaaggaatcgcaacatttttttttacttttcaagtatttcttgtttcatgttgggttttgaaatggtttgtctaatagaattgtctcggttatgttttatgttctagcaatgttgtttagaagtgaacgcatgctttttataaggagactactatgtgaatcttataccgtataacgatctgttttaaaaaaaaaaaaaaaaaaaaaaaaaaaaaaaaaaaaccggaaaaaaattacataaggaaaaaaaaaaaaaaaaacaaaacccg

SEQ ID NO: 9908 - DNA, 930 bp, Setaria italica
atggcgaagctcatggcgagggatttgagccgggtgctgaccacagccaggggaaccgtcgggtacctcgcgccggagtggatcggcgggatggccgtcacgcccaaggtcgacgtgtacgcctacgggatggtgctgctggagatcgtgtccgggaggatgaactcgcacgaggagctgcgcggggacgccgtcgtcgaggaggtggagagggcgtgcaaggtggcctgctggtgcattcaggacagcgaagttgatcggccgacgatggggaaggtggtccagattctcgaaggtctggttgaggtcgagatgcctccggtgccgagagtcactgaattaagaagtaagaagtacggttatccaatcatcaagctgcaggatgaattacgtgatgctgtgtttcttgtttttgctaacaagcaagatcttccgaatgctatgaacgctgctgagattactgataagcttggactgcactcacttcgccagcgtcactggtacattcaaagcacttgtgctacaactggtgagggattgtatgaaggcctggactggatgtccagcaacattgccagcaagtcctaaattttcgagaggtttggaccatctaggagcctttggatgatgatattgctggatatttagggttgggttgctattcccgtatgtaaggtgtatgccctgagctcaatagttattgagctttggttaagatttcacagttaaattgttttgtgtaatttgagcccttgagatattttcgaaccaaacagctaaagagagttccgttgagttaatttgttgggggaatacttgctggtatgcagtatcacattgctgttgtgagattctttcatgctccgtaggttgaacaccatccgaatggttgcattatttgtgttcttcgcatttgttccgccggtctaa

SEQ ID NO: 9909 - DNA, 708 bp, Humulus lupulus
caaccactcctctaacaagctcaagctcggtgagatcgtcaccaacaattcctaccagtttggtttacaacggtggagactggtaggaataaaaagaacatcagtctcacttggttggatgtggggggtcaagacaagatccgtcccttgtggaggcactacttccaaaacacgcagggtctcatatttgtggtggacagcaatgacagagatcgtgttgttgaggctagggatgaattacataggatgttgaacgaggatgagctgcgcgatgctgttcttcttgtttttgctaacaaacaagatcttccaaacgcaatgaatgcagctgagatcactgataagcttggtcttcattctctcaggcagcgccactggtacatccagagcacatgtgcaacttcaggagagggattgtacgagggtctggattggctctccaacaacattgccaacaaggcataatccctatgtggacaagcaattctggatgcaggggtgaatattatctagttttttttcttttctttttgttcgagacaattgaattgttgtgtctattgtcgtttgggtcaaatcatttaggattttctaatggttatattgtaatagaagaatggtcggttggatatatgccgttgagcttttgttgggatttaaatacaatgctgagttgtaatcaaactaattcgacgcttaatttctttc

SEQ ID NO: 9910 - DNA, 836 bp, Lolium multiflorum
caccaccatcccgaccatcggatttaacgttgagactgtcgaatacaagaacatcagcttcactgtttgggatgtggggggccaagacaagatcaggcccctgtggaggcactacttccagaatacgcagggactcatctttgttgttgacagcaatgacagggagcgtgttgttgaggccagagacgagctccacaggatgctcaatgaggatgagctgcgtgatgctgtgttgcttgtatttgcaaacaaacaagatcttcctaatgccatgaatgctgctgaaatcactgacaagcttggtctgcactcccttcgccagcggcactggtacattcagagcacttgtgctacatctggcgaaggattgtacgagggacttgactggctctccaacaacatcgccaacaaggcttgaagtgtctccacaacgcttccaggaacaaaggctctggctgtctgaagaactcactgctaccatttttcatattgtgatatataaatatatacactctacaacagatagtatgtatgcttatttgacagaagctctcctctgagtgggctagtatcaggttgtttcttcgtgtgggtattatcagcgtttctgttcagttttacaaggtttactgtgtcaaccatgtgtatgtacacctatgtttttgagatatagtaaaatgaggcatggtgccaaatattcgattagttcagtactgtggatggtgcaaattgttagcctatgatgtgagcactgttttcaccagttctgtatatgatcctgtgctactccctcctccctccgtcctagagtgtagtgtaaggcatatttctaaaaa

SEQ ID NO: 9911 - DNA, 537 bp, Avena sativa
agcaatgatagggaacgtgttgttgaggctagggatgagctccacaggatgctgaatgaggatgagctgcgtgatgctgtgttgcttgtatttgcaacaaacaagatcttcctaatgccatgaatgctgctgaaatcaccgacaagcttggtctgcactccctgcgccagcggcactggtacattcagagcacttgtgcgacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacaggcagaagctcccttctttaagtgagctagtatcaggtcaggttgtcctttttgtatggatattatcagctgctgttcggtggtttacagtttatgtgtcgacatgtgtgtctgacggtcgtggagcaggcacgacgagggatagg

SEQ ID NO: 9912 - DNA, 429 bp, Allium cepa
cgtaggtggccaggacaagatccgtcccttgtggagacattatttccagaatacacagggtttgatctttgtggtcgacagcaatgaccgagaccgtattgttgaggccagagatgagcttcaccggatgttaaatgaggatgagctgagagatgcagtgttgctcgtctttgcaaacaagcaagatcttcctaatgccatgaatgctgctgaaatcaccgataaacttggcctgcattctcttcgtcaacgccattggtatatacagagtacatgtgccacctcgggagagggcttgtacgagggattggactggctttcaaacaacattgctaacaaggcttagccacgctgctgccatcaccagttatcttcgtttctgtgcaagagtgttattgggtctatataataccatgtaatgagaggagg

SEQ ID NO: 9913 - DNA, 666 bp, Citrus sinensis
attgtactgttgtccacattcagattcgtcctttgtggagacattacttccaaaacactcaaggacttatctttgtggttgatagcaatgatcgtgaccgtgtggttgaagctagagatgaactgcaccggatgctgaatgaggatgagttgagggatgctgtgctgcttgtttttgccaacaagcaagatcttccaaatgccatgaatgctgcagagatcactgataagcttggtcttcactcacttcgtcaacgccactggtacatccagagcacatgtgcaacatctggggaaggactctatgagggtctggactggctctccaacaacatcgctaacaaggcttaattgattggtcaagtctgagcgactctttgcggcagcatctatgtgaatgatgttactatgcttttgtttattttgtcggggattctttttgggctttactacctacgttcagaagaatgtatttgtttgtgttagatatttgattggcaccatactataaagttttctgcattgtcattgtagagtttaaattaccctcattattcagaattcaatgattttttggctgttattcctcttagcttctctttagtctgtagcgttgcagatattctttaatcaccaataattggcttattgatttgttcttaatatt

SEQ ID NO: 9914 - DNA, 983 bp, Petroselinum crispum
acatcagcttcactgtgtgggatgttggtggtcaggacaagattcgtccattgtggaggcactacttccagaacacacaaggtctcatatttgtggttgatagcaatgatagagaccgagttgtggaggctagagatgagttacatagaatgttgaatgaggatgagctacgagatgcagtgctactcgtatttgctaacaaacaagatcttccgaatgcaatgaatgctgctgaaataaccgataagctcggtctccactctctccgacagcgccattggtacatacagagcacctgtgcaacatctggggaaggactttatgagggattggattggctttccaacaatattgccaacaagtcatgagcagatgcagagttgttcccgtggagtgattctggatgcagaattatattatctagttttccttctttctgttccccacacatattatgtttctgtagccaccgtctgctgatgaattttaaccaaagctgacctttaagtggtctgaacgcatgctgggttaaatagacgaattgtcgagaccctaaatacttgtatgtgcaatttgcaaatctgtaatatccaaagcttatgtggtgttgagacataaattttcattctcccagtttttgtagatctattcctattggtttgttcgtacctttagtattagttaaagcctaaaggatcattgcgccattctgtttttgttgtcatttgtcaagtgtgtcatggcagctgaactgctaaagtagttcacagataatttttatacatattccacatattttgagtggctgtagaaaagtaattattttccaaatttctagaggatacttgcatctttgtaagacatttagcatcattcatgtgatataagattaggttaaagtattgttgtagaacaatttatatgcaaatttaagttgtatagtattggttttataacaatatttatataactagagattgctc

SEQ ID NO: 9915 - DNA, 739 bp, Picea glauca
tcaatgtcgaaactgtggagtacaagaacatcagcttcactgtgtgggatgttgggggtcaggataagatccgtccactatggagacactacttccaaaatactcaaggtctcatctttgtggttgatagcaatgacagagatcgtgttgtagaagcaagggatgaactacataggatgctgaatgaggatgaactacgtgatgctgtattacttgtgtttgcaaataagcaggatcttccaaatgctatgaatgctgcagagatcactgacaaacttgggcttcattcccttagacagcgccattggtatatccaaagcacttgtgcaacttttggggggggattttacgagggtttggattggctttccaacaacattgcaaacaaggcttgaagaaatatggtgaactgggtttttggaattttgtagggcaatgtcgttttatttcatttttgtcagccagtttgaagaaataaggttttaattgggcagtcaaaccgacttttgactaacatttattcaattttttttaggggtttgattgtgccaatttgctagcaatgaattaatttatatagctccctgggcttaaatggcaaagcatagtagttttttttaaggtgggggatgattatgatattcccttcgtggggggggcatagacatttctaagcatgctccagctgatttgaaacttattttccttttccaagcttttttgtttcagattcccctca

SEQ ID NO: 9916 - DNA, 874 bp, Picea glauca
gaggcactactttcagaatacacagggtcttatctttgtggtggatagcaatgacagagaccgtgtagctgaggcaagagatgagttgcacaggatgttgaatgaggatgagttacgagatgcagtcctgctagtgtttgcaaacaagcaggatctcccaaatgcgatgactgctgctgaaatcaccgataagcttggtctgcactctttacgtcagcggcactggtatattcaaagcacttgtgcgacttctggtgaaggtctttatgaaggcctggattggctttcaaacaacattgcaaacaaggcttaaggatgatgcttgggaactgagttggtacagtgaatgggtttagtgatgcatttgatgtctttgccgacgagtaagggacaaggagttgtgtggtgaattggcccttacatttgttcctataagtaacaaatactatattattttgtatttatctaagaatttggggggtttccttcttgggtgtatgttatatctgagatttcggtttccttttctttgttggaagctaattatgaaaaagtattagttatatatgcttgaagcgaagtgcagaaatgctgagtattaaaagctccaaaggttaacagtatctattaaagacttaaggaattatactcaaaaaattatgtaagagtacggaaaacttcatgattatacgtgagataaatgagtatagaacaagaaaataaaagatagaaaatttgctaaaaacattcaacacccatctctccaccaatttacatgccacagatacattacaaatggccggtaaatatgcaggtgactggtgggatctcgtttctgaaccttgcaattcttaaccaaaaaaacaaaaaagta

SEQ ID NO: 9917 - DNA, 717 bp, Saccharum officinarum
gtcgagtacgagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaggacgagctccgtgatgctgtgcttttggtgtttgcaaacaaacaagatctgcctaatgccatgaacgctgctgaaatcactgataagcttggcctgcactcgctgcgccagcggcactggtacatccagagcacgtgtgctacctctggtgagggtttgtacgaggggcttgactggctttcaaacaacattgccaacaaggcttaagcatctaggcagggcttcaaccaatggaatcactctggatatacttgggtgcaaactgcctctaccattacagctatgtactatatagtcgtgaccgtgtcagatgtgggggtgtttctgagaggataaaaggctcttttggtcaaggagctaggtatcagatgttttcgtggtattgttaattttctgtgcttctgttttggtttgtgcaaggtatgccatgtccgactgcgtgctgtgtgtactcgccactgttctacattgtgctgtatactctcgccacctgtttgaggcgttgtactatctcgacctggctgtctcttggcatagcaaaat

SEQ ID NO: 9918 - DNA, 585 bp, Thalictrum flavum
tggagacactatttccaaaacactcaaggtctcatatttgtggtggatagcaatgacagagacagagttgttgaggcaagagatgaattgcatagaatgttgaatgaggatgagttgcgtgatgctgtgctgcttgtgtttgctaacaaacaagatcttccaaatgcaatgaatgctgcagagattactgataagctcggccttcattctctccgtcagcgccactggtacatccagagcacttgtgctacctctggagaaggtctttatgaaggtttggactggctatctaacaacattgctaacaaggcctgagtcagtaagcaatagctgttgaagtatctttctgcagtaaaacttgttcatgtggcctgtggtttgctcattagtgatgcgacaccattaagaattgccttttttttctatagaatattttggtgactattgtactagaggattttgtttcgttggatatattatgagctgccttgattgttggtttggaatttggttgtactgcactagctgtaaccaggatactttgctacttgatctgttttcacttactataactgcatttggatg

SEQ ID NO: 9919 - DNA, 623 bp, Thalictrum flavum
gggatgttgggggtcaggacaagatccgtccactgtggaggcactatttccaaaacacacaaggtctcatatttgttgtggatagcaatgacagagacagagttgttgaggcaagagatgaattacacagaatgttgaatgaggatgagttgcgtgatgctgtgctgcttgtgtttgctaacaaacaagatcttccaaatgcaatgaatgctgcagagattactgataagcttggccttcattctctccgtcagcgccactggtacatccagagcacatgtgctacctctggagaaggtctttatgagggattggactggctatctaacaacattgctaacaaggcctgaggcagtaagcaatagttgctgaagtatcttctgcagtaaaacttgttaatgtgtcagtggtttgctcctttgtggtgcaacacctttaagaattgttttttctttttccaatagaacattttggtgacaatattgtaatagaggattttttttttgtttttggatatatttatgagctcagctacaccttgattgctggtttggatttggttgtactctagctgttaccaggatactatctccctatcttcaatatgctcgatctgttttcac

SEQ ID NO: 9920 - DNA, 740 bp, Triticum aestivum
atccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaagacgagctccgtgatgctgtgcttttggtgtttgcaaacaaacaagatctgcctaatgccatgaatgctgctgaaatcaccgataagcttggcctgcactcgctgcgccagcggcactggtacatccagagcacatgtgctacctctggtgagggtttgtacgaggggcttgactggctttcgaacaacattgccaacaaggcttgaagcatctaggcagggcttcaatcaatggaaacactctggatacttggggtacgaactgcctctaccattacagcgatgaactatagtcgtgtctgtcggatgtggggatgtttttgggaggataaaaggctctttggtcaaggagctaggtatcagatgttttcgtggtattgttaatttctgttttggtttgtgcaaggtataccatgtccgactgtgtgctgtgtactcgccactgttctataatgtgctgtatactctcgacccctgactgaggcgttgtactatatatctcgatctgtctagctgtctcttggcatagcaaaaaa

SEQ ID NO: 9921 - DNA, 532 bp, Primula obconica
ggaggcactatttccagaacactcagggtcttatttttgtggtggatagcaatgacagagaccgtgttgttgaggcaagagatgagttgcaccgcatgttgaatgaggatgagttgtgagatgcagtactgctggtctttgctaacaaacaagatcttcccaatgctatgaacgctgctgaaataacagacaagcttggtctccactctcttcgacagcgccactggtacatccagagcacttgtgcaacatctggcgagggtctgtatggaggggttggattggctctccaacaacatagctaataaggcttgagtacggtgattcatcctgtgggagtaacactggatatgcagctttcttatctagtctgtttcgttcccttatatttcttgtccgaaaatttgttgttatcgatttaattttgtaagtgtttttttcttgattaagaatttttgcggctctctattacaatggggtttgttgaaatcatgatgcaccatcaaaaattctgcagatttgactatgaatg

SEQ ID NO: 9922 - DNA, 339 bp, Brassica napus
gacagagaccgtgtgttaggccagagatgaactcgcacaggatgctaatgaggatgagctgcgtgatgctgttctgctcgtgtttgctaacaaacaggatcttccaaatgccatgaacgcagctgaaatcactgataagcttggtctccactctctccgtcagcgtcactggtacattcagagcacatgtgccacttcaggcgaggggctttacgaaggtcttgactggttgtccaacaacattgccggcaaggcgtagagggaaggttcgtggttgagttgattttgctgagcaaatctggatgcaggggcaaacattatctgaactttttctttccg

SEQ ID NO: 9923 - DNA, 499 bp, Cleome spinosa
tggagactgtagagtacaagaacatcagtttcactgtttgggatgtcggtggtcaggacaagatccgcccgttgtggaggcactatttccagaacacacaaggactgatatttgtggttgacagcaacgacagggaccgagttggggaagcaagggatgagctgcatcgtatgctgaatgaggatgaactgagggatgctgtccttcttgtgtttgcaaacaaacaagatcttccaaatgcgatgaatgctgcagaaataacagacaagctgggccttcactctctccgccaacgccactggtacatccagagtacgtgtgcaacatctggggaaggtctttatgaaggccttgattggctctccaacaacatttctagcaaggcatgaagctgctgagattgaaagaaaccatagcagtggtggcgaagcagataggatatatgctgccctttgaaggttcattatgttaaaatgtagccatatgtatcggctgtttg

SEQ ID NO: 9924 - DNA, 302 bp, Primula obconica
tgaggacgagagatagagttgaccaccgacatgttacgaatggaggatgagttgcgggatgcagtattacttgtctttgccaacaaacaagatcttcctaatgcaaatgaacgctgctgaaataactgacaaacttggtctgaactctctccgacagcgccactggtatatccagagcacttgtgcaacctccggtgagggcctgtatgaaggggttggattggctctccaacaacattgcaaataaaggcttgagtatgggggcttgatacttggatgcaggatggtctttttatctagtc

SEQ ID NO: 9925 - DNA, 934 bp, Flaveria ramosissima
ataacctcatattcatcatcagttttctcgcccctttattcattttacatactccattttcctctccgtctctctcttccaatcgatcgattgatcccttttcaacaagcttttctcaggtaaatctagatctagatctagatctttgatttctcatccaattgatcagatctcaacattttatcagttggattcaagggatcctcactagcaagaggatggggctaactttcaccaaactcttcagccggctctttgccaagaaagagatgcgtatattgatggtggtcttgatgcagctggtaagacaaccattttgacaagctcaagcttggtgagattgtgactcgatccctaccataggtttatgtggagactgttgagtacaaaaacataagcttcactgtgtgggatgttggggtcaggacaagatccgtccactatggaggcactacttccagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgcctaatgcaatgaatgctgctgaaatcactgataagcttggccttcactctctccgacagcgccactggtacatccagagcacttgcgccacctctggggaaggactttacgagggtttgactggctctccaacaacattgctaacaaggcatgaggtgatgatcgacttgtaaaaggttggaaaacccgaggcgagtttagcttttcgtctggtcaggtctctttcccgttctcatcagtgcgagcggttatgaaactttgtttgttaaacaggtcttttgatttgatgtatataggacctgttacggtacaatgtttgttggaagtttgt

SEQ ID NO: 9926 - DNA, 690 bp, Pinus taeda
ctgtggattgcaagaatattagctttactgttggaggtcaggacaagatccgaccactatggagacattactttcagaatacccagggtcttatatttgtggttgatagtaatgacagggaccgtgttgttgaagcaagagacgaattgcataggatgctgaatgaggatgagttgcgagatgctgttctcctcgtatttgcaaacaagcaggatcttcccaatgcaatgaatgctgctgagataactgataagcttggcctgcattctttgcgtcagcgtcattggtatatccagagtacctgtgctacttctggtgaaggactgtatgaaggtttggattggctttctaacaacatcgcaaacaaggcataatgttgaagcatcgtaatgacgctatgaagcctttgagaatgggctggtttccatgtcttttgaatattggttggattaggatactttctgcagtgtagtggacgtgtttcatgcttctcctagtaaattgaagtagataaatagttaaggggggttgaggatctattcttgtggtgtactgatccttagtttacttaatttgtttgaaattttgcatgtctacaattgttacataatcaactatgaattcttccagtgggttcctcaggattgcaacgtaaaaaaaagaaccagaaccaatcccaaataaacttcg

SEQ ID NO: 9927 - DNA, 715 bp, Pinus taeda
gagacctgttctattccaaataatgacagggaccgtgttgttgaagcaagagacgaattgcataggatgctgaatgaggatgagttgcgagatgctgttctcctcgtatttgcaaacaagcaggatcttcccaatgcaatgaatgctgctgagataactgataagcttggcctgcattctttgcgtcagcgtcattggtatatccagagtacctgtgctacttctggtgaaggactgtatgaaggtttggattggctttctaacaacatcgcaaacaaggcataatgttgaagcatcgtaatgacgctatgaagcctttgagaatgggctggtttccatgtcttttgaatattggttggattaggatactttctgcagtgtagtggacgtgtttcatgcttctcctagtaaattgaagtagataaatagttaaggggggttgaggatctattcttgtggtgtactgatccttagtttagttaatttgtttgaaattttgcatgtctacaattgttaaatcaattatgaattcttccatgtggctgcggattgcaacgtcaaaagcagaaccagaatcaatcccaaataaacttcgcatctgctcatcgtagatttttatattgagggaatctttccaaccagttgagcaagagggtgtgtgaatcttcagcagttcatttgtctcctgacttggatatatctgaagaagtgttgg

SEQ ID NO: 9928 - DNA, 1015 bp, Pinus taeda
attatcactttgtttatgttatttttgatgctgaatgaggatgaactacgtgatgctgtcttacttgtatttgcaaacaagcaagatcttccaaatgctatgaatgcagcagagatcactgataagcttggtctgcattctctgcgtcagcgtcattggtatatccagagcacttgtgcaacttctggtgaaggcctttatgaaggcttggattggctttcaaacaacattgccaacaaggcataaactggaatgcatccaatttctttattgggcatgaactatattagccatgaggtagattccttcagattacaatgactgacaaccactggcatggatttgctaaagaagaccttgactcgattcattttctcgataccctgattgctatgcatttaccaacaactttgtcattattgttcaagaacctgggatttttctttctgacagttgtgctatattgactattatagctcttatatatatatagctgttatctgttgactgagaagacttgtataattagattttagaggactgaaaggctttgctatgttaactaggaacaaatataatgttgctttccaaatttattagttgggaaaaacagaaagtagttcagtatttatatcaatatctgaaaactgtatcagatatttatatctgtagtcttatcctgttgaccagttgaggtttcctgattgtgaagtttatagtgataatgctgtatgctgcatcaatgtgaaagctatagcagtctaagtgtacacctgtgttatgttagttattagtagtctttttgttttgggataaacagaatgatgtacgggagttaatagtctaggttgagttgacctctttcttcctttttgaagagatacgtgaacttgcttttaaaaaaaatgctggccgtgtttgatttgaaactatcaaaattacttcgaagtatgattattataatgttacatcattttttttgaaaatgctacttgtggtatattatgttagagcg

SEQ ID NO: 9929 - DNA, 371 bp, Bupleurum chinense
aagctagagatgaactgcacagaatgttgaatgaggatgaattgagagatgcagtgcttctcgtgtttgcaaacaagcaagatctccctaatgccatgaatgcagccgaaatcactgacaaacttggcttgcattctcttcgacagagacactggtacattcagagtacatgtgccacatctggagagggtttatacgaagggttggattggctttcaaacaacattgctaataaggtttaaagaatttattcggtatcttatgaactatatgggtggccgtcatcatctggtgccattgttgcttctgtttttgcagtcatcatctgggtgtcattgctgcttttgatattgtttccagaattactttgg

SEQ ID NO: 9930 - DNA, 491 bp, Cannabis sativa
ttaacaatccttctttcacaggttttaatgtggagactgtggaatacaagaacattagcttcacagtttgggatgtggggggtcaagacaagatccgtcccttgtggaggcactacttccaaaacacacagggtctcatatttgtggtggacagcaatgacagagatcgtgttgttgaagcaagggatgaattacataggatgttgaatgaggatgagctgcgcgatgctgttcttcttgtttttgctaacaaacaggatcttccaaacgcaatgaatgcagctgagatcactgataagcttggtcttcattctctcaggcagcgccactggtacatccagagcacatgtgcaacctcaggagaaggattgtacgagggtctggattggctctccaacaacattgccaacaaggcataatccctatgtggagcctttttgtggacaatcaattctggatgcaggggtgaatattatctagttctttttttt

SEQ ID NO: 9931 - DNA, 409 bp, Cocos nucifera
gtcgacagcaatgacagagatcgtattgttgaggctagagatgaattgcacaggatgcttaatgaggatgaattgagggatgcagtgctgctggtctttgcgaacaagcaagatcttcctaatgccatgaatgctgcagaaatcactgataagcttggtttacactccctccgccaacgtcactggtacatccagagcacatgtgccacatctggtgagggtctttatgagggactggagtggctctcaaataacattgctaacaaggtctgtctcatgaatgcatgagccaagtgctcttaatatttgatttctgttgaaagtgcagctttttgtgactttgtgatcgctcctccatttgtctgcaggcatagatattgctggttgggtaccttgttggagcttaaaa

SEQ ID NO: 9932 - DNA, 772 bp, Flaveria ramosissima
ccctaccacagggtttttaatgtggagactgttgagtacagaacataagcttcactgtgtgggatctggggtcaggacaaagatccgtccattatggaggcactacttccagaacacacagggtcttatctttgtggttgatagcaatgatagggacagagttgttgaggcaagagatgaattgcacaggatgttgaatgaggatgagttaagagatgcagttctccttgtgtttgctaacaaacaagatctcccgaatgcaatgaatgctgctgaaatcactgataagctcggtctccactctctccgacagcgccactggtacatccagagcacttgtgcaacctctggagagggactttacgagggattggattggctttcgaataacatagcaaacaaggcatgaggcgaatgatccattatgtgggtggatgtttctgttgcgggttttgtaacttgtttgtttgaaaaaggtattttgcttatgaaatacaattgaatacattgtttggattgcaagtatgtgttaggtaggttgtcgtctcaagttgtaagagattaactttttgtggtgattagaagttggattctcatgtagtttgttattgtccatttgataaaacatttttattctatcgggttctttgggttgtcacaatgcattctgctttgttgtgttcgtgagggtaaatgggtaattgggttatttgttgagaactctaaaactggtaattttttgtaactatgtacaattctgttatggtaaagt

SEQ ID NO: 9933 - DNA, 702 bp, Linum usitatissimum
attggattcaatgtggagactgtggaatacaagaacatcagcttcacagtgtgggatgtcgggggtcaagacaagatccgaccattgtggaggcactatttccagaacactcagggtctcatatttgttgtggacagtaatgacagagatcgtgttgttgaggccagagatgaattgcataggatgttgaacgaggacgaactccgagatgcagtgttgctggttttcgctaacaagcaggatctgccaaatgcaatgaatgccgctgagatcactgacaagctcggcctccactcccttcgccagcgacactggtacatccagagcacctgtgctacatcaggcgagggcctttacgaaggcctcgattggctctccaacaacatcgccaacaaggcttaaatgttggaagcagcaaggctggaggatggcaaagttctggatgcagggggggaggggtgggggggtgaatgttatcttctagttcctggttatttcttccatttttatttttcttcttatgagatgtcttggattgtgtgttagctctctttctctgcatctttgttacccccttctccattcttaacgtctcccttatggcttatactgacttgacttgtgggagtatttgccttctgcatgttaggaaactctgttttctttttgtaatggattgattatgtaatagaatactgtatc

SEQ ID NO: 9934 - DNA, 1401 bp, Setaria italica
tgaatgtaccagtgacgctggcgaagtgagtgcagtccaagcttatcagtaatctcagcagcgttcatagcattcggaagatcttgcttgttagcaaacacaagcaacacagcatcacgtaattcatcctgcaatcagtaacataacgatagattttaaagtactcgtaacataacaatagatgtgagcacacaaccacataccagtgaaaatattctcaatagcaaaggtatttacctcgttcagcattcggtggagctcatccctggcttcaacaacacgacccctatcgttgctgtccacaacgaagaatcggcgccaaacacgtcttcatcccgcatcggtgccggcggccgccccgccctatctccctaccgaatcggcgccgccctcgattccccgccctatctccctcccgcggttgctcgatcccgaggcgagaggggagagatggggctcatgttcacgaagctgttcagccggctgttcgccaagaaggagatgcggatcctcgtggtggggctcgacgccgccagaaagaccaccatcctctacaagctcaagctcggcgagatcgtcaccaccatccccaccatcgatcaggctgttgtggaggcattacttccagaacacacagggtctcatcttcgttgtggacagcaacgataggggttgtgttgttgaagccagggatgagctccaccgaatgctgaatgaggatgaattacgtgatgctgtggtgcttgtgtttgctaacaagcaagatcttctgaatgctatgaacgctgctgagattactgataagcttggactgcactcacttcgccagccacgtacattcaaagcacttgtgctacaactggcgagggattgtatgaaggcctggactggctgtccagtaacattgccagcaagtcctaaattttcgagaggtttggaccatctaggagcctttggatgatgatattgctggatatttagggttgggttgctattcccgtatgtaaggtgtatgccctgagctcaatagttattgagctttggtaaattgttttgtttaatttgggcccttcagatgttaccgaaccaaacagctaaagagagttccgttgagttaattggttgggtgaatgcgtgctggtatgcagtatcacattgctgttgtgagattctttcatgctccataggttgaacaccatcccaatggttgcattatttgtgttcttcgcatttgttccgccggtctaaaaaatggacggctgcgagagcttaagctatagactcgtatctttaacccaggtatgtgaagcgaacaagtagctttgttatgctaactaacaagcaattttgttatgctaactaacgtatctttcacctaggtccgtgaagcgaacaagcagc

SEQ ID NO: 9935 - DNA, 526 bp, Panax ginseng
ctttgtggttgacgagcaatgatcgagatcgtgtcgatgaagccagggatgagctgcacagaatgctgaatgaggatgagttaagggatgccgtgctactgtatttgcaaacaagcagatcttcccaatgcaatgaatgctgctgagattactgataaacttggccttcactctcttcgtcagcgccactggtatatccagagcacttgtgccacttctggtgaagggttgtacgaggggctggactggctctcaaataacattgcgaacaaggcgtagacggcttatctgagtttggatcgtcaccacagccaaattagagtttttcgtgctttatttggttcagaaatctgtaccatgttgatgtttacctcttttactatttttgaggtcccatttccagatattgatatttgtttccttcagtttcagaataattcacattattttgttttattcgccatatttctccatatctttgatattctatgcaagtacaatcctaaccttagagaaactattcccc

SEQ ID NO: 9936 - DNA, 776 bp, Panax ginseng
aagcagtggtatcaacgcagagtacatggggctcctcctccgcatctgatagacagagcggttttttgacgacagctccatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaatttttgacaagctcaagttgggtgaaattgtcaccactatccctacaattggactttaaatgtggagactgttgaatacaagaacattagcttcactgtgtgggatgttggtggtcaagacaagatccgacctttgtggaggcactatttccaaaacacacaagggacgtcatctttgtttgtttgtacagcaatagatcgagaccgtcgtggtcgaggctagagatgaactgcacaggatgtttgaatagaggatgaactgagagatgctgtactccttgtgtttgcaaacaagcaagatcttccaaatgccatgaatgctgctgagattactgacaagctttggtttgcattctcttcgacaacgacattggtatattcagagcacatgcgccacatctggagaaggtctatacggaggactggattggtctttcaaacaatattgctaacaaggcttaggtgggctactcgtaccggctcagttggtactacaaagaaatacattggtgcagtcaatctggttataagtgttgttgcaat

SEQ ID NO: 9937 - DNA, 306 bp, Guizotia abyssinica
gcactacttccagaacacacaaggtcttatctttgtggtcgatagcaatgacagggatagagttgttgaggcaagagatgagttacacaggatgttgaacgaggacgagcttcgagatgcagtcttgcttgtatgtgctaacaaacaagatcttccaaatgcaatgaatgctgctgaaatcactgataagcttggcctccattccctccgacaacgccactggtacatccagagcacctgtgcaacctcaggagagggactttacgagggtctggactggctgtccaataacatcgctaacaaggc

SEQ ID NO: 9938 - DNA, 326 bp, Primula obconica
tatttccagaactacccagggtctcattttcgtaggtggatagcaatgacagagaccgtgtgttgaggcgagagatgagttgcaccgcatgttgaatgaggatgaagtttccgggatgcagtattactgtttttgccaacaaacaagatcttcctaatgcaatgaacgctgctgaaataactgacaaacttggtctgaactctctccgacagcgccactggtatatccagagcacttgtgcaacctccggtgagggcctgtatgagggggttggattggctctccaacaacattgcaaataaggcttgagtatgggggcttgatac

SEQ ID NO: 9939 - DNA, 537 bp, Sarracenia psittacina
agttattgaggcaagggatgaattgcatcacatgttgaatgaggatgagctccgcgatgcagtactgctcgtatttgccaacaaacaggatcttcccaatgcaatgaatgctgctgaaataaccgacaagcttggtctcaactctcttcgtcagcgtcactggtacatccagagcacctgcgcaacctctggggagggactgtacgagggattggattggctctctaacaatattgctaacaaggcttgagatgttgcggaacgtttttgttgggttgtcctggatgcagtgtggtcttatccaagtctcttgtacttttcttttcttttctaccttacctctgccaggcagtttgtgtttatgaattttcattttttcttcaaaggtctttttcagattttgtgatggctatgttaacattgttatgaatgatggatacacatatttgcaattctttttttaaaaaaatatttatagattttgaatataatgcttatgactggaagtttgattaatatggtgttgaaatccatatt

SEQ ID NO: 9940 - DNA, 571 bp, Scabiosa columbaria
gtcggaggccaggacaaaattcgtccattgtggaggcactacttccagaacacacaaggtttaatatttgtggttgatagtaatgacagagacagagttgttgaggcaagggatgaactgcataggatgttgaatgaggatgagctccgagatgctgtgctactggtatttgctaacaaacaagatcttccaaatgcaatgaatgctgctgaaattacagataaacttggtctccactctctcaggcagcgtcactggtacatccagagcacttgcgcaacctctggggagggtctttacgagggactggattggctctcaaacaacattgccaacaaggcatgagctgttgcattgtttgttgtgaagccatatcctggatgcaggcatatttttatctagtcgttttattacttctgctgcagcgtgtgcttatgaattcgattccgaaggtaaaaatacttttgatgttaggattgttttgaattggttttgcattagaatgaatgatttggatttatgtactctctaaagcatatgtttaggtatggatacaattttaaagctgtat

SEQ ID NO: 9941 - DNA, 354 bp, Picea glauca
tcatgttcgggatgtcggaggtcaggacaggatccgacccactatggagacattactttcagaatacccagggtcttatatttgtcgtggatagtaatgacagggaccgtgttgttgaagcaagagatgagttgcatagaatgctgaatgaggatgagctacgagatgctgttcttcttgtatttgcaaacaagcaggatcttcccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaagg

SEQ ID NO: 9942 - DNA, 606 bp, Camellia sinensis
ggagactgtggagtataagaacattagctttactgtttgggatgttggtggccaggacaagatccgacctttgtggagacattacttccaaaatacgcaaggacttatctttgtggttgatagtaacgaccgagatcgtgtggttgaagcgagggatgagctgcacagaatgttgaatggggatgaattgagggatgctgtgctgctggtatttgcaaacaagcaagatcttccaaatgcaatgaatgctgctgagataactgataagcttggccttcactccctccgccaacgccactggtacatccagagcacttgtgccacttctggcgaagggctgtatgaaggactggactggctttcaaacaacattgcaaataaggcatagacagccggatgctgagtttggattccaactagtgcccggatagagtttaacatttctttggtgtttggattttcaactttttaatttgatacctaccttgaaatctgggattgtttctgttgcagataatgccatttgtttcatgtagtttcaaaataattcataaatttttattcatcctcatctatatcttgtttaacaaaaaaaaaaaaaaaaaa

SEQ ID NO: 9943 - DNA, 443 bp, Eucalyptus grandis
tgaattgtaggtattgtaggatgagctgagagatgccgttttgcttgtgtttgcgaacaaacaagatcttcctaatgcaatgaatgcagctgaaataactgacaagcttggtcttcactctctccgtcaacgccattggtacatccagagcacctgtgcaacatctggagaaggactttacgagggtctggattggctttccaacaatattgccagcaaggcttgaaatctctgaggactttgacaggcttcacgacggggcaccagaattatgtttggtcttgaaaggatttagtctttgtttttgctgttgatatactgttgtaaaagctcaaatggtttgctagagctttatctgtgtaatgtgacatgggattgcataactgctgtttttggctaaatacttttaagcagtacaaatggctctttaagacctttctaaa

SEQ ID NO: 9944 - DNA, 636 bp, Chrysanthemum coronarium
ctgcatttccttgaagcgcataagcgttcgtttcttcccaaaatattatacaacaagactttgcatatgactacatgaatcaccatttccagaatacatttggtcttatctttgttgttgatagcaacgacagggacagagttgttgaggcaagagatgaactgcacaggatgttgaacgaggatgagctaagagatgcagttctccttgtatttgctaacaaacaagatcttccaaatgccatgaatgctgctgagatcactgataagctcggtctccactcccttcgacagcgccactggtacatccagagcacttgtgcaacctctggagagggactttatgagggattggactggctttccaacaacatagcaaacaaggcttaggggatgaatgatctttgtttttatgagggtggatccttttccagtttgtggttctgtgctgcctttggttttggaacttggttctttcaaagggtgttttgtttttaatatagaagttatggattgtgtcgaattgaatacattgtcgtttgttttgtttggattgcaagtatcttctgttagatcatcatgattcttttatctgaagttgtaagaggttaactattttgtggttttagaaatcgag

SEQ ID NO: 9945 - DNA, 603 bp, Flaveria ramosissima
gtggtgggagtggtgggggtcgaggacaagatccgtccactatggaggcactacttccaaaacacacagggtcttatctttgtggttgatagcaatgatagggatagagttgttgaagcaagagatgagctgcacaggatgttgaacgaggatgagctaagggatgcagttcttctggtatttgccaacaaacaagatctgcctaatgcaatgaatgccgctgaaattactgataagcttggccttcactctcttcgacagcgccattggtacatccagagcacctgtgccacctctggggaaggactttacgagggtttggactggctttccaacaacattgctaacaaggcatgaggtgttgattgaactgtatttgagggtggaaaaaccggaggcaggttttgctttttgtgcggtcgatcactttcttgtactagttctcgttcttctgtgacggaggtgcgagtggttatggaactttgttaaaaaaggcattttgcattttatatatagtccttgtatgataaaatctttggttggaactttgtcgtcgtactttaaaggtttatttcacataaccaagagattaattttgcttgt

SEQ ID NO: 9946 - DNA, 525 bp, Humulus lupulus
ctgtggagacactacttccagaatactcaaggactcatctttgtggttgacagcaatgatcgtgaccgtgttgtcgaggctagggatgagttgcatcgtatgttgaatgaggatgagttgagggatgctgtgctgcttgtatttgccaacaaacaggatctcccaaatgccatgaatgcagctgagatcacagacaaacttggtcttcactctcttcgccaacgtcactggtacatccagagcacatgtgccacatctggggaaggactctacgagggtctggattggctctccaacaatattgctaacaaggcttaaagagacctgatctctgttgaaggatttcacgcagcaattggtgtcatcatggcatgctgctccccttatatttggtgttgatggattcttttttatctttttttttttactgtcattaattaatgtatctgttcagattttgtttccacaaaatagaaattgccattttatcctgtagatgctaaataattcatggttcttagaata

SEQ ID NO: 9947 - DNA, 573 bp, Fagus grandifolia
tcaagctcggtgaaatcgtaaccaccatcccctaccatcggatttaatgtggagacagtggaataataaaaacatcagcttcaccgtttgggatgttggggtcaagacaagatccgtcactgtggaggcactacttccaaaacactcaggtctcatttttgtggttgatagcaatgatagggatcgaattgttgaggcaagggatgagttgcataggatgttgaatgaggatgaactcagggaggctgttttgcttgtatttgccaacaaacaagatcttcctaatgcaatgaatgctgcagagataactgacaagcttggcctgcattctctccgccaacgccactggtacatccagagcacatgtgcaacttctggagagggtctgtatggagggggttggattggctttccaacaacattgctagcaaggcataagcgattaaagaattttggttcctagcgatttgggagatgacgccttctcagtgactgttgtaatagcagaatgtttgtctagaccttatattattttggtttgtatggttgcttactttagcttaatacttttag

SEQ ID NO: 9948 - DNA, 681 bp, Pisum sativum
tgggatgtcggaggccaagacaagatccgtcccttgtggaggcactacttccagaacactcagggtcttatatttgttgtagacagcaatgacagggatagagttgttgaggccagagatgagttacatagaatgttgaatgaggatgaactgagagatgcagtattgcttgtctttgctaacaaacaagatcttccaaatgcaatgaatgctgctgaaattactgacaagttgggtcttcactctttgagacagcgccactggtacatccagagcacttgtgcaacctccggggagggtctttatgaaggtttggactggctttccaacaacatagccaataaggcttaatgcttatcgggagtattgtggattggtggttctggatgcgggggtgaatattatctagctttcctttttgagtcttgtggagcagtaattctggatgcagaggaaaatattatctagcttttatttcttgggtcatctttcgaaacaacttgaatttgtcttcattcatgtattgtggtttaggatattttggtgcctaaaatcgtagtagggatttgtttcatgggctttgtaatacttttgagcttttaattgggttttgatgcaatgtccataactgtaatggagatacaattaaatgtgactcatgttctaatttacagatttatt

SEQ ID NO: 9949 - DNA, 997 bp, Thalictrum flavum
ggggttagtgtactgactgcgtgtgttttgtggcctataattaaaattatagtatatgacatatcatctggacctacacttgttaatttaagcttttgatgactattcaatgtccttttggcatgcatttcttgagattttgttgggatactccacttcatggtctttgtagccttctatattatgtgatgtataatcttaaccgtcaaaaactacttttttttttgtcagggtttaatgtggagactgttgaatacaagaacatcagctttactgtttgggatgttgcggccaggacaagattcgtccattgtggaggcactatttccagaacacacaagggcttatctttgtggtggatagtaatgacagagatcgagttgttgaagcgagggatgaattacataggatgttgaatgaggatgagttacgagatgctgtgttactggtattcgctaacaaacaagatcttcctaatgcaatgaatgcagctgagattactgataggctgggcctccattctcttcgccaacgccactggtacatccagagcacttgtgcaacctctggggagggcctgtatgaggggttggactggctctccaacaacattgctaataaggcttgaggtagctgggtttgcatcatattggtggtatccggatgcaggggtggatgttatctaggtttttttacaagtcgactagttcatctcttcggtgaagagtagactaaagatttttttttctgtaagactaatggtattggtgctgtaataggagaatgtgttttgatatattcttaatggccctcgggtcaagaactggcttctcaagttaatccttttagttgtaactaaaattatttcagtatattagattatcatcttatcatcttataaaacatgttaatagacttgggtgacttgaggaggttcactctatatactggggatataaagtaggctcattacttcatttatcaagtttggttttat

SEQ ID NO: 9950 - DNA, 2019 bp, Cichorium intybus
attagatgtcattcttcgccatgacattgttgaacaagctagagctggtgacacagtgatctttacaggcactgtggttgttatacccgacatttttgcattagctgcacctggtgaaagagctgaagttcgtagagaaggtggcagtaaacgtgatacaactggcaccgttcaagaaggtgttaaagggcttcgtgcattaggtgttagagatctttcttatcgacttgcctttattgccaattcagtacagatttgtgatggaagaagagatgctgatataaggaatagaaagagggatgctgaagatgatgacaatttacagttcacggctgaagagttagatgaagttaaacaaatgagaaacacacccgactttttcaacaagcttgttgacagtattgcccctactgttttcggtcaccaagacatcaagagagcaattttacttatgcttttaggcggtgttcacaaattcacacatgaaggaatcaatcttcgtggggacattaatgtctgtattgttggtgatcctagttgtgcaaaatcccaatttctcaagtacacaacaaccttagtttcaagatctgtttacacatctggaaaatcttcatctgctgctggtttgactgccactgttgcaaaagaaccagaaactggagagttttgtattgaggctggtgcactaatgcttgctgacaacggtgtttgttgcattgatgaatttgacaaaatggatataagagatcaggttgcaatacacgaagcaatggaacaacaaacaatcagtatcacaaaagcaggaatacaagcaacattaaacgcaagaacatcaattttggctgcagcaaatcccacaggaggccgttacgacaagtcaaaacctttaaagtacaacgtcgcacttcctccagccattctttcaagatttgaccttgtgtatgtcatgattgatgaccctgatgacacaacagattaccatattgcctctcacattgtaagagtccatcaaaaacgcgaaaatgccgtttctcccgctttcacaaccgctcaattgaaacgctacattcaagtcgccaagtctaaaaagccaaagttaaatgtagaggctagaaagattttagtggattcttatgttgctcttcgaagaggcgatacagctccaggaagtagagttgcataccgtatgactgtcagacagttagaggcgcttattagactctcggaggccattgccaggtgtcacctcgatgatgaagttcacccacgacatgttcgtttagcaacaagactcctaaaaacttcagtaatcagtgtcgagtcaaccgagatagatttgaccgagtttcaagaagagaatcaagaagaaggcgatgttggtgcagataatgcagatgctgacacaaccaataatgagcatccagaaaatggagaagggcaagaagggaagaaacttgttataacagatgaatactttcaacgggtgactcaagcgcttgtgatgcgtcttagacaacacgaggagactgttatccgagaagggactggattagcgggaatgaggcaaagggatttgattcagtggtatgtgggccagcagaatgagaagaacaactacagctcaatggaagaagcaaaggctgaagtgaccaagattaaagctatcatagagagtttggtgagaagggaggggtatttgatagtagtggatgaagatgcacaaggagatgatggaaccgcagtacggtcttcacgaaacaaccggattcttgcggttgcacctaactatgttattgattaaattggtaatttggtgaatttggaatgttgagtgaaatgttaatttgtatacggttaaatgagagtagggtgttcttctgttgtgtattctacaattggttgttttggtaggaatgagactttggaattattttcttaatttagtgtttttggctacaaaagattatcaacacaacatatcatttacagcaatgtagtaacaacactttttcaaaagtg

SEQ ID NO: 9951 - DNA, 2207 bp, Cichorium intybus
aaatgtcgagcaacagtataaatacaccgagcccatgatttgcatcaatgctatgtgtgcaaagaaaggaagatggacacttcttcgacaagaaagtaaatttgcagattggcagagagttagaatgcaagaaacatcaaaggaaattcccgcaggatctcttcctagatcattagatgtcattcttcgccatgacattgttgaacaagctagagctggtgacacagtgatctttacaggcactgtggttgttatacccgacatttttgcattagctgcacctggtgaaagagctgaagttcgtagagaaggtggcagtaaacgtgatacaactggcaccgttcaagaaggtgttaaagggcttcgtgcattaggtgttagagatctttcttatcgacttgcctttattgccaattcagtacagatttgtgatggaagaagagatgctgatataaggaatagaaagagggatgctgaagatgatgacaatttacagttcacggctgaagagttagatgaagttaaacaaatgagaaacacacccgactttttcaacaagcttgttgacagtattgcccctactgttttcggtcaccaagacatcaaaagagcaattttactcatgcttttaggcggtgtacacaaattcacacatgaaggaatcaatcttcgtggggacattaatgtctgtattgttggtgatcctagttgtgcaaaatcccaatttctcaagtacacaacaaccttagtttcaagatccgtttacacatctggaaaatcttcatctgctgctggtttgactgccactgttgcaaaagaaccagaaactggagagttttgtattgaggctggtgcactaatgcttgctgacaacggtgtttgttgcattgatgaatttgacaaaatggatataagagatcaggttgcaatacacgaagcaatggaacaacaaacaattagtatcacaaaagcaggaatacaagcaacattaaacgcaagaacatcaatattggcagcagcaaatcccacaggaggccgttacgacaagtcaaaacctttaaagtacaacgtcgcccttcctccagccattctttcaagatttgaccttgtgtatgtcatgattgatgaccctgatgacacaacagattaccatattgcctctcacattgtaagagtccatcaaaaacgcgaaaatgcggtttctcccgctttcacaaccgcacaattgaagcggtatattcaagtcgccaagtctaaaaagccaaagctaaatgtagaggctagaaagattttagtggattcatatgttgctcttcgaagaggcgatacagctccaggaagtagagttgcataccgtatgactgtccgacagctggaggcgcttattagactctcggaggccatcgccaggtgtcacctggacgatgaagttcacccgcgacatgttcgtttagcaacaagactcttaaaaacttcagtaatcagcgtggagtcaaccgagattgatttgaccgagtttcaagaagaaaatcaagaagaagtcgatgttggtgcggataatggagatgctgacacaactaataatgagcatccagaaaatggagaagggcaagaagggaagaaacttgtgataacagatgaatactttcaacgggtgactcaagcgcttgtgatgcgtcttagacaacatgaggagactgttatgcgagaagggactggattagcgggaatgaggcaaagggatttgattcagtggtatgtgggccagcagaatgagaagaacaattacagctcaatggaagaagcaaaggctgaagtgaccaagattaaagctattatagagagtttggtgagaagggaggggtatttgatagtagtggatgaagaggcacaaggagatgatggaaccgcggtacggtcttcacgaaacaaccggattcttgcggtggcgcctaactatgttattgattaaattggtaatttggtgaatttggaatgttgagtgaaatattaatttgtatacggttaaatgagtaaggtgttcttctgttgtgtattctacaattggttgttttggtaggaatgagactttgaaaccattttcttaatttagtgtttttggctacaaaagattatcaacacaacatatcatttacagcaatgtagtaacaacactttttcaaaagtggtcgtacatcaataacaac

SEQ ID NO: 9952 - DNA, 2110 bp, Cichorium intybus
aaatgtcgagcaacagtataaatacaccgagcccatgatttgcatcaatgctatgtgtgcaaagaaaggaagatggacacttcttcgacaagaaagtaaatttgcagattggcagagagttagaatgcaagaaacatcaaaggaaattcccgcaggatctcttcctagatcattagatgtcattcttcgccatgacattgttgaacaagctagagctggtgacacagtgatctttacaggcactgtggttgttatacccgacatttttgcattagctgcacctggtgaaagagctgaagttcgtagagaaggtggcagtaaacgtgatacaactggcaccgttcaagaaggtgttaaagggcttcgtgcattaggtgttagagatctttcttatcgacttgcctttattgccaattcagtacagatttgtgatggaagaagagatgctgatataaggaatagaaagagggatgctgaagatgatgacaatttacagttcacggctgaagagttagatgaagttaaacaaatgagaaacacacccgactttttcaacaagcttgttgacagtattgcccctactgttttcggtcaccaagacatcaaaagagcaattttactcatgcttttaggcggtgtacacaaattcacacatgaaggaatcaatcttcgtggggacattaatgtctgtattgttggtgatcctagttgtgcaaaatcccaatttctcaagtacacaacaaccttagtttcaagatccgtttacacatctggaaaatcttcatctgctgctggtttgactgccactgttgcaaaagaaccagaaactggagagttttgtattgaggctggtgcactaatgcttgctgacaacggtgtttgttgcattgatgaatttgacaaaatggatataagagatcaggttgcaatacacgaagcaatggaacaacaaacaattagtatcacaaaagcaggaatacaagcaacattaaacgcaagaacatcaattttggctgcagcaaatcccacaggaggccgttacgacaagtcaaaacctttaaagtacaacgtcgcacttcctccagccattctttcaagatttgaccttgtgtatgtcatgattgatgaccctgatgacacaacagattaccatattgcctctcacattgtaagagtccatcaaaaacgcgaaaatgccgtttctcccgctttcacaaccgctcaattgaaacgctacattcaagtcgccaagtctaaaaagccaaagttaaatgtagaggctagaaagattttagtggattcttatgttgctcttcgtagaggcgatacagctccaggaagtagagttgcataccgtatgactgtcagacagttagaggcgcttattagactctcggaggccattgccaggtgtcacctagacgatgaagttcacccgcgacatgttcgtttagcaacaagactcctaaaaacttcagtaatcagtgtcgagtcaaccgagattgatttgaccgagtttcaagaagaaaatcaagaagaaggcgatgttggtgcggataatgcagcagatgctgacacaaccaataatgagcatccagaaaatggagaagggcaagaagggaagaaacttgttataacagatgaatactttcaacgggtgactcaagcgcttgtgatgcgtcttagacaacacgaggagactgttgtgcgagaagggactggattagcgggaatgagacaaagggatttgattcagtggtatgtgggccagcagaatgagaagaacaactacagctcaatggaagaagcaaaggctgaagtgaccaagattaaagctatcatagagagtttggtgagaagggaggggtatttgatagtagtggatgaagaggcacaaggagatgaggtacggtcttcacgaaacaaccggattcttgcggttgcacctaactatgttattgattaaattggtaatttggtgaatttggaatgttaatttgtatacggttaaatgagagtagggtgttcttctgttgtgtatcctacaattggttgttttggtaggaatgagacattttcttaatttagtgtttttgactacaagattatc

SEQ ID NO: 9953 - DNA, 1690 bp, Daucus carota
gaatcccggagggcaagaaggtgtcaaaggccttagagccttgggagtcagagatctctgttaccgacttgccttcattgcaaattcagtacagatatgcgatgacagaaaggactcggacatcagaaatagaaagagagatgctgaagatgatgacagtcaggagttcacgacagaagagctaaatgaggttcaacagatgaggaacacccctgatttcttcaataagctggttgatagcattgctcctactatatttggccatcaagatatcaagagagcaatattgcttatgcttctgggtggtgtccataaatttactcatgaaggaatcaacttgagaggagatatcaatgtttgtattgttggagatcctagctgtgccaagtctcagttccttaagtatactacaaccctagttgctagatctgtgtatacatctggcaaatcctcgtctgctgctggattgacggcaacagttgctaaagagccggaaactggagagttctgtatcgaggctggagcactgatgctagctgataatggggtttgttgcattgatgaatttgataagatggatgttcgagatcaggttgcaattcacgaagcaatggaacaacagacaataagcataacaaaagcaggcatacaagcaaccttaaacgcaagaacttccattttggctgcagccaatcccactggaggccgctatgacaagtctaaacccctgaagtacaatgtggctcttcctcctgctatcctgtcaaggtttgatcttgtgtatgtcatgatcgatgaccctgatgatcaaacagattaccacattgctcaccacattgttagagttcatcaaaagcgtgaagcggcaatttctccaacgttctcgactgcccaattgaagcgttacattgcctatgcaaagaccctaaaaccgaaacttagtgcagaagccagacaattgttggtggaatcctatgttactttacgcagaggtgatacagctcctgggagtagagttgcatatcgcatgacagttagacagctggaggcgttggtcagactttcagaagctatagctcgaagccatcttgaagttcaggtggctacgcgtcatgtgcgtcttgcagtgagactactgaaaacatcaataatcagtgtggagtcaagtgagatcgatctatctgagtttcaagatggagattttgaagttgaaggtgctgaccctgcagcagctgaagctggacaaagtggtgctgaacctgaatcaacttctaacaatgcagaaaatggtgatgatgctacaggacagcagaaaaagaaacttgttataactgatgaatattttcagcgggtcacccaagcccttgttatgcgtctgagacagcacgaggagactgttacacaagaagggtctggactagctggaatgaggcagagggatctgatacagtggtatgtgggccagcagaacgagaaaaacaactacagttccatggaggaagcagcagccgaagtttctaaaatcaaagcaattatagagagtttgatacggagagaaggccatttgatagttctggatgatggaacacaagcagcggaagagggtgaaaatgctaggcagccttcgtctagaaatgatagaattcttgctgtggcaccaaattatgttattgattgatcctgcagtgtt

SEQ ID NO: 9954 - DNA, 2252 bp, Petroselinum crispum
aaaaaagaatcctggagggcaagaaggtgtcaaaggccttagagcattaggagtcagagatctctgttaccgacttgctttcattgcaaattcagtacagatatgcgatgacagaaaggactccgacatcagaaataaaaagagagatgctgaagatgatgacagtcaggagttcacgacagaagagctaaatgaagtccaacagatgagaaacacccctgacttcttcaataaactggttgacagcattgcccctactatatttggccatcaagatattaagagagcaatattgcttatgcttctgggtggtgtccataagtttactcacgaaggaattaacttgagaggcgatattaatgtctgtattgttggagatcctagctgtgctaagtctcagttccttaagtatactacaagtttagttgctcgatctgtgtatacatctggaaaatcctcgtctgctgctggattgaccgcaacagttgctaaagagccagaaactggagagttctgtatcgaggctggagcactgatgctggctgataatggggtttgttgcattgatgaatttgataagatggatgttagagatcaggttgcaattcatgaagcaatggaacagcaaacgataagcattacaaaagcaggtatacaagcaaccttgaacgcacggacgtccattttggctgcagccaatcctactggagggcgctatgacaagtctaaaccactaaagtacaatgtagctcttcctccggctatcctgtcgaggtttgatctggtgtatgtcatgatcgatgaccctgatgatcaaacagattaccacattgctcaccacattgttagagttcatcaaaagcgtgaagcagcaatttctccaacgttctctactgcacaattgaaacgttacattgcttatgccaagaccctaaaaccaaaacttagtgcagaagccagacagttgttggtggaatcatatgttattttacgcagaggtgatacagctcctgggagtagagttgcatatcgtatgactgttagacagctggaggcattggtcagactctcagaagcaatagctcgaagccatctggaagttcaggtggctactcgtcatgtgcgtcttgcagtgagactactaaaaacatcaataatcagtgtggagtcgagtgaaattgatctatctgagtttcaagatggagattttgaagttgaaggtgctgaccctgcagaagctgaagctcctgaaagtggcgctgaccctgaatcaacttctaacaatgcagcgcatggcgaggatgctacaggacagcagagaaagaaacttgtgataactgatgaatatttccagagggtcacccaagcccttgtcatgcgtcttagacagcatgaggagactgtaacgcaagaagggtctggactagctggaatgaggcagagggatctaatacagtggtatgtaggtcagcagaacgagaaaaacaactacagttccatggaagaagcagcagccgaagtttctaaaatcaaagctatcatagagagtttggtacggagggagggccatttgatagtcctggatgatggtagacaagcagcagaagagggtgataatgctaggcagacttcatctaggaatgacagaattcttgcagtagcacctaattatgtcatagattgattttaaatgcttcttccaacactggaatactttatccgtggaacatgcctaaccttgtgctttcacgaatgatggtaaccaatctactggctgaggctctgtactaggacattagaaatactgtagggcaggctgttattgctgcaactgtaaggtctgccaacacctcacctttctcgacacctatttcagagtggaagtaacgatgttcaatttcagagccgaacataccatgttaacttctgagtggacactatgtttaatttgatttaattgattgacacaacttttattgttgttatcgaagagatctggagaatggttgaaaagagacactgttttaagttgaaggcttggagcttatttgcaataacttaagctggttcaccttgaatcttcgatattgccccttcacaactcgagtcccgaatgctggggctcaactttgttatttcagttacggagcatccatcctgaactccgaactaaacaaactttactctatattaaaaaaggaaatccacattaattaggacatccaaaaggatattactttcttccaacacac

SEQ ID NO: 9955 - DNA, 2117 bp, Arnica chamissonis
aatcaatgctacttttctttctaatctttttgtaataaactggttgttgaaaggacaggtttcgataatttggatgatatgaatgatgtgcattttacggagaattaaatttcaccgaaaaacttgtaaaagtttcttcttttttggtagacaagtctgccgttaaattctggttggatcgggcttaattgtgtccccttacgtaattcggatcgttgattacttttgctacgtgttattcattcaccggttcggcgacaattctcggtttacttcgtgaatcgagatccttcttttagataattagggttttgagttgtggatgtatgatacggaaatgtgtagggtagatgatggagataagaagaggaggaggtttgcaattggaacaatgggattgaagaaattagggttgaaaagttgaaaaattccatggcgaatgcaaggtctcctaaaatgaagatgctgttaattagggtaacgacgacggtgttattgtggacttgcttggttcagttgacagcattaggaggtacatggggacctagggttttgaaaggttggccttcttgctttactcaagattctcattctgcaactgcgttagatattaaattgttgcctactgttcctgccagagttctcccttccaagagggtttacaagaacaatggttacttagttgtgtcttgtaatggagggctcaatcaaatgcgatcggctatttgtgatatggtcgcgattgctagatatttaaatgttactcttatagttcctgagctggataaaacttccttctgggctgatccaagtgactttgaggacattttcgatgttgatcatttcattacatctttgagagatgaagtccggatacttaaacaacttcctcctaggcttaaaacgagagttgaattaggaatcgtgcataccatgcctccggttagctggtctgatatttcttactatcataaccagattcttcctttgattcaaaaatacaaagttgtgcatttgaacagaaccgatgctcggcttgccaataatggtcaacccattgaacttcaaaaacttagatgccgagtaaatttcagtgctctgagattcactaatcaaatagaagaattgggtaggcgtgttgttaaacttttgagacaaaatgggccttttttagtgcttcatctcagatatgaaatggatatgttagcattctctggctgtacacaaggatgcaatgctgaagaggttgaagagttgaccagaatgagatatgcttacccatggtggaaggaaaagattataaattctgatttgaacgaaaagacggtttatgccctttgacccctgaagaaactgctcttacacttaaagcacttgatattgaccgtgacatccagatttacattgctgctggtgaaatatatggtggaaaaaggagaatggacagccttgcagatgcctacccaaatctggtgagaaaggagactctgttagggccagctgaccttcaatattttcaaaatcactcgtcacagatggcagcgttggattatcttgtgtcactagagagtgatatatttgttcctacttatgatggaaacatggccagagttgtagaaggccaccgcagatttttgggttttaagaagacaattctactggacaggagggttttggttgaattaatagacaaatacacaagcgggtttttgagttgggatgaattctcacgcgctgttaaggatacacacgcccaacgcatgggagcccctacaaaaagattggttatcgccgatagacctaaagaagaagactacttctatgcaaatccagaagagtgcttgcaggcatcagacgatgaacctgtgagcatcctatgattaaggatttgtcggttagtttggcctgttgggatctacgaaaccccaagattatgattcttggcccttgaatcagttggtgtaggatgaatatttggtgaatgtgaggatgctattgctaacacgtatggtgggaccgatggtgcacgaagacaagaatgtttccacgatcaataatatggcgtttattattgaaatttttatgttatttgatatgtatggttattgtcaataatt

SEQ ID NO: 9956 - DNA, 2306 bp, Flaveria ramosissima
tgagatcgtcacaaacacccgtcgcaaaagcccttttcttccaccactcaccgaccaccgacagtttatctccggcgacattatcataatatcacctcattccacaagaactccggtcggtggtaaccaaaattcaacttattatttcaattattcatcgtcggtagattaaaataacttcacaacacatttaatgcacttttagagcaattttacactgtcggtagctgaaacgcccgtgattattgtgaaatttggataatacggatgataccgatgatgttgcatttcactgagagttaattactccgaaaatctcgtttaaagtgttgaattccggttggatcgggcgtaattgtgtcccgatctttgattacttcaatcacgtgttgtttcgcgacaattctgcgggttttttcgtgaatcgagatcagttagagaattagggtttttgagaattagagaaatgtgtagggtggatgatcgaggtaagaagaggaggaggtttgcgattgggacaatggggttggagaaattgggggaaattagggttgagaagttgaagaattctgtggcgaatgtaaggtctcctaagatgatgatggtgttgattagggctacgacgatggtgttgttgtggacttgctttgttcagttgacagcatttgggggagattggggacctagggttttgaaagggtggccttcttgttttactcaagattctcatgctgcagctgtgttagatgataagttgttgcctagtgttcctgcaagagttcttccacccaagagggtttacaagaacaatggttacttggtggtttcatgtaatggaggactcaatcaaatgcgttcggctatttgtgatatggtcgcgattgctagatatttaaacgttactcttatagttcctgagctggataagacttccttctgggctgatccaagtgatttcgaggacatttttgatgttgatcatttcattacatccttgagagatgaagtccggatacttaaacaacttcctcctaggcttaaaaggagagttgaattaggaattgtgcataccatgcctcccgttagctggtctgatatttcttattatcataaccagattcttcctctgattcaaaaatacaaagttgtgcatttgaacagaactgatgctcggcttgccaataatggtcaaccccttgaacttcaaaacttaggtgtcgagtaaatttcaatgctctgagattcactcatcaaatagaagaattgggtaggcgtgttgttcaacttttaagacaaaacgggacttttctagtgcttcatctcagatatgaaatggatatgttagcattttctggctgtacacaaggatgcaatgctgaagaggtagaagagttgaccagaatgagatatgcttacccatggtggaaggaaaagataataaattctgatttgaaacggaaagacggtttatgccctttgacccctgaagaaactgcccttacacttaaggcacttgatattgaccgtgacatccagatctatattgccgctggtgaaatatatggtggaaaaaggagaatggatagtcttgctgaggcatacccgaagctggttagaaaggagaccttgttaggggcagatgaccttcagtatttccaaaaccactcatcacaaatggcagcattggattatctcgtgtcactagagagtgatatttttgtacctacttatgatggaaacatggccaaagttgtagaaggccatcgcaggttcttgggtttcaagaagacaatactgttggacagaagggtgttgactgagttaatagacaaatatacaagtgggtcgttgagttgggatgaattctcaagtgcggttaaggatacacatgcacagcgcattggggaacccttacaaaacgaacagttattccggataaacccaaagaagaagattacttctatgcaaatccagaagaatgcttgcagccatcagctgatgatgaacctgtgaacatcctatgattaaggatttgtcggttaatttggcctgttgggcttgataaagtgtctgaattacacgattagaatttttggtcctcgactctgttggtgtacaatgagtatttgttcaaaatacaaggatgccagacattttggtgagacgtatggtacgcgatgcacgcagacaacaaagcttccacgatgagattatggtgtcgattagtagttgtcttctttcttattgttttatgttatagtaaaacccccttacaactcgcggttagtgaaactagtgatatgtac

SEQ ID NO: 9957 - DNA, 2294 bp, Ambrosia trifida
aaccacattctctccctctaccaataaccggccaccgacagtttctcctccgttacaatctccggccaccaccggttcaaccgcttccctcttaattttataaaccccgtattaatattcaatacccaatgaatttaatacacttatgaaatcaagactcctgttcggttcctaaaagcctagagcttttctgtaactggattatacccacatcactgcctacattaattccacccaaaaacctctgaaagttgtttcttgttggatcagatctggtattattattattattaatttcggtaattgccttattgttcatgtatggtggagaaatgtgtaaggtagaggagagagataataataataataataacaataagaagaagaaaaggtttgtgattgggaagattagggttgagaagttgaagagttattctatggtgaatgaaggtcatgtaagatgaagatgtggttggttagggctacaaccatggtgttgttgttgacttgtttggttcagttaactgctttaagtggtggctcatggggtcctagggttttgaagggttggccttcttgttttactcaagattctcatactgctgctgctttggatattaagttgttgcctagtgctcctgttaggattcttccacacaaaagggtttacaagaataatggttatttggttgtttcgtgtaatggaggacttaatcaaatgcgttctgcgatttgtgatatggtcgcgattgctagatatttaaatgttacgcttatagtacctgagctggataaaacttccttctgggctgatccaagtgagtttgaggacatttttgatgttgatcatttcattacgtccttgagagatgaagtccggatacttaaacagcttcctcctaggcttaaaaagagagtcgaattagggattgtgcataccatgcctcctgttagttggtcggatatttcttactatcataatcagattcttccgctgattcaaaagtacaaagttgtgcacttgaacagaaccgatgctcggcttgctaataatggtcaaccccttgaacttcaaaagcttaggtgccgagtaaattttgatgctctgagatttactactcaaatagaagaattgggtagacgtgtagtgaagcttctgagacgaaacgggccttttctagtgcttcatctcagatatgaaatggatatgttagcattttccggctgtacgcaaggatgcaacgatgaagagattgaagagttgacaagaatgagatatgcttacccctggtggaaggaaaagattataaattctgatttgaaacgaaaagacggtttatgccctttgacccctgaagaaactgctcttacacttaaagcacttgatattgaccgcgacatccagatatacattgctgctggtgaaatatatggtgggaaaaggcgaatggatagccttgcagatgcttacccaagactggtaagaaaggagactctgctagggccagctgaccttcaatattttcaaaatcactcgtcacaaatggcagcattggattatctcgtgtcactagagagcgacatttttgttcctacttatgatggaaacatggccaaagttgtagaaggccaccgaagatttttgggtttcaagaagacgattctattggacaggaaggttttggttgatttaatagacagatatacgagcggagctttgagctgggatgagttctctggtgcggttaaggagacacacgcacagcgtatgggggcccctacaaaaagattggttatgcccgatagacccaaagaagaagattatttctatgcaaatccagaagagtgcttgcagccatcagatgatgaacctgtgagcattctatgagtaaggatttgtcggttaggctggcccgttggggtttatgaagtgtctgcaccacaggattatgattcttggccctcgaatcagtcggtgtactatgctaacacattttgatgggaccgatggtgagagatatgcatgaagacaagaatgttttcgccaacagtattatggcgtttattattgcagtcttgtttatttaatttcgtatgtatggttattgtcaataattctaattcatgtatagaaaaccgccctgacatttcaggttattcaaaactggcgatatgtacacatagagagcgtcgaaaccataggtgtggtccatttttcatttctaagcaaacgtattattgttattattactactattatttttgtcaaacattacatctgagtgtttgcagtc

SEQ ID NO: 9958 - DNA, 1601 bp, Ambrosia trifida
tgaagatgtggttggtaggctacaaccatggtgttgttggggacttgtttggttcagttaacggctttaggtggtgggtcatggggtcctagggtttttgaaaggttggccttcttgttttactcaagattctcatgctgcttctgctgctttggatattaagttgttgtctagtgttcctgttagggttcttccacataagagggtttacaagaataatggttatttggttgtttcgtgtaatggaggacttaatcaaatgcgttctgcgatttgtgatatggttgcgattgctagatatttaaatgttactcttatagtacctgagctggataaaacttccttctgggctgatccaagcgagtttgaggacatttttgatgtcgatcatttcattacgtccttgagggatgaagtccggatacttaaacagcttcctcctaggcttaaaaagagagtcgaattagggattgtgcatacgatgcctcctgttagttggtcggatatttcttactatcataatcagattcttcctttgattcaaaagtacaaagttgtgcacttgaacagaaccgatgctcggcttgcaaataatggtcaaccccttgaacttcaaaaacttaggtgccgagtgaattttaatgctctgagatttaccactcaaatagaagaattgggcagacgtgtagtgaagcttctcagacaaaacgggccttttctagtacttcatctcagatatgaaatggatatgttagcgttttctggctgtacacaaggatgcaacgatgaagagattgaagagttgacaagaatgagatatgcttacccctggtggaaggaaaagattataaattctgatttgaaacgaaaagacggtttatgccctttgacccctgaagaaactgctcttacacttgaagcacttgatattgatcgcgacatccagatttacattgctgctggtgaaatatacggtgggcaaaggagaatggatagtcttgcagatgcctacccaagactggtaagaaaggagactctgttagggccagctgaccttcaatactttcaaaatcattcgtcacaaatggcagcattggattatcttgtgtcactagagagtgacatttttgttcctacttatgatggaaacatggccaaagttgtagaaggccaccgaagattttgggtttcaagaagacgattctattggacagaaagattttggttgatttaatagacagatatacgagcggagctttgagctgggatgaattctccgatgcggttaaggagacacacgcgcaacgtatgggggcccctaccaaaagattggttatgctcgatagacctaaagaagaagattacttctattcaaatccagaaagagtgcttgcagccatcagatgatgaacctgtgagcatcctatgagtaggatttgtcggttaggctgttgcccattggggtttatgaagtgtctgcaccacaggattatgattcttggccctcgaatcagtcggtgtactatgctaacacattttggtgggaccgatggtgagagatgcatgaagacaaggacgtttccatgaacagtattatggcg

SEQ ID NO: 9959 - DNA, 2169 bp, Centaurea maculosa
ccggcaaccttctcatctctcgccggaataatcgccaccacttctttcaacattctcagttgtccctatttagatttaatgcctttctttctgatttccgccattaataggttttgctgaaatttgtgttctttattaactaatgcattttcatcacaatcaattgtagctgcatcgagcttaattgtgtatacataattccgatcttgattgcttttctcgcaaattttataatttgccgacaatttaggggtgaattcagccagatctttactcttcttgttttagatttagatagttagggttttggaagtttgtggatgtatgagagagatatgtgtagggtagaggatagagataagaacaagaagaggaggtttgcaattggagcaatgggattgaagacattgggggaaagtaaggttgctaagctcaagagttctatggctaatgctaggtctcctaagatgaaggtttggttaattagggcaactactactgttttgctatggacttgtttggttcagctgacagcattagggggtacttggggacctagggttttgaaaggttggccttcttgcttcactcaagattctcattctgctactgctttagatgtaaagttgttgcctgctgttcctgccagagttcttccacccaagagggtttacaagaacaatggttacttagtggtttcgtgtaatggaggactcaatcaaatgcgttccgctatttgtgatatggttgctattgctagatatttaaacgttactcttatagttcctgagctggataaaacctctttctggtctgatccaagtgagtttgaggacatttttgatgtcgatcatttcattacctccttgagagatgaggtccgtgtgctaaaagagcttcctcctagacttaaaaagagagtggaattaggaatcgtgcataccatgcctcccgttagctggtctgatatttcttactatcaaaaccagattcttcctctgattcaaaaatataaagttgtgcatttaaacagaactgatgcacggcttgccaataacggtcagccccttgaacttcagaagctcaggtgccgagtaaattttggtgcgcttagattcacgactcagatagaagagttgggccgacgggttgttaaacttttaagacaaaatgggccttttctagtgcttcatttaagatatgaaatggatatgttggcattttccggatgtactcaaggatgcaatgccgaagaggtggaagagttgacaagaatgagatatgcgtacccgtggtggaaggaaaagataataaattccgatttgaaaaggaaggatggtttatgccctttgactcccgaagaaaccgctcttacgctaagggcactggatattgatcacgatatccagatttacattgctgctggtgaaatatacggtggaaaacggagaatggatagtcttgcagaggcctatccgaaactggtacgaaaagagacactattaggtcctgctgaccttcagtatttccagaatcactcgtcacaaatggcagcattggactatcttgtgtcactggaaagcgatatttttgtacctacttatgacggaaacatggccaaagtcgtagaaggacatcgcagattcttgggtttcaagaagacaatactgttggataggaggcttctggttgatttaatcgacaaatataatagcgggtttttgagctgggatgaattctcaaagggtgttaaggaagcacacgcagaacggatggggaacccgacaaaaagattggtgatttctgatagaccaaaagaagaagactacttttatgctaatccagaagagtgtttgcaagcatcagaagatgaacctatgagcatcctatgatgacgagaggctttttgtggatgaatttgaagattatgattccgtggcctcgaatcggtcggtgtatgaggacgatatgtccaaaatatgaggctgcaacgggaaagactaaatgcgttttggtgggagatagacacaggcggacgagaatctttccacgaatagaaatgggcggtcgattattattaatgtctttgttttgatttcttcatatgtacggttattgtcaataataactcgcattcttgtatagaaaccgccctggcatttcagggtt

SEQ ID NO: 9960 - DNA, 1608 bp, Flaveria ramosissima
tactcaagatcctcattctgctaatgctttggatattaagttgttgcctagtgttcctgctagagttcttcctcccaagagggtttacaagaacaatggttacttggtggtttcgtgtaacggagggctcaatcaaatgcggtctgctatttgtgatatggttgcaattgctagatatttgaatgttactcttatagttcctgagctggataaaacttccttctgggctgatccgagtgagtttgaggacatttttgatgtcgatcatttcattacgtccttgagagatgaagtccggatacttaaacagcttcctcccaggcttaaaagagagttgaattaggaattgtgcataccatgcctcctgttagttggtctgatatttcttactatcataatcagattcttcctctgattcaaaaatacaaagttgtgcacttgaacagaactgatgctcggcttgccaataatggtcaacccattgaacttcaaaagcttaggtgccgagtaaacttcagtgctctgagatttactactcagatagaagaattgggtagacgtgttgttaatcttttgagacaaaacggcccttttctagtgcttcatctcagatacgagatggacatgttagcattttctggctgtacacaaggatgcaatgatgaagaggttgaagagttgaccagaatgagatatgcttacccatggtggaaggaaaagattataaattctgatttgaaacgaaaagacgggttatgccctttgacccctgaagaaaccgctcttacacttaaagcacttgatattgaccgcgacatccagatttacattgctgctggtgaaatatatggtggaaaaagaagaatggatagtcttgcagatgcctacccaaaactggtaagaaaggagactctgttagggccagctgaccttcaatattttcaaaatcactcgtcacaaatggcagcattggattatcttgtgtcacttgagagcgatatttttgttcctacttatgatggaaacatggccaaagttgtagaaggccaccgcagatttttgggttttaagaagacaattctattggacaggagggttttggttgaattaatagacaaatatacaagcggggttttgagttggaatgaattctcgagtgctgttaaggatacacatgcacaacgcatgggggcccctacgaaaagattgttcattgcggatagacccaaagaagaagattatttctatgcaaatccagaagagtgcttgcagccatcagatgatgaacctgtaagcatcctatgaccaaagatttgtcggttagtttggcccgttgggatctatgaactgtctgaaccacaagattatgattctcggcccctgaatcagtcgaatcagttggtgtgtgaatgaatatttgttcattatgagggtgcaacacattttggtgggaccaagtggcgagagatgcacgaagacaagaatgtttccacgaatagtaatatggtcgtttattattgattgtctttgtttttattatttctatatgtgtggttttattgtcattattctctattcatgttatagtaaaactattcctgtacttag

SEQ ID NO: 9961 - DNA, 2275 bp, Centaurea maculosa
caaccttctcatctctcgccggaataatcgccaccacttctttcaacaattctcagttgtccctatttagatttaatgcctttctttctgatttccgccattaataggttttgctgaaatttgtgttctttattaactaatgcattttcatcaccattaattgtagctggatcgagcttaattgtgtatacataattccgatcttgattgcttttctcaccaattttataatttgccgacaatttaggggtgaattcagccagatctttactcttcttgttttagattagatagttagggttttggaagtttgtggatgtatgagagagatatgtgtagggtagaggatagagataataagaagaagaggaggtttgcaattggagcaatgggattgaagacattgggggaaagtaaggttgctaagctcaagagttccatggctaatgctaggtctcctaagatgaaggtttggttaattagggcaactactactgttttgctatggacttgtttggttcagctgacagcattagggggtacttggggacctagggttttgaaaggttggccttcttgcttcactcaagattctcattctgctactgctttagatgtaaagttgttgcctgctgttcctgccagagttcttccacccaagagggtttacaagaacaatggttacttagtggtttcatgtaatggaggactcaatcaaatgcgttctgctatttgtgatatggttgcaattgctagatatttaaacgttactcttatagttccggagctggataaaacttctttctggtctgatccaagtgagtttgaggacatttttgatgtcgatcatttcattacgtccttgagagatgaggtccgtgtgctaaaagagcttcctcctaggcttaaaaagagagtggaatcaggaatcgtgcataccatgcctcccgttagctggtctgatatttcttactatcaaaaccagattcttcctctgattcaaaagtataaagttgtgcatttgaatagaactgatgcacggcttgccaataacggtcagccccttgaacttcagaagctcaggtgcagagtaaattttggtgcgcttagattcacgactcagatagaagagttgggcaaacgggttgttaaacttttaagacaaaatgggccttttctagtccttcatttaagatatgaaatggatatgttagcattttccggatgtactcaaggatgcaatgccgaagaggtggaagagctgacaagaatgagatatgcgtacccgtggtggaaggaaaagataataaattctgatttgaaaaggaaagatggtttatgccctttgactcccgaagaaaccgctcttacgctaagggcactggatattgatcacgatatccagatttacattgctgctggtgaaatatacggtggaaaacggagaatggatagtcttgcagaggcctatccgaaactggtacgaaaagagactctattaggtcccgctgacctccagtatttccagaaccactcgtcacaaatggcagcattggactatcttgtgtcactggaaagcgacatctttgtacctacttatgacggaaacatggccaaagttgtagaaggacatcgcagattcttgggtttcaagaagacaatactgttggacaggaggcttctggttgatttaatcgacaaatataatagcgggtttttgagttgggatgaattctcgaagggtgttaaggaagcacacgcagaacggatggggaacccgacaaaaagattggtgatttctgatagacccaaagaagaagactacttttatgctaatccagaagagtgtttgcaaacatcagaagatgaacctatgagcatcctatgatgatgagaggctttttgtggatgaatttgaagattatgattccgtggcctcgaatcggtcggtgtacgaggacgatatgtccaaaatacgaggctgcagcgtgaaagactaaatgcgttttggtgggagatagacgcaggcggacgagaatctttccacgaatagaaatggcggtcgattattattaatgtctttgttttgatttcttcatatgtatggttattgtcaataataactcgcattcttgtatagaaaccgccctggcatttcagggttattcaaaactactgatataggagtcggaacaaagtacgtttttgctatttttttctctcttaaaggttggtttattataataataatgatgatataaggtaatgattgttt

SEQ ID NO: 9962 - DNA, 2266 bp, Cirsium arvense
agagagtgtgtgtacataagttcccatagatccttgtgcccacccacacaaactccccctttttaactcatctttctttccatctcgccggccaccgacacttttctttccacattccggcgaccttcttatcttttgccgcaaaattcgccacttctttcaacaattatcagttgtcactagatttcaaaatctagatgaagatttaatgcttttctaatttctgccattaatggcttgctgaaatccaaggggttatgtttctcttctgttatgttctgtgtaatttggaatgacggtgcattttcatctcaattaatttcaccgaaaaacttgctttcttttctgctgtaggcaagtctgccattaaaattctagttggatcgggcttaattgtgttatgttccctatacataattcggatcttgattactttctcatacactagtcataattcattaatcggttcaccgacaatttagcggttctcttcagatccttccttgccgtttcttgtttagggtttgagttgtggatgtatgaaacagatatgtgtagggtagacgatagagataagaagaagaagaggaggtttgcaattggagcaatggggttgaagacattaggagaaactagggttgcaaagttaaagagttctatggcgaatgcaaggtctcctaaaatgaaggtttggttgattagggcaactagtacggttttgttgtggacttgtttggttcagctgacagcattagggggtacatggggacctagggttttgaaaggttggccttcttgtttcactcaagattctcattctgctactgctttagatataaagttgttgcccactgttcctgccagagttcttccacccaagagggtttacaagaacaatggttacttggtggtttcatgtaatggaggactcaatcaaatgcgttctgctatttgtgatatggttgcaattgctagatatttaaacgttactcttatagttcccgagctggataaaacttctttctggtctgatccaagtgagtttgaggacatttttgatgttgatcatttcattacatccttgagagatgaggttcgtgtcctaaaacagcttcctcctaggcttaaaaagagagtggaattaggaattgtgcataccatgcctcctgttagctggtctgatatttcttactatcataaccagatacttcctctgattcaaaaatataaagttgtgcatttaaatagaactgatgcacgccttgccaataacggtcagccccttgaacttcagaagctcagatgccgagtaaattttggtgctctcagatttacgactcagatagaagagttgggcagacgggttgttcaacttttgagacaaaatgggccttttcttgtgcttcatttaagatatgaaatggacatgttagcattttctggatgtacgcaaggatgtaataccgaagaggtggaagaattgacaagaatgagatatgcgtatccatggtggaaggaaaagataataaattccgatttgaaaaggaaggatggtttatgccctttgacccccgaagaaactgctcttaccctaagggctttggatattgatcatgatatccagatttacattgctgctggtgaaatatacggtggaaaaaggagaatggatagtcttgcagatgcctatccgaaactggtaagaaaggagactctattaggtccagctgaccttcagtatttccagaatcactcgtcacaaatggcagcattggactatcttgtgtcactggagagcgatatttttgtacctacttatgatggaaacatggccaaagttgtagaaggacatcgcagattcttgggtttcaagaagacaatattgttggataggaagcttctggttgaattaatcgataaatataatagcgggtttttgagttgggatgaattctcgaatggtgtgaaggaagcacacgcagaacggatgggaaacccgacaaaaagagtggtgattttagatagaccgaaagaagaagactacttttatgccaatccagaagagtgtttgcaggcatcagcagaagatgaacctgtgagcatcctatgataaatttgaggcttttgtggatgaatttggcccgaatttgaagattatgatccaatggctcaaattggtcgggtgtacaaggacaatatggtccaaaatacaaagctgcaacgaaatagactaatacatgcaagcagatgagatgtttccacgaat

SEQ ID NO: 9963 - DNA, 2002 bp, Flaveria ramosissima
cacttcaaatctgctgctttttcagtagctgttgatattgtagtgcagattgaaccttcatagatgcaattacgagatctattatgcttctggagcatgtgattgaaaatcttgagtgtaatcgcatgattcttgaggaattgaatggtggtacatttgttgtggagtttgattaatatcaagagtgtgaatgttgcttctgttttggaaacttagagtgcaattaatcggctttcttgtttagggattcgtggggtttgtgggatttgggtattttgtgcatctcgataacgttattgattacgtgtttattcgtttagtgttggtgaattttgccacaattggtttgtgatcactgttaatgggtagttagggttttgattggatgatggggttgaaggtgttgggggaaagtagagtggagaagttgaagagatcgatggggtattcgtatgcaaggagttcaaagatgaagctgtggattgttagggggatgacagtggtgttgttgtggacttgcttggttcagttgatggcattaggggatacatggggacctatggtgttgaaaggatggccttctcatgattctgttgctgctgctgctgctttagatgtcaaattgttgcctgttgttcctgctagagttcttccacccaagagggtatacaagaacaatggttacctactgatatcatgtaatggagggctaaatcagatgcgatcagctatatgtgatatggttgcaattgcaagatacttgaatgttacactcatagttcccgaactggataaaacttctttctgggctgatccaagtgaatttgaggacatttttgacgtcgaccatttcattacatccttgagagatgaagtccggatacttaaacagcttcctattaggcttaaaaagaaagtggaattaggaatcctgcataccatgcctcctgttagttggtctgatatttcatattaccacaaccaaattcttcctttgattcaaagatacaaagttttgcatttgaatagaactgatgctcggctggccaatagtggtcaacccattgacctccagaagctgaggtgtcgagtgaatttcagtgctctaagattcactagtcaaattgaagaattgggtagacgggttgttaacctttaaggaaaaatggacctttcttagtgcttcaccttcgatatgaaatggacatgttagcattttctggctgtacccaaggatgcgacgatgatgaggtggaagaattgacccgaatgaggtatgcttacccatggtggaaagaaaagatcataaattctgatttaaaaagaaaagatggtttatgccctttaactcctgaagagactgcccttgcattaagggcacttgatatagatcctaacatccagatttacattgctgctggtgaaatatatggtggagaaaggagaatggctagtcttgcatctgcgtatccaaagctggtaagaaaagagactctattgggaccagacgaccttaaatttttccagaatcactcgtcacaaatggcagcattagattatcttgtgtcactggaaagtgatatttttgtccctacttatgatggtaacatggccaaagttgtcgaaggccaccgcagatatttgggtttcaagaagacgatattattggacagaaagctacttgttgaattaatcgacaaatacacgagtaactcactgagttgggatgaattctcgagtgctgtcaaggaagtgcacaaaaaaccgcatgggtaacccgacaaaaagattaattattccagacagacccaaagaagaagattacttttatgcaaatccagaagaatgcctgcagtcttcagacaatgaacctgtgaatatcatccaatgaaaagccttcatttttggcgatttgatccaacaattttcataaatttgtacaagtcctagaacgcggttaaggtatcgaggagcacctttcacacgaccggaactattaatc

SEQ ID NO: 9964 - DNA, 2136 bp, Helianthus annuus
aaaacttccaatctgctgctatctttactccaatttcaaacttcataaattcaatttcgagatccaacatataattcaaaatctagggtttatcgcacagtactggaggatacatacagatcatggtacattcattccatttattccggaatttaatcaactcaaaaaacagttgtaaatgttagatattattgtgttagaaacttactctgcaattaatcagtcatccagttaattaatttgtgcatctcgataacattattatcgtgaatctgttcaatttgttcagttattagttgtcaattgactcaatttagtgagaattgtgttaattgtgttgtgattgaggtgtgatggatagttagggtttggatttgggggatcatggggttgaaagtgttgaaggagggtaaggtggagaggttgaagcggtcggtcgggtattcgaatgctaggggtaataaaatgaagctgtggatggttagggctactactgtggtgttgttgtggacttgtttggttcagttgatggcattgggggagtcttggggacctagggttttgaaagggtggccttcgcatgattcggttatttcgggtgctgctttggatgttaagttgttgccggttgttccggttagagagcttccacccaagagggtttacaagaacaatggttacctactgatttcatgtaacggaggacttaatcaaatgcgatctgctatatgtgatatggttgcaattgcaagatacttgaatgttacactcatagttcctgagctggataaaacgtctttctgggcggatccaagtgaatttgaggatatttttgacgttgatcatttcattacgtccttgagagatgaagtgcggatacttaaacagcttcctatcaggcttaaacagaaagtcgaatcgggaattctgcatacaatgcctcccgttagttggtctgatatttcatattaccacaaccaaattcttcctttgattcaaagatacaaagtgttgcatttgaatagaacggatgctcggctggccaatagtggtcaaccggttgacctccagaagctgaggtgtcgagtaaatttcagtgctctaagattcactagtcaaattgaagaattgggtagacgggtcgttaaccttttaagaaaaaatggaccttttttagtgcttcaccttcgatacgaaatggacatgttagcattttctggttgtactcaaggatgcaacgatgaggaggtggaagagttgacccggatgaggtatgcttatccatggtggaaagaaaagatcataaattccgatttaaaacgaaaagatggtttatgccctttaactcccgaagagactgcgcttgcgttaagggcacttgacatagatccgggcatccagatttacattgcggctggtgagatatacggtggggaaaggagaatggctacgcttgcatcggcatatccgaagctggtaaggaaagagactctattgggaccagacgaccttaaatttttccagaatcactcgtcacagatggcagcattggattaccttgtgtcactggaaagtgatatttttgtccctacttatgatggaaacatggccaaagtcgtagaaggccaccgcagatatttgggtttcaagaagacgattctattggatagaaaactacttgttgaactaatagacaaatacacgaccaactcgatgagttgggatgaattctcgagcgctgtcaaggaagcccatgcaaaccgaatggggaacccgataaaaagattaattattccagacagacccaaagaagaagattacttttatgcaaatccagaagaatgcttgcagcagccttcagacaatgaacctgtgaatatcatccaatgaaagccaccatttttatccgacaattttcataaatctgtacaagtcctagaatgcggttcaaggtattgaagagcatctttcacacgaccggagggcggggactattaatctcctccttttttatttttataaacatatcatcattgtcgtttgctatgatttatgtatagaaatcccctgacattccagggtcataccttcatatttataaattatattagaatacacacatattgaatcgggatc

SEQ ID NO: 9965 - DNA, 2055 bp, Chrysanthemum coronarium
aattcagatctcacagtctttatatattttttatagatcgttagggtttgaagggctattgaatgtatgaatcaaatatgtgtagattagaagagaagaataggaataaaataaaggctagatttgtgattggtacaatggggttaaagaaaagattaagtgaaattagagttgataaatttagaaactcgatgaggtcgtcttcgaaaatgaagatgtggttaattagggctacaactactgttttgttatggacttgtgttgttcagttaactgctttaggtggtacttggggtcctagggtgttaaaaggttggccttcgtgttttagtgttgatgatcatgttgctaagtcgttagatatcccggttccggctagggttttgcctccgaaaagagtgtataagaataatggctacttggttgtttcgtgtaatggaggtcttaatcaaatgcgttctgctatatgtgatatggttgcgattgctagatatttaaatgtgactctaatagttcctgaattggataagacgtctttttgggctgatccgagtgaatttcaagatatatttgatgttgatcattttattacgtcgttgagagatgaggttcgggtgcttaaacagcttccacctaggcttaagaagagagtggagttaggaattgtgcatactatgcctccggttagctggtctgatatttcttactatcataatcagattctcccattgattcaaaagttcaaagttgtgcatttgaatagaaccgatgctaggcttgctaataactttcaacccctcgaacttcaaaagcttagatgccgagcaaattttgatgctttgagatttactcctcagatagaagatttgggtagacgtgttgttaggcttttgagacaaaacgggccatttttagtgcttcacctcagatatgaaatggatatgctagcgttttctggctgcacgcaaggatgcaatattgaagaggttgaagagttgacgagaatgagatatgcttacccatggtggaaagaaaagataataaattctgatttgaaaaggaaagacggattatgccctttgactcccgaggaaactgctcttacacttaaggcactggatattgaccatgatattcaaatttacattgctgctggtgaaatatacggcgggaaaagaagaatggatagtcttgcagaggccttcccgaaactggtaagaaaggagactctgttagggccagatgaccttcagtatttccagaatcactcgtcacagatggcagcattggactaccttgtgtcacttgagagtgatatttttgtacctacttatgatggaaacatggccaaagttgttgaaggccatcgcagattcttgggtttcaagaagacgatactattggacaggaggcttctggttgaattaatagacaaatacactagtgggtccttgacctgggatgaattctcgagtggtgtcaaggaagcacacgcccaacgtatggggaaccctacaaaaagattggttatcccagatagacctaaagaagaagattacttttatgctaatcctgaagagtgcttgcagccatcagatgatgaacctctgagcatcatgtaacaaatggtggattattttggtcaaattatttgtcgttggcctctactacagttttatgaactgtcaattagaaaaattatggttctctgctatcgggaccagtcggtatacaaggaagatctttccaaaatgtgaggatgcgacagcacagaccaaaatacattttggtgggactggtggttggagattcacgtaggcaacaatcttaccacgaacataaatggcgtttattattcttaatgtcttcgttttcattttatatgtatcgttattgtcaataagttctcattcttgtatagaaaccaccctgccattgcagggttatatcgtccgtattcaaaactagttatatgtacacaaagagggagtcgaaaccttagatatgtttttgctcagaggtattattattattatcgcgacaacataattctat

SEQ ID NO: 9966 - DNA, 2258 bp, Chrysanthemum coronarium
aaaaacctctttctactcttctcttcaccgacactttctaattccggtcaccgtcacacttttccggccaccgtcgttttttccgaccaccatatccaattcccttccgaccctttatacacaatcaaaaacccattttatatcactaaaaactttccattttcatccattaaataaccgtgcattttaatctttacccagtactaaactcaccaaaaaagttaattttttcttgtgggtcattcgaaatttggatcaaatttattacataattaagatctcacagtctttatatattttttatagatcgttagggtttgaagggctattgaatgtatgaatcaaatatgtgtagattagaagagaagaataggaataaaataaaggctagatttgtgattggtacaatggggttaaagaaaagattaagtgaaattagagttgataaatttagaaactcgatgaggtcgtcttcgaaaatgaagatgtggttaattagggctacaactactgttttgttatggacttgtgttgttcagttaactgctttaggtggtacttggggtcctagggtgttaaaaggttggccttcgtgttttagtgttgatgatcatgttgctaagtcgttagatatcccggttccggctaaggttttgcccccgaaaagagtgtataagaataatggctacttggttgtttcgtgtaatggaggtcttaatcaaatgcgttctgctatatgtgatatggttgcgattgctagatatttaaatgtgactctaatagttcctgaattggataagacgtctttttgggctgatccgagtgaatttcaagatatatttgatgttgatcattttattacgtcgttgagagatgaggttcgggtgcttaaacagcttccacctaggcttaagaagagagtggagttaggaattgtgcatactatgcctccggttagctggtctgatatttcttactatcataatcagattctcccattgattcaaaagttcaaagttgtgcatttgaatagaaccgatgctaggcttgctaataactttcaacccctcgaacttcaaaagcttagatgccgagcaaattttgatgctttgagatttactcctcagatagaagatttgggtagacgtgttgttagacttttgagacaaaacgggccatttttagtgcttcacctcagatatgaaatggatatgctagcgttttctggctgcacgcaaggatgcaatactgaagaggttgaagagttgacgagaatgagatatgcttacccatggtggaaagaaaagataataaattctgatttgaaaaggaaagacggattatgccctttgactcccgaggaaactgctcttacactcaaggcactggatattgaccatgatattcagatttacattgctgccggtgaaatatatggcgggaaaagaagaatggatagtcttgcagaggcgttcccgaaactggtaagaaaggagactctgttagggccagatgaccttcagtatttccagaatcactcgtcacagatggcagcattggactaccttgtgtcactagagagtgatatttttgtacctacttatgatggaaacatggccaaagttgttgaaggccatcgcagattcttgggtttcaagaagacgatactattggacaggaggcttctggttgaattaatagacaaatacactagtgggtccttgacctgggatgaattctcgagtggtgtcaaggaagcgcatgcacaacgtatggggaaccctacaaaaagattggttatcccagatagacctaaagaagaagattacttttatgctaatcctgaagagtgcttgcagccatcagatgatgaacctctgagcatcatgtgacaaatgatggattattttggtcaaattatttgtcgttggcctctactacagttttatgaactgtcaattagaaaaattatggttctctgctatcgggaccagtcggtatacaaggaagatctttccaaaatgtgaggatgcgacagcacagaccaaaatacattttggtgggactggtggttggagattcacgtaggcaacaatcttaccacgaacataaatggcgtttattattcttaatgtcttagttttcattttatatgtatcgttattgtcaataagttctcattcttgtatagaaaccaccctgccattgcagggttacatcgtccgtattcaaaactagttatatgtacacaaagaggg

SEQ ID NO: 9967 - DNA, 1999 bp, Chrysanthemum coronarium
aagggctattgaatgtatgaatcaaatatgtgtagattagaagagaagaataggaataaaataaaggctagatttgtgattggtacaatggggttaaagaaaagattaagtgaaattagagttgataaatttagaaactcgatgaggtcgtcttcgaaaatgaagatgtggttaattagggctacaactactgttttgttatggacttgtgttgttcagttaactgctttaggtggtacttggggtcctagggtgttaaaaggttggccttcgtgttttagtgttgatgatcatgttgctaagtcgttagatatcccggttccggctaaggttttgcccccgaaaagagtgtataagaataatggctacttggttgtttcgtgtaatggaggtcttaatcaaatgcgttctgctatatgtgatatggttgcgattgctagatatttaaatgtgactctaatagttcctgaattggataagacgtctttttgggctgatccgagtgaatttcaagatatatttgatgttgatcattttattacgtcgttgagagatgaggttcgggtgcttaaacagcttccacctaggcttaagaagagagtggaattaggaattgtgcatactatgcctccggttagctggtctgatatttcttactatcataatcagattctcccattgattcaaaaattcaaagttgtgcatttgaatagaaccgatgctaggcttgctaataactttcaacccctcgaacttcaaaagcttagatgccgagcaaattttgatgctttgagatttacacctcagatagaagatttgggtagacgtgttgttagacttttgagacaaaacgggccatttttagtgcttcacctcagatatgaaatggatatgctagcgttttctggctgcacgcaaggatgcaatactgaagagattgaagagttgacgagaatgagatatgcttacccatggtggaaagaaaagataataaattctgatttgaaaaggaaagacggattatgccctttgactcccgaggaaactgctcttacacttaaggcactggatattgaccatgatattcaaatttacattgctgctggtgaaatatacggcgggaaaagaagaatggatagtcttgcagaggccttcccgaaactggtaagaaaggagactctgttagggccagatgaccttcagtattttcagaatcactcgtcacaaatggcagcattggactatctcgtgtcactagagagtgatatttttgttcctacttatgatggaaacatggccaaagttgttgaaggccatcgcagattcttgggtttcaagaagacgatactattggacaggaggcttctggttgaattaatagacaaatacactagtgggtccttgacctgggatgaattctcgagtggtgtcaaggaagcacacgcccaacgtatggggaaccctacaaaaagattggttatcccagatagacctaaggaagaagattacttctacgctaatccagaagagtgcttgcagccatcagatgatgaacctttgagcatcatgtgagaaatggtggattattttggtcaaattatttgtcgttggcctctactacagttttgtgaactgtcaattagaaaaattatggttctctactatcggaccagtcggtgtacaaggaagatctttccaaaatgtgaggatgcgacagcacagaccaaaatacattttggtgggactggtggttggagattcacgtaggcaacaatcttaccacgaacataaatggcgtttattattcttaatgtcttcgttttcattttatatgtatcgttattgtcaataagttctcattcttgtatagaaaccaccctgccattgcagggttatatcgtccgtattcaaaactagttatatgtacacaaagagggagtcgaaaccttagatatgtttttgctcagaggtattattattattatcgcgacaacataat

SEQ ID NO: 9968 - DNA, 2783 bp, Lactuca sativa
atataaaggaaaaaaagaaaacccttgcaatttcagtactctctctatctctctcatcacacaaatacagaagaccgccccgtgcgattcctcttatctttttctcgtcgtctatctctccaccgtcgttggctactttcgccacctccttacctctaccctttcaaaactgccgcccacaagcatccatttttctcaatatttccctcattttttttaatcggattctaaatttcttaatctcttaatttgtcgttttcggtggctgttaaatatcatttgacgaatagaatttccttaatgcccatttgagatcgaacggtgcttttggatttatgatcttccttctaaatgtgttattcaaaatcacagggttttgtgtaagaaagaaatcttggtacatattcccctgagatttataattaaaacttgtaaattgttgtttcgtttttggtaggtaagtgtgcaattgaattctagttgaatcgcgtttaattaccgtttcctgtatttacaaattcttggatctcgaaagcattatccgtttttgaattcctcgccaattcagatccttcctatacgtcccttttgttgtaccgacaatataattaagggtttggtggtggtagttgatgaatgggagtgatatgtacagcgtagaagatagagataagagaaagaggtttgggattggtattggaattggaattggagttaagatcagggcaatgggattgaagacattaggggagagtagagtagaaaaattgaaggcaaatgcaaggtctccaaaaatgaagttgtggataattagggccacaacaatggtgttattgtggacttgtttggttcagttgacagctttaggtgatacatggggacctagggttttaaggggttggccttcttctgtcactcaagattcccattctttagatgtcaagtttttgcccagtggtcctgctagggttcttcctcccaagagtgagtttctttcttcatgggtttaccaaaacaatggttacctaatggtttcatgcaacggaggactcaatcaaatgcgatctgcaatttgtgatatggttgcgatttcaagatttttaaatgttacacttatagttcccgagctcgataaaacgtcattctgggctgatccaagtgagtttgaggacatttttgatgtcgatcatttcattacttcattgagagatgaggtacggatacttaagcaacttcctccaaggcttaaaaagagaatggaattgggatacgtgcataccatgcctcccgttagctggtccgatatttcttattatcataaccagattcttcctttgattaagaaattcaaagttgtgcatttgaatagaacagatgctcggcttgcgaataatggtcaacccctagaacttcagaagctaaggtgtcgagtaaatttcaatgctttgagatttactcctcagatagaatacttgggtaggcgtgtggtgcaacttttgagaaaaaacggcccctttctagtgctacatcttagatatgaaatggacatgttagcattttctggatgcactcaaggatgcaatcctgatgaggtggatgagttgaccagaatgagatatgcatacccatggtggaaagaaaagattattaactctgagttgaaaagaaaagacgggttatgccctttgactcctgaggaaactgcccttactctaagggcacttgacattgctagtgacattcagatttatgtggcggctggtgaaatatatggtggtcaaaggagaatggccagccttgcagccgcttttccaaaactggttagaaaagagacgttattaggagcagatgacctacaatttttccagaaccattcgtcacagatggcagcattggactatcttgtatcattagaaagtgacatttttatccctacttatgatgggaacatggccaaagttgtagaaggccatcgcagatacttgggtttcaagaagacgatattattggatagaaagcttctggttgaattgatagacggatacacgagtggtttgttgagttgggaggaattctcaagtgctgtgaaggatgcacacatggcacgaatggggagccctaaaaaaagaaaagttgttcctgaaagaccaaaagaagaagattacttttatgcaaatccagaagagtgcttgcagccattagtagacatagaccctgtgactctgagcatcctaagatgagtaggctcttgtggaatatttaggtcagtatctttatcagaggcctcatcaagatggaagattgtggttcattatggttcactgccttcgagccagtggtgctagaggtgggtcaatcttgaatgaggcggcaggtggtggtggtagtggtggtgggtggtggacttccatgttgttgaccatgttttcgtagggctgagaaggggtttattattagtatccttttttttggcttacatattattggtaataatgcagattcatgtataggaattagtaattaccctggcattgcagggttatatcttcggccttgaaactaccgatgtatcacattgattcgaaatatagatttatttttgcccggtaatgtatctcatcagtgaagacgataacatgatacatcagttgtaatatagaggtaggtgctgttgttttttttgaggcaaatgtttgcaatttgcggaccacatctacagctctgcagtcagtggcggaaccagaaattttgatatggaggtacaaacattgtcaatatattag

SEQ ID NO: 9969 - DNA, 1532 bp, Centaurea maculosa
aagatgggatggaagtcattaggggaaagaagagtagaaaaattgaaggcaaatgcaagatctccaagaatgaaggtgtggataattagggcaacaacaatggtgttattgtggacttgtttagttcaattaacagcattaggggatacatggggtcctagggttttgaaaggttggccttctacttctacttcttcattcactcaagattctcattctttagatgtcaagtttctgccaattgctcctgctagagttcttccacccaagagggtttatcaaaacaatggttacctaatggtttcgtgtaacggaggactcaatcaaatgcgctctgccatttgcgatatggttgcaatcgcaagatttctgaacgttactcttatagttccggagctcgataaaacttctttttgggctgatccaagcgagtttgaggacatttttgacgtgaatcatttcatcacgtccttgagagatgaggtccgaatactgaaacaacttcctcccagacttaagaagagagtagaatcaggaatcttgcacactatgcctcctgttagctggtccgatatttcttattatcataaccagattcttcccttgattcaaaaacacaaagtcgcgcatttgaatagaaccgacgctcggcttgccaacaacggtcagccattagaacttcagaagcttagatgccgagtaaatttcaacgctttaagattcactcctcagatagagtacttgggtagacgtgtggtacaacttttgaggcgaaacgggccgtttttagtgcttcatcttagatacgaaatggacatgttggcgttttccggatgtactcagggatgtaatcctgatgaggtggaagagttgaccaggatgagatatgcgtacccgtggtggaaagaaaagattataaactcggagttgaagagaaaagacggtctttgccctttgactcccgaggaaactgctcttacgctgagggcactggacatcgatagcgacatccagatttacgtcgctgctggtgaaatttacagcggtcaaaggcgaatggctgctcttcaatccgcttttcccaagttggtgagaaaagagactttattaggagccaatgaccttcaatttttccagaaccattcgtcacaaatggcggcattggactatttggtatcgttagaaagtgacatttttatccctacgtatgatgggaacatggccaaagtcgtagaagggcatcgaagatatttggggttcaagaagacgatattattgaatagaaagctcgtcgttgagttaatagaccaatatacgagcgggtcgttgagttgggacgagttttcaggggccgtgaaggcggcacacgcggcggcacgaatggggagcccgaagaaaagagtggttcttccggagagaccgaaagaagaagattacttctatgcaaatccagaggaatgcttgcaaccgccattagagagcgagcccgtgagcattctacgatgaggggttttgtgggtccgggtctttat

SEQ ID NO: 9970 - DNA, 2144 bp, Petroselinum crispum
aaaaaagatcaaatcttggtactttttggaatcaatgttgatgatggtatgatactattgataagttgttttgggaaagttttgatttttgagtatattttagtatgtgtaagatagagaagaggggatatatagcaatggggatgaaaacatttggtggtgagggtaaaaaagggattgagaagtttaagagttcaatgatgtcaaggtctaaaatgaagctttggatgattagagcaacaacttcaattttgttgtggacttgtttagttcagttgacaactttgggtgagatgtggggacctagggttttaaagggctggccttcttgcttttctcatgaatctggtgctatggatgttaagattgcgtcgagtcttccagctagagttcttccacctaagagggtgtataagaacaatggctatttgatggtttcatgcaatggaggtcttaaccaaatgcgtgcagcgatatgtgacatggttgctatagcaagatatttaaatgttacacttattgttcctgagttggataaaacttctttctgggctgatccaagtgagtttcatgacatttttgatgtcgaccatttcatttcatccttgagggatgaggttcgaatattgaagcagctgcctcccaggataaagaggagagtggaactaggattgttttacacgatgcctcctgtcagttggtctgacatctcttactatcataatcaaattcttcctctgatccagaaatacaaaattgtgcatttgaataggactgatgctcggcttgccaacaatggtcagccgctggagatgcaaaagcttcgatgccgagtaaacttcagtgctctgagatttactactcagatagaggagttaggaaggagggtaatcaagcttttaaggcagaatggtcctttcctagtacttcatctcagatatgaaatggacatgttagcattttcgggttgtaaccacggatgcagcaacgaagaagtagacgagttaacacgaatgagatatgcctacccatggtggaaagagaaaatcataaattctgacttgaaaagaaaggatggtctatgtccattaacccccgaggaaactgctcttacactaagggcactggacattgatcgggacatccaaatttacattgctgccggagagatatatggtggagaaaaacgaatggctagtcttactgctgcttatccaaaagtggtcaggaaggaaactcttttgggatcatcagaccttggatatttccagaatcactcttctcagatggcagcactggattatcttgtttcactggagagcgatatttttgttcctacatatgatggaaacatggccaaagtagttgaaggccaccgaagattccttggttttagaaagacgatattattggatagaaagctattagttgatttaatagatcaatacaatcacggatccttgaattgggatgaattctctagtgctgttaaggaagtacattcagatcgcatggggaaccccactaaaagattggtgattgcagacagacccaaagaggaagattacttttatgccaaccctgatgaatgcttgcaatcatcagaaccatcagtagaaagattagatatcttataaatgccaggggcatgctttgttagtttgactaaaggactacaatgagaatctaccactattggagataaaaagttctgttatcactaaatcatcgcagaaggagaatcttgttttgaggaggcaatttagaagatggcagggaatgtgtacttttgccattgaagaggatcatcgggaccaggtgtagtttcatgtacacaatcttggtaatgtcaaatatttaataatttgattcctgtatagaagataccctgccattgcagggttatattaaacttgaccgccatcagtgtgcacaaatggatacatgtattagtccttattcattttgacatgcggtttttgaagacacgctattgaatatatacatataatcaaaattatttatcttcttacatgtgttcctcttgtgagtgatggttgtggtaagtaggagaaatggtttccttattcttgggtttataagccaagaaaatgaaccccagtcacttctacactcagatttcc

SEQ ID NO: 9971 - DNA, 2749 bp, Conyza canadensis
tcacacactaccctctcatttcaccttccacacactccatcatccaaccttcatccacaataaaattcactttctttatcacaaaacaaaacccctttttgttctctctactcctttttccggccaccgacactttaaaattccggcaactttatcatctctggcaccggaatcccaattttagtttcattattatcacttcatcttttttattgaacaaaaaacagttttgtttttgtgtaattcaataaaacccccaaaacccatttagaatctagtcggatccgggtctaattttttccgggtcaccggaaagtttgaatctttaataaagatcttatcagggtttttgtggggttgtgaatgtatgaaaagaaaatgtgttgtagagttgaacagaataaaaaagatttggaattggggaaatgggattaaggaaattaagtgaaattagagtcgagaaattaaagaattctgcaagatcaccgaaaattaagatgtgggcaattagagggattagtagtgtgttaatatggacatttttggttcaattaagtgcaataggaagcggtggtggtggtggtgatggaggaaatagtaattggggtcgtagggctctatcgtgtttcgggcaagattcttcagtttcttcggctgctttagatgttaagtttttgcctaatgttcctgctaaagttcttccacccaagagggtatacaagaataatggttacttggtggtgtcatgtaatggaggacttaatcaaatgcgttctgctatttgtgatatggtggcaatagctagatatttaaatgtgactcttatagttcccgagttggataaaacttctttttgggctgatccaagtgactttgaagacatttttgatgttgatcatttcattacttccttgagagatgaagtccgggtgcttaaacagcttcctcctaggcttaaaaagagagttgaattaggaattgtgcacaccatgcctcccattagctggtctgatatttcttactatcataaccagattcttcctttgattcaaaaatacaaagttgtgcatttgaatagaactgatgcccgccttgcgaataatggtcaaccacttgaacttcagaagcttagatgccgagtaaattttggtgctttgagatttacaactcaaatagaagagctgggcagacgtgttgttaaactattgagacaaaacgggccttttctagtgcttcatcttcgatatgaaatggatatgttagcattttctggctgtacgcaaggatgtaatgttgaagaggtggaagagttgaccagaatgagatatgcttacccatggtggaaggaaaagattattaattctgatttgaagcggaaagacggtttatgccctttgactcctgaggaaacagcccttacacttagagcactggatattgaccgggacatccagatttacattgcggctggtgaaatatatggtggaaaaagaagaatggatagccttacagacgtgtatccaaaagtggtaagaaaggagactctgttaggggcagatgaccttcagtatttccagaatcattcatcacaaatggcagcattggactatcttgtgtcattggagagtgacatttttgtgcctacttatgacggaaatatggccaaagttgtagaaggccatcgcagatttttgggtttcaagaagacgatactgctagataggagagttctggttgaattaattgacaaatacacaagtgggtcgttgagttgggatgatttctcgagtgctgtgaaggaaacacatgcacaacgtatgggaaaccccacaaaaagattggtcatttcggatagaccaaaagaagaagattacttttatgccaatccagaggagtgtttgcagccatcagacgatgaacccatgagcatcctataaacaaggcttcgtgaattgattttggtctctgtattacaagattaccattctctgccatgtaagcaaccagtgtacaatgagtaatctgttcaagatgcgacgatgcaacacattttgctgagattggtgacggggggatgcacgtggattacaatgtttccacgaatagaagtacggcgtttattattaatgatgtctcgtttttcattttatatgtatggttattgtcaataagtctcattcatgtatagaagaaacatctccctgacattacagggcttattcaagactagtgatatgtacacacagagttgatacattaggttgattttttatttatttgtgccctccatttgttgctttcctaagcaaaggtattttttagttaattaattatttaattaatggttattgccaactataacaattgagcatatggagtctaatactttccctgaatataagttaggagatttattataataatatataacttaatgattgtttttaatatattctttagaattgtttaatgaatgcacattctaaacaatgatgtggcaattagtggactaccaaatgaatggggttgagaatgattgaataccagaaacacattccttagaagaatatacgattgtggtattattcaaatccactcatgtctcactggattgaatatatctacatgatagggatgtgtggttgttgactttgaagcttctaaaaaatgattaaactttgcgaagcatgttgaatcatggccgccggcttggtcttaacagcagaaataggtcgtttttcatcttccc

SEQ ID NO: 9972 - DNA, 2517 bp, Lactuca sativa
taaagttgaaagagtatgtaaataacaaaaagcagctacacatcacaagcacatctctctctctctctctctctctctctctctcgttattctttgccggcaaccgacgccctctcattccggcgaccttctcatcacttgccatagttaattgccggttccaagctataaggaccatcaacactgtttcttctcgaaaacgatctcgatttgctgtaatctgctgctgttcagactagctgttgaaattttggtcaaaattgaaattgcttaaatgacttttttcgagatccactttgcttttgggaacgtgttattgaaaagctacggtttcgttgcatgttattggaggaaatgaatcttggtacattttgttctgagatttaattaaactgaattagtggttaatgttgcttctcttttggtagcttagtgtggaatcaaatcatcaatcatctcttctatttaggagattgtgcatctcgataacgatatctcatatctcatacgtatttattcatttatttagtcgtcaatatagcgaattcctgtgtggtatatagattattgcgatggagtgttagggtttcaaggtgatttatggttttgaaaccatgaaattaaaaggattaggagatagtaaagtagaaaaactgaagagtttgacaggaaattcatatgcaaaatcttctaaaacgaagctgtggatgatcagggccacgacagcggtgttgttgtggacttgtttggttcagttgacggcattaggagatacatgggggcctatggttttgaaaggctggccttctcgtgagactctttctgcttctgctttagatgtcaaattgttgcccatggttcctgctagagttcttccacccaagagggtttacaagaacaatggttacctactgatttcatgtaatggaggactaaatcaaatgcgatctgctatatgtgacatggttgcaattgcaagatacttgaatgttactctcattgttcctgaattggacaaatcttctttctgggctgatccaagtgagtttgaggacatttttgatgttgatcatttcataacatctttgagagatgaagttcggatacttaaagagcttccaattaggcttaaaaagagagtggaattaggactcatacataccatgcctcccattagttggtctgatatttcatactaccacaaccagattcttcctttgattcaaagattcaaagttttgcatttgaatagaaccgatgctcgccttgccaatagtggtcaaccctttgaccttcaaaagctgagatgtcgagtaaatttcagtgctttgagattcactagtcaaattgaagaactgggtaaacgagttgtgaatcttttaaaacaaaaaggaccttttttagtcctccacctcagatatgaaatggacatgttagcattttctggttgtactcaaggatgcaatgatgaagaagtggaagagttgacacgaatgaggtatgcttacccttggtggaaagaaaagattataaactctgaattaaaacgaaaagacgggttatgccctttaactcctgaagaaactgctcttgcattaagggcacttggggtaaataatgacatccagatttacattgctgctggtgaaatatatggtggagaaagaagaatggctagtcttaaagccacctatccaaatctggtgagaaaagagactcttttgggagcagatgagcttgggttttttcagaaccactcgtctcaaatggcagcattggattatcttgtatcactggaaagtgacatttttgtccctacttttgatggaaatatggccaaagtcgttgaaggtcatcggagatatttgggtttcaagaagacgatattattggatagaagattacttgttgaattaatagacaaatacacaagtaaattattaaactgggatgaattctcaaatgctgtgaaagatgctcatgcaaatcgcatgggtaaccccacaaaaagattggtgattccagacaaacccaaagaagaagattacttttatgcaaatccagaggaatgctttcatccctcatcacaaaatgaacctgtcaatataatccaatgattcatgcatccaacaattttcattaatctgtaccagtcttgtcctgttctgtcctgtcctgtcctgttcaatacagtctagtccagtcctgcaacaacctgatttaagaggcggtgatttattaatctcttactctttttttttaaaaaaatatttttgtcaataactatgattcatgtatagttatcaccctggcattccggggttatattggttacaactcgttcatttacaagaaaaatatttcagatataaatttattttagcttaattcattcatttttgtatgtataatttgtgggataattttttttatttgttgactagtagatttgtgtattaactggtggaggcattatataccaagagattttttttttggaataaataaagatgtcaa

SEQ ID NO: 9973 - DNA, 3924 bp, Prunus mume
atgagtcgagtgactgtctggctgagtatggagaaattgggatccacggctacatatcaacacaaagggctctatgtatctcccgactcatctactacatctccaaccaacacgctccaccaacaccgagacacgtgtcacacaacgcggctgaagccctcaacgggcgcgtgcaacttctacatccctctccgctgtacactgacaatatacttacaatgggtcccattcaggagcccacagttgggaaggagtcttgatcgcgacacgtgtcccgacatgcgcatctcaggatatacgcaccatcggacggctcttccaaaagcgacgtcctgccgtggcgccgttcacacggcacaaccgacactcagagggagcttttacccctcgctaggctacggggtggagggaccggcggaacgagaaagccaaacttatcgcgatatattgtcggcgtatcgacacgagaacaaacgggctgcgatcgaaacggagacaaggaaaccacaatctgatacggacttggctaaaacccatgatctcgttctcgacgtgtcaaagatcgagggcctgatgggagacacgtgttcaaaacataattggagcggggccggccgcatcggccatatagctggctttcatttattggaggctttgtgcactttaaagtaacacacacacacacgaagcccaagccctgccctcctcctccgagtccactttgagcccacgcaaaccgtcggtgcacgtcacgcacgccccatcacgcgttttttgtttttctctgcatcgcaccacattacatatgatgacaacaccgccctcctctaccactgctccctgtcctccctccctctctcatttcttagcgatcttcttctaatcgccggccaacgctccggcgactcttctcgccggataatacggcggatctgggtggggattccacctcgcatttcgggttcaattgccccggctctggaaaggtggtgttgtagcaaatatcagagttttcacttttttgtttcttttcttcttttgagcagtgttgtaggaaattatggttgttgatgcaattgtttgagggaatcttcgaaagcgagagttttggaggaaatctttgaggacgggtggggaatgtggtgagtattggctcagttttggaaatcggtttcggatctttgctggtttctatatatagcaagagcttaaaaaggaatgccatttttttggatccgacattgagcaatacgccccgtttcgttgacggcttgatgttgtacaaggaagagagatacacagattgatgtgcaagatagagaagaaggagagaaagggagtgatgggattcaaggtgttagggggaggaggaggagacaagttcaagaactcgatgctcgtcacgacgacgacgccgtcgccgccgtcgaggtcgaaaatgaagctgtggatgatacgggcaacgacgtcggttttgttgtggacgtgtattgtacaattaacggctttgggggatatgtgggggcctagggttttgaaaggctggcctgcttgtttctctcaggagtctgctgccgcctcttctgttttgcaagacaagttgccttccgtcccggccagagttcttccgcccaagagggtttataaaaacaatggctacctgatggtttcatgcaatgggggactcaatcaaatgagagcagcgatatgtgacatggttgctattgcaagatatttgaacgtcactctcattgtccctgagcttgataaaacctccttttgggctgatcccagtgagttccaagacatattcgatgtggatcatttcatcacatccttgagagatgaagttcgcatattgaaagagttgcctccgagggttaagaggagagtggcactaggaatgatttataccatgccaccaattagttggtctgacatgtcttattatcataatcagattcttcctttgatacaaaaatacaaagtggtacatctaaatagaactgatgcccgacttgccaataatggacaacctttggatattcagagacttcgatgccgagtaaattttagtgctctgaggtttacttctcagatagaggagttgggtaaaagggttatcaggcttctaaggcaaaatggtccgttcctagtgcttcatcttagatatgaaatggacatgttggcattttctggctgtactcaaggttgtaacgctgaggaggtggaagaattgacaagaatgagatatgcttatccctggtggaaagagaaaataatcaattctgacctgaaaaggaaagatggtttgtgtcctctgacacctgaagaaaccgctattacactgagcgcacttgacattgatcgcgatattcagatttatattgcagctggtgaaatatatggtgcagaaaggagaatggcaagtcttgcaaaggcttatcccaaattggtcagaaaggagacactgttggaaccgtcagaccttaggttctttcaaaaccactcatcccaaatggcagcactggattatcttgtctcattgaagagcgatatttttgttcccacatatgacggaaacatggctaaagtggttgaaggccatcgcagatttcttgggttcaagaagacaattctactggacagaaagcttcttgttgatttgatagaccagtacacaagtggatcattgaattgggatgaattttcatctgcagtaaaggacgctcatgcaggtcgaatggggaacccaactaataggttgatgatccaagaccgaccaaaagaggaggactatttctatgccaacccagaagagtgtttgcaaccgttagatgaacaactgagtagtacgtgatatatataatgttagaagattgtgacactcatctgtgttctacagtgttggctattttcccacagatgtataagaaagttgtctacagagggatagccataatgagattttgttctgaagaggcgatgaagattattgttggggggaagtaagtaatcttcaataaagccctgagaggatctatgataccagctggaggacatgttttatcttttatataagccaaataatccatccaaatcatgtatagaaagctgccttgccattcagggcgggaacgaattaaaactgcattgtatgtgggggaaacatataggtttggtttactggaactgcaaaatcatcaaaggtcaacccctattccttaattttttgtatttttttgtttctttttagatcaacctgtggtattgtgattctctagcatatactactacatcttaaaaggtttttctgtttgcacagatgattgcctcattcccgtttgtaatgtgggtctagttctgagagaatgactgagaggaagccaatgattatgtatttttacacaatacaacattaattaatatgtctaagagtgtttcgtttacttggagtgtttagggttttactggccttaaagtttcccaaatagatcatcagttgggttatttatggattggttggtagtacatgtaaatatataatgtttgagaaggtggtttgtaaatctcatatgataatgacaagccaagtaaacaaaccagtcaaacatgttccattgggattttgacatgtatatatctggatttgggggatctgcttgctagtgcctagtggttgggtagctgtcctttggggtttgtatatcaatacacttaattatatatatgtggttaataattcccagatttgccacaaaatggttggtagaacgatttcaattagatttggaaatttgagcaaaatagaagaagaaaagaattatacttggaattttattatatactaggagatttggttcatgtgaatggaatgattagctggcaatggcatactgatatattctgtgtctttcttccccg

SEQ ID NO: 9974 - DNA, 2421 bp, Ricinus communis
gtgattatgaagcggtgtacggttcacacaccaattagcttttttatcacagccacatcgcgtttctttgtataaactcctgttttctctctctctctcttcttctatttttctctgtctataacgatttttaaatcgccggcgacattacccggcggcttttgttgaatacatctccggctaatttatgagatcattgaaaaaattgtggttgatttgattcaattttgttgttatttgaagtcgattgattatttctatttttgttgatctggttaaagttttggcaatttcggatcttcggagatttccgattcggaaaacaaacaactgaaggaagaaacgacggcgttacggatcctacattgttaaaaaataataataacgatagttaagaagataagaggagagagaaactggtgacgtaatatgtatggagagaaatgtgcaggatagaaaggagtgaaagaaagagcagtgaaatggggataggtaaaggaggggtggagaaggtgaagggtaatagtggaataacatcgagcagtagtaggtcaaaaatgaagatgtggatgataagagcaacaacgtcggtgttgttatggacatgtattgtacaattaacgacgatcggagagatgtggggtcctagggttttgaaaggttggccttcttgtttctctcacgaatctgctgcttctgctttggaggagaataatcttcctgttagagttttgcctcctaagagggtttacaagaacaatggatatcttatggtttcatgcaatggaggtctcaatcaaatgagagcagcgatctgtgatatggttgctatcgctaggtatttgaatgtcacacttatagttccagagctggataaagcttctttctgggctgatcccagtgagttccaagatatatttgatgtagatcatttcattacatcattgagagatgaagttcggatattgaaagaattgcctcctaggctgaagaggagagtggaattagggatcacttataccatggcaccaattagttggtctgatatatcctattatcacatccagattcttcctttgatacaaaagtacaaggtcttacatctgaacagaactgatgctcgacttgccaataatcatcaacctttggagattcagaagttgcgttgccgtgtgaattttagtgctttgagatttacctctcagatagaggagctgggcaaaagagttataaagcttcttaggcaaaatggtccatttttagtccttcatcttagatatgaaatggacatgttggccttttctggctgtacccagggttgtaacaatgaggaggtagaagaattaacaagaatgagatatgcttatccttggtggaaagagaaaataataaattctgacttgaaaaggaaagatggtttatgccctttgacaccagaggaaacagctcttacattgagggcattggacattgatccagatatgcagatttacattgcagcaggtgaaatttatggtggagataggagaatggcaagtcttgcggcagcttttcccaaactggtcagaaaggaaaccctgttggaaccattagaccttaggttttttcagaatcactcatcccagatggcagcattagattatcttgtttctttggagagtgatatttttgtcccaacatatgatggaaacatggctaaagttgttgaaggccacaggagataccttgggttcaagaagacaattttactggaaagaaggcatttggttgatcttatagacagatacactaatggttcgctgagttgggatgagttttcttatgctgtaaaacaagcacatgcagaaaggatggggaacccgatgaagaggttggtgatcccggataggccaaaagaggaggattacttttattccaacccagaagagtgcttacagccgccagatgatcctttgctttctttgagtagcacgtgacagttattgaggagattgtgatattttatcagagtgttctccacattcctagtaattctaccaaagatcaaagggataattctctacacaaagaggatatagtgataaaggaacattttgtgaggaatagacaatcatgaaaaggaatagattgggttggtaaaaattcaagaaagcctgagatgatctatgggagcacttgtagaatgccatcatctttagtatatgccaataatccaattcatgtatagaagctaccctgccattacagggtgatgtcagtcaaatcaacaaaatcggattgtacacagagggatgcaaatatagatgtggtctaccagaagtgtggcctcaaaggaaggttactccttcgtccttccattttgtattttctttcttctcttttttgttttttttggttcatctatgatcttgtgagttccta

SEQ ID NO: 9975 - DNA, 2238 bp, Castanea mollissima
attattattgtacaaaattcaattttgtttgggaaaattagggtttgaattttgattgcatgggggaaagtggagcgagatgtgtaggatagagaggaaaagctgtgaatttgagaataacagcaagagagagatggggttgaaggcaatgggaggggttgagaagctgaggagttcaatgtcggtgtcgatgtcgaggtcgagaatgaagctatggatgatacgcgctacgacgtcggttttgctctggacttgtatagttcagttgacggcgttaggggatttgtggggtcctagggttttgaagggttggccctcttgttttttgcaggactcttcttcttcttcctcctccgccgccgttaacaacgccgttaccgttccgtctgttccgccgcgagttcttccacccaaaagggtttataagaacaatggttatctgatggtctcatgcaacggaggactcaatcaaatgagagcagcgatttgtgacatggttgctattgcaagatatttaaacgtcacacttatagtacctgagttggataaagcctccttttgggctgatcccagtgagttccaagacatatttgatgtggatcatttcattacgtccttgagagatgaggttcgaatattgaaagaattgcctcctaggctcaagaggaaaatggaactagggaaagtttattccatgcccccaatcagttggtctgacatatcttactatcataatcagattcttcctctgatatggaagcacaaagttgtacatctgaatagaactgatgctcgactggccaataatggtcaacctttggagcttcagaagctgcgctgcagagtaaattttagtgctctgagatttacttctcagatagaggagttgggtagaagggttatcaatcttttaaggcaaaatggccctttcctagtacttcatcttagatatgaaatggacatgttggcattttctggctgcacgcaaggttgcaacaatgaggaggtggaggagttgactaaaatgaggtatgcttatccatggtggaaagaaaaaataataaattcggacttgaaaaggaaagatggtttgtgccctttgacacctgaggaaactgctcttacactgagggcgctggacattgatcctagtatccagatttatatagcagctggtgagatctatggtggagacaggagaatggcaagtcttgcaaaggcttacccaaaattggtcaggaaggagaccctgttggaaccatctgaccttaggtttttccagaatcactcatcccagatggctgcattagattatctggtgtcactggagagcgatatttttgttcccacatatgatggaaacatggctaaagttgttgaaggccatcggagatttcttgggttcaagaagacgattctgttggatagaagactgctggtcagtttgatagaccagtacaatagtggatcactgagttgggatgagttctcatcagcagtgaaggattctcatgcagaacgcatgggaaacccagtgaaaaggttggtgatcccagacaggcctaaagaagaggattatttctatgccaacccacaagagtgtttgcagccattggacgaatcattgtcattgagtagtacgtgatctatatgttaggagattgtgacattgatcagtgttctgctacagtgctagcctttcagccatggagctgtagataggtttctacagaagtacagtgataatgaaggattttgttttgaagaggagatgatgaagattattgggagtggtaaaactacaagaaggcctgagaggatctatggaagcagccggggaaacaatattgtcttttacatatgccaataatcatccaattaatgtatagaagctaccttgtcatttacagggtgagagcagattgatctgcattgtacaccggggggatgcaaatatagatttggtttacgcaaagatgtagattcatggaaggttaatcccttatccttccattttgcattttttgtttcgttcggatcagccatggtcttctgatttcctctcagcatatataacattttaaatttatcagtttacacagattattgccactctcctattgcatggtggtcctattccatggaatcataggctgcggtgtttatgtacttcttacaagttactacattaattttatatgctcgggaaatgttcaacacttctagttaaatacatac

SEQ ID NO: 9976 - DNA, 2028 bp, Chrysanthemum coronarium
aaaggctatattgaatgtatgaatcaaatatgtgtagattagaagataagaataggaataaaataaagggtagatttgtgattggtacaatggggttaaagaaaaggttaagtgaaattagagttgataaatttagaaactcgatgcgttcgtcttcgagaatgaagatgtggttaattagggcgactactactgttttgttatggacttgtgttgttcagttaactgctttaggtggtacttggggtcctagggtgttaaaaggttggccttcgtgttttacttttgatgatcatgttgctaagtcgttagatatcccggttcctgttaagcatttggcggacaaaagagtgtataagaataatggctacttggttgtttcgtgtaatggaggacttaatcaaatgcgttccgcgatatgtgatatggttgcgattgctagatatttaaatgttactcttatagttcctgaattggataagacgtcgttttgggctgatccaagtgagtttcaagacatatttgatgttgatcatttcattacgtccttgagagatgaggttcgggtgcttaagcagcttcctcctaggcttaagaagaaagtggaattaggatttgtgcatactatgcctcctgttagctggtctgatatatcttactatcataatcagattcttccattgattcaaaaattcaaagttgtgcatttgaatagaaccgatgctaggcttgctaataataatcaaccccttgaacttcaaaagcttagatgccgaacaaattttgatgctttgagatttacacctcagatagaagatttgggtagacgtgttgttagcctattgagacaaaacgggccgtttctggtgcttcaccttagatatgaaatggatatgttagcgttttctggctgcactcaaggatgcaatactgaagaggtggaagagttgactagaatgagatatgcttacccatggtggaaagaaaagataataaattctgatttgaaaaggaaagacgggttatgtcctttgactcctgaagaaactgctcttacactaaaggcgctggatattgatcatgatatccaaatctacattgctgctggtgagatatacggtggaaaaagaagaatggatagtcttgcagaggccttcccgaaactggtaagaaaggagactcttttagggccagatgaccttcagtatttccagaatcactcgtcacaaatggcagcattggactaccttgtgtcactagagagtgatatttttgtacctacttatgatggaaacatggccaaagttgttgaaggccatcgcagattcttgggattcaagaagacgatactattggacaggaggcttctggttgatttaatagacagatatactagcgggtccttgaactgggatgaattctcgactggtgtcaaggaagcacatgcacaacgtatggggaatcctacaaaaagattggttatcccagatagaccgaaggaagaagattacttctatgctaatccagaggagtgtttgcagccatcagatgatgaacctttgagcatcatgtgacaaatggtggattattttggtcaaagtatctgtcgttggcctctattacagttttgtgaactgtcacaattagaaaaattatggttctctgctatcagaccagtcggtgtacaaggaagatctttccaaaatgtgaggatgcgacagcagagaccaaaatacattttggtgggactggtggttggagattcacgtaggacaacaatcttaccacgaacataaatggcgtttattattattactaatgtctcctttttcattctatatgtattgttattgtcaataatttctcattcatgtatagaaaccaccctgccattgcagggttatatcgtccgtattcagaactagctatatgtacacaaagcgggagtcgaaaccttagatatgtttttgctacgaggtattattgcaacataattctgtgccaactatgacatttgagcatatgttt

SEQ ID NO: 9977 - DNA, 2142 bp, Malus domestica
attgatgtgcaaggtggagaagaaggagagaaagggagtgatgggatttaaggtgttgggaggcggcggaggaggaggggaaaagttaaagaactcgatgctggtcacggcggcgtcgtcgccgtcgaggtcgaaaatgaagctgtggatgatccgtgcgacttcgtcggttttgttgtggacgtgcatcgtgcaattaacggctctgggggatatgtggggtcctagggttttgaaagggtggcctgcttgtttctctctggagtccgccgccgcctcctccgtcttgcaagacaggttgccttcccttccggccagagctcttccgcccaagagggtttataaaaacaatggttacctgatggtatcatgcaatggtggactcaatcaaatgagagcagcgatatgtgacatggttgctatcgcaagatatttgaacgtcactcttatagtccctgaacttgacaaaacctccttttgggctgatcccagtgaattcaaagacatatttgatgtggatcatttcatcacatccttgagagatgaggttcgcatattgaaagagctgcctcccagggtaaagaggagagtggagctaggaatgttttataccatgccaccagttagttggtctgatatgtcttattatcgtaatcagattcttcctctgatacaaaaatacaaagttgtacatctgaatagaactgatgctcgacttgccaataatggacaacctttggagattcagaaacttcgctgccgagttaatttcagtgctctgagattcacttctcagatagaggagttgggcagaagggttatcaggcttctaaggcaaaatggtccattccttgtacttcatcttagatatgaaatggacatgttggcattttctggttgtacccaaggttgtaacatcgaggaggtggaagagttgacaagaatgagatatgcttatccctggtggaaagagaaaataataaattctgatctgaaaaggaaagatggtttgtgtcctctgacacctgaagaaaccgctcttacattgagtgcccttgacattgaccgcgatattcagatttatatcgcagctggtgaaatctatggcgcagagaggagaatggcaagtcttcgagaggcttttccaaaattggtcagaaaagagacactgctggaaccatcagaccttaggttctttcaaaaccactcatcccaaatggcagcattggattatcttgtctcattggagagtgatatcttcgttcccacatatgatggaaacatggctaaagtggttgaaggccatcgcaggtttcttgggttcaagaagacaatcctactggacagaaggcttcttgttgatttgatagaccggtacactagtggatcattgaattgggatgaattttcatctgcggtaaaggaagctcatgcaaatcgcatggggaaaccaactaataggttgatgatccaagaccgacctaaagaggaggactatttctatgccaacccggaagagtgtttgcaaccatcagatgatgaactaagtagtacgtgatatacaacgttacaagatgcgtgacactcatccatgttctacagtgttggctactttcccacacagatctggaagaaaagttgtccacagaggtatagccataacgcgcattttgttctgaagaggcgatggagattgatgtagtgaagtaatcttcaagaagagcccgagaggatgcacgtatggtacgagctgtatgacatcttttatcttttgtatgagccccgaaataatccaaccaaatcatgtatagaaagctaccctgccattcagggtgagaacgaacttaaactgcattgtctgtggggtggggaagaacatatataggtttggttttactggaactgcgaaaaatcatcatcaaaaggtcaaaaccccttattccttacatttttttgtttttgcaatttttttgtttcttttagatcaacgaaacctatggtattgcgattctcatagcatattatatactacattctgaaagttttctgcttgcacagatcattgccctcttacccccgtattgtaacgccggtcccggtctaattcagagagaacggccacggccagccgggatccgatga

SEQ ID NO: 9978 - DNA, 1828 bp, Fagus grandifolia
ctttgatttaggggcgattgaactgtaaagggaaaaattacaattttgtttaggaatttagggatttatattgttgtgtttgtgttaagaaggaaaaacgaatcgttttgattgcatggggggaagagaagcgagatgtgcaggatagagaggaagggctgtgaatataacaaggaagaggaaaaggaaaaggaaaagagagagatgggattgaaggcaatgggtggggttgagaagttgaagagctctatgtctatgcccatgtctaggtccaggatgaagctgtggatgatacgcgccaccacttcggttttgctctggacttgcatcgttcagttgacggcgttaggggatttgtgggggcctagggttttgaagggctggccttcttgtttctcacaggactcctcttccgttaacaacgcccttacccaccccgatgttccgccgcgagttcttccacccaaaagggtttataagaacaatggttatctgatggtctcatgcaatggaggactcaatcaaatgagagcagcgatttgtgacatggttgctattgcaagatatttaaatgtcacacttatagtgcctgaactggataaagcctccttttgggctgatcccagtgagttccaagacatatttgatgtggatcatttcattacatccttgagagatgaggttcggatattgaaagaattgcctcctaggcttaagaggagagtggaactaggaagggtttattccatgcccccaatcagttggtctgacatatcttactatcataatcagattcttcccctgatacggaagtacaaagttgtacatctgaatagaactgatgctcgacttgccaataatggtcaacctttcgagattcagaagctgcgttgcagagtaaattttagtgctctgagattcacttctcagatagaggatttgggtaaaagggttatcaagcttttacggcaaaaaggtcctttcctagtacttcatcttagatatgaaatggacatgttggcattttctggctgcactcaaggttgcaacaatgaggaggtggaggagttgactaaaatgaggtatgcttatccctggtggaaagagaaaataataaattctgacttgaaaaggaaagatgggttgtgccctttgacacctgaggaaactgctcttacactgagggcgctggacattgatcctagtttccaaatttatattgcagctggtgagatatatggtggagaaaggagaatggcaagtcttgcaaaggcttacccaaaattggtcagaaaggagaccctgttggaatcgtcagaccttaggtttttccagaatcactcatcccagatggctgcattggattatttagtctcattggagagtgatatttttgttcctacatatgatggaaacatggccaaagttgttgaaggccatcggagatttcttgggttcaagaagacaattctactggacagaaagctgctggtcagtttgatagaccagtacaatagtggatcaatgagttgggatgagttctcattggcagtgaaagatgctcatgcagaacgcatgggaaacccattgaaaaggttggtgatcccggacagacctaaagaagaggattatttctatgccaacccagaagagtgtttgcaaccatcatacgaattattgagtagtacatgatctttatgttaagagattgtggacattcatctcctacagtgctagctttacccccatgaatctaaagattggtttctatagaggtacagtgataatgaaggtattttgttttgaagaggagatcatgaaagattag

SEQ ID NO: 9979 - DNA, 1678 bp, Prunus persica
attgatgtgcaagatagagaagaaggagagaaagggagtgatgggattcaaggtgttaggaggaggaggaggagacaagttcaagaactcgatgctcgtcacgacgacgtcgtcgccgtcaaggtcgaaaatgaaattgtggatgatacgggcaacgacgtcggttttgttgtggacgtgtattgtacaattaacggctttgggggatatgtgggggcctagggttttgaaaggctggcctgcttgtttctctcaggagtctgctgccgcctcttctgttttgcaagacaagttgccttccgtcccggccagagttcttccgcccaagagggtttataaaaacaatggctacctgatggtttcatgcaatgggggactcaatcaaatgagagcagcgatatgtgacatggttgctattgcaagatatttgaacgtcactctcattgtccctgagcttgataaaacctccttttgggctgatcccagcgagttccaagacatatttgatgtggatcatttcataacatccctgagagatgaagttcgcatattgaaagagttgcctccgagggttaagaggagagtggaactgggaatgatttataccatgccaccaattagttggtctgacatgtcttattatcataatcagattcttcctcttatacaaaaatacaaagtggtacatctaaatagaactgatgcccgacttgccaataatggacaacctttggatattcagagacttcgatgccgagtaaattttagtgctctgaggtttacttctcagatagaggagttgggtaaaagggttatcaggcttctaaggaaaaatggtcctttcctagtgcttcatcttagatatgaaatggacatgttggcattttctggttgtactcaaggttgtaacactgaggaggtggaagaattgacaagaatgagatatgcttatccctggtggaaagagaaaataatcaattctgacctgaaaaggaaagatggtttgtgtcctctgacacctgaagaaactgctcttacactgagcgcacttgacattgatcgcgatattcagatttatattgcagctggtgaaatatatggtgcagagaggagaatggcaagtcttgcaaaggcttatcccaaattggtcagaaaggagacactgttggaaccatcagaccttaggttctttcaaaaccactcatcccaaatggcagcactggattatcttgtctcattggagagcgatatttttgttcccacatatgacggaaacatggctaaagtggttgaaggccatcgcagatttcttgggttcaagaagacaattctactggacagaaagcttcttgttgatttgatagatcagtacacaagtgaatcagtgaattgggatgaattttcatctgcagtaaaggaagctcatgcaggtcgaatggggaacccaactaataggttgatgatccaagaccgaccaaaagaggaggactatttctatgccaacccagaagagtgtttgcaaccgttagatgaacaactgagtagtacgtgatatatataatgttagaagaatgtgacaatcatccatgttctacagtgttggctattttcccgcagatgtataagaaagttgtctacagagggatagccatgatgagattttgttctgaagaggcga

SEQ ID NO: 9980 - DNA, 3102 bp, Tripterygium wilfordii
caaccacatccctggccttcgtcgtcgtcgtcgtagcagccgctggttctctttgtcgctctatatttttttgcaatcgcattatcatcatggccggcgtgttcctccggtactaatcgatgagatcatattcgaaattgcatctcatttgatttgaattggtgtcatacaactaagtcgtatagttgccggattcgagatcggcggtctccttttgccggatttgagatcggctgtctccaaaaaaaccaatttcttcttgttcttcgataatccctgggaagtttccctacactgtctttgtacatcctcttcatgggccaattagacatgaccctaaaaaccaatctatctcactacactaggcccaaacctatcaggtgagacccgagtcaaacctgcctatcaaccaactgggttggtgacaattggcgaattggagaaggggttgtcgagggtaccaggattttcggttgctctggttgaaagttgcagttgttgaggtgttttcgatgggatttggcaaatgtttgggatatttctgtttcgattataggtttctatttgtggcaatttcggatctctatcagtcttgagcttaacaaggaaagtagcttttgtgctaatattcctggtgttttctttcctttaattatcaaatctagagtttcgttgtttgcgtccgagatacttttttcgcctgcattggcgaaattgaattgggaaacaaattgtggtgtttgtttgttttggttggtgtgatgaggagggatgtgcggggtagagaggggtggtgaaaggaattgtgaggttattctcaaaaaaaaaaaaaatgaaaggagagagcagaagagtggtggcggagaaggtgaagagcggttcgaggtcaaaaatgaagctttggatgatacgtgccaccacgtcggtggtgctgtggacttgcgtggtacagttgacgacgttgggggagatgtgggggcctagggttttgaagggatggccatcttgcttcttgcaggattctgccgccgtgttagaggataaggttcctatcttggccgccccggttctgccacccaagcgggtttataagaacaatggatatcttatggtttcatgcaatggaggtctcaatcagatgagagcagcgatatgcgacatggttgctattgcaaggtatttaaatgtcacacttattgttcctgagctggataagacatccttttgggctgatcccagtgagttccaagacatatttgatgtggatcatttcattacatcgttgagagatgaagttcgaatattgaaagaattgcctcccaggcttaagaggagaatggaactaggagtgattcgtacaatgccaccagttagttggtctgatatatcttactatcgtaaccagatccttcctcttatacaaaagtacaaagttgtgcatcttaatagaactgatactcgacttgccaataatggtcaacctttggagcttcagaagttgcgctgccgtgtaaattttagtgctctgagattcacttcgcagatagaggaattaggcaaaagggttgtcaagcttttgaggcagaatggccctttcctggtactccatcttagatatgaaatggacatgttggcattttctggctgcacacaaggttgcaaccatgaggaggtagaagagttgacaagaatgagatatgcttatccatggtggaaagagaaaattataaattctgacttgaaaaggaaagatggtttgtgccccttgacgcctgaagaaactactctaacattgagggcattggacatcgatccggatatccagatctatattgcagctggtgaaatttatggtggagaaaggagaatggctactcttgcctcggcatatcctaaattggtttgtcagaaaggaagtactgttggaaccatcagatcttaggtttttcgagaatcactcatctcagatggctgctctggattatattgtttctttagaaagtgacatttttgttcctacatatgatggaaacatggctaaagttgtcgaaggacatcgaaggttcctgggtttcaaaaagacgattgtgttagacagacggtttttggttgatctgatagatcgttacactattggatcactgagttgggttgagttctcatcagctgtaaaggaagctcatgcagatcgcatggggactccaaggaaacggcttgttattcctgaccgacctaaagaagaggactacttctattccaatccagaagagtgcttagaaccatcacatgatctgttgagtagtacgtgatttttacatgagaagataattatatttatctgtgtcatttgaattggagtacgtatttcaaaacagatccaaggacagttctctacaaagaggtatggtaattctgaaggttttgtccttgaaacttgaaagcagatggagaggataaatagggatggtatattgtgcctgatgactgatgggccacacaaggaaagctactggaagggtgttgtcaactttgataaagacaattgtgcaatgcatgtattgaaggtaccctgccattattggggttatgaagattaaagacttggaagttggagcattgaagtacaagcttggtttagcggactggacccgtaaaaggttaatccctctacctacatgtattttgttgttgattggattgactccagcttgtgattttattattttttttgcatatattaccttcgtaaaagtttaggcattcagaaaattgaggtagaaatcattgttcttccttatttccccctcttcccagtgtactcaactattactggaaatgataccaagtctagactgcatattctctgcaggaatcccgtctggatgattagatttgtaggagaaatgttaatgagaggttgtttgtgtactaatgctataatggctctttcccaagcgtctcccggttttctaagcaggagtacatataatcaacacccacaagcaaattctgtatgtccaaatgctgctcacacaaagataatatacctaaaatcaagtgaatctaagaactcacccttgtgagtacacagtagagatgcta

SEQ ID NO: 9981 - DNA, 2089 bp, Manihot esculenta
aaatgtgcaggatagaaaggagcgataggaagagtggtgaaattggggagagaagagaaagagaaaaggaaatgggaacgagtaaaggagtggagaaggtgaagagtatatcgaggtccaaaatgaagatgtggatgatacgcgccaccacttcggtgttgttgtggacatgtgtcgttcaattgacgacgatcggtgagatgtgggggcctagggttttgaaaggatggccctcttgtttctcgcacgaatcagctgccgccctggaggagaaggttctcactgtgcctgctcgagtgctgccaccgaagagggtttacaagaataatggctacctcatggtttcatgcaatggaggtctgaatcaaatgagagcagcgatttgcgatatggttgctattgcaagatatctgaatgtaacgcttatagttccagagcttgataaaacttccttttgggctgatccaagtgagtttcaagatatatttgatgtagaacatttcattgcatcattgagagatgaggtccgtatattgaaagaattgcctcctaggctgaagagaagaatggagctagggatgactcgtacaatggctccagttagttggtctgatatatcttattatcataaccagattcttcctttgatacagaagtacaaagttttacatcttaataggaccgatgctcgacttgccaataatcatcaacctctggagattcagaagttgcgctgtcgtgtaaattttagtgctttgagatttacttctcagattgaggagttgggtaaaagagttataaagcttcttaggcaaaatggtccatttctagtgcttcaccttagatatgagatggacatgttagccttttctggttgtactcaaggttgcaacaatgaggaggtagaagaattgacaagaatgaggtatgcttatccttggtggaaagagaaaataataaattctgacttgaaaaggaaagatgggctgtgccctttgaccccagaggaaacagcccttacattaagggcattggatatcgatccaaatatacagatctatattgcagcgggcgagatatatggtggagaaaggagaatgaccagtcttgcagctgcttaccccaaactggtcagaaaggaaacgctgttggaaccttcagaccttaggttttttgagaatcactcatctcagatggcagcactagattatcttgtctcattggagagtgatgtctttgtccccacatacgatggaaacatggccaaagttgttgaaggccataggcgattcctggggttcaagaagacaattttactggacaggaggcttttggttgatctgatagataggtacaataatggatcactgagttgggatgagttctcttttgctgtaaaagaatcacatgcaaatcggatggggaacccagtgaagaggttggtgattccggagaggccaaaagaggaggattacttctattccaacccagaagagtgtttatcgtcttcagaggatcctttggatcctttgagtagcacgtgacaattattatttagaagattgtgatgtttattctaccacagatgaaaggatagttctctacgctggaggaatagcgataaaaggaagattttgcaatcaagaagataatatggggctggtaaacttgaagaaagcctgagatgatgtatgggagcgtttgtaggacgttatcatcctctgggtatgtgccaataatccaattcatgtatagaagctgccctgccattccagggtgatgtccaatcaacaaaatcgggaggaatgcaaatatagacgtggtctaccagaaatatgttaccaaggaaggtcactacatcatcatccttccattttgtacttcttttattggttcgattctgatatttgatagcgtccactctagcaaatatcgtattttagaaatttctattcccttattattactgagatggatgtttgcttctccctgctttggtcaagtccggcttaaacttcggaggaaatggtcccaagtgccaattatgtattcttttagtgcttatattgctataaatggcagctgttta

SEQ ID NO: 9982 - DNA, 2790 bp, Cannabis sativa
gattgtagagatccaatggttcatcaattgatagttcactcacacacatgactgtatatttccataaatctcaattatatctcagcgcgtgttatctacctcccaaattagtgacgccgtacccttatttcccggctaaggttgaggccggaattattattctgatcttgcgagaagacaaggagttaagcggcatttccccggtgattttttattttatttttttgtcggtgatcggctaaagatcggagttcggtgcaatgtggttagggaattgaggtgttttcgaggctgttttgtgaaattcggtgaggtttttgctgggtattttttgttttcctttttgagattttttggcgaggactggaatttggatcttggagatttggatttgtggtggagaagacgaaaggaaaggagagaagaggtgtatatgaatgcttaagagtggtagaaggaaggaaaaaaaggaaaagggtttgagaaagaggattgatgtgcaggtttgagaagaaggagaagaaagaaggaacaatgggatttaagtcttttggaggagagaagttgaagacgacgatgggtatgagtacggcgccttccaggtcgaaaatgaagctgtggatgatacgtgcaaccacgtcggtcttgctatggacctgcatcgttcaactgacggctttgggggacatgtggggacctagggttcttaaaggatggccttcttgcttctctcaggaggctgctacagccatctccgttctgcaagacaaggctctgaacgtacagactagagtacttcctcccaagagggtttataagaacaacggttatttgatggtttcctgcaatggcggacttaatcaaatgagatcagcgatttgtgacatggttgctattgcgagatatcttaatgtcacacttatagtgcctgaattggacaaaacatccttttgggcagatcctagtgagtttcaagacatatttgacgtggaccatttcattacctctttaagagatgaggtccgcatattaaaggaattgcctcccaggctcaaaagaagagtggaattaggtggagtttatacaatgccaccagttagttggtctgacatttcatattatcataaacagattctgcctcttatacagaagtataaagttgtacatctcaacagaactgatgcgagacttgccaataatggtcaacctttggagattcaaaggctacgctgccgtgtaaattttagtgctctaagattcacttctcaaatagaggaattgggtagaagagttatcaggcttcttaggcaaaatggtccagtcctagtacttcatcttagatatgagatggacatgttagcattttctggatgcacccaaggttgcaacaatgatgaggtggaagagttaacaagaatgagatatgcttacccctggtggaaagaaaaaataataaattctgacttgaaaaggaaagatggtttgtgtcccttgacaccggaagaaactgctctcattttgactgcaatgggaattgatcccaatgtccagatatatatcgcagctggtgagatatatggtggagagagaagaatggcaagtctagcaaaggctttcccaaaagtggtaagaaaagagactctattgaatccatcagaccttaggtttttccagaatcactcatcacagatggcagcattggactatcttgtttcattggagagtgacatctttgttcccacatatgacggaaacatggctaaagttgttgaaggccatcgcagatttcttgggtacaagaagacaatattgttggacagaaggcttctcgttgatttgatagaccaatacagtagtggatcacttagttgggatgaattttcatctgctgtaaaggaaacacatgcagaacgcatggggaacccaactaaaaggttggtgattcctgacagacccaaagaagaggactatttctatgccaatccagaggagtgtttagaattgtcggatgaacaattaagcagtacatgattatttacgctaggaatattttgtgacattcatcatcagtgttctcccacagttggtagtagcttttaattaacaagagaccgttaagagaattctctatggagaattatatagagtgggatgggattttgtttcaatcatagaggccataatgaaagattaaaagaattccaagaagaaaggatctatggatcaactggaggaccaatccattacctttattatatatgaaaatattgccaaataatccactcaaaatttatgtatagaagaagccaagggagacaacagatccaactgccacttacacgagagaaatatgcgaagaaagagggaactgctggagtcatgagaggtcaatgtccttttcttttctctaatagtttcctttcctttccttttttctttaatttttttattccatatgtaatagtaagcccatggtttcgtgcttttgtggccataaaaatagtacaattcctttaagatttttctgtttgcacatattgttacctcattcctgttctgtggcgtgcctatatatagaattatatatatacaagtatattaaacagggaatgaagtgtgtgcgatatattttgtatttactttttgcagatcacgtaaataaatttaaatgttcctagaatgttaatactgtaactctttatttggtgtatatgggtgtggggtggggctttcaagatagtttggttttggttcctcactcttaatatgtatactaggttgatattccta

SEQ ID NO: 9983 - DNA, 2006 bp, Manihot esculenta
aaatgtgcatgataggaaggagtgagagaaagagcggtgaaagtggggagagaagagaaagagagaaggaaatgggaatagtaaaaggagtggagaaggtgaagagtatatcgaggtcaaaaatgaagatgtggatgatacgcgccaccacgtcggtcttgttgtggacttgtgtcgttcaattgacgacgatcggcgagatgtggggacctagggttttgaaaggatggccctcttgtttctcgcatgaacctgccgccgccctggaggagaaggttctcgctgttcctgctcgagtgcttccaccgaagagggcttacaagaacaatggctacctcatggtttcgtgcaatggaggtctaaatcaaatgagagcagcgatatgtgatatggttgctattgcaagatatttgaatgtaacgcttatcgttcccgagcttgataaaacttccttttgggcagatccaagtgagtttcaagatatatttgatgtagaacattttattacatcattgagagctgaggttcggatattgaaagaattgcctcctaggctgaagaggaggatggagctagggatgacttataccatggccccagttagttggtctgatatatcttattatcataaccagattcttcctttgatacagaagtacaaagttttacatcttaatagaactgatgctcgacttgcaaataatcatcaacctctggagattcagaagttgcgatgccgtgtaaattttagtgctttgagatttacttctcagatagaggagttgggtaaaagagttataaatcttctcaggcaaaatggtccatttttagtacttcacctcagatatgaaatggacatgttggccttctctggttgtactcaaggttgcaacaatgaggaggtagaagaattaacaagaatgagatatgcttatccttggtggaaagagaaaataataaattctgacttgaaaaggaaagatgggttgtgccctttgacaccagaggaaacagcccttatattgagggcattggacattgatccaaacatacagatctatattgcagcaggtgagatatatggtggagcaaggagaatggcaagtcttgcagcagcttatcccaagctggtcagaaaggaaacgctgctagagtcatcagaccttaggttttttcagaatcattcatcccagatggcagcattggattatcttgtttccctggaaagtgatatttttatccccacatatgatggaaacatggctaaagttgttgaaggtcataggcgattcctgggatacaagaagacaattttactggacagaaggcttttggttgatctgatagacaggttgaacaatggatcgcttagttgggatgagttttcttctgctgtgaaagaatcacatgcaaaccggatggggaacccagtaaagaggttggtgattgcagacaggccgaaagaggaggattacttctattccaatccagaagagtgtttacagccttcagagaatcccttggatccttcaagtagcatgcgacaattatttaggtgattgtgatgttttgtcaaatcgttcaccacagtcctagtaattttaccacagatcaaagggacagctctcaacacgaggtatagtgagaatggaagaggagatcaagaagttaatatgagttggtgagcttgaagaaagcctgagatgatctatgggagcggtagtgggacattatcatctttagtatgtgccaataatccaattcatgtatagaagctaccctgccatttacagggtgatgtcaaatcaacaacaaaagtggggttgtacacacaggtttgcaaatataggcgtggtctaccagaagtgtggcctaaaggaaggttactccttcatcctgccattttacttttttttttttgttgttttttggttggttcgttcatgatattctgagtttctagcaaatatcatattttataaaagtttctatccccttattactgt

SEQ ID NO: 9984 - DNA, 2637 bp, Malus domestica
cgcacgcctttcacgcgtttttcgttcctctctctctctcctctctctctctctctctctctctctagaattgctagcaacacatgatgtcatgacaccaccaccaccactgctcgtcttcttccctctctccttcgcctacatcccaatctctctcgcttcttaaatcgctgccccccccgcggcgaaagctgcagcgactgatatcgccggagaacacggcggatctgggagggaattgcagctcgcatttgggtttggattgcccgggtctggaattcgagtgtggcggcaaagatcggagctttgcaattttttaatttgggatttttgtttttgctgtgagaaattagggatcttgatgcaatttttggagggaatcttcgagcgcgagagttttggagcaaatctttgaggaatgtggtgagcattttggctccgttttgggaaatcgggttctcggatctttgctgttttctataaatagcgggagctcaaaaaaggaaagccatttttttggatccggtatcggccaagacgcaccgttttgggccactgcgttgatgtttgtagggggaggaagagagagaatatacagagattgatgtgcaaggtggagaagaaggagaggaagggagtgatgggaattaaggtactgggaggcggcggaggaggggaaaagttaaagaactcgatgctggtcacggcggcgtcgtcgccgtcgaggtcgaaaatgaagctgtggatgatacgtgcgacgacgtcgattttgttgtggacgtgcatcgtgcaattaatggcgttgggggatatgtgggggcctagggttttgaaaggctggcctgcttgtttctctcaggagtccgccgccgcctcctccgtcttgcaagacccattgccttctcttccggtcagagctcttccgcccaagagagtttataaaaacaatggttaccttatggtctcatgcaatgggggactcaatcaaatgagagcagcgatatgtgacatggttgctatcgcaagatatttgaacgtcactcttatagtccctgaacttgacaaaacctccttttgggctgatcccagtgaattcaaagacatatttgatgtggatcatttcatcacatccttgagagatgaggttcgcatattgaaagagctgcctccccgggtaaagaggagggtggagctaggaatgttttataccatgccaccaattagttggtctgacatgtcttattatcgtaatcagattcttcctctgatacaaaaatacaaagttgtacatctaaatagaactgacgctcgacttgccaataatggacaacctttggagattcagaaacttcgctgccgagtaaattttagtgctctgagattcacttctcagatagaggagttgggtagaagggttatcaggcttctaaggaaaaatggtccattccttgtacttcatcttagatatgaaatggacatgttggcattttctggttgtactcaaggttgtaacatcgaggaggtggaagagttgacaagaatgagatatgcttatccctggtggaaagagaaaataataaattccgacctgaaaaggaaagatggtttgtgtcctttgacacctgaagaaactgctcttacattgagtgcccttgacattgaccgcgatattcagatttatattgcagctggtgaaatctatggtgcagagaggagaatggcaagtcttggaaaggcttttccaaaattggtcagaaaggagacactgttggaaccatcagaccttaggttctttcaaaaccactcatcccaaatggcggcattggattatcttgtctcattggagagtgatattttcgttcccacatatgatggaaacatggctaaagttgttgagggccatcgcaggtttcttgggttcaagaagacgattctactggacagaaagcttcttgttgatctgatagaccagtacactagtgggtcattgggttgggatgaattttcatctgcagtaaaggaagctcatgcaaatcgcatggggaacccaactaataggttgatgattcaagaccgacctaaagaagaggactatttctatgccaacccggaagagtgtttgcaaccatcagatgatgaactaagtagtacgtgatacataatgttagacgacttctgacactcatccgtgttctacagcgctggctactttcccacacagatctattagaaaaaaattgtctacaataacgagcgttttgtcctgaggaggcgatggagattgtccaagtggaagtaatcttcaagaagagcccgaggggatgcacgtatggtacgagctgtagtacatcttttatcttttgtataagccgaaataatccatccaaatcatgtatagaagctaccctgccattcaggggtgggaacgaaattaaactgcactctgtgtggggagggaagatcatatatagctttggttttttactggaactgcgaaaaatcatcaagaggtgaatccctattccttacattttttatttttttttttaatttttttgtttcttttagatcaaaccctatggtattgtgattcccttagcatattatatactacatcctcaaagttttctgcttgca

SEQ ID NO: 9985 - DNA, 2195 bp, Daucus carota
ctgtcagtagatttgtttcatctgggctgcaatctttttgtcattgtgtggtaaagctacattctttttagccttttgagtaacaaatcacttgctttcaagaattcacagttatagaattcttggatcttgaacaatcaaataaagatcagatctttacattttttggaaccattgtttgtgattttggtttgctgagctggtgatgatattcacaagttgatttgggtaagttttgattttttgagtgtatataggaatagtatgtgtaagatagagaagaggggatatattgaaatggggttgaaatcatttggtggtgagggtaaaaaggggattgacaagtttaagagttcaatggtgtcaaggtctaagatgaagctttggatgattagagcaactacttgcattttgttgtggacttgtttagttcagttgacaactttgagtgagatgtggggagctagagttttgaagggttggccttcttgcttttcccatgaatctgctactgctatggatgttataatcacaccggctcttccggctcgagttcttccacccaagagggtgtataagaacaatggctatttgatggtttcatgcaatggaggtcttaaccaaatgcgtgcagcgatatgcgacatggtagctatagcaagatatttaaatgttacacttattgttcctgagctggataaaacttctttctgggctgatccaagtgagtttcaggacatttttgatgtcgaccatttcatttcatcactgagggatgaggttcgtatactgaagcaactgcctcccagagttaagaggagagtggaactaggattgttttacacaatgcctcctgtcagttggtctgacatttcttattatcataatcaaattctccctctgatccagaaatacaagattgtgcatctgaataggactgatgctcggcttgccaacaatggtctgccactagagatgcaaaagcttcgatgccgagtaaacttcggtgctctgagatttacttctcagatagaggagttgggaaaaagggtaatcaagcttttaaggcagaatggtcctttccttgtacttcatctcagatatgaaatggacatgttagcattttcgggttgtaaccagggatgcagcaatgaagaagtagatgagttgacacgaatgagatatgcctacccatggtggaaagagaaaatcataaattctgacttgaaaagaaaggatggtctatgtccattaacccccgaggaaactgctcttacactgagggcactggacattgatcgtgatatccaaatctacattgccgctggagagatttatggcggagaaaaacgaatggctagtctcactgctgcttatccaagagtggtcaggaaggaaactcttttggactcgtcagaccttggatatttccagaatcactcttctcagatggcagcactcgattatcttgtttctctagaaagtgatatttttgttcctacatatgatggaaacatggccaaagttgttgaaggccaccgcagattccttggtttcagaaagacgatattattggatagaaagctactagttgatttaatagatcaatataatcacggttccttgaattgggatgaattctctagtgctgttaaggaagcacattcagatcgcatggggaaccccacaaaaaggttggtgattccagacagaccaaaggaggaagattatttctatgccaaccctgatgaatgcttgcaatcatcagaaatgtcggaggaaagattagaaatcttataattgactggggaacgctctgttgttttgactagtggactacattgtgaatctaccatactggggatcaaagttctcttattactgaatcattagagatgacgagtatcttgttctgaggaggaaattgaaatgatggcaaggactgtgcaatttcgccactaaagaggatcatcaggaccaggtggagtttcatgtaaattctcggttgtattgtattaattatctaataatttggttcctgtatagaagataccctgccattacagggttatactgaacttcaccgtcctcggtgtacgcaaatggatagcatgcattagtccctgttcatttgacatgcggttctctgtaggcacactatcgattatcgaatatatagataccatcaatatagt

SEQ ID NO: 9986 - DNA, 2106 bp, Cirsium arvense
ctctattttatccaacaatctaatctaatctaatctactactgtcactagctcttcaatattgaaatctctctttccagatccacactctgcttttccatcctccattttcataccttagggtttcatccatccagtattcattcatcctgtttacgaaattctgcatctcgataacattataactacgttagctgtcaattgagttgcgtatggatttattatggtggatttggatttaggttagggttttggtagtaggtgaatcgatcgatcgatctctaatggaaggaggaatatgtaatgttgtgttatagtataagaggagatttagttaggattggaaaagcatggggttgaaagcgtttggaggaagtagagtagagaaattaaggacaaggtctcctgctaagatgaagctgtggatgattagggctactacggtggtgttactgtggacttgtttggttcagttgacggcattaggtgatacttggggacctatggttttgaaaggttggccttcttctcgtgattctctttctgcagcacctactttggatgccaaattgttgccaattgttcctgctagagttcttccaccaaagagggtttacaagaacaatggttacctactgatttcgtgtaatggaggacttaatcagatgcgatctgctatatgtgatatggttgcaattgcaagatacttgaatgttactctcattgttccagagctggacaaaacttctttttgggctgatccaagtgaatttgaggacatttttgacgttgatcatttcattacatccttgagagacgaagtccggatacttaaaaagcttcctattaggcttaaaaagagagtggaattaggaatcattcataccatgcctcccgttagttggtctgatatttcatactaccacatgcagattcttcctttaattcaaagatacaaagttctgcatttgaatagaaccgacgctcggcttgccaatagtggtcaaccgctcgaccttcagaagctcaggtgccgggtaaatttcagtgctcttagattcactactcagatagaagagttgggtagacgggttgttaagcttttgagacaaaacggaccctttctggtacttcacctgcgttacgaaatggacatgttagcgttttctggttgtactcaaggatgcaatgatgaagaggtggaagagttgacacgaatgaggtatgcttacccatggtggaaagagaagatcataaactctgagttgaaaaggaaagatggtttatgccctttgactcctgaagagaccgcacttgcattaagggcacttgacatagatcgtgacatccagatttacatcgctgctggtgaaatatatggtggtgaaaggagagtggctagtcttgcagccgcatatccaaagctggttaggaaagagactctattggcaccagcggaccttcaatttttccagaaccattcgtcgcagatggcagcattggactatcttgtatcgctggagagtgatgtttttgtccctacttttgacggaaatatggccaaagttgtcgaaggccatcggagatacttgggtttcaagaagacaatattattggatagaaaactacttgtcgaattaatcgacaaatacacaagtaaatcattgagttgggatgaattctcgagcgctgtcaaagccgctcatgcacaacgcatgggaaaccccacgaaaagatcggttattcccgacaaacccaaagaagaagattacttctatgcaaatccagaagaatgcttgcagccctccgacaacgaacctgtgaatattatgctctaattccgccttcatttttgtcaacaatttttacgaatccatccggaattctaccctgcaacaaaacctagatcgcgatttgaacgggtggtcggagcggagacacatcaacgaggctggatctttcgtacgaaccaagatggtgtgtatttaattaatctcttgcctcttatttttctacacgcatcatcattgtcaataactccgattcatgtatagatacgataccaccctgacattccagggccatattcataactattaaagtccca

SEQ ID NO: 9987 - DNA, 2000 bp, Daucus carota
ttgtgattttggtttgctgagctggtgatgatattcacaagttgatttgggtaagttttgattttttgagtgtatataggaatagtatgtgtaagatagagaagaggggatatattgaaatggggttgaaatcatttggtggtgagggtaaaaaggggattgacaagtttaagagttcaatggtgtcaaggtctaagatgaagctttggatgattagagcaactacttgcattttgttgtggacttgtttagttcagttgacaactttgagtgagatgtggggagctagagttttaaagggttggccttcttgcttttcccatgaatctgctactgctatggatgtcatgatcacaccgtctcttccgactcgagttcttccacccaagagggtgtataagaacaatggctatttgatggtttcatgcaatggaggtcttaaccaaatgcgtgcagcgatatgcgacatggtagctatagcaagatatttaaatgttacacttattgttcctgagctggataaaacttctttctgggctgatccaagtgagtttcaggacatttttgatgtcgaccatttcatttcatcactgagggatgaggttcgtatactgaagcaactgcctcccagagttaagaggagagtggaactaggattgttttacacaatgcctcctgtcagttggtctgacatttcttattatcataatcaaattctccctctgatccagaaatacaagattgtgcatctgaataggactgatgctcggcttgccaacaatggtctgccactagagatgcaaaagcttagatgccgagtaaacttcggtgctctgagatttacttctcagatagaggagttgggaaaaagggtaatcaagcttttaaggcagaatggtcctttccttgtacttcatctcagatatgaaatggacatgttagcattttcgggttgtaaccagggatgcagcaatgaagaagtagatgagttgacacgaatgagatatgcctacccatggtggaaagagaaaatcataaattctgacttgaaaagaaaggatggtctatgtccattaacccccgaggaaactgctcttacactgagggcactggacattgatcgtgatatccaaatctacattgccgctggagagatttatggcggagaaaaacgaatggctagtctcactgctgcttatccaagagtggtcaggaaggaaactcttttggactcgtcagaccttggatatttccagaatcactcttctcagatggcagcactcgattatcttgtttctctagaaagtgatatttttgttccaacatatgatggaaacatggccaaagttgttgaaggccaccgcagattccttggtttcagaaagacgatattattggatagaaagctactagttgatttaatagatcaatataatcacggttccttgaattgggatgaattctctagtgctgttaaggaagcacattcagatcgcatggggaaccccacaaaaaggttggtgattccagacagaccaaaggaggaagattatttctatgccaaccctgacgaatgcttgcaatcatcagaaatgtcggaggaaagattagaaatcttataattgactggggcacgctctgttgttttgactagtggactgcattgtgaatctaccatactggggatcaaagttctcttattactgaatcattagagatgacgagtatcttgttctgaggaggaaattgaaatgatggcaaggactgtgcaatttcgccactaaagaggatcatcaggaccaggtggagtttcatgtaaattctcggttgtattaattatctaataatttggttcctgtatagaagataccctgccattacagggttatactgaactagaccgtcctcggtgtacacaaatggatagcatgcattagtccttgttcatttgacatggggttctttgtaggcacactattgaatatatacataccatcaat

SEQ ID NO: 9988 - DNA, 1718 bp, Flaveria ramosissima
gggggacaacaatggtgttactgtggacttgtttggttcagttaacaacattaggggatacttggggtcctagggtgttaaaaggttggccttcttcattcactcatttagatgcgaagtttttgcctgctgattctgctagggttcttccacccaagagggtttaccagaacaatggttatctaatggtatcatgtaatggaggactcaatcaaatgcgatctgcgatttgtgatatggttgcaattgcaagattcttgaatgttactcttatagttcctgagttggataaaacatctttctgggctgatccaagtgagtttgaagacattttttgatgttgatcatttcattacgtcccttagagatgaagtccgaatacttaaacaacttcctcctcggcttagaaagagagtggattctggaattgtgcataccatgcctcccattagctggtctgatatttcatattatcataaccagattcttcctttgattaaaaaatacaaagtcgtgcatttgaatagaacagatactcggcttgccaataacggtcaacctcttgaacttcagaggctcaggtgtcgagtaaattacgatgctttgagatttactcctcagatagagtacttgggtaggcgtgttgtacaacttctgagacaacgcgggccatttctagtgcttcatttaagatatgaaatggacatgttagcattttctggatgcacccaaggatgcaatcttgatgaggtggaagagcttactagaatgagatatgcatacccatggtggaaagaaaagattataaactctgaattgaagaggaaagacggattgtgccctttgactcccgaggaaacggcccttacacttagggcactcggcattgataggaacatccagatttatattgctgcgggtgaaatatatggcggtcaaaggagaatggctagtcttgcagccgctttcccgaagctggtaagaaaagagactttattaggggcagacgaccttcaattttcccaaaaccattcgtcacaaatggcagcactggactatcttgtatcgttggaaagtgacatttttattcccacttattatgggaatatggccaaagttgtagaaggtcatcgcagatacttgggtttcaagaaaacgatatcactagatagaaagctgttggttgaactaatagacaaatatacgagtggatcattgagttgggatgagttctcgaacgctgtaaaggatgcacacgcaacacgaatggggcaaccaaaaaaccgagtggttattccagatagacctaaagaagaagattactttcattcaaatccagaagaatgcttacagtcattagagactaaacctgtgagcattttatgatgacacttttgtggattaccttacttgggtctaaagttggaagattatggttagtcacccttgacccagtggtgcaccaggcgggttgatcttgactttgagcctgcgattgtgtcggtgggaggatggagacgtttagaagagcgtatttggtacagttgatatgcgggtttattatttagtatcttaaattttttctttttagttgcatattattgctaataatgcaaattaatgtataggaaccgccctgatattgcagggttatatattggtcctcataactactgatatgtacatgcccatttgaagtatagattattttcgtcacg

SEQ ID NO: 9989 - DNA, 2406 bp, Euphorbia peplus
acaaaccgagcatttttatttcggttgggtagcgatccatcgaagcggtgtacggttcggttcggttcagcatttcacccatacgccggtctggttggttctccggcgaggtgtggtttcttgttgtgtcggtggatgtaaatttgagaattagggataagaaatagaatgctgggtttgttgtcttttccattattattattttaaaattcttgatctgttatttttacttttttggcaactttggatcttggaagattgcgtaggaaatctaggggaagaagcaacgtttttgttcacattttatatctgtttgttccgaaattaaggctttctgtttgctttgaggatcctacattgttcaaattttgggataagactgaatgtgggataggatagagtgagagttaaattcgggtttagggattatgggggttggtaaaggagttgagaaggtgaagaagagtatatccaggtctaaaatgaagatgtggatgatacgcgccaccacttccgtgttgttgtggacgtgtattgttcaattgacgaccatcggtgagatgtggggacctagggttttgaaaggatggccctcttgtttctctcatgaatcttctgctgccttgcttgagaataatctccctgctgttcctgctcgattgctgcccccgaaaagggtttataagaacaatggatatctcatggtttcctgcaatggaggtctcaatcaaatgagagcagcgatatgtgatatggttgctattgcaaggtatttgaatgtcacacttattgttcctgagctggacaaaacttcattttgggctgatcccagtgagtttcaagatatatttgatgttgatcatttcattacatcattgagagatgaagttcggatattgaaagaattgcctccgaggctgaagggcagagtggaactggggatgacatataccatggcaccagtcagttggtctgatatatcttattatagcaatcagattcttcctttgatacagaagtacaaggttctacatcttaatagaactgatgctcgacttgccaataatcatcaacctcttgaaattcagaagctgcgttgccgtgtaaactttagtgctctgaaattcacctctcagatagaggagttaggcaaaagagttataaatcttcttagaaaaaatggtccatttttagtacttcacctcagatatgaaatggacatgttagcattttcgggctgcacacagggttgcaataatgaagaggtagaagaattgacgagaatgaggtatgcttatccttggtggaaagagaaaataataaattctgatctaaaaaggaaagatggattatgtcctttgacaccggaggaaactgctctcacattgagagcgttggacatcgatccaagcatacaaatatacattgcagcaggtgaaatatatggtggagaaaggagaatggcaagccttacagcagcttatccaagagtggtcagaaaggaaaccctgttggaaccattagacctgagattttttcagaaccactcatctcagatggcagcattagattatcttgttgctttggagagcgatatctttgttcctacttatgatggaaacatggctaaagttgttgaaggccaccggagattccttggattcaagaagacaattttactagacagagggcttttggtcgatttaatagacagatacaatggcggagccttgagttgggatgagttttcagatgctgtaaaagaagcacattcagatcggatggggaacccgacaaagaggttggttatcccagacagaccaaaagaagaggattacttctattcaaacccagaagagtgtttccagatttcagatgattatcccttgagcagcacgtgaccataatttaggagattatgacgttttgacacattggtcttgtctctccacagtcctagtaattgtaccacagatgaaacatagttttcttgccaagaagactttgttatgggaagggcaaagaagaaagttatacgtgactttgcaggaaggaagacttggatggtcgggtcctaggggagcaagcagtcaggtaatgatatcgtgttagtaaaaagaaatgccaataatccaattcttatgtatagaaggctgccctgccattacagggttgtacacagagcgaagcaaatatattagatatatatggcctcaaggaaggtctctctctctccaccacacctttccatctagtttttgtttaactttgttattttcgcttgcattgttggatatggtattttataagtaccccccattcacacattctctgagagtagaatgatccttaagcttgggttagctataatgtaaatgcctttatttgtcctaatttgtttaggcc

SEQ ID NO: 9990 - DNA, 2501 bp, Cajanus cajan
aaacacaaccctctctctctctctctctctcgctcgctcgttaactcggtctggttacgagttacgtccctgttcggacgcgcttctctgaacacacacagacgcgcgctttcggttatcgttgttattatccggtgtttggttgagcattgtaagaattgcgccctcgctggccggcgatctgaggtcggagatctcggcggtcggtaatgcgcgtcggaggcgagggtggcggcggcgggttttggatctgggattggggaaattgagcggcgaattagggttggtgagggggggtgcatttatgaaggaggcggtgctgggtgggggagagaagagtgagaggaagagagggagggtggtgtgggaagggttcatgacgatgggcttcggcaacaccaacaacggtaaggtgaagaattcggtgaggccttccaccatgaagctctggatgatacgcgcgaccacatcggtcttactgtggacctgcgtcgttcagttaaccgcgttgggtgacacgtgggggcccagagttttgaagggctggccttcctgcttcacccacgagtccgcgctcattgagtttccgtcttccacacccgcggttctccctcccaagagggtttataaaaacaacggctatttgatggtgtcgtgcaatggaggattgaaccaaatgagagcggcgatatgtgacatggtggcgattgcaaggtatttaaatgtgacgcttatagtgccggaattggataaagcgtccttttgggctgaccccagtgagttccaagacatattcgatgtggatcattttattacatccttgagggatgaggtgaggatattgaaagagttgcctccaagactcaagacgagagtggaaaatggattgttttacagcatgccaccgattagttggtctgatttatcttactataagaaccagattctacctttgatacaaaagtacaaagttgtccatttaaatcgaacagatgcccggctggccaataatggtcaacctttggaggttcagaggttgcgttgcagagtcaattttagtgctcttagatttacttctcagattgaggagttaggcagaagggtgatcaagcttctgaggcaaaatggcccttttttggtgcttcatctgaggtatgagatggacatgctagcattttctggctgtacgcaaggttgcaacagcgaagaggtggaagaattgacaaggatgagatatgcttatccttggtggaaagaaaaaataattaattctgatttgaaaagaaaagatggtttgtgtcctttaactcctgaggagactgcccttacacttagggccctagacatcgatcaaaacattcaaatctacatcgcagccggggaaatatatggtgggaaaaggagaatggcaagtcttgcgaaggactatccaaaattggttagaaaggaaacactgttggaatcatctgaccttcagttcttccaaaatcattcctcccagatggcggcattggattaccttgtctcattagagagtgatatctttgtgcctacatatgatggaaatatggccaaagtagttgagggccaccgcagatatcttggcttcaagaagacgattttattgaacagaaagctcctggttgatttgatagatcaatacagcaatggaatattgaactgggatgaattctcttcagctgtgaaggaagctcatgccgatcgcatgggtggtgcaaccaaaagattggtaatccctgacaggcccaaagaagaggattatttctatgccaatccagaggaatgtttagaactgtcagatgatatgttgagtagtacgtgagtgatgtgtttggaaataagataatttacttgtgccctctcctggtgcacttggttttctaccacggatactaagataggtctcgacgcagtttagcaaagacaacgacagctttttgtatcagagaggcagtcatagtactgttagaagggggaggggtgttaggcttttcatgaaagcaagagaagatcaagcaaggtagccgagggataccttatatataaaatctgcaaataatccacatcacattcatgtatagaagccacaccctgccattacagggtaagagcagatcaaactgcattgtacacggagggattcatatacaaatttggatttctggaacagcagttcgtggaagctttattccttggtacctctcattttttccttctcttctaaatataaatatattataaattgcttttttttttttttttttttttttttttccctttaccacacttctttttgttcaatacaaccgttgtgatttcagattaccctcgctgtaaaatttgattgttcatgattactgtctcctaatgtattagcttttggtagtaattattaaggggattggtaggttggactttcctttcattttctttttgtttttggtgttttctaatttacatttttgatggagtgctatctt

SEQ ID NO: 9991 - DNA, 2190 bp, Chrysanthemum coronarium
cccctttaacctctctctactcttctcttcaccgacactttcttattccggtcaccgtcacactttcccggccaccgtctttttttccggccactatatccaatttccttccgaccctttatacaaaatcaaaaacccaattaatatcactaaaaattttccattttcatccattaaataaccgtgcattttaatctttacccagtactaaactcaccaaaaaagttaattttttcttgtgggtcattcgaaatttggatcaaatttattacataattcagatctcacagtctttatatattttttatagatcgttagggtttgaagggctattgaatgtatgaatcaaatatgtgtagattagaagagaagaataggaataaaataaaggctagatttgtgattggtacaatggggttaaagaaaaggttaagtgaaattagagttgataaatttagaaactcgatgcgttcgtcttcgagaatgaagatgtggttaattagggcgactactactgttttgttatggacttgtgttgttcagttaactgctttaggtggtacttggggtcctagggtgttaaaaggttggccttcgtgttttacttttgatgatcatgttgctaagtcgttagatatcccggttcctgttaagcatttggcggacaaaagagtgtataagaataatggctacttggttgtttcgtgtaatggaggacttaatcaaatgcgttccgcgatatgtgatatggttgcgattgctagatatttaaatgttactcttatagttcctgaattggataagacgtcgttttgggctgatccaagtgagtttcaagacatatttgatgttgatcatttcattacgtccttgagagatgaggttcgggtgcttaagcagcttcctcctaggcttaagaagaaagtggaattaggatttgtgcatactatgcctcctgttagctggtctgatatatcttactatcataatcagattcttccattgattcaaaaattcaaagttgtgcatttgaatagaaccgatgctaggcttgctaataactttcaacccctcgaacttcaaaagcttagatgccgagcaaattttgatgctttgagatttacacctcagatagaagatttgggtagacgtgttgttagacttttgagacaaaacgggccatttttagtgcttcacctcagatatgaaatggatatgctagcgttttctggctgcacgcaaggatgcaatactgaagaggttgaagagttgacgagaatgagatatgcttacccatggtggaaagaaaagataataaattctgatttgaaaaggaaagacggattatgccctttgactcccgaggaaactgctcttacactcaaggcactggatattgaccatgatattcaaatttacattgctgctggtgaaatatatggtggggaaaggagaatggctagtcttgccgccagctatccaaagctggtaagaaaagagactcttttgggacccgacgaccttgggtttttccagaaccactcgtcacaaatggcagcattagattatcttgtatcactggaaagtgatatatttgtccctacttttgacggaaatatggcgaaagttgttgaaggtcaccggagatacttgggctttaagaagaccatattactggatagaaaactgctagtcgaattgatagacaaatatactagtaaatcgttgagttgggatgaattctcgaccgctgtcaaggaagctcatgcacagcgcatgggaaaccccacaaaaagattgattattccagaccgacctaaagaagaagactacttctatgcgaatccagaagaatgcttgcagccctcagatgacgaacctgtgaatataatgcaatgatgcccttctagtgggccatcatttttgtccattgcctccaaagattttcatgaatcattacatgccctagaatgcgatttaaggctttggagacacattgaagaggttcttttgcgcgagcggagatggtgtgtattattaatctctttcccattctattataaaatgtttcattgttgtcaatagctctaatccttgtatagtaaccgccctgacattccagggttataccaccttattcataattactagtgcgtacagagaaagattcacaatatagatttgttttca

SEQ ID NO: 9992 - DNA, 1433 bp, Ambrosia trifida
aagtagagtggagagattgaagaggtcggtcgggtattcgaatgcaaggggttataaaatgaaggtgtggatggttagggctaccactgtggtgttgttgtggacttgtttggttcagttgatggcattgggggatacttggggtcctagggtattgaaaggttggccttctcatgattcgggtggttcgggtactgccttagatgttaagttgttgccaagtgttccggttagagttgttccgcccaagagggtttacaagaacaatggttacctacttatttcatgtaatggaggacttaatcaaatgcgatctgctatatgtgatatggttgcaattgcacgatacttgaatgttacactcatagttcctgagctggataaaacttcgttttgggctgatccgagtgaattcgaggacatttttgacgttgatcatttcattacgtccttgagagatgaagtccgaatacttaaacagcttcctatcaggcttaaacaaaaagtcgaatcaggaatcctgcataccatgccgcctgttagttggtctgatatttcatattaccacaaccaaattcttcctttgattcaaagatacaaagtattgcatttgaatagaactgatgctcggctggccaatagtggtcaaccggtagacctccagaagctgaggtgccgagtaaatttcagtgctttaagattcactagtcagattgaagaattgggtagacgggttgttaatcttttacgaaaaaatggacctttttagtgcttcaccttcgatacgaaatggacatgttagcattttctggttgtactcaaggatgcaatgatgaggaggtggaagagttgacccgaatgaggtatgcttacccatggtggaaagaaaagatcataaattctgatttaaaaagaaaagatggtttatgccctttaacgcctgaagagactgcgcttgcattaaaggcactagacatagatcctggcatccagatctacattgctgccggtgagatatacggtggagaaaggagaatggctacgcttgcatctgcatatccaaagctggtaaggaaagagaccctattgggaccagaagaccttaaatttttccagaatcactcgtcacagatggcagcattggattatcttgtatcactggaaagtgatatttttgtccctacttatgatggaaacatggccaaagttgtagaaggccaccgcagatatttgggtttcaagaagacgattttattggatagaaaactactcgttgaactaatagacaagtacacaagtaactcactaagttgggatgaattctcgagcgctgtcaaggaagcccatgcaaaccgaatggggaacccaataaaaagattaattattccagacagacccaaagaagaagattacttttatgcaaatccagaaga

SEQ ID NO: 9993 - DNA, 1896 bp, Artemisia annua
ccggccaccgacaccctcattttccggcaccactttcctacttcaagatccattaaaacctaacattgtcttcaattttataaaatataaagtcatgggtgttgagaaaatgaagaggtcaataaataataataattttaataataaaagtaatgtgaagatatggattgtaagaggtgcaagtgtggtgttgttatggacttgtgtggttcagttgagtgcattaggtggtggtggtgatccatctatggttttaagtagtactactaatagtaataataataatataatgtggtggtgctggtgctgattctgttgttaattctgttaagctgttgcctactgttcctgctagagttcttcctcccaagagggtttacaaaaacaatggttacttaatgatttcatgtaacggaggacttaatcaaatgcgatctgctatatgtgatatggttgcaattgcgagatacttgaatgttacactcatagttcctgagctggataagacttctttctgggctgatccaagtgagtttgaggacatttttgacgttgatcatttcatgacgtccttgagagatgaagtccggatacttaaacagcttcctgttaggcttaaaaagagagtggaattaggaatcgtgcataccatggctcccattagttggtctaatatttcatactaccacaaccagattcttcctttgattcaaagacacaaagttttgcatttgaatagaactgacgctcggcttgccaatagtggccacccactagaccttcagaagctgaggtgcagagtaaattttagtgctttgagattcactagtcagattgaagagttgggtagacgggttgttaaccttttgagacaaaatggaccttttctagtgcttcacctccgatacgaaatggacatgttggcattttctggctgtacgcaaggatgtaacgatgaagaggtggaggagttgacccgaatgaggtatgcttatccatggtggaaagaaaagatcataaactctgacttgaaaaggaaagatggtttatgccctttaactcctgaagagactgccctggcactaagggcgctcgacatagatagcgatattcaaatttacattgctgctggtgaaatatatggtggagaaaggagaatggctagtcttgccgccagctatccgaagctggtaagaaaagagactcttttgggacccgacgaccttgggtttttccagaaccactcgtcacaaatggcagcattagattatcttgtatcactggaaagtgatatatttgtccctacttttgacggaaatatggccaaagttgttgaaggtcaccggagatacttgggctttaagaagacgatattattggatagaaaactgctagtcgaattaatagacaaatatacaagtaaatcgttgagttgggacgaattctcgacagctgtcaaggaagctcatgcacagcgcatgggaaaccccacaaaaagattgattattccagatcgacctaaagaagaagactacttctatgcgaatccagaagaatgcttgcagccctcagatgacgaacctgtgaatattatgcaatgatgccctcctagtgggccatcatttttgtccattgcctcccaagattttcatgaatcattacacgccctagaatgcgatttaaggctttggagacacgttgaagaggttcttttgcgggagcggagatggtgtgtattattaatctctttcccattttattataaaatatttcattgttgtcaatagctctaatccttgtatagtaaccgccctgacattccagggttataccaccatattcataattactagtgcgtacagagaaagattcacaatatagatttgttttcacccc

SEQ ID NO: 9994 - DNA, 1823 bp, Silene vulgaris
aatggcggtatgtctccatcatcatctagaacaaagatgaagacatggatggtgagggcaactacctcaattttgttatggacttgtattgtacaattgaccacattgagtgaagtttggggaccaagagtcttgaagggttggccttcctgttttacacaagagactgcattggatcttaagctggcatcttcggttcccgctcgtgttcttcctcccaagagggtttataagaacaatggttacctgatggtttcatgcaacggaggacttaatcaaatgcgatcagctatttgtgacatggtggcaattgcaagatatcttaatgtcaccctcattgtcccggagctggataaaacttctttttgggctgatcctagtgaatttcaagacatatttgatgtagatcattttatttcatccttaagagatgaggtgaggatcttgaaggagctcccaccaaggcttaagaaaagggtagaggctggaaaggtttacacaatggctcctgttagttggtctgatatatcttactatcataatcagatccttcctctgatacaaaagtacaaggttttgcatctgaatagaactgatgctcggcttgcaaataatggtcagcctttggaaatccaaaggcttagatgccgggttaatttcagtgggttacgatttactccacaaattgaggaactaggaagaagggttgttaaattgctgagacaaaatggtcactttttggttctccatttgcgatatgagatggacatgctggcattctccggttgtacccaaggctgcaatagtgaggaagtggaggacttgacaagaatgagatatgcctatccatggtggaaagagaaaaatcattaattccgatctgaaaaggaaagatggactatgcccattgacgccagaggaaacaacgttggcgcttagggctttggatatcgatcccagttatcagatatatatcgctgctggtgagatatatggtggagagaggaggatggctaatcttgcagaagcttatccgaagctggtgagaaaggagacattactcaatccagaagacttgagattctttcagaatcattcatcccagatggctgctctagattacctcgtttcactggagagcgacatcttcgtcccaacttatgatggtaatatggccaaagttgttgagggacatcgcaggtaccttggctacaaaatgacggtcttattggaccgaaggctgttggttgatttgatagacaaatatacatctggatcactgagttgggatgagttctcggatgctgtgaagcaaactcatgcacatcgcatcggaaaatcaactaaaaggctggtcattccagaccgaccaaaggaagaggactatttctactctaatcctcaggaatgtctcctacccgaggaaccgttaaatagcatgtgatttatatacacgagcttactatacttgtattctattgtgatgctgtatcccactggaatctgttaagaggatctcagctcaggtttagagccccaattttagaaacacgtttggtaggaccgacccgagttggaggaatgagccatggaccatggatcctggttattataatttcggctacgaaattggggagagcaggaggtggatggagcatattatacatggccttagtagtctgccgttgcggggtggagttagattgccctgttgtgtacatgtagagagacttcacatatagattgtttgatttaattcctgagattttaaggttagtttggtcatcttatcttttatctttgcatttttgtattactactac

SEQ ID NO: 9995 - DNA, 2746 bp, Catharanthus roseus
cgccgaccgctcagattccggcggtacaataaatatcacgccggcatttcccatagatctctctcccatattctgcatttttttattctttttattcagaagaggagatacaacagaaacggcatcaatcaaattgtttaaattttttcccctgatttttctctagggcgtgatcgttaaaaaatctcatctttgaatctttttccggtgaatgtgcgttaagttgggctttgaagttattacggaacttgttattttggttgaattttattggatatagaaattttgtttagggcatttcaccttttgtttgtttgaggtaaaaagggatattggttggtttcttcctagatcgctgattgattggggaacgccaatatttggtgaaacattggagaaagcttcaaagtggggtgggcaggtgggtggtgttgaatgtatggggggatatgtgtagaatagaagaacagcggagtgaagagaagaggaggaggaggtgggttttaggatttggattagaactaggaggaacgatgggtttgaaaggtggggagagtagagtagagaagctgaagaattctatggtttctaggtccagaatgaaactatggatgataagggcaactacttctgtcttgctgtggacttgcctggttcaattaactgcattgggtgagacttggggtcctagggttttgaaaggttggccctcttgttttcatcaggatgctgcctctgcctctgcttctaccgctaccggagcagtggctttggatgtcaaatctgctccggaagatgtccctgctcgcgttctccctcccaaaagggtttacaagaacaatgggtatctgatggtttcttgcaatggaggccttaaccaaatgcggtcagctatatgtgacatggtggcaattgcgagacacttgaatgtgacacttatagttcctgagttggacaaaacttctttctgggcagatccaagtgaatttcaggacatatttgatgttgatcatttcattacatccttgagggatgaagtccgtattctgaaagagctaccacctagactcaagagaagagtggagctcggaatgatatataccatgccgcctattagttggtccgacatttcttactatgaaaatcaaattcttcccctgatacgcaagtataaagttgtgcatcttaacagaactgatgctcgactagccaataatggtcagcccttggaaattcagaagctaagatgtcgagtaaattttggtgctttgcggtttacacctcagattgaagagttgggcagaagggtcattaaacttctaagacagaagggtcctttcatagtactccatctaagatatgaaatggacatgttggcattttcgggctgtactcagggatgcaacaaggaggaggtggaggagttgactagaatgagatatgcatatccatggtggaaagaaaagataataaattctgatttgaagaggaaagatggtctgtgtcctttgactcctgaagaaactgctcttgcgttgagagcgttagacattgatcaaagtttccaaatctacattgctgctggggaaatatatggtggagataggagaatggctagcctggctgcttcttatccaaatttggtccgaaaggagacactgttgaatcctgcggatcttaggttcttccaaaatcattcttcacaaatggcagcacttgactatcttgtttctctggagagtgatatttttattcctacatacgacggaaacatggcaaaagttgttgaaggtcatcgcagatatctgggatataagaagacaatcttactggacaggaaacttctagttgatttgatagaccaatacaatatgggatcactaacttgggatgagttttccgctgctgttaaggatgctcatggcgagagaatgggaaatcctagcagaaggttggtaattcccgatagacccaaggaagaggattatttctatgccaacccgtgggagtgtttgcaaccttcacatgaagatgaactgcttagtaagatttaaacaccaattggtgatagatagcgcatttcatcagattcttgctatgcattcctgcgaaaaatataaacgagagagataagagagacagacagagttgacaagacttatataagcgtgagaaaggagaagttcgtttgcaggtttttgcattttgaagttcatcatacgaggaggtaggtgcagtttcaccaagaacctcagagagaacctttggaagcccctggagtacattaatatctttatatagcttaataatgcaattcatgtatagaagaagttcccctgccattgcagggttttacatcaacttaactgcagtagtgtatacagagggatgagaatatagatttgttttattggaaattctggttttgataaaaaggttaggccaccatcatcatcccttcttccttcttttctcttcgtttttcctttctacattgtcctcattcatcatatacttggcaagtttatgaaacacctgtttatttcccaccattttgcctcttaccttcttttattatttcttcaatgtcaagtgatggatcttttgtagactttgttgtatttaaagaatggctaaatgtgtagccatatggcataactttttatgtttttgtttcaatatatacacttttgaatggtgaactgagttgtaagaataatacaaggctgagaaaattattgtttag

SEQ ID NO: 9996 - DNA, 2554 bp, Quercus alba
tccttctctgtctgtatctctctctccctctctttctctctctaacctccccctatatatttatactcgcgctggtgtactcgctccggcgaatcgggccaaaaatctcgccggcgaatacaccggatctttgaagatcttcaaattcacaatctcccattgccgtttcggtaccataatctgcctataaatacgaagatcttattcgctacttatttttccttttcaattggctgcttcttcttctcgaattgggaaaaaaatcggtgatgaagatcgataagccttgtgagtataatgcacgtggagaattatagcattcctttttagggttctagaaatcggtgaaaagaatctataaaacaatggtggtggtgataattctggtcagtttggggtttgaattttgattgcatgggggaaagtgaagcgagatgtgtaggatagagaggaaaagctgtgaatttgagaacaacaataagagagagatggggttgaaggcaatgggaggggttgagaagctgaggagttcaatgtcggtgtcgatgtcgaggtcgagaatgaagctatggatgatacgcgctacgacgtctgttttgctctggacttgtattgttcagttgacggcgttaggggatttgtggggtcctagggttttgaagggttggccctcttgttttttgcaggactcttcttcttcttcttcttcttcttcctccgtctcctccgccgttaacaacgccgttaccgttccgtctgttccgccgcgagttcttccacccaaaagggtttataagaacaatggttatctgatggtctcatgcaacggaggactcaatcaaatgagagcagcgatttgtgacatggttgctattgcaagatatttaaacgtcacccttatagtacctgagttggataaagcctccttttgggccgatcccagtgagttccaagacatatttgatgtggatcatttcattacatccttgagagatgaggttcgaatattgaaagaattgcctcctaggctcaagaggaaaatggaactagggaaagtttattccatgcccccaatcagttggtctgacatatcttactatcataatcagattcttcctctgatatggaagcacaaagttgtacatctgaatagaactgatgctcgacttgccaataatggtcaacctttggagcttcagaagctgcgctgcagagtaaattttagtgctctgagatttacttctcagatagaggagttgggtagaagggttatcaatcttttaaggcaaaatggccctttcctagtacttcatcttagatatgaaatggacatgttggcattttctggctgcactcaaggttgcaacaatgaggaggtggaggagttgactaaaatgaggtatgcttatccatggtggaaagaaaaaataataaattctgacttgaaaaggaaagatggtttgtgccctttgacacctgaggaaactgctctgacactgagggcactggacattgatcctagtatccagatttatatagcagctggtgagatatatggtggagaaaggagaatggcaagtcttgcaaaggcttacccaaaattggtcaggaaggagaccctattggaaccatctgaccttaggtttttccagaatcactcatcccagatggctgcattagattatctggtgtcactggagagcgatatttttgttcccacatatgatggaaacatggccaaagttgttgaaggccatcggagatttcttgggttcaagaagacgattctgttggatagaagactgctggtcagtttgatagaccagtacaatagtggatcactgagttgggatgagttctcatcagcagtgaaggattctcatgcagaacgcatgggaaacccagtgaaaaggttggtgatcccagacaggcctaaagaagaggattatttttatgccaacccacaagagtgtttgcagccattagacgaatcattgtcattgagtagtacgtgatctatatgttaggagattgcgacattcatcagtgttctcctacagtgctagcctttcagccatggatctgtagataggtttctacagaagtacagtgataatgaaggattttgttttgaagaggagatggtgaagattattgggagtggtaaaactacaagaaggcctgagaggatctatggaagcagccggggaaacaatattgtcttttacatatgccaataatcatccaattcatgtatagaagctaccttgtcatttacagggtgagagcagattgatctgcattgtacaccggggggatgcaaatatagatttggtttacgcaaagatgtagattcatggaaggttaatcccttatccttccattttgcattttttgtttcgttcggatcagccatggtcttctgatttcctctcagcatatataacattataattttatcagtttacacagattattgccactctcctattgcatggtgtcctattccatggaatcataggctgcggtgtttatgtactcttacaagttacta

SEQ ID NO: 9997 - DNA, 2468 bp, Amsonia hubrichtii
cgtttgtgcgccaccactatcacgcgcaccaacactctctcatctctctaccccttccctttctctatattcattcccattcgtcgccggccactcagattccggcgacaatatcaatatcacgccggaatttccgctagatctctcctaaattctgcatttttaatctctttttttctggaaagtagagatactacaacataaacggcaaattgttttttttcctttgatcgccaaagattgtctctttctttcgaactcacacgaatccacgttcggggtgaatgtgcatcaaagtcagaatttctactgccatctctcctgccatattacagtattttcgtggttttcctgatttttggttgaatttggttcaatatggaaaatttatggcacgacaggttgtttaatttgaggtggaagtgaatttgatttggtttccccagaatttgatttgttttccagatcgctgattgattaaagaacgacatcgagtatattggaggaaagctcttggagtgggtgactgagatgtatttgggatatgtgcaggatagaggaacagcggagtgaaaagaggacgaggtgggttttaggattaggattaagtttacgaaggatggggttaaaaggcggggagggtagggtagagaagttgaagagttccatggtttccaagtccagaatgaagctgtggatgataagagctacgacatctgtattgctgtggacttgcttggttcagttgactgcattgggtgagacttggggtcctagggttttgaaaggttggccttcttgttttcatcaggatgctacgtctgctcctgccactgccggagcagtggccttggatgttaaatctaccccggaagatgtcccggcccgggttctccctacccaaaagggtttacaagaacaatggttatctgatggtttcatgcaatggaggccttaaccaaatgcgggcggcgatatgtgacatggtggcaattgcgagatatttgaacgtgacacttatagtccctgagcttgacaaaacttctttctgggcagatccaagtgaatttcaagacatatttgatgttgatcatttcattacatctttgaggcatgaagtccgtatattgaaagagctaccggttagagtcaagaaaagagtgcagcaagaaacattgtatactatgccgcctattagttggtctaatatttcttactatgaaaatcaaattcttcctctgatacgaaagtataaagttgtgcacctgaatagaactgatactcgacttgccaacaatgatcagcccatggaaattcagaagctacgctgccgagtaaattttagtgctttgcgatttacacctcagattgaagagttgggtagaagggtcattaaacttttaagacaaaagggtcctttcatagttctccatctcagatatgaaatggacatgttagcattttctggctgtactcagggatgcaacaacgatgaggtggaggagttgacaagaatgagatatgcttatccatggtggaaagaaaaaataataaattctgatttgaagaggaaagatggtctgtgccctttgacacctgaagaaactgctcttactctgagagcattagacattgatcgcagtatccaaatttacattgctgcgggggaaatatatggtgggtataggagaatggctagtctcgccgctgcttatccaaatttggtcagaaaggagacgctgttgaatccttcggatcttaggttcttccagaatcattcttcccaaatggcagcactagactatcttgtttctctggagagtgatatatttgttcctacatatgacgggaatatggctaaagttgttgaaggtcatcgcagatatcttggatacaagaagacggtcctactggacagaagacttctagttgatttgatagaccaatacaatatgggatcgctgacttgggacgagttttctgctgctgttaaggatgtgcatggtgagagaatgggtaatcctagcaaaaggttggtgattcctgatagacccaaagaagaggattatttctatgccaacccgtgggagtgtttgcaaccatcagatgaagataatctgctaagtaggatctaaacatcaatggtggtatgatttgtttagattcttgctgtgcattccttcgataaatgagagacaagagttgtcaggatataagagtgaaaatggagagttttgtttccaggaggcctcttgaagttcgtacgaggaggaggtacactttcaacaaagcctcagagaaccttcggaagctgccggagtacattaatatcttatatagcttaataatccaattcatgtatagaagttcccctgccattgcagggttttacggcaacttaactgcagtgtacacagagggatgaaaatatagatttcttttattggaattctggatttgataaaggt

SEQ ID NO: 9998 - DNA, 1864 bp, Chrysanthemum coronarium
ctaacattgtcaaaattttataaaaaatagaacttgatgggtgctgagaaaatgaagagggggcataataataaaagcaataatgcgaagatatggattgtaagatgtgcaagtgctgtgttgttatggacatgtgtggttcagttgagttctttaggtggtggtgatatgtggggcccatctatggttttaactagtagtaatagcaatggtggtggtggtgattctgttgttaattctgttaagttgttgccaactgttcctgctagagttcttcctcccaagagggtttacaaaaacaatggttacttaatggtttcgtgtaacggaggacttaatcaaatgcgttctgctatatgtgatatggttgcaattgcgagatacttgaatgttacactcatagttcctgagctggataagacttctttctgggctgatccaagcgagtttgaggacatttttgacgttgatcatttcattacgtccttaagagatgaagtccggatacttaaacagcttcctgttaggcttaaaaagagagtggaatcaggaattgtgcataccatgcctcccattagttggtctaatatttcatactaccacaaccagatccttcctttgattcaaagacacaaagttttgcatttgaatagaactgacgctcggcttgccaatagtggtcacccgctagaccttcagaagctgaggtgcagagtaaattttagtgctttgagattcactagtcagattgaagagttgggtagacgcgttgttaaacttttgaaacaaaacggaccttttctagtgcttcacctccgatatgaaatggacatgttggcattttctggctgtacacaaggatgtagtgatgaagaggtggaggaattgacccgaatgaggtatgcttatccatggtggaaagaaaagatcataaactctgacttgaaaaggaaagatggtttatgccctttaactcctgaagagactgccctggcactaagggcgctcgacatagatagcgatattcaaatttacattgctgctggtgaaatatatggtggagaaaggagaatggctagtcttgccgccagctatccaaagctggtaagaaaagagactcttttgggacccgacgaccttgggtttttccagaaccactcgtcacaaatggcagcattagattatcttgtatcactggaaagtgatatatttgtccctacttttgacggaaatatggcgaaagttgttgaaggtcaccggagatacttgggctttaagaagaccatattactggatagaaaactgctagtcgaattgatagacaaatatacgagtaaatcgttgagttgggatgaattctcgaccgctgtcaaggaagctcatgcacagcgcatgggaaaccccacaaaaagattgattattccagaccgacctaaagaagaagactacttctatgcgaatccagaagaatgcttgcagccctcagatgacgaacccctgaatattatgcaatgatgccttgtagtgggcccccgttttagtccattggctccaaagattatcatgaatcatacatgccccagaatgcgagttaaggctttggagacacattgcagaggttcttgtgcgagcggaaacggtgtgtattattgatctctttcctttttattataaaatgttccattgttgtcaatagctctaatccttgtacagtaaccgcccttgcattcgagggttataccaccttcttatccataattactagtgtgtacagagaaagattcacaatatagatttgttatcaccttcaaattttgcaaggtacacacgttttaagcttatttcaatcaatcctaggagaatg

SEQ ID NO: 9999 - DNA, 2280 bp, Daucus carota
ccccacgactcctatcactgtccgctctgtctctctctccgttgccgacattctcagattccggccagcccttgttggaaaattgatcccctcagcttttttcatcaatctgctctgaccctttctatattttagtgtttcttggttgcttcagtcgcctttttgtgttttcgtcatgggttttgatttagattatctgggctagcttttttgcttgcattgtgttataaagttgtgatctttacaggaaaattttagttttgatagttttttgaggataatttgatttattgttgatgaagttgtgatccttacaagaaagtttcaattttgattgttcttgaggatgatatgatttatttttgttaatattttggtgaattgtgtaatcttcggaggtattttttgtttgattgagattaattacagtttataagctatgtgtgtaaaagatgagattgaaagggttgaggaggggggacaaaagaagaggaggaggtgggaaacagtaatgggattaaagggtagtcgaaaaaggattgagagattgaggagttcagtggctttgaagtctcgaatgaagttgtggatgataagagctactactttggtgttactgggcacttgttttgttcagttaacagctgtgggagaggtgtgggggcctagggttttgaagggctggccttcttcctttgctcaagattctagtaagatggatgttaagttgtcgacaagcctttcggatcaagttctacctcccaagagagtttataagaacaatggttatttgatgatttcatgcaatggagggcttaaccaaatgcgtgcagcgatctgtgatatggttgctattgcaagatatttaaatgtgactcttatagttccagagctggataaaacttctttttgggctgatccaagtgaatttcaagatatttttgatgttgatcatttcatctcatccttgagagacgaggttcggatcctaaaagagctgcctcctaggctcaagaggagagttgaactgggaatgttctacacgatgtcgccgatcagttggtctgacatttcttattatcgtaatcagattcttcctttgatacagaaacataaggttgtgcatttgaacagaacagacgcccgtcttgccaacaatggtcaacccctcgaaattcagaagctccgctgccgagtgaactttggtgctctgagatttacttctcagatagaggagttgggaaggagggttattaagcttttaaggcaaaagggtcctttccttgtacttcatctaagatatgagatggacatgttagccttttctggttgtacacagggatgcaacgaagaagaggttgaagagttgacaaaaatgagatatgcttacccttggtggaaagaaaaaatcatagattccgacatgaaaagaaaagatggtctatgtccgttaagtcctgaggaaactgctcttactttaagagcactagatattgatcgtgacattcagatctacatcgctgcgggagaaatatatggtggtgcgagaagaatggctgatctttcagctgcttatccaaaagtggttcgtaaagagactctgttaggtccctcagaccttggatattttcaaaatcactcttcccagatggcggcactggattatcttgtctctctggaaagtgatatatttgttcccacatatgatggaaatatggctaaagttgttgaaggtcatcgcagattccttggattcaagaagacaatactcctggacagaaggatactagttgatttaatagaccgatacaaccatggattgcttaactggtccgagttttctattgaggttaaaagagttcatgcagatcgcatgggaaatcctaccaagaggacggtgatttcagatcgacctaaagaagaagattatttttattctaacccagaggaatgccttctatcatcagatccatatggtgaactgtcgagattatcatcctgaaccatagttgccaatttgaccctcaatgggaattgaaaagatgtaggatcctctttttgacatgttataataattcaatttgaagtatagaagttgctctgccattgcagagttgtatcaacaaagaggtacatataaattttgatttttgaagatagcaaatagtcgtagtactactgtttcttatttgtggatccttgttaatgttatacagcataatcattcttaattatatgtacataaagagtttatattaataaatctgtatgactagtggc

SEQ ID NO: 10000 - DNA, 2475 bp, Arachis hypogaea
caaatgtcgtttatgcgttttgaagagcgtagcgttttattctctctctcacacgctggacaccccacacctacaccctcacacacctacgctaattcatttcatttttctctttttttttctctcacacactcgccggccattcccgccgatcactaaacgacgcatcctgcagacattcattcgaagatcgatcttgtaagttgcgtgacattgtggcggatgctggtggattcgtggccgttacaggcaaggacgacggatcttggattgaatctggcattttagggttatgaagggggaggaagaggaggaggcattgtgagatgtgcaggccggagaggaccagcagcagcagcagcaattgccaagatttggtgtggatgggtgtgagggtggagaagggagggagaggctcttctaacggttcgtcgtcgtcggtggcggcagcgtcgagatcgaggatgaagatgtggatgattagggcgacgacgtcggtgcttgtgtggacctgcgtggtgcagttgacgacgctgggtgagatgtggggtccaagagtcttgaagggttggccttcttgtttcactcatgattcttcttcttcttctgctgtcagtgcccttgatttcgattcccaactacttccgtctccgcgtcccgttcttctccctcccaagagagtttataagaacaatggatacttgatggtgtcgtgcaatggaggactcaaccaaatgagagcagcgatatgtgacatggttgccattgccagatatctaaatgtcacgcttatcgtccctgaactcgataaaacttccttctgggctgaccctagtgagttccaagacatatttgatgttgatcattttattacatccttgagagatgaggtcaggatattgaaagagttgcctcctagactcaagctgagagtggaaagaggaatggtttacaccatgcccccaattagttggtctgacatttcttactataagaatcagattctgcccctgatacaaaagtacaaagttgtgcatttaaatcgaaccgatgctaggctggcaaataacggtcaacctctggaccttcagaagctgcgatgccgtgttaattttagtgctctgagatttactcctcagatagaggagttgggcagaaaggtcatcaagcttctgaggcaaaatggtccatttatggtgcttcatctgaggtatgaaatggatatgttggcgttttctggctgtactcaaggttgcaacagtgatgaggtggaagagttgacaaggatgagatatgcttatccctggtggaaagaaaaaataatcaactctgatttgaaaagaaaagatggcctatgccctttgacacccgaggagactgctctaacgcttagggctcttgacattgatcggaacattcaaatctacattgcagctggagaaatatatggcggggaaaggagaatggctagtcttgcaaaggactacccaaaattggtcaggaaggaaacactgttggaaccatctgaccttcagttcttccagaatcattcatctcaaatggcggcattggattatcttgtctcattagagagtgatatatttgtccccacatacgatggaaatatggccaaagtagttgagggccatcgcagataccttgggttcaagaagacgatattgttgaacagaaagctcctagttgatctgatagatcagtaccataatggagtactggactgggatacattctcttcagccgtaaagagagctcacgcagatcgtatgggtagtccaaccaaaaggttggtaatcctcgacaagcccaaagaagaggattatttttatgcgaacccacaggagtgtttagaatcatcagttgatctgctgagtagtacgtagtagtaatgcatccagaaaacgctggaattcacttgtgccatcacctcctggtgcacttggttctctaccacagatagtgaattagttctctacgcagttttagcaaagatgacggcttttgtatcaaagaggcagtcatggtgactcgaaaaagagagatggttgggtttggggaagggatctataacattcatgacagctctagtcaagggaagcaaagcaagccggggaatactttatattttacatatgcaaataatcatccatcacattcatgtatagaagctaccctgccatttcggggtgagagcagtttatactgcattgtacacggaggaattgaattcatatacaaatttggatttactggaactgccgttcgtggaaagcttaatacattggtacttgcctctgtttttaggatataaatatataagttttgttcccatttttttcttctttttttttattttgctttttcctttgcctcctttctctttatcctgccatcattcacactataaaatttgtttgttgatgtattattcccgctaatttgatattcttttgtttt

SEQ ID NO: 10001 - DNA, 2685 bp, Populus trichocarpa
taattctagtggggccacccgtactggcgtcagctggcgagcatttactggctgaaatgtaagggtagagttaagtacagtcaagacgtaaaccatagtcagccataaccatagttaaataaatatggcaagaagagagagaaaaagaaactctgaataggaaaaaaaaaacaaaacaaccggtggaaagtgatgaagcggtgtctatgttgtgttgccggttcacaccataacagctcttctttttttttctcgagtactctccaccactctctctctcctttttaaaaccgtcggcgagtattgttgtctctctcgccggaaaaattgatgagatagtggagaaatttcttcattcgttttttgattgattgattttgaagaggtgggtagaaattgatatttatttgttttttttggattcagttttggatgtcgaagtttctttgttaaagttacggatcctgcattgttgaagaggaacgacaggtcgttttgaatgggggagaaatgtgcaggatagagagaaagtgtggaggaggagagtatgggggtagttaaaggagtagaaaagataaggattagtatatcaaggccgtcgtcgaaaatgaaggtgtggatgataagggcaacgacgtcggttttgttgtggacatgtgtggttcagttgacgacaatcggtgagatgtggggtcctagggttttgaaaggttggccttcccaatctgcctctgccgccttgcaagagaatgttccttctctccctgctcgcgttttgcctccaaagagggtttataagaacaatggatacttaatggtctcgtgcaatggaggtcttaatcaaatgagagctgcgatatgcgatatggttgctattgctagatatttgaatgttacacttatagtaccggaactggataaaacctccttttgggctgatcccagtgagttccaagacatatttgatgtggagcattttatcacatcattaagggatgaggttcgcgtattgaaagaattgccttccaggctgaagcagagagtggaactggggatgacttataccatgccaccagttagttggtcggatatttcttactattataaccagattcttcctttgatacagaagtacaaagttgtacatctaaataaaactgatgctcgacttgccaataatcaccaacctctagagctgcagaagttgcgctgccgtgtgaatttttttgctctgagattcaccactcaaatagaggagttgggtaagagagttataaggcttctaaggcaaaatggtcccttcttggtactccaccttcgatatgaaatggacatgctggcgttttctggctgtactcaaggttgcaacgatgaagaggtggaagaattgacaagaatgagatatgcttatccttggtggaaagaaaaaataataaattcggatttgaagaggaaagatgggttgtgtcctttgacacctgaggaaacagctctcacgttgagggcactggacattgatccaaatatgcaaatatatgttgcagctggtgaaatatatgggggtgataggagaatggcaagtcttgctgcatcttatccaaaactggtcagaaaggaaacactgttggaaccatcagaccttaggttcttccagaatcactcatctcaaatggcagcattggattatcttgttgcattggagagtgatatttttgtccctacctatgatggaaacatggctaaagttgttgaaggccaccgcagattccttggctttaagaaaacaattttactggacagaaggcttttggttgatctgatagatcgatacactaatggatcgctgacctgggatgaattttcgtattatgtaaaagaatcccatgcagatcggatgggcggcccaacaaaaaggctggtgatccttgacaggcctaaagaagaggattacttctattcaaacccagaagagtgtttgcagtcatcagaggatccattgagcagcacatgatcattatttgacgaattattacataaatcagtctcacagtgctagccattctaccacattgttctctacaagaggtacagtgttaatgaaggagtttgctttcaataggcattatagtgtttggtgaacttcaagaaagcctgagatgatgtgtggaagcaaacctaggttagtattataaaatatactcgaagactccaattcatgtatagaagctcctctgccattacagggtgatgccagattgacaagattgggttgtccaagtataaaagctcccccagtcatttcatggaaggttaatccgtcgtccttccatttcctttttgtacttttttttttctattggatctttcgccatcttgtgagttcctaacatatcactttctaaaatttccttgctatgaaagatcactgctgctcctttttttattatagctcaaagattttgcagcaaatgtcctcgaaaaccgtaaaaagtgaattatgcactttgtgacttgttaatggagacgactgtctggaatgccctggattatcctttgttcacgggttttgagtctgagccataaaggccgcggctcatctggagcaacagccgactatttgagctgatttgatgttggttgctacatgttgcttagattaaacttgaaaagagtttgtagaccaaa

SEQ ID NO: 10002 - DNA, 1870 bp, Chrysanthemum coronarium
atctcgctaacattgtcaaaattttataaaaaatagaacttgatgggtgctgagaaaatgaagagggggcataataataaaagcaataatgcgaagatatggattgtaagatgtgcaagtgctgtgttgttatggacatgtgtggttcagttgagttctttaggtggtggtgatatgtggggcccatctatggttttaactagtagtaatagcaatggtggtggtgctgattctgttgttaattctgttaagttgttgccaactgttcctgctagagttcttcctcccaagagggtttacaaaaacaatggttacttaatggtttcgtgtaacggaggacttaatcaaatgcgttctgctatatgtgatatggttgcaattgcgagatacttgaatgttacactcatagttcctgagctggataagacttctttctgggctgatccaagcgagtttgaggacatttttgacgttgatcatttcattacatccttaagagatgaagtccggatacttaaacagcttcctgttaggcttaaaaagagagtggaatcaggaattgtgcataccatgcctcccattagttggtctaatatttcatactaccacaaccagatccttcctttgattcaaagacacaaagttttgcatttgaatagaactgacgctcggcttgccaatagtggtcacccgctagaccttcagaagctgaggtgcagagtaaattttagtgctttgagattcactagtcagattgaagagttgggtagacgcgttgttaaacttttgaaacaaaacggaccttttctagtgcttcacctccgatatgaaatggacatgttggcattttctggctgtacacaaggatgtagtgatgaagaggtggaggaattgacccgaatgaggtatgcttatccatggtggaaagaaaagatcataaactctgacttgaaaaggaaagatggtttatgccctttaactcctgaagagactgccctggcactaagggcgctcgacatagatagcgatattcaaatttacattgctgctggtgaaatatatggtggagaaaggagaatggctagtcttgccgccagctatccaaagctggtaagaaaagagactctgttgggacctgatgaccttgggtttttccagaaccactcttcacaaatggcagcattagactatctcgtatcactggaaagtgatatatttgtccctacttttgacggaaatatggccaaagttgtcgaaggtcaccggagatacttgggctttaggaagacgatattattggatagaaaactgctagttgaattaatagacaagtatacaagtaaatcgttgagttgggatgaattctcgtcagctgtcaaggaagctcatgcacagcgcatgggaaaccccacaaaaaggttgattattccagaccgacctaaagaagaagactacttctatgcgaatccagaagaatgcttgcagccctcagatgacgaacccctgaatattatgcaatgatgccttgtagtgggcccccgttttagtccattggctccaaagattatcatgaatcatacatgccccagaatgcgagttaaggctttggagacacattgcagaggttcttgtgcgagcggaaacggtgtgtattattgatctctttcctttttattataaaatgttccattgttgtcaatagctctaatccttgtacagtaaccgcccttgcattcgagggttataccaccttcttatccataattactagtgtgtacagagaaagattcacaatatagatttgttatcaccttcaaattttgcaaggtacacacgttttaagcttatttcaatcaatcctaggagaatg

SEQ ID NO: 10003 - DNA, 1681 bp, Vinca minor
atgtgtaaaatagaagaacatcggagtgaggagaagaagaagaagaagaggaggaggtggatttttggattagggttaataaatttaggaaatactatggggttgaaaggtggtggggagagtagagtagagaagatgaagaattcgatggtttcgaagtctagaatgaagctatggatgataagggcaactacttctgtgttgctatggacttgccttgttcagttaactacattgggtgagacttggggtcctagggttttggaaggatggccttcttgttttcaccaggattctacaggagctgtggctatggatgttaaatctgaccacgatagtgtgccagctcgtgttgtccctcccaaaagggtttacaagaacaatggttatttgatggtttcttgcaatggaggccttaaccaaatgcgggcagcaatatgtgacatggtggcaattgcgagacatttgaatgtgacacttattgttcctgagctggataaaacttctttttgggcggatccaagtgaatttcaagacatatttgatgttgatcatttcattacatccttgagggatgaagtccgtattctgaaagagctgccgcctagactcaagaagagagtggagctaggaatgttatataccatgccacctattagttggtccgacatttcttactatgaaaatcaaattcttcctctgatacgcaaatataaagtcgtgcacttgaacagaactgatagtcgacttgccaataatgctcagcccatggaaattcagaagctacgatgtcgagtaaattttggtgctttgagatttacacctcagattgaagagttgggtagaagggtcattaatcttctaagacaaaagggtcctttcatagtactccatctcagatatgaaatggacatgttagcattttctggctgtactcagggatgcaacaaggaggaggtggaggagttgacaagaatgagatatgcttatccgtggtaggaagaaaaaataataaattctgatttgaagaggaaggataggtctgtgcccgttgacacctgaggaaactgctctcaccctgagagcattagacattgatcgcagtatccaaatctatattgctgctggggaaatatatggtgcagagaggagaatggctactctggctgcttcttatccaaatttggtcagaaaggagacgctgttgaacccttcggatcttaggtttttccagaatcattcttcccagatggcagcactagactatcttgtttctctggagagtgatatatttgttcccacatatgacgggaacatggcaaaagttgtcgaaggtcatcgcagatatcttggatacaagaagacaatcttactggacagaaggcttctagttgatttgatagaccaatacaatacgggatcactggcttgggatgagttctctgctgctgttaaggactctcatggtgagagaatgggtaatcctagcataaggttggtaattcctgatagacctaaagaagaggattatttctatgccaacccgtgggagtgtttgcaaccctcgaatgaaaacgaactgctgagtaacatctaaacctcgacattggtagcatttcttgaagattcatgctatgcattttctacgataaacgagagacaaactgtcgtcaacaagata

SEQ ID NO: 10004 - DNA, 2060 bp, Vinca minor
aagttagtagtaatctaattgttatttgtattcaattagtaacttataattctttttattgtatttaaaagggaatatattttttatgtgcctagatcgttgattaattgaacaatattgggtgtggatgtatgggtggaatatgtgtaaaataggagaacgtaggattgaggaggaaaggaagaggaagaggaggtgggttttgggattagggttaaagatggggttgaaaggtcgtggtggagtagagaggttgaaaaattcgatgttttcgaggtcaagaatgaagctatggatgataagggcgactacctctgtgttgatttggacttgtcttgttcagttaactgcattgggtgaaacttggggtcctagggttttgaaaggttggccttcttgctttcaccaggatgctgcttcaggagcagtggctatggatgttaaatctgaccatgactatgtcccaactcgtgttctacctcccaaaagggtttacaagaacaatggttatttgatggtttcttgcaatggaggccttaaccaaatgcgggcagcaatatgtgacatggtggcaattgcgagacatttgaatgtgacacttgtagttcctgagttggataaaacctctttttgggctgatccaagtgaatttcaagacatatttgatgttgatcattttattacatccttgagggatgaagtccgtattctgaaagagctgccgcctagactcaagaagagagtggagctaggaatgttatataccatgccacctattagttggtccgacatttcttactatgaaaatcaaattcttcctttggtacgcaagtataaagttgtgcacctgaacagaactgatagtcgacttgccaataatggtcatcctatggacattcagaagctacgatgccgagtaaattttggtgctttgcgatttacaccccagattgaagagttgggtagaagggtcattaaacttcttagacaaaagggtcctttcatggtactccatctcagatacgaaatggacatgttagcattctctggctgtactcagggatgcaacaaggaggaggtggaggagttgacaagaatgagatatgcttatccgtggtggaaagaaaaaataataaattcggatttgaagaggaaggatggtctgtgccctttgacacctgaggaaactgctctcaccctgagagcattagacattgatcgcagtatccaaatctacattgctgctggggaaatatatggtgcagggaggagaatggctactcttgctgcttcttatccaaatttggtcagaaaggagacgcttttgaacccttcggatcttaggttcttccagaatcattcttcccagatggcagcactagactatcttgtttctcttgagagtgatatatttgttcctacatatgacgggaatatggcaaaagtagttgaaggtcatcgcagatatcttggatacaagaagacaatcttactggacagaagacttctagttgatttgatagaccaatacagtatgggatctctgacttgggatgagttttctgctgctgttaaggactctcatggtgagagaatgggcaatcctagcaaaagattggtaattcctgatagacccaaagaagaggattatttctatgccaacccatgggagtgtttgcaaccatcaaatgaagacgatctgcttagtaacatctaaatatcgattctggtagcgtttcttcaagattcttgctatgcattcctgcgataaaccagagacaaattgtcgtaaagatataaagagtgagggaaggagaattttgtttccaggatatccgccttttgaagtttcatatgaggagggacactttcagaaaaagcctcagagaaccttcggatgccgcccctggattacattaatatctttatatagcttaataatccaattcatgtatagaagctcccctgccattgcagggttttacaaccaacttaactgcagtgtatacagagggatgaaaatatagatttgtttcattgaaatttctggatttgatata

SEQ ID NO: 10005 - DNA, 1700 bp, Chrysanthemum coronarium
gcccatctatggttttaactagtagtaatagcaatggtggtggtgctgattctgttgttaattctgttaagttgttgccaactgttcctgctagagttcttcctcccaagagggtttacaaaaacaatggttacttaatggtttcatgtaacggaggacttaatcaaatgcgatctgctatatgtgatatggttgcgattgctagatatttaaatgtgactctaatagttcctgaattggataagacgtctttttgggctgatccgagtgaatttcaagatatatttgatgttgatcattttattacgtcgttgagagatgaggttcgggtgcttaaacagcttccacctaggcttaagaagagagtggagttaggaattgtgcatactatgcctccggttagctggtctgatatttcttactatcataatcagattctcccattgattcaaaagttcaaagttgtgcatttgaatagaaccgatgctaggcttgctaataactttcaacccctcgaacttcaaaagcttagatgccgagcaaattttgatgctttgagatttactcctcagatagaagatttgggtagacgtgttgttagacttttgagacaaaacgggccatttttagtgcttcacctcagatatgaaatggatatgctagcgttttctggctgcacgcaaggatgcaatactgaagagattgaagagttgacgagaatgagatatgcttacccatggtggaaagaaaagataataaattctgatttgaaaaggaaagacggattatgccctttgactcccgaggaaactgctcttacacttaaggcactggatattgaccatgatattcaaatttacattgctgctggtgaaatatacggcgggaaaagaagaatggatagtcttgcagaggccttcccgaaactggtaagaaaggagactctgttagggccagatgaccttcagtattttcagaatcactcgtcacaaatggcagcattggactatctcgtgtcactagagagtgatatttttgttcctacttatgatggaaacatggccaaagttgtcgaaggccatcgcagattcttgggtttcaagaagacgatactattggacaggaggcttctggttgaattaatagacaaatacactagtgggtccttgacctgggatgaattctcgagtggtgtcaaggaagcacacgcccaacgtatggggaaccctacaaaaagattggttatcccagatagacctaaggaagaagattacttttatgctaatcctgaagagtgcttgcagccatcagatgatgaacctctgagcatcatgtaacaaatggtggattattttggtcaaattatttgtcgttggcctctactacagttttatgaactgtcaattagaaaaattatagttctctgctatcggaccagtcggtgtacaaggaagatctttccaaaatgtgaggatgcgacagcacagaccaaaatacattttggtgggactggtggttggagattcacgtaggcaacaatcttaccacgaacataaatggcgtttattattcttaatgtcttcttttcattttatatgtatcgttattgtcaataatttctcattcatgtatagaaaccgccctgccattgcagggttttatcgtccgtattcaaaactagttatatgtacacaaagagg

SEQ ID NO: 10006 - DNA, 1393 bp, Flaveria ramosissima
tggttacttggtggtttcgtgtaacggagggctcaatcaaatgcgttctgctatttgtgatatggttgcaattgccagatatttgaatgttactcttatagttcctgagctggataaaacttccttctgggctgatccaagcgagtttgaggacatttttgatgttgatcacttcattacatcattgagagatgaagtccggatacttaaacagcttcctcccaggcttaaaaagagagttgaattaggaattgtgcataccatgcctcctgttagttggtctgatatttcttactatcataaccagattcttcctctgattcaaaaatacaaagttgtgcatttgaacagaactgatgctcggcttgccaataatggtcaacccttgaacttcaaaaacttagatgtcgagtaaacttcagtgctctgagattcactaatcaaatagaagaactgggtagacgtgttgttcaacttttgagacaaaacgggccttttctagtgcttcatctcagatatgaaatggacatgttagcattttctggctgtacacaaggatgcaatgctgaagaggttgaagagttgaccagaatgagatatgcttatccatggtggaaggaaaagataataaattctgatttgaagcggaaagacggtttatgccctctgaccctgaagaaactgctcttacacttagggcacttgatattgaccgtgacatccagatttatatcgctgctggtgaaatatacggtggaaaaagaagaatggaaagtcttgcagatgcctacccaaagctggttagaaaggagactctgttaggggaagatgaccttcagtatttccaaaaccactcatcacaaatggcagcattggattaccttgtgtcactagagagtgatatctttgtacctacatacgatggaaacatggccaaagttgtagaaggccatcgcaggttcttgggtttcaagaagacaatactgttggacaggagggttttgactgagttaatagacaaatatacaagtgggttgttgagttgggatgaattctcaagtgcggttaaggatacacacgcacagcgaatggggaacccttcaaaaagaacagttatttcagatagacccaaagaagaagattacttctatgcaaatccagaagaatgcttgcagccatcagatgatgatgaacctgtgagcatcctatgattaaggatttgtcagttaatttggcccgttgggcttgataaagtgtctgaattacacgattacaattcttggtcctcgactctgttagtgtacaatgagtatttgttcaaagtatgaggatgccacacattttggtgagacgtatggttcgcaatgcacacaaacaacaaagcttccacgaa

SEQ ID NO: 10007 - DNA, 2574 bp, Populus trichocarpa
tctgaatctatctaaaaaacgtgtggaaagtgacgaggcaggcggtgtttaccggttcacaccatgagtccataacacaatagatcttccttttctctctctactctccaccactccacattttgtttgctgcttttgtctttaattaccactatagttgttttttttttaatattgttattgttgttgtttactacatcattttttctctttaatcgccgccgaccaagaagaaaaatagtcgagatcgtggagagatttgtttattttttttgattgatctgaaggaaattgagatttatatgtattttttttcagttttggatctccaaggttttgattacagttaccgatcctgcattgttggaaaataacaataataaaaaaaaaacagaagaggaacggcaggtcattttgaatgggggataaatgtgcagaatagagagaaagtgtgggggaggaggaggagagaaagataaggagactatgggggtagttaaaggagtggaaaagattaggagtagtatatcaaggccgtcttcaaaaatgaagctgtggatgataagggcaacgacgtctgttttgttgtggacttgtgtggttcaattgacgacgatcggtgagatgtggggtcctagggttttgaaaggttggccttcttgttggcctccccaatctgtctctgccgccttgcaagagaatgttcctactgtccccgctcgcgttttgccaccaaagagggtttataagaacaatggatacttgatggtctcgtgcaatggaggtctcaatcaaatgagagcagcgatatgtgatatggttgctatcgcgagatatttgaatgttacgcttgtagtaccagagctggataaaacctctttttgggctgatcccagcgagttccaagacatatttgatgaggagcattttatcacatcattgagagatgaggttcgaatattgaaggaactgcctcctaggttgaagcagagagtggaactggggatgacctataccatgccaccagttagttggtctgatatttcttactatcataaccagattcttcctttgataaaaaagtacaaagttgtacatctaaatagaactgatgctcggcttgccaataatcgccagcctttagagctgcagaagttgcgctgccgtgtgaattatagttctctgagattcaccactcaaatagaggagttgggcaagagagttataaggcttctgaggcaaaatggtcccttcttggtgcttcaccttcgatatgaaatggacatgctggcattttctggctgtagtcaaggttgcaacaatgaagaggtggaagaattgacaagaatgagatatgcttatccttggtggaaagaaaaaataataaattcggacttgaagaggaaagatgggttgtgtcctttgactcctgaggaaacagctctcactttgagggcactggacattgatccgaatatccaggtttatattgcagctggtgaaatatacgggggtgaaaggagaatgtcaagtcttgcgtcagcttatccaaaactggtcagaaaggaaacactgttggaaccatcagaccttaggtacttccagaatcactcatctcaaatggcagcattggattatcttgttgcgttggaaagtgatatttttgtccctacctatgatggaaacatggctaaagttgttgaaggccaccgcagattcctcggctttaagaagacaattttattggatagaaggcttttggttgatctgatagatcgatacactaatggatcgctgaactgggatgaattttcatatgctgtaaaagaatcccattctgatcggatggggggaccaatgaaaaggttggtgatcccagacaggcctaaagaagaggattacttctattcaaacccagaagaatgtttgcagtcatcagaggatccgttgagtacatgatcgttatttgaagaacttgtgccatttatctgccccacagtgctagccgttctaccacagatcaaccgcttgttctctactagaggtccagcgatagtggagtttgtcttcaagaggcaattgaactatagggttgtgaacttcaagaaagcaagagatgatctgcggaagcaaacctaggttagtgttataaaatatacgcaaatactccaattcatgtatagaaagctcccctgccattacagggcgatgccaaattgacaagactgggtttgggttgtacacggatgcaaatatagttgtgtttcaccagaactgtcatctcgtggaaggataatcccattttcctttggcatttatttgtttcttttggatcgtgtgcgatcttgtaagttcctagcaaatataactttatagaatttttgttcgtaccatgctatgaaagatcattgcctctcctcttctattaagactaattatgcagcaaatgttcccggaccctaagtgcgaattatgtgctgtgtgatgactggaatgccctggattctccttgagtgaattataagccttcagaagaccgctttccagttggaataatatacgaatattcgagct

SEQ ID NO: 10008 - DNA, 1779 bp, Vinca minor
attatggtatttttttctcagtttgaggtaaaaaggagaaatattattttttcccctagatcgctgattgattgaagaatattgggggtgggttggtattggatgtatgggtggggggatatgtgtaaaatagaagaaaatcggagtaaagagaagaggaggagaaagtgggttttgggattagggttagggaagatgggattgaaaggttgtggtggggagagtagagtagagaagttgaagaattcaatggttacgaggtctagaatgaagctatggatgataagggcaactacttctgtgttgctttggacttgtcttgttcagttaactgcattgggtgagacttggggtcctagggttttcaaaggttggccctcttgttttcatcaggatgctgctgcttcagtggctatggatgttaaatctgaccatgaatatgtcccagctcgtgttctccctcctaaaagggtttacaagaacaatggttatttgatggtttcttgcaatggaggccttaaccaaatgcgggcagcaatatgtgacatggtggcaattgcgagacatttgaatgtgacacttatagttcccgagttggataaaacttctttctgggcagatccaagtgaatttcaagacatatttgatgttgatcattttattacatccttgagggatgaagtacgtgttctgaaagagctgccgcctagactcaagaagagagtggagctaggaatgttatataccatgccacctattagttggtccgacatttcttactatgaaaatcaaattcttcccctgatacgcaagtataaagttgtgcacctgaacagaactgatagtcgacttgccaataatgggcagcccatggaaattcagaagctacgatgccgagttaattttggcgctctgcgatttacacctcagattgaagagttggggaggaaggtcattaaacttctaagacaaaagggtcctttcatagtactccatctcagatatgaaatggatatgttagcattttctggctgtactcagggatgcaacacggaggaggtggaggagctgaccggaatgagaaatgcttatccatggtggaaagaaaaaataataaattctgatttgaagaggaaggatggtctgtgccctttgacgcctgaagaaactgctcttaccttgagagcattagacattgatcgcagttttcaaatctacattgctgctggggaaatatatggtgcagagaggagaatggctagtcttgctgcatcttatccaaatttggtcagaaaggagacgctgttgaacccttcggatcttaggttcttccagaatcattcttctcaaatggcggcactagactatcttgtttcattggagagtgatatatttgttcctacatatgatgggaatatggcaaaagtagttgaaggccatcgcagatatcttggttacaagaagacgatcttactggacagaaggcttctagttgatttgatagaccaatacaatatgggatcactgacttgggatgagttttcggctgctgttaaggactctcatggtgagagaatgggtaaaccgagcaaaagactggtaattcctgatagacctaaagaagaggattatttctacgccaacccatgggagtgtttgcaaccctcaaacgatgatgaattgcttagtaacatctaaacgtcaatggtggtagcgtttcttttagattattgctacgcaatttcctatgctaaaccagagtcaaattggcgtcaatat

SEQ ID NO: 10009 - DNA, 2604 bp, Petroselinum crispum
ctgaaagagctgtatctgtatgtatatttctttattttgtatgtatatacagtctccttgccagttgccactacaactcttttattatttgtgcaccccacgactcctatcactgtcctcattcttactttcttctcctctccccccaccgtcgccgacatttctagattccggccaacccatgtcggaaaattcttccctttttccacaattttacttttttcattgaattactctgacccattttgttctttagtgtttcttgattgaatcaatagtctagttgtattgcaatcatgggttttgtttacattgtgtgataaagttgctgtctttgtgtgcttttttggtgaatgaatcttggtagatgtatttgcaagtgttggaacaaaaaagtttcaattttgatactatttaagggtagttgttgaattcttgaatttagttgattgtgtgtttttgcattatcaatagtgtatagagatcacttggatattttggtgaattttgtggaattttttgggtattttgtgtttgattgagatttatagtttagaaatatgtgcataaaagatgagattgagagggttgaggaggggggagaaaagaagaggagaaggagatgggaaacagtaatggggttgaagggtagtagaaaaaggatggagaaaataaggagttcaatggcttcgaaatctcgaatgaagttgtggatgataagagctactactttggtgttgttagggacttgttttgttcaattaacagctgtgggagaggtttgggggcctagggtgttgaagggttggccttcttcctttgttcaagattctactaaaatggatgttaagttgtcgacaagccttccggttcaagttcttccacccaagagagtttataagaacaatggatatttgataatttcatgcaacggaggccttaaccaaatgcgtgcagcgatctgtgacatggttgctattgcaagatatctaaatgtgactcttatagttcccgagctggataaaacctctttttgggctgatccaagtgaatttcaagatatatttgatgttgatcatttcatctcatccttaagagacgaggttcggattctaaaagagctgcctcctaggctcaagaggagagtggaactgggaatgttctacactatgccacccattagttggtctgacatttcttattatcgtaatcagattcttcctctgatacagaaacataaagttgtacatttgaacagaacagacgcccgtcttgccaacaatggtcaacctctcgaaattcagaagctccgctgccgagtgaacttcagtgctttgagattcacttcccagatagaggagttgggtaggagggttatcaagcttttaaggcaaaagggtcctttcttagtacttcatctaagatatgagatggacatgttggcattttctggttgtacacagggatgcaacgaagaagaggttgaagagttgacaaaaatgagatatgcttacccgtggtggaaagaaaagatcatagattccgacatgaaaagaaaggatggtctgtgtccattaagtcccgaggaaactgctcttacactaagagcactggacattgatcgtgacattcagatctacattgctgcaggagaaatatatggtggtgggagaagaatggctgatctttcagctgcttatccaaaagtggttcgtaaggagactctgttgggtccatcagaccttagatatttccagaatcactcttcccaaatggcggcactagattatcttgtctctctggaaagtgatatttttattcctacatatgatggaaacatggccaaacttgttgaaggtcatcgcagattccttggattcaagaaaacaatacttctggacagaaggctactagttgatttgatagaccaatataaccatggattgctgaactggtctgagttttcaatggcggttaaaggagttaatgcagatcgcatgggaaatcctaccaagaggatagtgattccagatagacctaaagaagaagactttttctatgccaacccagaggaatgccttatatcatcagattcatctgaaactttgaaattatcatcctgataatgctgctagcacatgggcgccattttgacgttcaatggtatataacacagtattccacctttacgaatcaagatcaccggtgactagggagaatattgtttctgaggagggtaaattatatattgcgagggcattggaaatacataggatcttctttttgatattttataataattcaattcaattgaaagtatagaagttacactgccattgcagagttgatcaaaagagaggtacatacataaattttgatctctgaatttagcaaattagtattagtcctaccgttcttatttttgaatccttgttaatgttaatcagcataatgattcttaattgtattgcacagaaggtttatattaataaatctgcatgttctgttctgagcagtggctactattcttgatggtgctttagttaaacatggtcacttcagtgagttgtaactataatttcttttatatgcaataatagatcc

SEQ ID NO: 10010 - DNA, 2023 bp, Helianthus annuus
attaactcataattcaggggtaggtgggaactgatgaatgcaagaaatatgaaaaacagaattggaattaacaacatgggtttgaagagaataggggaagaaaagattattaaggcacatgtaaggtctgctaaaatgaagatttggataattagggggacagcaatggttcaattaactgcattaggggatgtatggggaccaagtgttttaaaaggttggccttcagttactcaagattctcattctttggatgctaagtttttgtctactgttcctgctagagtccttccacacatgagggtttacagaaacaatggttacttgatggtatcatgtaatgggggactcaaccaaatgcgttcagcaatttgtgacatggttgcaattgcaagattcttgaatgttactctaatagttcccgagctcgataaaacatctttctgggccaatccaagtgagtttgaagatatatttgatgttgatcatttcattacatctttgagagatgaagtccagataattaaacttcctccaaggcttaaacaaagagtcgatttaggaatcgtgcatacgatgcctccagttagttgatctcatatttcttattatcataatcagattctccctttgattaaaaaatacgaagtcatgcatttgaatagaaccgatgctcggcttgccaataacggtcaacccattgaacttcaaaagctgaggtgtcgagtaaatttcgatgctttgagatttactcctcaaatagaatacttaggtaggcgtatcgttcaacgtctgaggcaaaatgggccatttctagtgctgcatcttagatacgaaatggacatgttagcgttttctggatgcacacaaggatgcaatcttgatgaggtggaagagttgactagaatgagatatgcgtacccatggtggaaagaaaagattataaactccgaattgaagagaaaagacgggttatgccctttgactcccgaggaaaccaccctcacactgagagcgcttgacattgatagggacatccagatatatattgcggctggtgaaatatacggcggtcaaaggcgaatggctgatcttgcagcggctttcccgaaactggtaagaaaagagactttactaggggcagatgaccttcaatttttccaaaaccattcatcacaaatggcagcattggactatctcgtatcattggaaagtgacatttttgtccccacgtatgacgggaacatggccaaagttgtcgaaggtcatcgcagatacttgggcttcaagaaaactataacattggaccgaaaactattggttgaactaatagacaaatacacaagcgggtcactgagttgggatgagttctcaaatgccgtaaagaacgcacactccgcacgaatggggagcccgaaaaaacgagtggttatttcagatcgaccgaaagaagaagattacttttatgcaaatccagaagaatgcttacagccattagagactaaacctgtgagcattttataatgagacttttgagggttagttaggtcacccatgagtcagtggtgccccgggcgggtctttcttgactttcgacccgcgggttgtgttggtggcgggttagagatattcgaaagagcgtatattggacctttgatagggttgggatgcgggtttattattagtatcttattttttaataatgcaaaaattatgtatagaaactagtcaactaccctgacattgcagggctatatattggtattcgaaacgtgattgatacgtccccttttaaaaaaaaaaaaaccccccccaaaaaaaaaaccgggccttttggtccaaaagggggggggtttccccaaaaaccttttttaaacacctcctggcccccccggggcgatttattttaaaattccgggggttttaggggggggggggttttcccggaccaggggggggggggttttttttatgggcttatcccgcccaaccccagggggggggggccccatttttgggggaa

SEQ ID NO: 10011 - DNA, 2285 bp, Glycine max
ctcgcgctctcttactcgccggcgatcgtttcagatcaatcgccgacgctgtccaatccactcgctctccggcgcattcagttgcattcaaaacgcgaggatctcgccgtttcgggtaatgcgcctcgaaattctggaatcgggagcctcgcggcgggtttggatctggaattgggggagggggaattgaatccaattgaaccgttagggtttggggcgcgggtgaggggggttgcatttatgaaggaagcggtgttgttaggagataagaagagcgagaggaaaagaggaggagggagggtggtttgggaagggttgatgatgatggggttgaagggacaaagtaataataataacaacagtaagttaaagaattcggttgtagtttcttcggcgaggtcttcgaggatgaaactgtggatgatacgcgccaccacatcggtgttactgtggacctgcgtcgttcagttaacggcgttgggggatatgtggggcccgcgtgtcctcaaagggtggccgtcgtgtttcacgcacggcgaatccgccgtgctcattgagttgccgtctgccaccacgcctagagtgctcccacccaagagggtttataagaataacggttacttgatggtgtcgtgcaatggaggactcaaccaaatgagggctgcgatatgtgacatggtggcgattgcaaggtatttaaacgtgacgcttatagtgccggaattggataaagcgtccttttgggctgaccccagtgagttccaagatatctttgatgtggaccattttattacatccttgagggatgaggtgcggatattgaaagagttgcctcctagactcaagacgagagtggaaaatggtttcctttacagcatgccaccgattagttggtctgacatatcatactataagaaccagattctacctttgatacaaaagtacaaagttgttcatttaaatcgaacagatgcccggctggccaataatgaccaacctttggagattcagcggctgcgttgcagagtcaattttagtgctcttagatttacttctcagattgaggagttaggcaaaagggtgatcaagcttctgaggcaaaatggcccatttttggtacttcatctgaggtatgagatggacatgctggcattttctggctgtacacaaggttgcaacaatgatgaagtggaagaattgacaaggatgagatatgcttatccttggtggaaagaaaaaataattaattcagatttgaaaagaaaagatggtttgtgtcctttaacaccggaggagactgccctcacacttagggcccttgacattgatcaaaacattcaaatctacattgcagctggggaaatctacggtggggataggagaatggcaagtcttgcgaagaactatccaaaattggtcagaaaggaaacactgttggaaccatctgaccttcagttcttccaaaatcattcctctcagatggcagcgttggattaccttgtctcattagagagtgatatctttgttcctacatatgatggaaatatggccaaagtagttgagggtcatcgcagatatcttgggttcaagaagacgattttattgaacagaaagctcctagttgatttgatagatcaataccatgatggaatattgaactggaacgaattctcttcagctgtgaaggaagttcatgctgatcgcatgggtggtgcaactaagagattggtgatgcctgacaggcccaaagaagaggattatttctatgccaatccagaggaatgtttagaactatcagatgatatgttgaggagtacgtgagtgacacgtttggaaataagagaatttacttgtgccctctcctagtgcaagtacttggttttctaccacagatgtttaagatgggtctctacgcagtttagcgaagaggatgacagctatttgtatcacagaggcagtcatatagtgactgttagaatggggaggggggaataggatttttcatgaaagctcgagaaggtcaagcaaggtagccgagggatactttatatatataatacgcaaataatccatcaccacattcatgtatagaagccacaccctgccattacagggtcagagcagatcaaactgcattgtacacggagggattcatatacaaatttggaattctggaagctttgttccttggtacctctcattttttccttctcttctaaatataaaatatatattataaattgtttttttttttacccaccctttaccacacctttttatttaac

SEQ ID NO: 10012 - DNA, 2755 bp, Glycine max
tgccaaaaatcaaaaagcaatagcagtaatagtattgattgggttgggtgcagatctcgcgatataatgtcggcgtgggcgagacgagacgagggtgccaaacgaaatcactcaccctcttctgggaaagccctcaatgaagggtcaccacgtatcccagccgaacatctggcctatcaatcgccgacgctgtccaatccactcgctctccggcgcattcagttgcattcaaaacgcgaggatctcgccgtttcgggtaatgcgcctcgaaattctggaatcgggagcctcgcggcgggtttggatctggaattgggggagggggaattgaattcaattgaaccgttagggtttggggcgcgggtgaggggggttgcatttatgaaggaagcggtgttgttaggagataagaagagcgagaggaaaagaggaggagggagggtggtttgggaagggttgatgatgatggggttgaagggacaaagtaataataataacaacagtaagttaaagaattcggttgtagtttcttcggcgaggtcttcgaggatgaaactgtggatgatacgcgccaccacatcggtgttactgtggacctgcgtcgttcagttaacggcgttgggggatatgtggggcccgcgtgtcctcaaagggtggccgtcgtgtttcacgcacggcgaatccgccgtgctcattgagttgccgtctgccaccacgcctagagtgctcccacccaagagggtttataagaataacggttacttgatggtgtcgtgcaatggaggactcaaccaaatgagggctgcgatatgtgacatggtggcgattgcaaggtatttaaacgtgacgcttatagtgccggaattggataaagcgtccttttgggctgaccccagtgagttccaagatatctttgatgtggaccattttattacatccttgagggatgaggtgcggatattgaaagagttgcctcctagactcaagacgagagtggaaaatggtttcctttacagcatgccaccgattagttggtctgacatatcatactataagaaccagattctacctttgatacaaaagtacaaagttgttcatttaaatcgaacagatgcccggctggccaataatgaccaacctttggagattcagcggctgcgttgcagagtcaattttagtgctcttagatttacttctcagattgaggagttaggcaaaagggtgatcaagcttctgaggcaaaatggcccatttttggtacttcatctgaggtatgagatggacatgctggcattttctggctgtacacaaggttgcaacaatgatgaagtggaagaattgacaaggatgagatatgcttatccttggtggaaagaaaaaataattaattcagatttgaaaagaaaagatggtttgtgtcctttaacaccggaggagactgccctcacacttagggcccttgacattgatcaaaacattcaaatctacattgcagctggggaaatctacggtggggataggagaatggcaagtcttgcgaagaactatccaaaattggtcagaaaggaaacactgttggaaccatctgaccttcagttcttccaaaatcattcctctcagatggcagcgttggattaccttgtctcattagagagtgatatctttgttcctacatatgatggaaatatggccaaagtagttgagggtcatcgcagatatcttgggttcaagaagacgattttattgaacagaaagctcctagttgatttgatagatcaataccatgatggaatattgaactggaacgaattctcttcagctgtgaaggaagttcatgctgatcgcatgggtggtgcaactaagagattggtgatgcctgacaggcccaaagaagaggattatttctatgccaatccagaggaatgtttagaactatcagatgatatgttgaggagtacgtgagtgacacgtttggaaataagagaatttacttgtgccctctcctagtgcaagtacttggttttctaccacagatgtttaagatgggtctctacgcagtttagcgaagaggatgacagctatttgtatcacagaggcagtcatatagtgactgttagaatggggaggggggaataggatttttcatgaaagctcgagaaggtcaagcaaggtagccgagggatactttatatatataatacgcaaataatccatcaccacattcatgtatagaagccacaccctgccattacagggtcagagcagatcaaactgcattgtacacggagggattcatatacaaatttggaattctggaagctttgttccttggtacctctcattttttccttctcttctaaatataaaatatatattataaattgtttttttttttacccaccctttaccacacctttttatttaacacgaccattatgattttgaggattactttcactgtaaaatctgtttgttcatgattattgcctccaaatttcttattagcttttggtcattattattaagggtaatggtaggttggacttttctttcctttgtgttttctctaatttatattcatttatacttgacagagtgttatcttatccatcgaccattatatggcccataattcgtaactataattcatgatacaataatatgatgatattacatcaacttaattgcttaaacaatgtcatcttatcatcaaccaccaaaaagtgctgaaccaataaacccatttgaacagtga

SEQ ID NO: 10013 - DNA, 2522 bp, Theobroma cacao
tcatcgcccacgaggaggaggagttttttttttatgttttgaaaattagtttattattcgattggaattcgttaatttgttgcgttgcattttgaagaagaggaaacaattggatctctttgattgattttgaatattttgttaaaattttgtaagttatcggatctcgaagattctgttaggttttattttttggaaaataaaagcacagcaagggaattttttcccttttttttcgggtggttactaaattgggcgaaaatgatctgaaaatcaacctacattgatcgaatttgaaacgaacgaagcggagtcgtattgggggatgagggggagagtggggaatatcgttgttgttggagatgtgcagtgttgaggggttagggagaaagggcgggataagaatgggggtgatgaaagcgggaggaggaggcggcggggagagagtggagaagttgaagagctcgagaatgaagctgtggatgatacgcgccaccacatcggtgttgctttggacttgcatcgtacaattaacggctttgggagagacatggggaccacgagtccttaagggttggccttcctgtttctctcatcaggattcctccgtttccgttattgaagacagagtcccctccgttcccgcccgtgtccttcctcccaaaagggtatataaaaacaacggttacttgatggtttcatgcaatggaggtctcaatcaaatgcgagcagcaatttgtgacatggttaccattgcaagatatttaaatgtcacccttatagtcccggagctagataaaacatccttctgggctgatcccagtgaatttcaagatatatttgatgtggatcatttcattacatcactgagagatgaggttcggatattgaaggagctgcctcctaggcttaagaggagagtggaaatgggactggtgcattccatgccaccagttagttggtctgatatatcctactaccatcagcagattcttcctctgatacagaagtataaagttgtacacttaaatagaactgatgctcgactggccaacaatgggcaacctttagatattcagaagctgcgatgtcgtgtaaattttaatgctttgagattcacttctcagatagaggagttgggtaaacgagttattaagcttctgaggcaaaatggtccttttatagtacttcatcttagatatgaaatggacatgttagcattttctggctgtacccaaggttgcaacaatgaggaggtggaggagttgactagaatgagatatgcttatccctggtggaaagagaaaataataaattctgacttgaaaaggaaagatggtttgtgccctttgacgcctgaggaaactgcccttactttgaaggcgctagacattgatactagttaccagatctatattgcagctggtgaaatatatggtggagagagaagaatggcaagtctttctgcagcttatccaaaattggttaggaaggagactctcttggaggcatcagaccttaggttttttcaaaatcattcatcccagatggcagcattggattatcttgtttccctggagagtgatatttttattcctacatatgatggaaacatggctaaagttgtagaaggccatcgcagatttctggggttcaagcggacaattttattggacagaaggcttttagttgaactgatagatcagtacaatggtggatctcttaattgggatgagttctcagctgctgtgaaggaaactcatgaaagtcgcaaggggcaaccaacaaaaaggttggtgaccccagacagacctaaagaagaggattacttttatgccaacccagaagaatgcttgcaaccatcatatggtcaactaagtagcacgtgatctttctgtctggggactgtgacgattatcagtgtttttttgttagagtgctagctatcacacctgagaccaaaaggtagtttctctacaggaggatggatgatgacaatgatggtttttctttcgaggaggcagctgtggagatgactggggactcaaaaacttgaagaaagcctgggaggatcttgtgaagcagctggaggacaccaaaattattagtatatgcaaataatcagaatcatgtatagaagagctgccctgccattatagggtgatatcagatcaagaatgggttgttgtacacgagggatgcaagtatagatttggattactgagactggatttgtggaaggttaattcttcgccctcctgtcttgaatttttttgtttcttttaaatcactcacaatctagttagctagcatatatcaatcacattctagaattcaatcttgtcacaccctacacagaccaatgtttttgtttctagtatggccccatcaatgcagggaatggttgaaaggcattgaatattatcttttactacacgtatcttgtaaattaaatggtgcggttcttgacatttttggttgagtaacttggtgttgccttccagttgggatagtatggtcag

SEQ ID NO: 10014 - DNA, 2477 bp, Sesamum indicum
ctctctcctctgccattcttctctctctgggaagcttgccgccggcgggtcatataatcttgccgagatatctgccggatctctgccactcgttgttttctgggacccattttcatttctccggcgaaaaacctttttctgggactgggatcgatcttgatcgatccccatttttgtgttgctcgtgggtaatgtgcctgtaatataaccggctttattgggtttccattctgggaaagaatcttggcttgtaccagtcaattttcttgtatatttctacgtttagatttgcaattttgtttctgttcctagccgttgcgcgtttctgttaatccctcaacatatccatttagagagatcaaattttgggatcacatcatcactccagggcgacgtcgtccgagcagtctgctgtaggtgagggagtttatgggtttgtgggcatgtgcaaaataaagggttgtgaagagactaataggaggagaaggtggggaataatggggctgaaaacagcggcatttgcgggggacagattggagaagctaaggaatagtgggatggtttcgcggtcaagaatgaagctttggatgattagggctactacgtcggttttgctgtggacttgcttagttcagttgacggcattgagtgaaacttggggtcctcgggtgttgaagggttggccctcttgcttttctcaggaatccgccgcttctgccgccgttgccttggatgttcattcgtcccctgaactcccagctagagttcttccacccaagagggtgtacaagaacaatggttacctgatggtttcgtgcaatggagggcttaatcaaatgcgggctgcgatatgtgacatggttgcaattgccagatacctaaatgttacgttggtagttcctgaacttgacaagacgtctttttggaatgatcctagtgagttccaagacatatttgatgttgatcattttattacgtccttaagagatgaagtccggatactgaaggagttacctccaagggtcaagaggagggtagagatggggatgttctacacaatgccgcctgttagttggtcggatatctcttactatcacaatcaaattcttcctctgattcagaaatataaagttgtccatttgaacagaacagatgctcggcttgccaataatgatcagccaatggagcttcagaggctccgttgccgagtaaactttagtgctctaaaatttactcctcagattgaagaattgggtaggaaggttattaaaatattaaggcaaaatgggcctttcatagtactccatctgagatatgaaatggacatgttggctttttctggctgcactcagggctgcaatacagaggaggtggaagaattaacaagaatgagatatgcctacccgtggtggaaagagaagatcattgattctgatatgaaaaggaaagaaggtctatgtcctttaacacctgaggaaactgcactcacattgcgggcactggacattgatcccaatatccagatttacatagctgctggagaaatatatggtggagaaagaagactgtccagtcttacatcattttatccaaatttggtaaggaaggagacgttgctggagccttctgatcttcggttcttccaaaatcactcatctcagatggcagctctggattatctcgtttcactggagagtgatatctttgttcccacatatgatggaaacatggctaaagttgttgaaggacaccgcagatatcttgggtacaagaaaacaattttactggacagaaggatgctagttgatttaatagacaagtacaattttgggtctctgacttgggatgagttctctgctgctgttaaagacgcccatgctttacgcatggggaatccgtccaaacggctggtgattccagacagacctaaagaagaggattacttttacgcaaacccctgggagtgtttgcagccactaaacgaagacgaacgactactactagatagcatttgaaccttacccgttgagtatttggctagagatccatgcatttctgtgatggatatagactcagtattcctcaagacggccacagtgaaaaggtggattttgttttcaggaggtgcaacttgaacaaagtcgaaagaggtatggagaaaagcagctgtattaattgttctttttatctcgagttaataattcaattaatgtatagaatctcccctgccgttttaagggtttatatagacctgtccgcgcgctgtacacatagagatacaaatatagatttctttttactgcaactatcgatttgcagtagcttaagctttcactcatcacttttgccttatctttctgttctatcattaccatttttgaagggggattgacatctattgctcatcaggttgttcctgtgtttgcccaatgaaaaatattgatacttgacgtgtttgtttataatgtaaaatccac

SEQ ID NO: 10015 - DNA, 2473 bp, Lupinus angustifolius
ctctgtcataacacgcacagcacctatattaataattgtcctcgcgctttcgtctactcgccggttgtttcaaacgccacgctccggccatttttctgaacattctttaccctttctttcaacccttttgtcccataaattgaaagatcttctcttttttttgtttttttctgttggggtttctattttttggatataaaccattgtgcttctctcgggtccctgtgaaaaaggcattgttttgtgtgagatgtgcaaggtgaataaaaagagaagcgaaagcaataataaaaagtgtaacttgaaggagttgggttggatgggtttgaagagggtagggttaggggtagagggtaaagttgagaagttgaggaatagcattggtattagaataggtatgggtggttcatcttcttcatcttcttcttcttcttcaaggtctcagatgaagctgtggatgatacgcgccaccacatcgataatgctatggacttgtattgttcaattaacggcattgggagacatgtggggtcctagagtattgaagggatggccttcttgttttactcatgattctgccattgctgctcttgattctcacttttcaactccacctcatgtttttcttccccccaaaagagtttataaaaacaatggatatctaatggtctcttgcaatggaggactaaatcaaatgcgagctgcgatatgtgacatggtagccattgcaagatatttaaatgtcacacttatagtccctgaattggataaagcatccttttgggctgatcccagtgagttccaagacatatttgatgtggatcattttattgcatccttgagagatgaggtgcgcatattgaaagagttgcctcctagactcaagctcagagtggagaatgggcaactttactcgatgccgcctattagttggtctgacatatcgtattatcagaaccagattttgcccttgatacaaaagtacaaagttgtccaattaaatcgaaccgatgcccggctggccaataacaatcaacctctagagattcagaagttacgctgccgagttaattttagtgctctgagatttactcctgagatagaggagttgggcagaaaggtgatcaaccttctacggcaaaatggtccatttctggtacttcatctgaggtatgagatggacatgttggcattttctggatgtactcaaggctgcaacggcgaagaggtagaagagttgacaaggatgagatatgcttatccttggtggaaagaaaaaataattaattctgatttgaaaagaaaagatggtctatgtcctttaacacccgaggagactgcccttacgcttaaggcccttgacattgatcggaacattcaaatctacattgcagctggtgaaatatatggtgggcaaaggaggatggcgagtcttgcaaaggattacccgaaattggtcaggaaggaaacattgttggaaccaactgaccttcaattcttccaaaaccattcatctcagatggcagcattggattatcttgtctcattagaaagtgatatctttgttcccacgtatgacggaaatatggccaaagttgttgagggccatcgcagacatcttgggtacaagaagacgattttattggacagaaagcaactagtggatttgattgatcagtacaacaatggagcactgaactgggacgagttctcttcggcagtgaaggaagctcatgctgatcgcatgggtaacccgacgaaaagggtaataatccctgacaggcccaaagaagaggactatttctatgccaacccagaggagtgtttagaaccatcatcatatcttccgttaagcagtacgtgagcaacaagttcgtcaaaagtggaatttactcgcgccatcatctcgggtgcgcatggtttggttttctaccacagatactgaggtagttccactcagttatagcaaaagatcacagttttaacaaagtggcagtcatggtgatccaaaaagaaatagagggtgtggtggaatggatagtgaaacaaagcaaaaagggggaatactttatattatataatatgcaaataatccattccattccattcatgtatagaaggtaccctctcattatagggtaaaagcagttcatagctgcattgtacacaagagggattcatatacaaatatggattactgcaacttcaatccttggaagcttaatttattggtactttcctctttgatataagtatataatttttattttttgtccactatctttttatttcatcattgtgattttctggattatgcccactatacaatttgtttgttcttgtaatattattgtcccataatttcatattctttttgtttattcagcaaagctaggtgggttgaatttatttatttattctctccactttatatttttagtgataatgaatgctatttagaatcaattcttaa

SEQ ID NO: 10016 - DNA, 1874 bp, Beta vulgaris
ccacttttggggaggtttgggggatatgtgtagggtagagagtaatagtgaggagagagaaagcaggagaagaaggaggtggtggaagattggtatgggggttaaagttgtagtttgtgatgacaataagaaggagaaatcaaagagttcttcggcctcgaatatcggtggtggatcatcgaggtcgaagaagattaagttgtggatggtgagagcaacaacttcagttttactatggacttgtattgtcaatttgaccacttttggggaggtttgggggcctaaagttttgaagggttggccctcttgttttagtcaggattctccattggatctcaagttgtcatctactgtttctgtaccacctcgtgttcttcctcccaagagggtttataagaacaatgggtacctaatggtttcatgcaatggaggacttaatcaaatgagatcagcaatatgtgacatggtggccattgcaagatatttgaatgtcactctcatagtccctgagctggataaaacatctttctgggctgatcctagtgagtttcaagacatatttgatgttaatcattttataacatcattgagagatgaggttagaattctgaaggagcttccccctaggctcaagaaaagaatggagctaggaagagtccataccatggctcctgttagttggtctgatatatcctattataacaatcagatacttcctttgatacaaaagtacaagatcttgcatctaaacagaacagatgctcggcttgccaataatgttcaacctgtagaaattcaaaagcttagatgtcgagtgaattttagcgctttgagattcacttcacagattgaggagctcgggaaaagggttgtcaagttgctgcgtcaaaatggtccattccttgttcttcatttgcgatatgaaatggacatgttagcattttctggctgtacccaaggttgcaatactgaggaggtggatgaattgaccagaatgagatatgcttacccatggtggaaagagaagattataaattctgatttgaaaaggaaagatggactctgtccattgacaccagaggagactactttggcacttcgggctttagatattgatcctagttatcagatatatattgcagctggtgaaatatatggcggtgagaggaggccagccagtcttgccgaggcttacccaaagctagtcagaaaagagacattattggatcccgcagacttgagattttttcagaatcactcatctcagatggctgcattggattatcttgtttcactggagagtgatatctttgttcctacttatgatggaaatatggcaaaagttgttgagggacatcgcaggtaccttgggtacaaaaagactatcttgttggacagaaggttgttggttgatttaattgacaagtatactgttgggtcactaacttgggatgagttctcacttgctgtaaaggaaactcatgcccatcgcagtggacaaccgactaagaggttggtaatacctgacagaccaaaagaggaggactatttctactctaatcctcaggagtgtctccaatccgatgagcccttaactagtatctgatttatatacctgaagaaaagattcatgcccttgtgtttcttctatgacggctatttatagcaaatatcaggtataaaaaagatcttgatgcacattctacagtgctacacttacaggaatggctttgttttggccgctctctcaagaggattattggctattgctttaacgtatatatatatctctatatgatgcgggcaattttgagaaaaagtcgagatatttatcggagcgccagcagctggggctggagggagcgtaatatgat

SEQ ID NO: 10017 - DNA, 1231 bp, Echinacea purpurea
ttgtggacttgtttggttcagttgactgctttaggtggttcttggggacctagggttttgaaaggctggccttcttgttttactcaggattctcattctgctgctgtgttagatgttaagttgtttcctaatgttcctgtcagagttcttccacaaaagagggtttacaagaacaatggttacctactgatttcatgtaatggaggacttaatcagatgcgatctgctatatgtgatatggttgcaattgcaagatacttgaatgttacactcatagttcctgaactggataaaacttctttctgggctgatccaagtgaatttgaggatatttttaacgttgatcatttcattacatccttgagagatgaagtccggatacttaaacagcttcctattaggcttaaaaagaaagtggaattaggaatcctgcataccatgcctcctgttagttggtctgatatttcttactatcataatcagattcttcctctgattcaaaaatacaaagttgtgcacttgaacagaaccgatgctcggcttgccaataatggtcaaccccttgaacttcaaaaacttaggtgccgagtaaatttcaatgctctgagatttactcctcaaatagaagaattgggtaggcgtgtggtgaagcttctgagacaaaacgggccttttctagtactccatctcagatatgaaatggatatgttagcattttctggctgtacacaaggatgcaatgatgaagagattgaagagttgactagaatgagatatgcttacccttggtggaaggaaaagattataaattctgatttgaagcgaaaagacggtttatgccctttgaccccggaagaaactgctcttacacttaaggcacttgatatcgaccgtgacatccagatttacattgctgctggtgaaatatatggtggaaaaaggagaacggatagtcttgcagatgcctaccctaaactggtaagaaaggagactctgttgggagcagatgaccttcaatatttccaaaatcactcgtcacaaatggcagcattggattatcttgtgtcactagagagtgatatttttgtacctacttatgatggaaacatggctaaagttgtagaaggccatcgcagatttttgggttttaagaagacaatactgttggacaggagggttttggttgacctaatagacaaatatacaagtggattattgagttgggatgaat

SEQ ID NO: 10018 - DNA, 2753 bp, Citrus clementina
ctccaatcacaagttatacgcgtcgtttccacattctccgtctgtctctctctctctctctatatcttttgtgtctgtgtcgcgatcttaattttgcgaacctcggcgagaatctttcgtgtgaatatctcgccgttaatgttcggtttcgatttctcgtttatcttgtaagaagaagatataaaaaatccgtttcattgattcattttatttttattttttgattggtgcattaatagtggtttagggttcgttagcagcggcggttcggttgaagaagattgagaaagatcgcggattttgtgtaaatgcgagccccgcattttaaatgaaaatttgtttttcttcttgaggagataaaatcgaacaaataaatcttgttattcggggagaaattttatattgtgtgtcttcaaatttagtggatcacgttttgatcctatatttggaagatttggatctggtagattcggattaaataatcacgccatttaaagaaaattcattttttttatatcattttaaagttaattttcattttaggtatttgatgccatccacattgatgattataattcatacacgcgcataataaaaagtaaatttttggagagagaggagaggaggggcggccatcaaatctaattgaggaaaaaaaaaacgacgggtcgttttttatgttcttgtgcgggagatgtgtaggttagagaagagtgagagaaagagagagatgggaagtgggttagtgaaaggaggagtggagaagcatttgaagagttcatcatcgagaatgaagctgtggatgatacgggctacgacgtcggttttgttgtggacttgcatcgttcagttaacggcgattggcgagacgtggggtccccgggtactgaccgtttggcctccctgttttaaccgtgagtccgataccgcttctgctgttgttcaggataaggttccggccgttcccgcccgtgttctcccacctaagagggtctacaagaacaatgggtacttgatggtttcatgcaatggaggtctcaatcagatgagagcagcgatttgtgacatggtggctattgcaagatatctgaatgtcactcttatagtccctgaattggataaaacttccttctgggctgatcctagtgagttccaagatatatttgatgtggatcattttattacatcattgagagatgaggtgcggatactgaaagagttgcctcctaggctgaagaagagagtggaaatgggaagggttttgtccatgccaccaattagttggtctgatatatcttactatcacaatcagattcttcccctggtacagaagtacaaagttgtacatctcaacagaactgatgctcgacttgccaataatggtcagcctttagagattcagaaactgcgttgccgtgtaaattttagtgctttgagattcacctctcaaattgaagatttgggtaaaagagttatcaagcttctacggcagaatggtccttttcttgtacttcatcttagatatgaaatggacatgttggcattttctggctgcactcaaggttgcaacaaagaggaggtggaagaactcacaaggatgagatatgcttatccttggtggaaagagaaaataataaattctgacttgaagaggaaagatggattgtgccctttgacacctgaggaaacagctcttatattgagggccctggacattgatcctaatatgcagatttacatcgcagctggtgaaatatacggtggcgaaaggaggatggcaaatcttgctaaagcttatccaaaattggtcagaaaagaaacgctcttggaaccatcagaccttaggtttttccaaaaccattcatcccaaatggcagccctagattatctcgtttcattggagagtgatatatttgttcctacatatgatgggaacatggctaaagttgttgaaggccatcgcaggttccttgggtacaagaagacaatcttattggaaagaaagcttttggttgatctgattgaccagtatagcaatggatcactgacttgggatgaattttcagcagctgttaaggaatctcatgcggatcgcatgggagggccaacaaatagattggtgatcccagacaagccaaaagaagaggattacttctattccaacccagaagaatgtttgcaaacgtcatcattcgatccgttgagtagtacgtgattactgtaatctacacaagatttgtggcattttaccagtgttttcctagagtgccgactactagacagcagatcaaaaggtagttcccacaacaatggtatagcgatgacacagaaaattttgttcctaagaacaataacggtatctgaaagaaaaagccagagataatcttgggaagggagctggaggatgtcaaggtcattttatatatatgctaataatccaattcgtgtatagaatcggccctgccattacagggtgataagagagatttaaaaaaaaaaaaaggaagaaactatggggttgtacacactgagggagcaaatgatagaattggtttactggaaccgaagattcatggaaggtttgtgtccctcatccgctttctgttttgtattttcattttcttttgttttgttccttttccgatcgtccatgatctttgtgagttccttcctacttcctagcatcatatgattcacattccgaaatttatttatctgttcacacatataattattcttttatcacatagttt

SEQ ID NO: 10019 - DNA, 2767 bp, Citrus sinensis
ctccaatcacaagttatacgcgtcgtttccacattctccgtctgtctctctctctctcttctatatcttttgtgtctgtgtcgcgatcttaattttgctaccctcggcgagaatctttcgtgtgaatatctcgccgttaatgttcggtttcgatttctcgtttatcttgtaagaagaagatataaaaaatcagtttcattgattcattttatttttattttttgattggtgcattagtagtgctttagggttcgttagtagtggcggttcggttgaagaagattgagaaagatcgcggattttgtgtaaatgcgagccccgcattttaaatgaaattttgtttttcttcttgaggagataaaatcgaacaaataaatcttgttatttggggagaaattttatattgtgtgtgttcaaatttagtggatcacgttttgatcctatatttggaagatttggatctggtagattcggattaaataatcacgccatttaaagaaaattcattttttttatatcattttaaagttaatttcattttaggtatttgatgccatccacattgatgattataattgatacacacgcataataaaaagtaaatttttggagagagaggagagaagaggagaggaggggcggccatcaaatctaattaaggaaaaaaaaaaaaacgacccgtcgttttttatgttcttgtgcgggagatgtgtaggttagagaagagtgagagaaagagagagatgggaagtgggttagtgaaaggaggagtggagaagcatttgaagagttcatcatcgagaatgaagctgtggatgatacgggctacgacgtcggttttgttgtggacttgcatcgttcagttaacggcgattggcgagacgtggggtccccgggtactgaccgtttggcctccctgttttaaccgtgagtccgataccgcttctgctgttgttcaggataaggttccggccgttcccgcccgtgttctcccacctaagagggtctacaagaacaatgggtacttgatggtttcatgcaatggaggtctcaatcagatgagagcagcgatttgtgacatggtggctattgcaagatatctgaatgtcactcttatagtccctgaattggataaaacttccttctgggctgatcctagtgagttccaagatatatttgatgtggatcattttattacatcattgagagatgaggtgcggatactgaaagagttgcctcctaggctgaagaagagagtggaaatgggaagggttttgtccatgccaccaattagttggtctgatatatcttactatcacaatcagattcttcccctggtacagaagtacaaagttgtacatctcaacagaactgatgctcgacttgccaataatggtcagcctttagagattcagaaactgcgttgccgtgtaaattttagtgctttgagattcacctctcaaattgaagatttgggtaaaagagttatcaagcttctacggcagaatggtccttttcttgtacttcatcttagatatgaaatggacatgttggcattttctggctgcactcaaggttgcaacaaagaggaggtggaagaactcacaaggatgagatatgcttatccttggtggaaagagaaaataataaattctgacttgaagaggaaagatggattgtgccctttgacacctgaggaaacagctcttatattgagggccctggacattgatcctaatatgcagatttacatcgcagctggtgaaatatacggtggcgaaaggaggatggcaaatcttgctaaagcttatccaaaattggtcagaaaagaaacgctcttggaaccatcagaccttaggtttttccaaaaccattcatcccaaatggcagccctagattatctcgtttcattggagagtgatatatttgttcctacatatgatgggaacatggctaaagttgttgaaggccatcgcaggttccttgggtacaagaagacaatcttattggaaagaaagcttttggttgatctgattgaccagtatagcaatggatcactgacttgggatgaattttcagcagctgttaaggaatctcatgcggatcgcatgggagggccaacaaatagattggtgatcccagacaagccaaaagaagaggattacttctattccaacccagaagaatgtttgcaaacgtcatcatttgatccgttgagtagtacgtgattactgtaatctacacaagatttgtggcattttaccagtgttttcctagagtgccggctactagacagcagatcaaaaggtagttcccacaacaatggtatagcgatgacacacaaaattttgttcctaagaacaataacggtatctgaaagaaaaagccagagataatcttgggaagggagctggaggatgtcaaggtcattttatatatatgctaataatccaattcgtgtatagaatcggccctgccattacagggtgataagagagatttaaaaaaaaaaaaaaggaagaaactatggggttgtacacactgagggagcaaatgatagaattggtttactggaaccgaagattcatggaaggtttgtgtccctcatccgctttctgttttgtattttcattttcttttgttttgttccttttccgatcgtccatgatctttgtgagttccttcctacttcctagcatcatatgattcacattccgaaatttatttatctgttcacacatataattattcttttatcacatagttt

SEQ ID NO: 10020 - DNA, 2363 bp, Panax ginseng
ggagtacgtagctatttttggtcgtcatttgttattttatttttgttgggtttaattggttgattatattccaattatggtttttttattgcagtagttttgcagttttttgggtccatttttgtaatgtgcgagaaagttactgtttttgtgtgctatttggggaaggaatctgttagttatcatcatttaaggtagagaaagattgggaattctgtatttagcaatatcggatcttgaagaaactttttgtaacaaggtcatccaaaatcttcacttttgtcatatatatatttttttttatcaatttcaaggatttttgttttgtgtttggtttaataaggttaaatttttgtggggttgttgtgttttgtgtatgtatggcgggaggggatataaagggcagttattatgcgcaaaatagaagagagagaaaaaagtgaggaggagaaagagaggaagaggagaaggagatgggggtaataatggggttgaagacatttggaggagaaagtagaaaaagaattgagaagctgaagagttcaatggtttctaagtctagaatgaagctgtggatgattagggctactacttcagtgttgttgtggacttgtttggttcagttaacagctttgggggagatgcgggggcctatggttttaaagggttggccttcttgtttttctcaggattctgctatggatgttaagttggttcaaaccattccaactagagttcttcctcccaagagagtttataagaacaatggttacctgatggtttcgtgcaatggagggcttaatcaaatgagggcagcgatatgcgacatggttgctattgcaagatatttaaatgttacactaatagttcctgagctggataaaacttctttttgggctgatccaagcgagtttcaagacatttttgatgttgatcatttcatcgcgtccttgagagacgaggttcggatactgaaagagctgcctcccaggctcaagaagagagtggaactaggaatgttctacacgatgcctcccatcagttggtctgacatctcttactatcataatcagattcttcctctaataaagaaatacaaagttgtgcatttgaatagaaccgacgctcggctcgccaataatggtcagcctcttgagattcagaagcttcgttgccgagtaaatttcagcactctgagatttacaactcagatagaggagttgagtaggagggttatcaaacttctaaggcagaatggtcctttcctagtacttcatctcagatatgaaatggacatgttagcattttcgggctgtagtcagggatgcaacaatgaagaggtggaagagttgacaagaatgaggtatgcctatccatggtggaaggagaagatcataaattctgacttgaaaagaaaggatggtctatgtccattaacccccgaggaaactgctcttacactaagggcactggacatcgatcgtgacatccagatttacattgctgcaggagaaatttatggtggagagaggagaatggctagtctcgctgctgcttatccaaaactggttcggaaggagactcttttgggaccatccgaccttggatattttcagaatcactcgtctcagatggcagcattggattatcttgtttctttggagagtgatatttttgttcctacatatgatggaaacatggctaaagttgttgaaggtcatcgcagattccttggtttcaagaagacaatcctattggacagaaggctactagtggatttgatagatcaatataatcatggatcgctgaattgggatgaattctctagtgctgttaaggaagctcatgcggatcgcatggggagccccaccaaaaggttggtgattccagacagacctaaagaggaggactatttctatgccaacccagaagaatgcttgcaatcatcaaatccatcagaagaactatcaacaagtattctctgagtgccagcttgtggtcccgttttgaccaatggactacgatgcaaattctgccatatttagggatcaaaattctcttcactgatgatgatgattcacgaggaaggagaattttgttttgaggaggcaattttgaatgattgcaagggaaggtttgttgcactgcacgtttaagaggatcttcggaaccaggtggagtttatttttaatcaaaatcattacggagtacattatcttctctaataattcaattcatgtatagaagtttccctgccattacagggttaaatcaaactccacaaaaggatgcagatattaatcctcctcctcctcctttttgttctactgttctttgaatacgtacattgaatatatacatac

SEQ ID NO: 10021 - DNA, 2292 bp, Amaranthus tuberculatus
cacagatcttatagaatcaacaatctggcaaccaattgtaaacagcattgattgataaatccccccaaaaccaaaatctttagcttattgatgtttccaattacaatcaattttgttacattattggtcttttcttactagtgactagggattataagattgagaaacaaaaaattagtgggatatgtgtaaattagagaagagtaatagtaattgtgaagtaagagaaagaagaagaaggtggtggtgggggattggtattggtatgggggttaaagttgtagttagtgatgataaaaaagagaaacccaaaacttgttcagcttcaaataatggtgttggatcatcaaaatacaagatgaagatgtggatagtaaaagcagtaacatcaattttgttatggacttgtgttgttaatttaaccacttatggacataattggggacctagagttttaaagggctggccttcttgttttactcaagaagctgctttggatcttaagttgccttcttctgtttctgttcctcctcgtgttcttccccccaaaagggtttataagaacaatggttatctgatggtttcttgcaatggaggacttaatcagatgagatcagcaatatgtgacatggtggccattgcaagatacctgaatgtcactcttatagttcctgaactggataaaacatctttttgggctgatcctagtgagtttcaagatatatttgatgtggatcattttattgcatccttgagagatgaggtcagaattctgaaggagcttccccctaggcttaagcaaagactggagctaggaagagtccatactatggctcctgttagttggtccgatatatcgtattataacaatcagatacttcctttgatacagaagtacaagatcgtgcatctaaacagaacagatgcccggctcgccaataatggtctacctatagaaattcaaaagcttagatgtagggtaaatttcagtgctttgaaatttacttcacaaattgaggagctcggaagaagggttgttaagctgctgcgtcaaaatggtcccttccttgttcttcatttgcgatatgaaatggacatgctcgccttttcgggctgtactcagggttgcaatagtgatgaagtagaagaattgaccagaatgagatatgcttatccatggtggaaagagaagattataaattcgtcgttgaaaaggaaagatggactttgccctttaacacccgaggaaactgccttggcgcttcgggctttggacattgatcctagttatcaaatatacattgcggctggtgaaatatacggtggtgagaggaggatggccagtcttgctgaagcttacccgaagctggtgagaaaagagacattattgaatcctgcggacttgagattttttcagaatcactcatcccagatggctgcattggattaccttgtatcattagagagtgatatctttgttcccacttacgatggaaatatggccaaagttgttgaaggacatcgcaggcaccttggatacaaacaaactatcttgccggatagaaggttattggtcgatttgatagacaagtataatgttgggtcattaagttgggatgagttttcagctgctgtgaaggaaactcatgcacaacgcaacggacaaccaactaagaggttggtaatacctgacaaaccaaaagaggaagactatttctactctaatcctcaggagtgtctccaatccgatgagcagctaagtagcatgtgacctatatgccccgtaaacaagatttatgcccttatgttcttctggaacgactagtcgtagcaaaaacgaggtactcggggatctcgatccacacttaacgatgctacactgaaaaattggcttcagttttactgcctctttatgatgactatggcggttgcgtatataaacataaatatatatcgagcaaacaatttttgagggaaaaaagtggaacgagcgggtggtggggggagaggatcatataagtgaaaaagtgttgtatagaacacaccctgccattacagggggtgaagatagatgcatccgatgtacatggagtgaatgccacgtagattcgttcgatttaaattcagggagtttgaggtagatttatataactcgctcatcctcgatgtttttgtgcttcttttctaatgaatattgttacatttatagaagttgattatcatctttgtttggctatcggttttagatttcttcattttcacgaaaatttagggttggttaggttcgtatcg

SEQ ID NO: 10022 - DNA, 2556 bp, Cajanus cajan
ctgaactcggcgccgatcattccacgtcactcgccgccggtcccttctctattcaattcgcccttttcccaaaattacagcaccttttcctttctctttatccctcgaataaacaattgtgcgctttcgatttggataacaagcctcgcactcctccgccgaagaactggtgtcgctgttaatgtggcagagaattgaacttcgctgacggtgacgctgacggttcttcaactcgaaatcggcgagtgtcggcattggcgaatgggggttcggtgagtgcgtgttaggttggatccgacgccgtttgggatctcggcggagaaaaagggggatcgaagcgacgtttagggtttggcggacatgaatagcgcattggggagagaataaatgtgcagggcggagtgggaaggttttatgggtttgaagaggtgggagagtaaggttcagaaggtggggatggggttagggtcggcttcaggttcggcttcggcttcgtctcgttccaagatgaagatgtggatgatacgggctaccacatcggtgttactgtggacttgcgtcgttcagttaacggctctcggtgacatgtggggtcccagagttttgaagggttggccttcttgtttcactcacgagtccgctgttagagcattggacatggagttaccctctccgcgtcctcctcttctccctcccaagagagtttataagaacaacggatacctcatggtctcctgcaatggagggctcaaccaaatgagagcagcaatttgtgacatggtggctattgccagatatttaaatgtcacgcttatagttcccgaattggataagacatccttttgggctgatcccagtgacttccaagacatatttgatgtggatcattttatcacgtccttgagggatgaagtgcggatattgaaagagttgcctcccaggctcaagctgaaagtagaacgtgggtttctttacactatgccgcctgtcagttggtcggatatatcttactataagaaccagattctgccattgatacagaagtacaaagttgttcatttgaatagaactgatgctcggttggctaataatggtcaacctatagagattcagaagctgcgttgccgagttaattttagtgctctgagatttacttctcagatagaggagttggggagaaaggtgatcaaccttttaaggcaaaaaggtccatttctggtgctccatctgaggtatgagatggacatgttggcattttctggctgtactcaaggttgcaacagggatgaggtggaagagttaacaagaatgagatatgcttatccttggtggaaggaaaaaataattaattccgatttaaaaagaaaagacggtttatgccctctaacacctgaggagactgcccttacgcttaaggctcttgacattgatcggaacattcaaatctacattgcagctggggaaatatatggaggggaaaggagaatggcaagtcttgggaaggagttcccaaaattggtcaggaaggaaacactgttggagccatctgaccttcggttcttccaaaatcactcatcccagatggccgcattggattatcttgtctcattggagagtgatatttttgttcccacttatgatggaaatatggccaaagtggttgagggccatcgcagatatcttgggtttaagagaacgattttattgaacagaaagctcctagtcgatttgatagatcagtacaataatggagtgctgaactgggatgagttctcttcggctgtgaaggaagctcatgcgtatcgcatgggtagccaaactaagaggctagtgatccctgacaggcccaaagaagaggattatttctatgccaacccacaggagtgtttggaaccatcaaatgatctatctgttggcgttgagtagtacgtgaggaatgtgttgggtaatagtggaatttacttgtgccatctcctggtgcacttggttttctaccacagatagttttccacgcaataacaaggtcgtgaaaaggtgacacccataaagaaaaagtgggtaaactctagtcaagcaaagcagccgggggacactttttttaatttattttatatatgcaaataatcaatccatcacattcatgtatagaagctaccctgccattacagggtgagagcagttcaaacagcattgtagacggaggaattcttatacaaatttggattactgcaactggccttcgtggaagcttaattcgttggttggacgatcttttttgtattctcttctcatatatttatagacaatgagtgtcatttctgaaataattaattcataattgctgaatgaagacttagctatcaaccctaaagtagtagttgaagagcaaataatacaacatgggataggaactcatgtcctgttccaagtctctagcatgttagtgtcgtgtttatactttatagataagcttataatttggtaagggggagtttgaggggagggtgttacattactccttggagcctatgttcccgagagagacatgttaacaat

SEQ ID NO: 10023 - DNA, 2054 bp, Glycine max
tagggtttgtggcgcggagggggtgcatttatgaaggaggcggtgttgttaggagagaagaagagtgagaggaagagaggagggagggtggtttgggaagggttgatgatgatgggattaaaggaagaaagtaataataactgtaagttaaagaattcggttgtggtctcgtcggcgaggtcttcgaagatgaagctgtggatgatacgcgccaccacatcggtgttactgtggacctgcgtcgttcagttaacgacgctgggggatatgtggggcccgcgggtcctgaaagggtggccgtcgtgtttcacgcacgacgaatccgccgcgctcattgagttgccgtccgccaccacgcccagagttctcccacccaagagggtttataagaacaacggttacttgatggtgtcgtgcaatggaggactcaaccaaatgagggctgcgatatgtgacatggtggcgattgctaggtatttaaacgtgacgcttatagtgcctgaattggataaagcgtctttttgggctgaccccagtgagttccaagacatctttgatgtggatcattttattacatccttgagggatgaagtgcggatattgaaagagttgcctcctagactcaagacgagagtggacaatggtttactttacaccatgccaccgattagttggtctgacatatcatactataagaaccagattctacctttgatacaaaagtacaaagttgttcatttaaatcgaacggatgcccggctggccaataatgaccaacctttggagattcagcggctgcgttgcagagtcaattttagtgctcttagatttacttctcagattgaggagttaggcaaaagggtgatcaagcttctcaggcaaaatggcccatttttggtacttcatctgaggtatgagatggacatgctggcattttctggctgtacacaaggttgcaacagtgatgaagtggaagaattgacaaggatgagatatgcttatccttggtggaaagaaaaaataattaactctgatttgaaaagaaaagatggtttgtgtcctttaacacctgaggagactgcccttacacttagggcccttgacatcggtcaaagcattcaaatctacattgcagctggggaaatatatggtggggacaagagaatggcaagtcttgcgaagaactatccaaaattggtcagaaaggaaacactgttggaaccatctgatcttcagttcttccaaaatcattcctctcagatggcggctttggattaccttgtctcattagagagtgatatctttgttcctacatacgatggaaatatggccaaagtagtcgagggtcatcgcagatatcttgggttcaagaagacgattttattgaacagaaagctcctagttgatttgatagatcgataccatgatggaatattgaactgggacgaattctcttcggctgtgaaggaagttcatgctgatcgcatgggtggtgcaactaagagattggtgatccctgacaggcccaaagaagaggattatttctatgccaatccagaggaatgttttgaactatcagatgttatgttgagtagtacgtgagtgatgcatttggaaataagagaatttacttgtgccctctcctagtgcgtgcacttggtcttctaccacagatacttaagataggtctctacgcagtttagcaaagatgatgacagcttttttgtatcacagaggcagtcatatagtgacagttagaatggggaagggggaatgggcttttcatgaaagctcgagaaggtagccgacggatactttatatataaaatatgcaaataatccatcatcaccacattcatgtatagaagccacaccctgccattacaggatgagagcagatcaaactgcattgtacacggaggggttcatatacaaatttggattctggaactgcagttcgtggaagctttgttcctttggtacctttcattttttccttctcgacaaatataaatatatatcataaattgttttttttttaccacaccttttta

SEQ ID NO: 10024 - DNA, 3158 bp, Glycine max
gcagatctcgcgatataatgtcggcgcgggcgagacgacggtgccaaacgaaatcactcaccaaaggaaaaagagggtacggcctctttttggaaagccctcaatcaagggtcgccacgtatccctgccgaacatctggcatgtgggccccacgcatctgcctcggcatttattggctcgttttaatgaggcgcacccaataaaataaaaacaaaccctctctctcacaccccccccaacacacacacccccataaccctctctttctctctttaatcttaaaccccgttacgacgtcgtacggcttgggctctttctccctctacccgaaccgaacaacaatcgtgaaaaaaaaaaaacagaataccttcattctctctctctcttactttctctattgcaacgcgttttattctctctcttataatatatttctccactcgcgctctcttactcgccggcgattgtttcagatcaatcgccgacgccgtccaattcactcgctctccgtggcgttcagttacattcaaaacgcgaggatctcgccgtttcgggtaatgtgcctcggaattctggaactgggaacctcgcggcgggtttggatctggaattgggggagggggagttggattgaattaagacattagggtttgtggcgcggagggggtgcatttatgaaggaggcggtgttgttaggagagaagaagagtgagaggaagagaggagggagggtggtttgggaagggttgatgatgatgggattaaaggaagaaagtaataataactgtaagttaaagaattcggttgtggtctcgtcggcgaggtcttcgaagatgaagctgtggatgatacgcgccaccacatcggtgttactgtggacctgcgtcgttcagttaacgacgctgggggatatgtggggcccgcgggtcctgaaagggtggccgtcgtgtttcacgcacgacgaatccgccgcgctcattgagttgccgtccgccaccacgcccagagttctcccacccaagagggtttataagaacaacggttacttgatggtgtcgtgcaatggaggactcaaccaaatgagggctgcgatatgtgacatggtggcgattgctaggtatttaaacgtgacgcttatagtgcctgaattggataaagcgtctttttgggctgaccccagtgagttccaagacatctttgatgtggatcattttattacatccttgagggatgaagtgcggatattgaaagagttgcctcctagactcaagacgagagtggacaatggtttactttacaccatgccaccgattagttggtctgacatatcatactataagaaccagattctacctttgatacaaaagtacaaagttgttcatttaaatcgaacggatgcccggctggccaataatgaccaacctttggagattcagcggctgcgttgcagagtcaattttagtgctcttagatttacttctcagattgaggagttaggcaaaagggtgatcaagcttctcaggcaaaatggcccatttttggtacttcatctgaggtatgagatggacatgctggcattttctggctgtacacaaggttgcaacagtgatgaagtggaagaattgacaaggatgagatatgcttatccttggtggaaagaaaaaataattaactctgatttgaaaagaaaagatggtttgtgtcctttaacacctgaggagactgcccttacacttagggcccttgacatcggtcaaagcattcaaatctacattgcagctggggaaatatatggtggggacaagagaatggcaagtcttgcgaagaactatccaaaattggtcagaaaggaaacactgttggaaccatctgatcttcagttcttccaaaatcattcctctcagatggcggctttggattaccttgtctcattagagagtgatatctttgttcctacatacgatggaaatatggccaaagtagtcgagggtcatcgcagatatcttgggttcaagaagacgattttattgaacagaaagctcctagttgatttgatagatcgataccatgatggaatattgaactgggacgaattctcttcggctgtgaaggaagttcatgctgatcgcatgggtggtgcaactaagagattggtgatccctgacaggcccaaagaagaggattatttctatgccaatccagaggaatgttttgaactatcagatgttatgttgagtagtacgtgagtgatgcatttggaaataagagaatttacttgtgccctctcctagtgcgtgcacttggtcttctaccacagatacttaagataggtctctacgcagtttagcaaagatgatgacagcttttttgtatcacagaggcagtcatatagtgacagttagaatggggaagggggaatgggcttttcatgaaagctcgagaaggtagccgacggatactttatatataaaatatgcaaataatccatcatcaccacattcatgtatagaagccacaccctgccattacaggatgagagcagatcaaactgcattgtacacggaggggttcatatacaaatttggattctggaactgcagttcgtggaagctttgttcctttggtacctttcattttttccttctcgacaaatataaatatatatcataaattgttttttttttaccacacctttttatttaacacgaccattgtgattttgaggattgagtcactgtaaaatttgtttgttcctgattattgcctccaaaattcttagcttttggtcattattaaagagaatggtaggttggacttctctttcctttgtgttttctctaatttatatttatttatacctgacagagtgctatcttatccatcgatcattatatggctcttaattcgtgactataattcatgatacaataatatgatgatagtacatcaacttaattgcttaaacaatgccattttatcatcaaccaccaaaaaagtgctgaaccaataaacccatttgaacagtgaactcttgtcctcatgtgagatcgtctttctaacaaatggttttggatggaacttgacttgttttattggttggggtgcttatcttataattaggcaaattggagttgttataagttaagtctttgttccgg

SEQ ID NO: 10025 - DNA, 1749 bp, Glycine max
gacggttatgaagagagaagaataaaataaatgtgcagggcggagtgggaaggttttatgggtctgaagaagtgggaaagtaaggttccgaaggtgggaatgggaatgggtgtgttaggttcgggttcgggttcgggttcgtcgcggtcgagaatgaagatgtggatgatacgggcgaccacatcggtgttactgtggacctgcatcgttcagttaacggcgttgggtgacatgtgggggccgagagttttgaaaggttggccttcttgtttcactcacgagtctgccgttagagcaatggatgtcgagctaccgtcaccgcgtcctcctcttctccctccaaagagagtttataaaaacaatggttatcttatggtctcgtgcaatggaggactcaaccagatgagagctgcgatatgtgacatggtggctattgctcgatatttaaatgtcacgcttatagttcctgaactggataaaacatccttttgggctgatcccagtgacttccaagacatatttgatgtggatcattttatcacttccttgagagatgaagtgcggatactgaaagagttgcctcccagactcaagctgaaagtggagcgcgggtttctttacaccatgccgcctattagttggtctgatatatcttactataaggatcagattctacccttgatacaaaagtacaaagttgttcatttaaatagaactgatgctcggttggccaataatggtcaaccgctggagattcagaagctgcgttgccgagttaattttagtggtctgagatttacttctcagatagaggagttgggcagaaaggtgatcaggcttcttaggcaaaaggggccatttctggtgctccatttgaggtatgagatggacatgttggcattttctggctgtactcaaggttgtaacagtgatgaggtggacgaattgacaagaatgagatatgcttatccttggtggaaggaaaaaataattaattctgatttgaaaagaaaagatggtttatgccctctaacacctgaggagactgcccttacgcttaaggctcttgacattgatcagaacattcaaatctacattgcagctggggaaatatatggaggggaaaggagaatggcaagtctagcgaaggagtacccaaaattggtcaggaaggaaacgctgttggagccatccgaccttcagttcttccaaaatcattcatcccagatggcagcattggattatcttgtctcattagagagtgatatttttgttcccacatatgatggaaatatggccaaagtggttgagggccaccgcagatatcttgggttcaagaaaacgattttgttgaacagaaaactcctagtcgaattgatagatcaatacaataatggagtgctgaactgggatgaattctcttcagcagtgaaggaagcccatgccaatcgcatgggtagccaaaccaagaggtttgtaatccctgacaagccaaaagaagaggattatttctatgccaacccacaggagtgtttggaaccatcagcatatgaactgttggcgttgagtagaacgtgattaatgtcttgggaaatagtggaatttacttgtgccatcatcatctcctggtggcacttggtttttctaccacagataagcagttttttccaggcagtttcagcgaatcaacaacgaggtcgtcaaaaggtgacccataaagaaaagtgaagtgggtaaagcaaaaacagc

SEQ ID NO: 10026 - DNA, 2615 bp, Glycine max
cgaatgtctttctgtttgcgttttattctcttctctctctactctctcacttcctaaaacatttttttttctactcgccgccgatcagccacgtcactctccggcgacacccttctctttttcgatttgttccttcctccaaattgcaagatattttctttgttttattgtaaaaagaattgtgtggtggttatcgcgcggtttcgatttggataataagcgtcgtctgcgcttctctgccggaagaagcgggtggatgtgcctttctgttaatgcggccaagaactgagcttcgttgacgcttctagaactcgaaaatagaaatctgtcagtgtcggcattggcgagttgtggtttcgtgagtccgtgtttaggttcgatccggtgccgtttcggggaagcacggatctcgtcggagagaagaaggggggaggatcgaaacgacggcgtttagggttttgacggttatgaagagagaagaataaaataaatgtgcagggcggagtgggaaggttttatgggtctgaagaagtgggaaagtaaggttccgaaggtgggaatgggaatgggtgtgttaggttcgggttcgggttcgggttcgtcgcggtcgagaatgaagatgtggatgatacgggcgaccacatcggtgttactgtggacctgcatcgttcagttaacggcgttgggtgacatgtgggggccgagagttttgaaaggttggccttcttgtttcactcacgagtctgccgttagagcaatggatgtcgagctaccgtcaccgcgtcctcctcttctccctccaaagagagtttataaaaacaatggttatcttatggtctcgtgcaatggaggactcaaccagatgagagctgcgatatgtgacatggtggctattgctcgatatttaaatgtcacgcttatagttcctgaactggataaaacatccttttgggctgatcccagtgacttccaagacatatttgatgtggatcattttatcacttccttgagagatgaagtgcggatactgaaagagttgcctcccagactcaagctgaaagtggagcgcgggtttctttacaccatgccgcctattagttggtctgatatatcttactataaggatcagattctacccttgatacaaaagtacaaagttgttcatttaaatagaactgatgctcggttggccaataatggtcaaccgctggagattcagaagctgcgttgccgagttaattttagtggtctgagatttacttctcagatagaggagttgggcagaaaggtgatcaggcttcttaggcaaaaggggccatttctggtgctccatttgaggtatgagatggacatgttggcattttctggctgtactcaaggttgtaacagtgatgaggtggacgaattgacaagaatgagatatgcttatccttggtggaaggaaaaaataattaattctgatttgaaaagaaaagatggtttatgccctctaacacctgaggagactgcccttacgcttaaggctcttgacattgatcagaacattcaaatctacattgcagctggggaaatatatggaggggaaaggagaatggcaagtctagcgaaggagtacccaaaattggtcaggaaggaaacgctgttggagccatccgaccttcagttcttccaaaatcattcatcccagatggcagcattggattatcttgtctcattagagagtgatatttttgttcccacatatgatggaaatatggccaaagtggttgagggccaccgcagatatcttgggttcaagaaaacgattttgttgaacagaaaactcctagtcgaattgatagatcaatacaataatggagtgctgaactgggatgaattctcttcagcagtgaaggaagcccatgccaatcgcatgggtagccaaaccaagaggtttgtaatccctgacaagccaaaagaagaggattatttctatgccaacccacaggagtgtttggaaccatcagcatatgaactgttggcgttgagtagaacgtgattaatgtcttgggaaatagtggaatttacttgtgccatcatcatctcctggtggcacttggtttttctaccacagataagcagttttttccaggcagtttcagcgaatcaacaacgaggtcgtcaaaaggtgacccataaagaaaagtgaagtgggtaaagcaaaaacagccaggggatactttaaatttttatatttgcaaaataatcaatccatcacattcatgtatagaaagctaccctgccattacagggtgagagcagttcaaacaacattgtagacggaggaattcttatacaaatttggattactggaaactgcccttcttggaaagcttaattcattggtatttgcctcacttttttttttcttcttggatataaatatataattttttccctccttttttcttaaattcgtctccatcattgtgattttctggattattatacactaaagaatttgtttgttcgtgtattaattaatgcctcctaatttcattttccacattggtacgttccgggaatggtatgctaggttggacgaagcttttgtatcatcatctcatttatatttg

SEQ ID NO: 10027 - DNA, 2666 bp, Panax ginseng
ggaagcagtggtatcaacgcagagtacatgggacgactgctcgcttttattgtgtatttatatgcacccctcacgactcggtcaagtgttcttatctctctctatccatcttcgccggtcgcctaagtagtcagttcccggcgatctcaaaacggcagattgtacttgatcgccgaactatttttttacctttgaattgattttttttctttcagaaaaggaacaaaactttggcccatttgtacgttttttggtgggtttaattagttgagtatatttcaattaggggtttgttgatcgcagttttgttgctttttgggtcgaatcatttgcattgcgagagaaagttactgtttttgtgtggtatttggggaaggaatctgttagctattcagtaaaggcagaaaatgaagaatttttcagaatcatttatgagaaaaattcactcgtgttgttgttgcatttttgttggtaatatttagggagagttgaatatcagttgagctctagtttgatttgcttctttgtttagcaatttcggatcttgaagattcttgttgttacaagatcatcataattgtcacttttggcatatttttgataaattttagccattttttgggggttattgagtgaaatttggaagttgaattggtgtaataaggtaattttggatttcggtggtttgatgttttctgtattgtagatgtatggggaaggggatagacagggtagatattatgtgcaaaatagaggagatagaaagaagtgaggaggagagagaaaggaagaggagaaggaggtggggggtaacaatggggttgaagacattcagaggagagagtagaaaaggaattgagaagctgaagacttcaatggtttctaggtctagaatgaagctatggatgattagggccactacttcagtgttggtgtggacttgtttggttcaattaacagctttgggagagatgtgggggcctagggttctaaagggttggccttcttgcttttctcaggattctgcaatggatgttaagttgccgccagcccttccggatagagttcttcctcccaagagggtttataagaacaatggttacctgatagtttcatgcaatggagggcttaatcaaatgcgggcagcgatttgtgacatggttgctattgcaagatatttaaatgtgacacttattgttcctgagttggacaaaacttctttctgggctgatccaagcgaatttgaagacatttttgatgttgatcatttcatctcatccttgagagatgaggttcgaatactgaaagagctgcctcctaggctcaagaggagagtggaactaggaatattctacaccatgccacccatcagttggtctgacatctcttattatcaaaatcagattcttcctctgataaagaaatataaggttgtgcatttaaatagaacagacgctcggctcgccaacaatggtcaaccccttgaaattcagaagctccgttgccgagtaaacttcagcgctctgagattcactactcagatagaggaattgggtaggagggttatcaagctgctaaggcaaaatggtcctttcctagtacttcatctcagatatgagatggacatgttagcattttctgggtgtacacagggatgcaacaatgaagaggtggaagagttgacaagaatgaggtatgcctatccatggtggaaggagaagatcataaattctgacttgaaaagaaaggatggtctatgtccgttgactcccgaggaaactgctcttacactaagggcactggacattgatcgtgacatccagatttacattgctgctggagaaatatatggtggagaaaggagaatggctagtcttgctgctgcttacccaaaactggttcggaaggagactcttttgggtccatcagaccttaattattttcagaaccactcgtcccagatggcagcattggattatcttgtttctctggacagtgatatttttgttcctacatatgatggaaacatggccaaagttgttgaaggccatcgcagattccttggattcaagaagacaatactactggacagaaggctactagttgatttgatagaccaatataatcatggatcactgaattgggacgagttctctactgctgttaaggaagctcatggcgatcgcatggggacccctaccaaaaggttggtgattccagacagacctaaagaagaggactatttctatgccaacccggaggaatgcttgcaatcatctggtctatcagaagaactatcgagagttatctgaattccagcaggtggtggctgttttgaccacaatggcctacactgcaaaatttggtgaaggaatttttttgaaggagtcaattatgcgcacgatgaagaggagcttcggagccagctggagttgttattgcaatctttataatatatcctagtaattcaattcatgtatagaagttaccctgccattacagggttataatatcaaactcaactaccgtgtatacagagggatgaaaatataaattttgatttaccctccgcatcctagtaggttaatttcatttattgtacatatctttgtttattttccatcatatactcactcgtatcgtacatggaataaaattaaaatggc

SEQ ID NO: 10028 - DNA, 1899 bp, Panax ginseng
agagtagaaggaggtgggggataacaatggggttgaagacattcagaggagagagtagaaaaggaattgagaaactgaagacttcaatggtttctaggtctagaatgaagctatggatgattagggccactacttcagtgttggtgtggacttgtttggttcaattaactgctttgggagagatgtgggggcctagggttctaaagggttggccttcttgcttttctcaggattctgcaatggatgttaagttgccgccagcccttccggctagagttcttcctcccaagagggtttataagaacaatggttacctgatagtttcatgcaatggagggcttaatcaaatgcgggcagcgatttgtgacatgattgctattgcaagatatttaaatgtgacacttatagttcctgagttggacaaaacttctttctgggctgatccaagcgagtttgaagacatttttgatgttgatcattttatctcatccttgagagacgaggttcggatactgaaagagctgcctcctaggctcaagaggagagtggaactaggaatattctacaccatgccacccatcagttggtctgacatctcttattatcaaaatcagattcttcctctgataaagaaatataaggttgtgcatttaaatagaacagacgctcggctcgccaacaatggtcaaccccttgaaattcagaagctccgttgccgagtaaacttcagcgctctgagattcactactcagatagaggaattgggtaggagggttatcaagctgctaaggcaaaatggtcctttcctagtacttcatctcagatatgagatggacatgttagcattttctgggtgtacacagggatgcaacaatgaagaggtggaagagttgacaagaatgaggtatgcctatccatggtggaaggagaagatcataaattctgacttgaaaagaaaggatggtctatgtccgttgactcccgaggaaactgctcttacactaagggcactggacattgatcgtgacatccagatttacattgctgcaggagaaatttatggtggagagaggagaatggctagtcttgctgctgcttacccaaaactggtccggaaggagactcttttgggtccatcagaccttaattattttcagaaccactcgtcccagatggcagcattggattatcttgtttctctggacagtgatatttttgttcctacgtatgatggaaacatggccaaagttgttgaaggccatcgcagattccttggattcaagaagacaatactactggacagaaggctgctagttgatttgttagaccaatataatcatggatcactgaattgggacgagttctctactgctgttaaggaagctcatggcgatcgcatggggacccctaccaaaaggttggtgattccagacagacctaaagaagaggactatttctatgccaacccggaggaatgcttgcaatcatccgatctatcagaagaactatcgagtgttatctgaattccagcaggtggtcgctgttttgaccacaatggtttacactgcaaatctgccaattttagggatcaaaatttgctcgtcgctgtgtgtcgaatcatcagtgacgaaggtatttttttcaaggagtcaattttgcgcacgatgaagaggagcttcagagccagccggagttcttattgcaatctttataatatgtcctaataattcaattcatgtatagaagttaccctgccattacagggttataatatcaaactcaactacggtgtatacagagggatgaaaatataaattttgatttaccccgcatcctagtaggttaatttcatttattgtacagatgtttgtttattttccatcatatatactcactcgt

SEQ ID NO: 10029 - DNA, 2519 bp, Lupinus angustifolius
tctctctctctctctctctctctctctctctctctctatattaataattgtactcgcgctttcgtttactcgccggtggtttcagacgccacactccggcgatctcttcaaacaccaatccaacttcgtcacacccatttgaattttctcttccaagatcttaacttttttactttcattccggtggggtttggaatttggataaccattgtgcttctccgttgaagaagttccatgcttgttccttgtcaaagagaaaaatcagtgtgtgcgttaatgcggttgaaaattgattaatgctctaaaccccttttgggtaattttgtcggcattggtgaataacagtttcctaaattgggttcttagatcttggagttgcataaaggggaagtgtgttatattgagatgtgcagggtgaataataaaaagagggagatcaataataataagaataataagagtaagtttgaagaattaaggttgatgggtttgaagagggtagaaagtaaggttgagaagttgaggaatagcatgagtggttcatcttcttcaaggtctcggatgaagctgtggatgatacgcgccaccacatcgatattgctatggacttgtatcgttcaattaacagcattgggtgacatgtggggtcctagagtattgaaaggatggccttcttgttttactcatgattctcactttcccactcaccctcctcctcttcttcctccaaagagagtttatagaaataatggatacttgatggtttcatgcaatggaggactaaatcaaatgagagcagcgatatgtgatatggtagccattgcaagatacttaaatgtaacacttattgtccctgaactggataaagcatccttttgggctgatccaagtgagttccaagacatattcgatgtggatcattttattgcatccttgagagatgaagtgcgcatattgaaagagttacctccaagactcaagcttagagtggagaatgggccactttacactatgccaccaattagttggtctgacatatcttactatcaggaccagattctgcccttgatacgaaagtacaaagttgtccatttaaatcgaaccgatgctcgtctggccaataacaatcaacctctcgagattcagaagttgcgctgccgagttaatttcagtgctctgagattcactcctcagatagaggagttgggcagaaaggtggtcaagcttctaaggcaaaatggtccatttctggtacttcatctgaggtatgagatggacatgttggcattttctggatgtacacaaggttgcaacagtgaagaggtagaagagttgacaaggatgagatacgcttatccttggtggaaagaaaaaataattaattcggatatgaaaagaaaagatggcttgtgtcctttgacacctgaggagactgcccttacgcttaaggctctagacgttgatcagaacattcaaatttacattgcagctggggaaatatatggtggccacaggaggatggcaagtcttgctaaggattacccgaaattggtcaggaaggaaacactgttggaaccatctgaccttcagttcttccaaaatcactcatcccagatggcagcattggactatcttgtctcattagagagtgatatctttgccccgacatatgatggaaacatggccaaagtagttgaaggtcatcgcagatatcttggatacaagaagacgattttattgcacagaaaacttctagttgatctgattgatcagtacaacaacggaatactgaactgggatgaattctcttcggccgtgaaggatgctcatgctgaccgcatgggtaacccaacgaagaggttggtaatcccagacaggccgaaagaagaggactatttctatgccaacccagaggagtgtttagaaacaccaccagatcttccattgagtagtacgtgagtaatgtattcggaacataccggaatttaaacgtggcatcatttcctggtgcacttggttttgttttctaccacagttactgagttagttccactcagttatagcaaaagaggcattgatggtgatccatagaggaataccttatattatatatatgtgcaaataatccatcttattcatgtatagaagctaccctgccattacagggtgagagcagttcataactgcattgtacaccaaggaattcatatacaaatttggattactggaactgcaattgctagaagcttaattcattgctacttcccttttcttagatataagtatatagtattatttttttgcccttttgccacctttctttttatccagattttatggattatatccactacacaatttgtttgttcatttattattattgcccacaaatttcatattttttttgtctattcagcaatgttgggtcggattatattttttaagttctgtctagtatgaggagatacattattctcttatatttatatcgacatttagtgccatttctaatgaattct

SEQ ID NO: 10030 - DNA, 2755 bp, Chenopodium quinoa
cctttccttcttcttcctttctactacttctttcttcctttctttcctttcctacttctacttctacttttaccttacttcctttctttaacctacttttttttcgttttacccctacttttccttcttccttccttcctacttcttccttccttccttcgtcctactttttcttcgtcctacccgtacctacccgtccctacctattcgtttgtatttctttacccttctttcctttttattcttcggtatccggtcgtctacattttcgtaagtattcctaatttgggttcttcgttttttcttttttagggtttcctaagtattctcttgattttgttggggtttccccggtttattgtataattgtgttttattaatttcttccttgtcaattttgtaaagtttctgggtgtttttggtatcttttattatttgggtataggttttgttctgggtaatttttggtattttgtatttggttgggttatttttctgggttggttgaattttttgtatatgggttttttttttacttcggatctttggtattattgattgattcaatttgggcaaagtgattgcaattgtattatgcaacattgattaggaaaattgaaggtaattttagggaattgttggttgcattgggtgttgtgaggttgggatgagaggaaaggaggaggaatatgtgtaaggttgagaggagtagtggtagtgaggagagagaaagcaggagaagaaggtggtgggggattgggattggtatgggggttaaaattgtagttagtgatgagaagaaggagaaatccaagagttcttcggcctcaaatggcggttcgaggtcgaagatgaaggtatggatggttagagctacatcatcagttttgttatggacttgtattgtcaatttgactacttttggggaggtttgggggcctagagtcttgaagggttggccctcttgttttactcaggaatctgcttatcttaagttgccttcttctgtttcagtcccacctcgtgttcttcctcccaaaagagtttataagaacaatggttacctgatggtttcgtgtaatggaggacttaatcaaatgagatcagcaatatgtgacatggtagccatcgcaagataccttaatgtcactcttattgttcccgagctggataaaacatccttctgggctgatccgagtgagtttcaagacatatttgatgtggatcattttatttcatcattgagagatgaagttaggattctgaaggagcttccccctaggctcaagaaaagactagagctgggaaaagttcataccatggctcctgttagttggtctgatatatcctattacaacaatcagatacttcctttgatacaaaagtacaagattttgcatttaaacagaacagatgcccggctcgccaataatggtcaaccgatagaaattcaaaagcttagatgccgggttaatttcagcggtttgagatttactcctcagattgaggagcttgggaaaagggtggtcaagctgctacgtcaaaatggtcctttccttgttcttcatctgcgatatgaaatggacatgttagccttttctggctgcacccagggttgcaatactgaggaggtggatgaattgaccagaatgagatatgcttacccatggtggaaagagaagatcataaattctgatttgaaaaggaaagatggactctgtccattgacgccagaggaaactactttggcactgcgagctttggacattgatcctagctatcagatatatattgcagctggtgaaatatatggtggtgagaggaggatggctagtcttgctgaatcttacccaaagctggttaggaaagagacattattgaatcccgcagacttgagattttttcaaaatcactcatctcagatggctgcactagattatcttgtgtcattggagagtgatatcttcattcctacttatgatggaaatatggcaaaagttgttgagggacatcgcaggtaccttgggtacaaaaggactatcttgttggacagaaggttgttggttgatctgatagacaagtatactgttgggtcacttagttgggatgagttctcaactgctgtaaaggaaactcatgcacatcgcagtggacaaccaactaagaggttggtaatacctgacaaaccgaaagaggaggactatttctactctaatcctcaggagtgtctcgaatctgatgaatccttgagtagcaatggcatgtgatctataatacctggagaagattcatattcttctatgatggctatttgtagcaaaattcaggtaaaaaaggatcttgatgcacatcttacagtgccacgcttacatgaatggctttgttttggccgccttctctctgggggtttatggttgttgcgttaacgtacatatatatattggggcggacaattttgagttataaaaactgaggaatatgttggagcaggagaagatggtgctggagggagcatgatatgctgttgtagatgcaaataactgaaattcttgtatagaaacacaccctgccattactggggtgaagttagatgcatctgtcgtgtacatggagtgacttgccacataaatttgtttgattaaattgttgtgggagcttgagttagatctactactcactcatccttcatatttttgtatttcttatttctttaggactacatatctactcaactgatcttttttaatcgtacatt

SEQ ID NO: 10031 - DNA, 2803 bp, Phaseolus vulgaris
agccctcaatcaagggttgccacgtatcacagccgaacatctggacggagcacacgtctgtgggccccacgcatctgcctcggcatttattggctcgtttaatgaggcgcacccaataaaataaaccctcacccctcataaccataacccctcttcccctctcaatcttaaccacggtccggttacgaccttcgtacggctcgtgctaccctccgcgacccgaaccggacgcacgcaaatctgtcaacaacaacaaccgtgaaaatcttcattgcctctctctctctgtctcttacttttgcttttctgttgtgacgcgttttattctctctccctcataataattctcaactcgcgctccgtttctcgccggcgattgtctcagatcaatcgccgccgactccccttgccgttcaattcagactgttgcccgcgcgtgcggtcgtctcctgaacccgaggatctcactgttgaggttctgcggggaatgtgcctctgaattcgaggctctggagttgcggcttggtgggctccgaattcggaacgttgaggcgagtttggatctggaattggacgggaaggggaaattgaattgacgggttagggtttggcgcggggtgcatttatgaaggaggcgctgttgggtgggggagataagagtgagaggaagagagggaaggtggtttgggaggggttgatgatgatggggcttaaaggggagagtaacaacaagctgaggaattcgatggtggtgtcatcgtcgtcgtcgaggtcgaggatgaagctgtggatgatacgcgcgaccacatcggtgttgctatggacctgcgtcgttcagttaacggcgctgggtgacatgtgggggcctagagtcttgaaagggtggccttcgtgtttcacgtacgaatccgcgctcactgagttgccatcttctacccccgtagtgctcccacccaagagggtgtacaagaataatggttacttgatggtgtcgtgcaatggaggactgaaccaaatgagagcagcgatatgtgatatggtggctattgcgaggtatttaaacgttacacttatagtgcctgaattggataaaacgtccttttgggctgaccccagtgaattccaagacatctttgatgtggatcatttcattacatccttgagggatgaggtgcgaatattgaaagagttgcctcctagactgaagacgagagtggaaaatggactgctttacaccatgccaccgattagttggtctgatatatcatactataagaaccagattctacctttgatacaaaagtacaaagtcgtccatttaaatcgaacagatgctaggctggccaataacgaacaacctttggagattcagaggctgcgatgcagagtcaattttagtgctcttagatttactcctcagattgaggacttgggcaaaagggtgatcaagcttcttaggcaaaatggcccatttctggtgcttcatctgaggtatgagatggacatgctggcattttcaggctgtacacaaggttgcaacggggatgaggtggaagagttgacaaggatgagatatgcatatccttggtggaaagaaaaaataattaattctgatttgaagagaaaagatggtttgtgccctttaacacctgaggagactgcccttacacttagggcccttgacatcgatcaaaacattcaaatctacattgcagctggggaaatatacggtggaaacaggagaatggcaagtcttgcgaagaactatccaagattggtcagaaaggaaacactgttggaaccatcggaccttcagttcttccaaaatcattcctctcagatggcagcattggattaccttgtctcactagagagtgatatttttgttcctacatatgatggaaatatggccaaagtagttgagggacatcgcagatataatgggttcaagaagacgattttgttgaacagaaaactcctagttgatttgatagatcaataccataacggagaattgaactgggatgaattctcttcagctgtgaaggaagctcatgctgatcgcatgggtagtgcaactaaaagattggtaatccctgacaggcccaaagaagaggactatttctatgccaatccagaggaatgtttaggactatcagatacgtgattggtgtgtttggaaataagagaatttacttgttccctctccttgtgcacttggttttccatcacagaattttaagataggtctctacgcagtttagcaaagatgaagacagttttttgtaccgaagaggcagtcatagtgattgtttgaagagggaggggggataggcttatcatgaaagctggagaaggtcaagcaaggtagccgagggatactttatatataaaatatgcaaataatccatcaccacattcatgtatagaagccacaccctgcaattacagggtgagagcagatcaaactgcattgtacacggagggagacatatacaaatttggatttcttgaactgcagttcgtggaagctttattccttggtaccaaaatttttccttctcttctaaatataaatatattacaagtacaaatattttttcctttaccacccttctttttatttaacacgatcattgtcagtttttgaattactcccactgtataatttgtttgttcatgattattctgtcctaatttcttagcttttggtgattattaataatgggatcggtaggttggacttttctcttgtgttttctctgatttatatttatttatatttgacagtgttgttatctta

SEQ ID NO: 10032 - DNA, 2556 bp, Solanum lycopersicum
ccaccacgcggtgcgtgttcttatcactctctttctttctctctccacattcacattttttccttttccctctctcgtcgccggcggcaccagattccggcgaaacgttaccgtctcgccgggaaattctccaaaatctccgatacatttcacatttttattaatatatttgattgatctctcatccataagaaaaaaaaactgaataatcagttagggttcgttttccgttaacacttaaagatcgaacttttggttgattttttcccctaatgtggttgagatttagggtttatggtgctgctttgggaatcaacactcgctggaagatctaactgttcaagttttgcttacgtttctgaaggatcaaatttcgtcctgttttcacttggtgctcagatttgagcagtttgatccgctcactttttttttgtctttaaattgtgagtgttagattatttcttaaacttatttggtttaatttttgactgattttggatactacattatcgacgaggcaaattcattgctgccagactgaaggaaacttacaaggaagtaagataagattttgggcgggatatgtgcagaatagagggagaaaagagtgaatttgaaggcagagagaggaagagaaggaagtggggattgaacgtaatgggattcaaagcagctgctttaggtgatagtcgtgtggagaaactgaaaagttctatgatgtcgcggtctagaatgaagttatggatgataagggcaacaacttcgattttgttgtggacttgtgtggttcaattgatgactttaggggagacttggggtcctagagttttgaaggggtggccttcttgtttctcacaggaatctactgcagcatttgctctccaatcgtcgccggaggtccctgccagagttcttccacctaagagggtttacaagaataatggttaccttatggtttcatgcaatggagggctgaatcaaatgaggtctgcgatatgtgatatggttgccatagcaagatatttgaatgtgactctcatagttcctgagctggacaaaacctcgttttgggctgatccaagtgaatttcaagatatttttgatgttgatcattttataacatccttgagagatgaagtccgaatattgagagagctaccgccaagactgaagaggagagtggagctaggaatgctttacaccatgcctcctatcagttggtctgatatttcttactaccataaccagattcttcccttgattcagaagtacaaagttgttcacctaaacagaactgatgctcggctagctaataatggtcaaccgatggaattgcaaaaactgcgttgtcgagtaaattttgatgccttgaaattcacccctcaaatagaagagctgggtaaaaaggtcattcaacttctcaggcaaaagggtcctttcatggtgctccacctgagatacgaaatggatatgttagctttctctggctgtagtcagggatgtaacaaggatgagattgacgagttgacaagaatgagatatgcttatccatggtggaaggagaaaatcataaattcagatttgaaaaggagagatggtctctgtcctttgacacccgaagaaactgctctgactttaagggcattggacattgattccagcatacaagtttacattgctgctggcgagatatatggtggacgaaggcgaatggctagtcttgcagcagcttaccccaatctggtgaggaaggagacactactagaaccttccgaccttatgttctttcagaatcactcttctcaaatggctgcattggactatcttgtttcattggagagtgacatttttgttcctacgtatgatggaaacatggccaaagttgttgaaggacatcgcagatatcttggctacaagaaaaccatcttgttggacagaaagcttttagtggatttgatagaccaacatactgctggatcattgacatgggatgagttctctaatgcagttaagcatgctcatgctgaacgtatgggcaacccaaccaagaggttggttattccagaccgacccaaagaagaggattatttctattcaaacccatgggagtgtttagaatcatctaatgaggatgaaacacttagtagcagcatttaaatccatctcagaaagaaaaaaacacttccacttgcagttccacgcagtttctgtgaatgatttatagaagatagctctcaacacattgagtcaatagaaagcaggattttgcctcaatgcagctcttgaagttcagtaggagggtgcacttcgacagggctgacagacatgctggagagagtacattttattttataaagtttttacataaattaataatcaatttcctgtatagaagcttcccctgccattgcagggttacaccaaactctacggcagtgtacacacacacgggtgaaatatagaaatttgttttactgcaactttgttatctgctgttctgcaaattttattattgacccctcatcatcatcatagttacttgctttagcagtttaa

SEQ ID NO: 10033 - DNA, 2392 bp, Fragaria vesca
ccggccggcattacggtttgagtcagcgtctaccggagatcggagtttggaggtgtgtccagttatattggcggcgagattgttggaggtggaatgcggtaacggttacgggtttcggatctttctaaatatagccggggggagctggaaaaggaaagaggagattttctggatccggcattgatcgcaaaacgcagcgtttagaggagtgagagagattgatgtgcaaggtggagaaggagagaagaggagtgatggggataaaggggctgggaggaggagagaagctgaagaactcgctgctgcaaacgacgtcgccttctcggtcgagaatgaagctgtggatgataagggcgacgacgtcggtgttgctgtggacgtgtgttgtgcaattgacggcgttgggggatatgtgggggcctagggttttgaaaggatggccgtcttgcttctctcaggagagtgccgtggcttcgtcggttttgcaggaccggacgacttccgttccggccagagttcttccaccaaagagggtgtacaaaaacaatggctacttgatggtttcgtgcaatggtggactcaatcaaatgagagcagcgatatgcgacatggttgctatagcaagatatttgaatgtcactcttgtagttcccgagctcgataaaacgtccttttgggctgatcccagtgagtttcaagacatatttgatgtggatcacttcatcacatccttgagagatgaggttcggatattgaaagagttgcctcccagggttaagagaagagtggaactaggaatggtttataccatgccaccagttagttggtctgacatgtcttattatcgtaatcagattcttcctctgatacagaaatataaaattgtacatctaaatagaactgatgctagacttgccaataatggacaacctttggagattcagagacttcgatgccgagtaaattttagtgctctgagattcacttctcaaatagaggagttgggtagaagggtcataaaccttttaagggcaaatggtcctttcttagttcttcatcttagatatgaaatggacatgttggcattttctggctgtacccaaggttgcaatgctgaggaggtggaagagttgacaaggatgagatatgcttatccctggtggaaagagaaaataataaactctgacctcaaaaggaaagatggtttgtgtcctttgacaccagaagaaactgctctcactctgagtgctcttgaaattgatcccaacattcagatctatattgccgctggtgaaatctacggtgctgagaggagaatggcaagtcttgcaaaggcttttccgaaattggtcagaaaggagactctgttagaaccatcagacctcaggttctttcaaaaccactcctcccaaatggcagcattggattatcttgtctcgttggagagtgatatctttgttcccacatatgacggaaacatggctaaagttgttgaaggccatcgcagatttcttgggttcaagaagacaattttgctggacagaaggcttcttgttgatttgatagaccagtacaatagtggagaattgaattgggatgaattctcatctgcagtgaaggaagctcatgcagaacgcatgggtaacccaactaaaaggttgatgatccaagaccggcctaaagaggaggactatttctatgccaacccagaagagtgtttgcagttgtcagatgatgagcaattatcagatgggggattgagtagtacgtgattatacataatggttagaagattgtggagttcacgaaatgttctgcagtgttggctatttttccacagatctcctatgcaagttctccacagagaggggaggtatagtgataatgaaggattttgatatgaagatgaaggacccaaagattattgtggggtattaaaacttgaagaaagccaagccctaccgaggatcttatggtatctcaactggaggacatgtttttttcttttcttttatctttttaatataagccaaaataatccatccaaatcatcatgtatagaagccaaggtacccaccgtaccctgccattcagggtgagagcaaattaaactgcaactgcattgcatttgcatctgtggaggaatgcaaataggtttggtttactcgggaactctgcagaacatcgaaaggtcaaccccatattccttaaatttttttgtgctcttcgtttctttagaccctagacctatgatgttgtgattctctagcatatatactactacatcccttcatatttcctgtttgcacagagagaatgactggtagagatggttatgtatttttacagattactcagaaatttatgtccaatagtggctgattcacttcaa

SEQ ID NO: 10034 - DNA, 1923 bp, Daucus carota
tattattatatgttggttagaggatagggaaaggatgaaaatggggtttaaaacatttggaggggagggtaagaaggggattgagaagttgacagcttcaatggtttctaagtctggaatgaagctatggatgattagagctactacctcaattttgttatggacttgctttgttcaattgtcagctttgagtgagttgtgggggcctagggttttaaaaggctggccttcttgtttttctcatgattctgctgcattggatgttatgatcactccggtgcttccggctagagtccttcctcctaagagggtgtataagaacaatggctatctgatggtttcatgcaatggggggcttaaccaaatgcgagcagcgatctgtgacatggttgctatagcaagatatttgaatgttacacttattgttcctgagctggataaagtttctttctgggctgatccaagtgagtttcaagacatatttgatgtcgactatttcatttcatccttgagggatgaggttcggatactgaaggagctgcctccaagaatcaagaggagagtggaactaggactgttttactcgatggcccccatcagttggtctgacatctcctactatcataatcaagttcttcctctgatccaaaaatacaaaatagtgcatttgaataggactgatgctcggcttgccaacaataatcagacactaagtatacaaaagctcagatgccgcgtaaacttcaatgctctgagatttacttctcagatagaggagttgggcagaagggtaatcaagcttttaagacagaatggtcctttcctggtacttcatctcagatatgaaatggacatgttagcattttcaggctgtagccagggatgcagcaatgatgaggtggacgagttaacaaggatgagatatgcctacccatggtggaaagagaaaattatagattcggaattgaaaagaaaggatggtctatgtccattaacccccgaggaaactgctcttacactaaaggcattggacattgatcgtgatatccaaatatacattgccgcaggagaaatatatggtggagaaaaacgaatggctagtcttacagcttcttatccaaaagtggtccgaaaggagactcttttgggttcatcagacctgggatattttcagaaccactcgtctcaaatggcagcactggattatcttgtttcattggagagcgatctgtttgttccaacatatgatggaaacatggccaaagttgttgaaggccaccgcagatttcttggtttcaagaagacaatattactggatagaaaactattggttgatttaatagatcaatacaatcatggatccttaagttgggaagagttctctagtgctgttaaggaagcccatgctgatcgcatggggagtcccaccaaaagattggtgattcctgacagacctaaagaggaagattatttctatgccaaccccgaagaatgtttgcagttatcagaaatatcagaagcaagattagatgttgtataaatgcctcttggcacccgtcgtgttgactagtgagctacaacgtccatttgcccttttagggatcagtgtgccattgtcggtgaaggagaaatttgctcggggcaggaactaaaagaaaattagaagaaacgagaatccgtcccttgaaaaggaatgtcggggccatgtgaactttcatgtaaaatattgattgtattagtatctaggaattgttttaatgtatagaaaagtgccctaccattacaggatgatatcgaactcattcgccattcatggtacacaactggatgcatatggtaaacgttcgttcattgtcctgtgttaaatgtgtaatcaggtctgtaaacatacatatcatcaatataatttatcacattatagat

SEQ ID NO: 10035 - DNA, 1992 bp, Solanum phureja
attttgggcgggatatgtgcagaatagagggagaaaagagtgaatttgagggcagagagaggaagagaaggaggtggggattgaacgtaatgggattcaaagcagctgctttaggtgatagtcgtgtggagaaactgaaaagttctatggtgtcgcggtctagaatgaagttatggatgataagggcagcaacttcgattttgttgtggacttgtgtggttcaattgatgactttaggggagacttggggtcctagagttttgaagggatggccttcttgtttctcacaggaatctactgctgcatttgctctccaatcgtcgccggaggtccctgccagagttcttccacctaagagggtttacaagaataatggttaccttatggtttcatgcaatggagggctgaatcaaatgaggtctgcgatatgtgatatggttgctattgcaagatatttgaatgtgactctcatagttcctgagctggacaaaacctcgttttgggctgatccaagtgaatttcaagatatttttgatgttgatcattttataacatccttaagagatgaagtccgaatattgagaaaactaccgccaagactgaagaggagagtggagctaggaatgctttacaccatgcctccgatcagttggtctgatatttcttactaccataaccagattcttcccttaattcagaagtacaaagttgttcacttaaacagaactgatgctcggcttgctaataatggtcaaccgatggaaatgcaaaaactgcgttgtcgagtaaattttgatgccttgaaattcacccctcaaatagaagagctgggtagaaaggtcattcgacttctcaggcaaaagggtcctttcatggtgctccacctgagatacgaaatggatatgttagctttctctggctgtagtcagggatgtaacaaggatgagattgacgagttgacaagaatgagatatgcttatccatggtggaaggagaaaatcataaattcagatttgaaaaggagagacggtctctgtcctttgacacctgaagaaactgccctgactttaagggcattggacattgattccagcatacaagtttacattgccgctggcgagatatatggtggacgaaggcgaatggctagtcttgcagcagcttatcccaatctggttaggaaggagacactactagaaccttccgaccttatgttctttcagaatcactcttctcaaatggctgcattggactatcttgtttcattggagagtgacatctttgttcctacgtatgatggaaacatggccaaagttgttgaaggacatcgcagatatcttggctacaagaaaaccatcttgttggacagaaagcttttagtggatttgatagaccaacatactgctggatcattgacatgggatgagttctctaatgcagttaagcatgctcatgctgaacgtatgggcaacccaaccaagaggttggttattccagaccgacccaaagaagaggattatttctattcaaacccatgggagtgtttagaatcatctaatgaggatgaaacactaagtagcagcatttaaatcatgttggtacaacatatggtcagaaagaaaaaaaaaacacttccacgctgtttctgtgaatgatttatagaagatagctctcaacacactgagtcagtgagaaagcaggattttgcttcaatgcagctcttgaagttaagtaggagggtgcacttcgacagggatgagaagactcgagaacatgctggagagagtacattttataaagtttttacataaattaataatcgatttcctgtatagaagcttcccctgccattgcagggttacatcaaactctacggcagtgtacacagaggggtgaaatatagaaatttgttttactgcaaattttattattgaccctcatcatcatgatagttacttaagcagtttataatagaatacacaaaattcattt

SEQ ID NO: 10036 - DNA, 2554 bp, Solanum lycopersicum
gacccaattgtatattcatttctctctctttttttccctttctcctcaaatttctttttccctctccggtcaccggcttttcaacattccggcaacatcaccgccgtcctgacaccaactcctctagatatccccacgtattccacattcattgctagtcagtgtattttattgatttctcctttttaaaaaatttcaaaattattgggattcgcttccctgatcagttaaagattgccgcattttgtagaatatacttgtaaggtgacaaagagttagggatttttcttctcttcatcgaaacaatcgtctttggaaggtttcagaatccaagttttgctcaagtttctgaaagagataattctcattgacgttcgggtttctatatttttgtaactccttatcttctttcttcaactttttttataaaagcatttctgggtatcaaaaaaagtaggattttgattgatttttggatcctacattacccaaaaaaagtgacttttttttcttttggtatattgattgtttgtgatgagtgattgaggaaaacaaataagtaatacaacttgtgagttgaatagtaaggggaaatgtactgagaaagtaggggtgggggaatttgggcataatggggctaaaagtaacagctttagcagaaagtcgtttggaaaaactaaaaagttctatgtcatccaagtctagaatgaagttatggatgataaggatcacaacatcagtgcttatatggatttgcttagttcaattaacgatattgggagagacttggggtcctagagttttaaaaggttggcccccttgtctttctcacgaatcagctgcagtactggctgttaaatcgtcgtctgaggttcctgccagagttcttccaccaaagagggtttacaggaataatggttacctcatggtttcatgcaatggtgggcttaatcaaatgcggtcagcgatatgtgatatggttgctatagcaagatatttgaatgtgactcttattgttcccgagctggataaaacctctttttgggctgatccaagtgaatttcaagacatatttgatgttgatcacttcataatgtccttgagagatgaagttcgaatattgaaggagctacctccaagactaaagaggagggtagagttaggagtgactcatactatggctcctattagttggtctgacatttcctactaccataatcagattcttcccttaattcagcagtataaagtagttcatttgaacaggactgatgctcggcttgccaataatggacaacctatggaagttcaaaagctacgatgcagagttaattttggtgcattgaaattcacccctcaaattgaagagttgggtagaaaggttgtcagaatacttaggcaagagggtccatttatggttctgcacctgagatacgaaatggatatgttagctttctctggctgtactcagggatgcaagcaggaggaggtggaagagttaacaagaatgagatatgcttatccatggtggaaagaaaaaatcataaattcagatttgaaaagaagagatggtctgtgtcctttgacacctgaggaaactgctcttactttaagggcattggacattgatcctagtattcaagtgtacattgcggctggagagatttatggtggagaaaggagaatggctagtcttgctgcagcttatcctaatttggtaaggaaggagacactactcgagccctctgagctgaggttctttcaaaatcactcctcccaaatggcagcattagactatcttgtttccttggagagcgatatctttgttcctacatatgatggaaacatggccaaagttgttgaaggacatcgcagatatcttggatacaagaaaactatcttgttagacagaaagcatctggtggatttaatcgaccaacataatgctggatcattgacatgggatgagttctctaccgctgttaaagaagctcactctgaacgtatgggcaacccaacaaagagattggtcattcaagacagacctaaagaggaggattatttttactccaacccatgggagtgcttaaaaccatcttatgaggatgaactttaagcagcatgtaaattatgatggtggtaacattgcattatagagaagtacttccgcgcactcacatatttggaggacatacttgtcaacactcgataacattgtgctgcattttgcttctgaggacgactgttgcagtaaaggcgcgatacacttgaaatcctgagatcctcagaagcatttggaaaagggtttatattaaaatgttctttgtttttccttcagaaactcaataattgaatacatgtatagaaaactgtcctgccattgcaaggatatattatcaatggcagtatacacagaagggtacaatatagatttgttttgccaggacttttggatttgtcaaatttaaagttccactcaataccacactagttgactcactcagtctcctccattcttttctacgtaaatattactctagtcagactccacttg

SEQ ID NO: 10037 - DNA, 2476 bp, Gossypium raimondii
ctctaattgcttcattctctctaattttcttgatcggtttatacttgaacgccggtacggcggtatcaacggccgttacacggcaaattttcaccgggaaatgttttgatcgccgcggagtaggaagtttttttttgtttgttttttaaattgaaattggttaagttaatgagttcgatttgagaataagaggcgaaaaattggatttcttttattgattattgaatttctttgggggggggttgtttttggaagttatcggaatttgaagattctgttaggttagttttttgtttgcaacattaaaaagaaaaagaagttgttgttgtcggtgcaaatcaacctgcattgatggaatttggaaggagagaagcggtgtcgtattgagggggtatatgaggagagtggagattgaggttgttgctggaaatgtgcagtgttgaagggatagggaaaaagggaggtatgagaatcggggtaataaaagggggcggaggcggagcaagcggaggagagagagtggataagttgaaaaagagttcgagaatgaaggtttggatcatacgcgccaccacatcggtgttgctgtggacttgcatcgtacagttaacgaccttgggagagacatggggacctcgcgtccttaagggttgcccttcctgtttctctcaccaggattcttccgtttccgccattgaagacaaacttccctcggttcccgcccgtgtaattcctcccaaaagagtgtataagaacaatggttatttgatggtttcatgtaatggaggtctcaatcaaatgcgagcggcaatttgtgacatggttactattgcaagatatttgaatgtcacgcttatagtcccggagctggataaaacatccttctgggccgatcccagtgaatttcaagatatatttgatgtgaatcatttcattacatcactgagagatgaggttcgaatattgaaggagttgcctcctaggcttaagaggagagtggaaatggggtttgtgtattcaatgccaccaattagctggtcagatatatcctactatcataatcagattcttcctctgatacagaagtataaagttatacatttgaatagaactgatgctcgacttgccaacaacgggcagtctttagatgttcagaagctgcgatgtcgtgtaaattttaatgctttaagattcactcctcagatagaagagttgggtaaacgagttattaagcttctgaggcaaaatggtcctttcatagtacttcaccttagatatgaaatggacatgttagcattttctggctgtacgcaaggttgcaacaatgacgaggtggaggagttaacaagaatgagatacgcttatccatggtggaaagaaaaaataataaattctgacttgaaaaggaaagatggtttgtgccccttgacgcctgaggaaactgcccttattttgagggcactggacattgataaaaattaccaaatctatatcgcagctggtgaaatatatggtggagataggagaatggccagtcttgctgctgcttatccaaaattggttagaaaggagactctattggggccatctgaccttgggtttttccaaaatcattcatcccagatggcagcattagattatcttgtttcattggagagtgatatttttattcctacttatgatgggaacatggctaaagttgttcaaggccatcgcaggtatctggggttcaagcagacaattttgttggacagaaggctattagtcgatttaatagaccagtacaataatggatctctaagttggatccagttctcagacgctgtgaaggaaactcacgaaaggcgcagggggcaaccgagtaaaaggttggtgattcctgacaggccaaaagaagaggattacttctatgccaacccagaagaatgcttgcaacaaccggatggtcaactaagtagcacgtgatcgttgtcaccaggatttgttatgtacgtatgttgaagggtgttttgtttttctagtggtaggcatcatcatacctgaaacacaaaaggtaaatgacacgaatgaagagggttttacattgaaggaggcgaatcggggacaggcagtagagctcaaagaaaccccgagaggacagatttttagcatgtgaaaaaaatccgaagggtgtatagaagaagagctgtggaatgccattaataggataatatatcagatgaaaaggtatttgcgaagtatagatttggattcatggaaggttagtctctcaccctccatttttcttgaattttcccccctttttattttatttcttgttagctttatatatatatatatcacattctagaatttatcattgtcatacatacactacatggacgattgtatttctttgtagtatggtccctccccatcaaatgcaaggaatgattgaaagcattgaatatagaatttactgcacttttggataaaa

SEQ ID NO: 10038 - DNA, 2290 bp, Panax ginseng
tttttggtcgaatcatttgcattgccagagaaagttactgtttttgtgtggtatttggggaaggaatctgtttagctagtaaaggaagaaaataaagaattttcagattcatttatgagaagaattcactcgtgttgttgttgttgcatttttgttggtaatatttagagagagttgaatatcagttgagctctagtttgatttgcttctttgtttagcaatttcggatcttgaagattcttgttgttacaagatcatcataattgtcacttttggcatatttttgataaattttagccattttttgggggttattgagtgaaatttggaagttgaattggtgtgataaggtaattttggatatcggtgttttgatgttttctgtattgtagatgtatggggaaggggagagacaggatagatattatgtgcaaaatagaggagatagaaagaagtgaggaggagagagaaaggaagaggagaaggaggtgggggataacaatggggttgaagacattcagaggagagagtagaaaaggaattgagaaactgaagacttcaatggtttctaggtctagaatgaagctatggatgattagggccactacttcagtgttggtgtggacttgtttggttcaattaactgctttgggagagatgtgggggcctagggttctaaagggttggccttcttgcttttctcaggattctgcaatggatgttaagttgccgccagcccttccggctagagttcttcctcccaagagggtttataagaacaatggttacctgatagtttcatgcaatggagggcttaatcaaatgcgggcagcgatttgtgacatggttgctattgcaagatatttaaatgtgacacttattgttcctgagttggacaaaacttctttctgggctgatccaagcgagtttgaagacatttttgatgttgatcatttcatctcatccttgagagatgaggttcggatactgaaagagctgcctcctaggctcaagaggagagtggaactaggaatattctacaccatgccacccatcagttggtctgacatctcttattatcaaaatcagattcttcctctgataaagaaatataaggttgtgcatttaaatagaacagacactcggctcgccaacaatggtcaaccccttgaaattcagaagctccgttgccgagtaaacttcagcgctctgagattcactactcagatagaggaattgggtaggagggttatcaagctgctaaggcaaaatggtcctttcctagtacttcatctcagatatgagatggacatgttagcattttctgggtgtacacagggatgcaacaatgaagaggtggaagagttgacaagaatgagatatgcttacccatggtggaaagagaagatcatagattctgacatgaaaagaaaggatggtctatgtccgttgactcccgaggaaactgctcttacactaagggcactggacattgatcgtgacatccagatttacattgctgctggagaaatatatggtggagaaaggagaatggctagtcttgctgctgcttacccaaaactggttcggaaggagactcttttgggtccatcagatcttaattattttcagaaccactcgtcccagatggcagcattggattatcttgtttctctggacagtgatatttttgttcctacatatgatggaaacatggccaaagttgttgaaggccatcgcagattccttggattcaagaagacaatactactggacagaaggctactagttgatttgatagaccaatataatcatggatcactgaattgggacgagttctctactgctgttaaggaagctcatggcgatcgcatggggacccctaccaaaaggttggtgattccagacagacctaaagaagaggactatttctatgccaacccggaggaatgcttgcaatcatctggtctatcagaagaactatcgagagttatctgaattccagcaggtggtggctgttttgaccacaatggcctacactgcaaaatttggtgatggaatttttttgaaggagtcaattatgcgcacgatgaagaggagcttcggagccagctggagttgttattgcaatctttataatatatcctagtaattcaattcatgtatagaagttaccctgccattacagggttataatatcaaactcaactaccgtgtatacagagggatgaaaatataaatttgatttaccccccggaatcctagtagttaattcatttattgtacatat

SEQ ID NO: 10039 - DNA, 2152 bp, Citrullus lanatus
tttggacgaactgcttagcggtggatcttggattaggaggggaaattgtgtgtgtgtgtgtgtaagatgcaacggggagatcgagatgtgcaggattgagaggaataagtggacattgaagagctctatggtgatgggattgaaggcattgggagagagcaaagttgagaagctgaagagttcaatggtgtctccaaggtcgaagatgaagctatggatgatccgtgcaatgacgtctattttgctttggacttgcatcgtgcagttgactgccttgggagagacgtgggggccaagggttttgaagggttggccatcttgtttcactcaagaatctgcatctgtggatgcgtttggtatccccaataaacctgttccagttccccccaaagtagttcttcctcctaagagaatctataagaacaatggttatctgatggtctcttgtaatggaggactcaatcaaatgagagctgcaatttgtgacatggttacaattgcaagatatttgaatgtgacacttattgtacctgaacttgataaaacttccttctgggctgaccccagtgagttccaggacatatttgatgtggaacattttattacatcactgagagatgaagtgcgcatattgaaggagttgcctcccaggctcaagaagagagtggaacagggaaggatttattccatgccaccaattagttggtctgatatatcttactaccataatcaggtccttcctcttattcaaaaacataaagttgtgcatctaaataaaactgacacccgacttgccaataatggtcaacctatggagattcagaaactgcgctgccgggtgaactttagtgctctgaggttcacttcccagattgaggagttgggaagaaaagttataaagctcctaaggcagaatggtcctgttctagttcttcatctcagatatgaaatggacatgttagcattttctgggtgcacccaaggctgcaatgatgaagaggttgaagagttgacaagaatgagatatgcttatccctggtggaaagaaaaagtaataaattccgagttgaaaaggaaagatggtttgtgtccattaacacctgaggaaactgcacttacactgagggcactagatatcgatcccagtatccagatttatattgctgctggggaaatatacggcggcgacagaagaatggctgctcttgcaaaggcttttccaaaattggtaagaaaggagactttgttggaaccttcagaacttaagtccttccagaatcattcatctcagatgtcagcattagattatcttgtttccttggaaagtgatatatttgttcctacatatgacggaaacatggctaaagtggttgaaggtcaccgcagatttctggggtttaagaagacaatcttattggacagaagagtacttgtagatctgatagatcaatacaacagagaattgcttaactgggatgaattctcatctgcagtgaaagaagctcatgcaggtcgctgggggagccctaccaagagaatggtcatcccagacaggcctaaagaagaagattatttctattctaaccctgaagagtgtctgcaattttcaaaggaagggttgagtagtacatgatttacataaatatgtggagcttgcgattacattgccaccattgctctctcagctctagattttattactaaagagatatttaaaatagagttccccgcttgcattctggaaactatgagaggtcaacttcaaaagaatcctacagaatctgtggagtcagctggagaacatgtttaattttaatgctataatcctgtatagaagaagaagcttgcctgccatttggataagaagagagcaggtgaagttagattgtacacagaagaagatgcaaatacgaccgcggtttagtgcaactacgattcatggaggagggtcaatccccaaatctttcactttttattttcttctttccaatttttttgtttcttcctttctcatcaaccatcaatcttgtgatttcgatatgttatgtcatgatatacaacaaattacagtatattttcacacttaaacttttcacccttcctgttgatggcttcaatctgttaatggaaaggggcaagagctagacatgtg

SEQ ID NO: 10040 - DNA, 2553 bp, Capsicum annuum
gctataaccacacaccaaacaagcactccctaaacccaccccacgcggtgcgtgttcttctctgttcttctctctctctctctctctctctatttctttatttctctctcttcttcctttttccctctctcgtcgcttatcaccggcggcaccagattccggcgaaacttccaccgtctcgccggaaaatcccccctaaatctctcacgcatttcacattttttcatatcgtcttagtcgatctcattcataagaaaacaaaactgaataataatcagttaggtttcatttctattatcactcaaagatcgaacttttggaatgttctagagatttagggtttatgctgctgctttggtaacgaacattagatctaactgttcaagtttgtttacttttcccgaaggatcaatactcagatttgagcagtttgatccgctcactttttggtctttgaattttctgtgctggatttatttgccctaaacatattttcgtttaatttctgactggttttggatactacattatcagtaaggcgcagttttatggagttaattaagattttttgagtagaggagtttattgtatgggcaggctatgtgtagagtagagggagagaagagtgaatttgaggggggaagagagaggaagaggaggaggtggggaggattgagtgtaatggggttaaaagcagcagctgcttttggtggtgatagtcgtgtggagaaattgaaaagctctatgatgtccaggtctagaatgaagttatggatgataagggcaacaacttcaattttgttatggacttgtgtggttcaattgatgactttaggggagacttggggtcctagagttttgaagggatggccttcttgtttctcacaagaatctgctgctgcatttgctgtcaattcgtcgccggaggtccctgcaagaattcttccacctaaaagggtttacaagaataatggttaccttatggtttcgtgcaatggagggctgaatcaaatgaggtctgcgatatgtgatatggttgccattgcaagatatttgaatgtgactctcatagttcctgagctggataaaacctcattttgggctgatccgagtgaatttcaagatatttttgatgttgatcattttataacatccttgagagatgaagtccgaatattgagagagctaccgccaagattgaagaggagagtggagctaggaatgatttacaccatgcctcccatcagttggtctgatatttcttactaccatgaccagattcttcccctaattcggaagtacaaagttgttcacttaaacagaactgatgctcggcttgctaataatggtcaacccatggaaattcaaaaactgcgttgtcgagtaaattttggcgccctgaaattcacccctcagatagaagagctgggcagaaaggtcattcgacttctaaggcaaaagggtcctttcatggtgctgcacctgagatacgaaatggatatgttagctttttctggatgtagtcagggatgtaacaaggatgaggttgacgagttgacaagaatgagatatgcttatccatggtggaaggagaaaatcataaattcagatttgaaaaggagagacggtctctgtccgttgacaccagaagaaactgccatgactttaagggcattggacattgattccagcatacaagtttacattgctgctggagagatatatggcggacaaaggcgaatggctagtcttgcagcatcttatcccaatctggtgaggaaggagacactgctagaaccttccgaccttatgttctttcagaatcactcttctcaaatggctgccttggactatcttgtttcattggaaagtgatatctttgttcctacgtatgatggaaacatggccaaagttgttgaaggacatcgcagatatcttggctacaagaagaccatcttgttggacagaaagcttctagtggatttaatagaccaatatactgctggatcattgacatgggatgagttctctcatgcagttaaggaagctcatgctgaacgaatgggcaacccaaccaagaggttggttattccagaccgacccaaagaagaggattatttctactcaaacccatgggagtgtctacaatcatccaatgaggatgaaacactaagtagcagcatttaaatcgtgttgacggtaacacttggtcagaaaaaagaacaaaaaaaatactgccacacagtttctgtgaatgatttagagaagtagttctcaacacggtgagacagtgagaaagcaggattttgcttcaatgcagctcttgaagttcagcgggaggtgcactacgactggctgagaagactcaagagcatgctggcaagtacattaaaaatgttttacataaattaataatcgatttcctgtatagaagaagcttcccctgccattgcagggttacatcaaactctacggcagtgtacacagaagggtgaaatatacaatttgtttttcctgcaagtacagacccaacaattttaagattcaaccccc

SEQ ID NO: 10041 - DNA, 2491 bp, Medicago truncatula
taaaataatagtattacactatagaacgagttaaggggaagcaatccaagttaaccatagttaggttagcaaggttgtaggtatgtgtaggagcatgtgtcaactgcgcgaatgtctttcttagcattttattctctctttcctcaccaccggctataatattataatattcattcattcttcttccttcttcactctccggccaccacattctcgccggagcaacctcaattttctctcacacttcaccttcatttcctcaaattcaacaacatttccctcctcaatataaaaataatcacttctgctaaatttggttgatgcttcttgaactgaatttcatactgtattccgtgtctgcattggtgaagataacttcgatccggcgtcgtttcgttgaacaacggatcttgaagatttctttaattaaatctacatttatagggtttatggtatgaaaaaattgaggaagtaagattaagatgtgtaaaccagagagtaacagcaataactacaagtggcaagatttgggttggatgggtttgaaagcacaaaaagagagactagcttcgggttcgggttcgggttcgggttcgggaagaggtagaatgaaactatggatgatacgtgcaactacaacggtgatattatggacttgtatagttcaattaacagctataggtgatttgtggggtcctcgagttcttaaaggttggccttcgtgttttactcatgtggattcttctgcttcaaattctagagcgttggataataataatgttcagtttctgcgtccaccaattcttcctcccaagagagtttacaaaaacaatggatacttgatggtttcctgcaatggaggattgaatcaaatgagagctgcgatatgtgatatggttgccattgcccgatatttaaatgtcacgcttatagtccctgaacttgataaaacatccttttgggctgatcctagtgaattccaagacatatttgatgtggatcattttatcacatccttgagagatgaggtgcggatattgaaagagttgcctcctagacttaagctgaaagtggaacgcggttttctttacagtatgccacccgttagttggtccgacatatcttactataagaaccagattctacccttgatacaaaagcacaaagttgtccatctaaatagaacggatgctcggctggctaataatggccaacctccagaaattcagaagctgcgatgcagagttaattttggtgctctgagattcacttctcagatagaggagttgggcagaaaggtgatcaagcttctaaggaaaaacggtccatttttggttcttcatcttaggtatgagatggacatgttagcattttctggctgtactcaaggttgtaacagtgatgaagtggaagagttgacaagaatgagatatgcctatccttggtggaaagagaaaataattaattctgacttgaaaagaagagatggtttatgtcctctaacacccgaggagactgcccttacactaagggctcttgacattgatcaaaacattcaaatctacattgcagctggtgaaatatatggtggagaaagaagacgggcaagtctttcaaaggagtacccaaaattggtcaggaaggaaacactgttggagccatccgatcttcaatttttccaaaatcattcatctcagatggcagcattggattatcttgtgtctttagagagtgatatttttgttcccacatatgatggaaatatggccaaagtagttgcgggccaccgcagatatcttgggttcaagaagacgattttactggacagaaagctcttagttgatttaatagatcagtactataacggtgcactgaactgggaccaattttcttcagctgtgaaggaatcacatgctcatcgcatgggtaaccctagtaaaaggttggtaattcctgacaagcccaaagaagaggattatttctattccaacccagaggaatgtttagaaccatcaaatgatatgctgagtagcacgtgacaatgtgtttggaaaaataatggaattttacatgtaccatctcctggtacacttggttttctaccacagatatattgaattagctctctattcagttttaacaaacacgaaggcttttttgtatcaagaaaagaggcagacatagagaaaagaaggtggagtgggatagcctttgcaaaaattctaatcaagcaaagcagccgggggatactttatatttttatctatataataaacatatgcaataatccatcacattcttgtatagtagccaccctgacattgcagggtgagtgcagtttaaacatcattgtacacggaggaattcatattcatatacaaatttggattactggatctgcagtttgtggaagcttaaaccactggtattattttttcttcttctttatatataaagatatagattttttgtacctatttttttggtacac

SEQ ID NO: 10042 - DNA, 2843 bp, Mimulus guttatus
ccacacacacacacacacacacacacaatacacgcactcgtacatctccccccttcccaaccgacgcgctttttccttcttatctctctctcctctctctcttctctctctcttatttttcacattcttctctctgtcaacacctccgtcgcctgcggcagtgttccggtgagccctataaattcttgccgggatagccgccggatctctatcccgattactcctccgaccatttttcatttctccgccggaaaaatcgagtttacttcaatttttatccacctgggatcggtggtgaagatcgagccattatttctgtaattttgaccaatgtgcctgtaatatgagcattgtttcttttgactttcattttagggaaagaatcctggcttaaatctcgaaccaattttggctctttctacgcttagattcgcaatttattaccccctcgattccgttccatacccctgccatttttcctatattacagcaatcccccaatccggggaaggaaagatttcatttttttctttttttatttttttttccggatcgcaagattttgttaacaaaacaaagacaacacagtccaagcaaaactgcagtttaatatttctagcgttctatggggttgttggcatgtgcagaatataagtagtagaaataaggaataaaagtagaaactggttgggggtgaaaaatggggctgaaaacggggtcgtttggtggtgagagattggagaagcttagaaatagtgggatggtatcacggtcgaggatgaagctttggatgattagggctaccacttcgattttgctgtggacttgtttagttcagcttacggctttgagcgaaacttgggggcctcgtgttttgaagggttggccttcttgcttttctcaagaatccggcgctgttgccttagatgttcattcgtctctcgaacttcccgttagagttcttccacccaagagggtttacaagaacaatggttacctgatggtttcatgcaatggagggcttaatcaaatgcgggcagcgatatgcgacatggttgcaattgcaagatacctaaatgttacattgatagtccctgaactcgacaagacttctttttggaatgatcctagtgagttccaagatatcttcgacgtggatcatttcgttacgtcattaagagatgaagttcgaatactaaaggagctacctccgagggtaaagaggagagtagaattagggatgatatatacaatgccacctgtcagttggtcggatatttcgtactatcacaatcagattcttccattgattcagaaatataaagtcgtccatttgaacagaacagatgctcgtcttgcaaacaacgaacagccaatggacattcagaggctccgttgcagagttaactttagtgctttaaagttcacccctcagatagaagaattgggtcgaaaagttatcaaaatattaagacaaaacggtcctttcatcgtacttcatctcagatatgaaatggacatgttagccttttctggctgtactcagggctgcaatatggacgaggtcgaagaattaacgagaatgagatatgcttacccatggtggaaagagaagattattgattctaatatgaaaagaaaagaaggtctatgccctttgacccccgaggaaactgcactcacattacgtgcactagatatcgatcgcaatattcaaatttatatagctgctggagaaatatacggtggagaaagaagattatctagtcttaccgcatcttatccaaatttggtgaggaaagagacacttttggaatcttcagaccttaggtttttccaaaatcactcgtcccaaatggcagctctcgattatcttgtttcactggagagtgatatattcgttcccacatatgatgggaatatggctaaagttgttgaaggccatcgcagatatcttggatacaagaaaacaatattgctggagagaaggctattagtggacataatagacaagtacaacactggttcactatcttgggacgagttctcgaatgccgttaaagatgttcatgctgaaagaatgggaaaccctatcaggagatctgttattcccgatcgacctaaagaagaggattacttttatgccaacccttgggaatgtttgcagccttcgtacgaagacgaaccgctacacctaagtagtgtttgaagccttcttattattctgtaggatttggctagaacaaaagaatatttgaagttactcgatggaatttagggttggatatcctcaaagaagatcacgaggaaaaataacagattttgtttggaggaggtggtgaggtgaaactccgacctatgaggagaggtttggaaaaacgcagcagctgtattacattgttctttctttttttttgattttttcttttttggaatccaagttaataatacaattcatgtatagaatctacccccgtcatttaaggggggtttatatcgactcgtctgcacttttgtacacaaagagatgcaaatatagattacattttactgcagctatcgagtctttgaggcttacccctttttgttgccatttctcgcatttctgtcaccattctttttttcgtttttttgttgggattcgtatctgttttgaagataaatatgtttgcgtgtacatgtaagatcaaataatttctgtaatatttattcaattgttcgttagattgttgctgtccatgtgtagtttttttccctctctataattgagatgactgggattttcttgattcagatggtgactatgtttttttatttaatgtggaattaccagtaattgagaa

SEQ ID NO: 10043 - DNA, 2127 bp, Gossypium hirsutum
taaattgaaatttggttaagttaatgagttcgatttgagaataagaggcgaaaaattggatcggttttattgattattgaatttcttggggggggttgtttttggaagttatcggaatttgaagattctgttaggttagttttttgtttgcaacataaaaaagaaaaagaagttgttgttgtcggtgcaaatcaacctgcattgatggaatttggaaggagcggagcggtgtcctattgacggtgtatatgaggagagtggagattgaggttgttactggaaatgtgcagtgttgaagggatagggaaaaagggaggtatgagaatcggggtaataaaagggggcggaggcggagcaagcggaggagagagagtggataagttgaaaaagagttcgagaatgaaggtttggatcatacgcgccaccacatcggtgttgctgtggacttgcatcgtacagttaacgaccttgggggagacatggggacctcgcgtccttaagggttgcccttcctgtttctctcaccaggattcttcggtttccgccattgaagacaaacttccctcggttcccgcccgtgtaattcctcccaaaagagtgtataagaacaatggttatttgatggtttcatgtaatggaggtctcaatcaaatgcgagcggcaatttgtgacatggttaccattgcaagatatttgaatgtcacgcttatagtcccggagctggataaaacatccttctgggccgatcccagtgaatttcaagatatatttgatgtgaatcatttcattacatcactgagagatgaggttcgaatattgaaggagttgcctcctaggcttaagaggagagtggaaatggggtttgtgtattcaatgccaccaattagctggtcagatatatcctactatcataatcagattcttcctctgatacggaagtataaagttgtacatttgaatagaactgatgctcgacttgccaacaacgggcagtctttagatgttcagaagctgcgatgtcgtgtaaattttaatgctttaagattcactcctcagatagaagagttgggtaaacgagttattaagcttctgaggcaaaatggtcctttcatagtacttcaccttagatatgaaatggacatgttagcattttctggctgtacgcaaggttgcaacaatgacgaggtggaggagttaacaagaatgagatacgcttatccatggtggaaagaaaaaataataaattctgacttgaaaaggaaagatggtttgtgccccttgacgcctgaggaaactgcccttattttgagggcactggacattgataaaaattaccaaatctatatcgcagctggtgaaatatatggtggagataagagaatggccagtcttgctgctgcttatccaaaattggttagaaaggagactctattggggccatctgaccttgggtttttccaaaatcattcatcccagatggcagcattagattatcttgtttcattggagagtgatatttttattcctacttatgatgggaacatggctaaagttgttcaaggccatcgcaggtatctggggttcaagcagacaattttgttggacagaaggctattagtcgatttaatagaccagtacaataatggatctctaagttggatccagttctcagacgctgtgaaggaaactcatgaaaggcgcagggggcaaccgagtaaaaggttggtgattcctgacaggccaaaagaagaggattacttctatgccaacccagaagaatgcttgcaacaacgggatggtcaactaagtagcacgtgatcgttgtcaccaggatttgttatgtacgtatgttgaagggtgttttgtttttctagtggtaggcatcatcatacctgaaacacaaaaggtaaatgacacgaatgaagagggttttacattggaggagaatcggggacaggcagtagagctcgaagaaaccccgagaggacggatttttagcatgtgaaaaaaatccgaagggtgtatagaagaagagctgtggaatgccattaataggataatatatcagatgaaaaggtatttgcgaagtatagatttggattcatggaaggttagtctctcaccctc

SEQ ID NO: 10044 - DNA, 2410 bp, Brachypodium distachyon
cgaagaaagtggttcttccgatcgcctccaatggcttcatccctcctccgcgcctcgcctctctccctcctctcccgcctgaggccgctcagccgcaggcctccctccccgcacctcctccttctctccggctccacctcggcctcctgctctccgcccacgctccgaaccctagccaccgatgcggcgaccatacctgaggaggcggcgcttcccgcggcggaggccaagctggagaggatgctgcctctgcagtggcctcggcgggacgcgctgtgcggcgagatttccgcgggcgatgccgggcaccgggttcggctctgcggctgggtcgctctccgacgcacccacgctggcctcactttcctcaccctccgtgattcctccggcaatggttcagatcaggtgacaactttgccagaataccctgaagtttacactgttgtgaacaagctgagagtggaatcagtggttgttgtcgagggggtggtgcgcccacgcccaacagaagccttcaatgcagagatgaagactggggctatagaggttgctgcagatcatatactggtgctcaactctgtagctcgttcactacagtttccaatcactactgctgatgctgtaaaagataaatttctggaagaagtcaggttgagatttagggtgctggacttgcgtcgaccacaaatgcagtcaaacttgaggctgcgccataaagtaattaagcacgttcgtcgctacttggaggatagacatgattttgttgagccaggaacatgctttgctcttcctcaaagccctcagctgttcaagcaaatgttgatggcctccggctttgaaaaatattttcagatcgcaagatgcttccggaacgaagatcttcgtgcagataggcaacaagaatttacgcaactcgatatggagattgcctttacatcaatggaggatatgttgaagtttaatgaagagttgatgacacatatatttcaagaggtgggagatatcaagcttccaaaatattttccaaggcttacctatgtggaagcaatgaatcgttatggcacagacaggcctgaccttcggtttgattgggagctaaaagatgctagtgatgtatttttgggcagtagcttcaaggtttttgccgatacattagaaaatggtggtgtaataaaggcattgtgtgtgcctggtggtgccaaagttttttcgaacactgacctaaagaagggaactgtttacactgaagcatccaaagctggagctaagggcctgcctttcctcaaagttatggataatggggagcttgaaggaattggtccgctggtgtcaactctgaaacctgaaaagaaagagcagctattggaacttatggacgcaaaagcaggtgaccttatcctgtttgccctgggagagcattcaacagctaatcaaattcttggcaggttaagattatttattgctcataagttggaagtgatagacacgacagcacagtcaattctttgggtgacggattttccaatgtttgaatggaacagtgatgaggagagatatgaggctctacaccatcctttcactgcaccaaatcctgaagatatgaatgatctaccatcagctcgtgccttggcttatgatatgatttacaatggggtggagattggagggggcagtttgaggatctacaaaagtgatgtgcaacaaagaattttcgagatcctcggcatctcacctgaacaggcagaggaaaaatttggttaccttttggagtgtttcgacatgggtgctcctccgcatggaggaattgcttatgggtgggaccggttggtgatgcttttggctcgtgaaagttcaatccgggacgtgatagctttccccaagaccacgactgctcaatgttcactcaccaaagcgtcatctcctgtggatcctcagcaattgaaggatctcagcctacgtgcttcatgagcgaactgttcatagtacccaaaaccattatgggtggtggagagagaaaatatgagtactcaaaatgactccaacttttccagcccaaaactgaatacccatatttgtttcttctccccttctcatctacttgcatatccaatccaaactatataagaattaaactagtgcatatgaaatctgaacatcataaaatagaatccaaatagtgcattaatatcacaaattttaagaaccgaattgaacacaaacatttatgaatgtctcacaacacaaagttcaaaacatagataaatatgatgcaacatagataaactagttgccttgttctccattcgacgaaattttcaagtaaccaatccatctacacacataagcatctcccaccactcacatattactcatggaaaccaggggcggaggcagaaaaataatacaggga

SEQ ID NO: 10045 - DNA, 4911 bp, Sorghum bicolor
ctcgctgggagtcatatggctaacgactacatacagagtatacagagtatacacacagtgatgagatgaggcacactgagtcagtagtgacgactccatgggcatcgccgtacgtgactggtttccacattcgtgcgtggtgtgccgccgtgtagtacccagccgcccaggcaagcgaccagagccgggccgagccgacccggagcggacgaaccccgcggtgtcgcgcgataaatcgggagcagagcaggagcagagcctaacagaaaaggcaagccgcgtgtcgtccccgccaggcagccactgccaccctccccccacctctctcgaccccacccgacaccgcgcggacccggagccgcacgcccgcaccgcctcccgcccccaaaccggcgccgacgagccccagcgcccaatggcggcggccttcctcgacctggaggcccgcgtgacatgatccctggccctccgaggaagggaatatccgcgcgcgcgcgcacccccgccccacaccccagccagagcccgcccacacagcccccaatcctcgccttccccaccgcaaatccttctcgactcgtccgtctctcctccaccgcctcgcgcgccgcccggcaggcggccgcaatcggctgctcgtgctcgcgtggccccggatcgccgccaggaagtgactaattggtggtgcgcataggacttgctggatttcagttgtctgatatactcaggactcagtgctgatcaagtgaacctattcgcttcaacttggtttcagtctcacacaagtatggcgccctctgccgcagtcccgggcggttctgaggctgagggggcaccacgcatggccaagttcctctgcagctttggaggcagtatccttccccgaccactcgatggctgtcttcgatatgttggtggtgagacaaggattgtcatgttgccgcgtgacatatcatatgccgacctagctgcacggatgagagagctctataaggatgctgatatcatcaagtaccagcaacctgatgaggatctggatgcgctggtctcggttgtgaacgacgatgatgtggtgaacatgatggaggagtatgacaaggtcattgccactggggaggccttcactcggctcaggatcttcttattttctcagcatttggatgatgatgctgcatcagtggctgtgcattacaatgtagacgagcgggaaacagagaggaggtatgtagatgcgctcaacagccttggtgatgttaagtcaccttcctcccctgtatctgtggagcagctttttggcattggaggcaatgattcaggaattccagattttgctggcttgagacatttgaatgtccctcgtccatcacatagtcagaggtatggagagatggattccccttggagccctgcatatgtctcgcctggccagtacggagtgcatgacccaagggattttccaatttcaccatcatctgcaaggttccaagtaggagcggaggattttgatgagaggattcctgacgactttgtaaggcagtcaccaaaatatcggcattatgaggcccagtcaccatcacatgtggataatttagtctggcttccacctggtgctataattcagcaaaatgcaggctttcccggtaatttgagccggtccaacaatttcttggatgggaacagcggatgtgatcactgccgttcaccattccagaagggtcaaggttcagtgagtgatcctatctatatgaaccctcgttggactcggccagtccaacaacattttgaccaagcaagcatgattagtgattatccaagtcaccatgctagttcttgttcagattactgcctccctggtgagcattatgtgggaggtcaagatgttagattggaaaatggtgtttatgttaaagagcaaaatggtggccatcctcccatgttttataatgagtcacatcctcatgatagagtctggcatgcacataccaaccaaagtcatcagcggtatgaggatccaaggctgcatcatcctgctaatggtagagtgattgaaccatacattgtcgatggcaactctgtcaattcagcatttgcaccaaacaaagtatatgaaatgcattcagcatctcttggtcgttctagtcatgaaagtcctcaccattttcatggtaccagtgagctcataaatgacacgtaccacaaccaacaagttggaggcagtgggtcgtatgtgcaaccagcagggtttgaagaatcctctgggcagcattacaaccactcttcggcctatggtgcagattccttttaccaaatgcagcagaatttgccaccgattcagtccctgaggaggagagcgaacagccctgttcacactgcctcaccatatgattccccacacctgccaatgccaaatgggagcattagcacaaactttgttagaaatacaggtgatgttagtcccaggataccaggtctacctggatatgatcggatgccaaacccatggactcctcccaatggcaacataccatatagagttgttggacatgatgttccttctgccatggaaaacactagtgcttttgcacctaggtctaatccaactgctgctcagtatgttcagccttttattgctcctgaatcaatccagcatcaacctggaggtccattgattcatcctgaaagagcataccctgaacccatgccggcatcatatgctgatagcaaagtagctgtttctgcattgcccctcactgatcaattatccaggttggatgcaaacacaatgaagaaacttgaaggtccagatgataactctactcgaaatgtgaatgaaacaactcctttgcatgctgtgaatgaaccaagtaccttaccccaccatgttggagctgtgcatgaagtcagtcctaagcagaagccaaccgaacatgaaagcaggcaaaagcaacatgaagctggggctacagcactgcaggaatgtggggatatttcagaggataggttgaatttccttcccgaattaattgcctctgttaaaaaggcagcactggaagatgctgctgagacacaaatagtccaatcagatgctaatgctgctgtttcacctgttcctgatgatgacgataatggaaagaagttggatgaggcaactgctgttaatacagatgcaaatcaggaccctgatttgcaaggaagccttgatcggcagaagagctccaagattgagtccacaactgctgaagctgaagctttgtcaaaaggactacagactatacaaaatgatgatttggaggaaattagagagctgggttcaggtacttatggtgcggtctatcatggtaaatggaggggatgtgatgttgctattaaaagaataaaagcaagttgctttgatggaagaccatctgagagagagcgtttgattgcggatttctggaaagaagctctgatcctaagctcacttcatcatccaaatgtggtttcattttatggtgtagttcgtgatggtccggatggaagcttagcaactgttactgagtttatggtcaatgggtctctcaaacagttcctgaggaaaaaagacaggacaatagatcgccggaagagagtaatattagccatggatgctgcatttggcatggagtatttgcacgggaagaatatagtccattttgacctgaagtgtgagaatctactagtgaacatgagggatccgcagcgaccaatctgcaagatcggtgatctcggactatcaaaggttaaacaacatactttggtatctggtggtgtcagaggaaccttaccatggatggcaccagagcttctgagtgggaaaagtaatatggtgtcagagaagatcgacgtctattcgtttggaattgtcatgtgggagctgcttactggggatgagccatactctgatatgcgtgctgctgaaattattgggggcattgtaaacgattccctacgtcctcaaatcccttcgtggtgtgatcctgagtggaaggggttgatggaaagctgttggtccagtgatccagctgagagaccgtccttcactgatatatctcaaaggttgaggaaaatggccgctgcaatgaatgtgaagtaaaggtttggaagccataaatggatcatcatctcagtttaccctactccaagtgattatttatcaagtgcttacttcatggaagaaaaagtatgtcatggagattccaaagcatgtttaatgatatttttttttaatcctgcagtaaaccggctatcaaatgccttcggtcgaaaacaagtatgctatatagcgtattgtcttgatgggaactgttggactgtaattgtaaataagttttgacttgcttcatcttgctggcacgtattagatgtgcaaagtaataggcacgatcaaagctggacacagttatcctttttccccatacaaattgtgtcctaggagagatggatcgaacacgactagagctatccttgttcagattgtacatagtctaaaaataatagtataatactgtttccctgtatatatcaccacttcctatttgaatgaccatatgtttgcatcgtccttgtttcacctccatgtctggttacaatatatatcgcctgtttttttgtaaaagttatcttgtggttttgctgtacccccatttatttggagggagagtagagtagttttcctgttcagtcctcatcgatcaggtaaagccactgtctatccaaggagaccatggagcagcggtatcaattgcattaccattgttatgctccattgcttgtcactctggatgcaatttgacttctaattttaaatatggagagcatataattttgcagacataatggagaaggatgtttaggtagctctgctccatgaatgtataaacagtgtgatgcctg

SEQ ID NO: 10046 - DNA, 4303 bp, Zea mays
cccccacaccccagccatagggccccccaattctcgccttccccaccgcaaatccttctcgactcccgtatctcccctctcctcctccgccgcctcgcgcgccgcaattggcgttgtgctcgcgtggacccagatcgccgccaggaagtgtctaattggtggtgcgcataggactggctggatttcaatcgtgataatactgatatacggagactcattgctgatccagtgagcctattcgcgccaacttgattacagcctttctcacacaagtatggcgccctctgctgccgtcccgggtggctctgaggttgaggggtcaccacgcatggccaagttcctctgcagctttggaggcagtatccttccccgaccactcgatggctgtcttaggtatgttggcggcgagacaaggattgtcatgttgccgcgtgacatatcatatgccgacctggctgcacggatgagagagctctataaggatgctgatatcatcaaataccagcaacctgatgaggatttagatgcgctggtctcggttgtgaacgacgacgatgtggtgaacatgatggaggagtatgacaaggtcattgcgacaggggaggcgttcactcggctcaggatcttcttattttctcagcatttggatgatgatgctgcatcagtggatgtgcattacaatgtagacgagcgggaaacagagagaaggtatgtagatgcgcttaacagccttggtgatgttaagtcaccttcctcccctgtgtctgtggagcagctttttggcattggaggcaatgattcaggaattcctgattttgctggcttgagacatttgaatgtccctcgtccaacacatagtcagaggtatggagagatggattctccttggagccctgcctatgtctcaccaggccagtacggggtacatgacccaagggattttccaatttcaccatcatctgcaaggtttcaagtaggagcggaggattttgatgagaggactcctgacgactttgtaaggcagtcaccaaaatatcgtcattatgaggcgcattcaccatcacatatggataatttagtctggcttccacctggtgctgtaattcagcaaaatgcaggctttcctggtaatttgagccggtccaacaatttcttggatgggagcaatggatgtgatcactgccgttcaccattccataaggttcaaggttcagtgaatgatcctatctatatgaaccctcgttggactcggccagtccaacaacattttgaccaaccaagcatgattaatgattatcccggtcaccatgctaattcttgtccagattactgccgccctggtgatcattatgtgggaggtcaagatgttagattggaaaatggtgtttatgttaaagagcaaaatggtggtcatcctcccatgttctataatgagtcacatcctcacgatagagtctggcatgtgcataccaagcaaagtcatcagcgatacgaggatccaaggctgcatcatcctgctaatggtagagtgatcgagccatacattatggatgccaacaaagtatatgaagttcattcagcatctcttgctcgttctagccatgagagtcctcactattatcacggtagcagtgaggtcataaatgacacgtatcacaaccaacaagttggaggcagtgggtcgtatgtgcagccagcagggtttgaagaatcccctagccaccattacaaccactcttcggcctatggtgcagattccttttaccaaatgcagcagaatttgccacccattcaatctctgagaaggagagcgaacagccctgttcacactgcctcaccatatgattccccacacctgccaatatcaaatgggaccattaacacaaacttcgtaagaaatacaggtgatgtcagtccgaggataccagggctacctggatatgatcgaatgccaaacacatggactcctcccaacggcagcataccatatagagttgttgggcatgatgttcatgctgcctccatggaaaacactagtgcctttggtcctaggtctaatccaactgctgctcagtatgttcagcatttcattgctcctgaatcaatccagcatcaacctggagctccattgagggaggttcatcctgaaagatcataccctgaacccatgccgtcgtcatatgttgatggcaaagtagctgtttctgcattgcctctcactgatcaattatccaggttggatacaaacacaataaagaaacctgaaggtccagatgatgttaactcaactcaaaatgtgaatgaaacaactcctttgcatgctgtggatgaaccaagtaccttaccccaccatgttgtagttgtacatgaagttgatactaagcaggggaagccaaccgaacatgaaagcaggcaaaagcaacatgaagctggggctacagcactgcaggaatgtggggatatttcagaggatagattgaatttccttcctgaattgattgcctctgttaaaaaggcagcactggaagatgctgctgagacacggatagcccaatcagatgctaatggtgctgtttcacctgttcctgatgatgatgatgataatgaaaagaagttggatgcggcagctgctggtactacagatgcaaatcaggaccctgatttgcaaggaagcattgatcggcagaagagctccaagattgagtctacaactgctgaagctgaagctttgtctaaaggactacagactataaaaaatgacgatttggaggaaattagagagctgggttcaggtacttatggggcagtttatcatggtaaatggagaggatgtgatgtcgctgttaaaagaataaaagcgagttgctttgtaggaagaccatctgagagagagcgtttgattgcggatttctggaaagaagctctgatcctaagctcactccatcatccaaatgtggtttcattttatggtgtagttcgtgatggtccagatggaagcttagcaactgttactgagtttatgatcaatggatctctaaaacagtttctgaggaaaaaagacaggacaattgatcgccggaagagagtaatattagccatggatgctgcatttggcatggagtatttgcatgggaagaatatagtccattttgacctgaaatgtgagaatctactggtgaacatgagggatccgcagcgaccaatttgcaagatcggtgatcttggactgtcaaaggttaaacagcatactttggtatctggtggtgttagaggaaccttaccatggatggcaccagagcttctgagtgggaaaagtaatatggtgtcagacaagattgatgtctattcgtttggaattgtcatgtgggagttgcttactggggaagagccatactctggcatgcgtgctgctgaaattattgggggcattgtaaacgattccctacgtcctcaaattccttcatggtgtgatcctgagtggaagggattgatggaaagctgttggtccagtgatccagctgagagaccgtccttcacggatatatctcaaaggttgaggaaaatggccgccgcaatgaatgtgaagtaaaggtccggaagccatatttgtcttgtatgtgtgttccccgcatccaatatatatagcgatatacaagaggaaggcagagttgaaacaggattattttgagtaaatatgttccatatgtcttggcagcatcgcagttgatgaccctactccaagtgataatttaacaagtgctgacttcatgggagaaaatctatgtcatggagattccaaagcatgtttgatgttttcttttaatcctggagtaaaccggctaccatttgccttccgccgaaaacaagtatgctatatggcgcattgtcttgatgggagctgttgcactgtcatgtaaataagttttgacttgctggcccgtagtagatgtgcaaagtaataggcacgatcacacagttacttttttttttcccatataaattgtgttctaggataggtagaacgaacatgactggagcgatccttgttcagattgtaaagaaaaggacagacccagtgctgacggttcttatatgagtggggtctggttaaagaataaccaaaacaagtcttatacttttatcttgcagagaggttgcatcgaatctaggactttggctcggtagaaaggtttttcaccactgcgttaggcctatacttttttcagtttaaccactgtgctagacctgcccccttttttcagtttgtacttggtctaaaaataagagtatactgttttccatg

SEQ ID NO: 10047 - DNA, 4457 bp, Panicum virgatum
cgcccccgcaccaccacccctcgcggagccgaaccggcgccgacgagccccggcacccaatggcggcggccttcctcgccctagcgtccgcgggacatgatccctagcaccgctggggtgggaatatccgcggtcgcccgaatcgctccccccaagccaccccaatcctagcctccccaccagaaatcctgcctccgcctctctcctcctcctcctccaccgcctccaggcgcagacgcggccggcggccgcagttggttgctcgagctggcgtggcccgggatcgccggacaggaaggggctaatcggagctgcgcatagggctttctggatttgagtcgtgtcatattctcagactcacagctgatccagtgatcataaccacacgagcttgatcagagtctcacactgagtatggcgcctcctgctgccgcaccgggtagctctgaggctgaggggccaccacacatggccaagttcctctgcagctttggaggcagtatccttccccgcccacttgatggctgtcttcgatatgtcagtggtgatactcggatcgtcatgctgccacgtgatatatcatatgctgacctagcggcgcggatgagagagctttacaaggacgctgatgtcatcaaatatcagcaacctgatgaggatctagatgcgctggtctcagttgtgaatgatgacgatgtggtgaacatgatggaggagtatgacaaggtcattgcctcaggggaggttttcacccggctcaggatcttcttattttctcagaatttggatgatgatgctgcatcagcggttgtgcattacaatgtagatgagcgagaaactgagagaagatatgttgatgcactcaatagccttggtgacgttaacacgccttcctcccctgtatcagtggagcagctttttggaattgtaggcaatgactctgggattcctgattttgctagcttgaggcatttgaatgttcctcgtccgtcacaaagtcagagttacggagaaatggattctccttggagccctgcgtacatctcacctggccagtatgcagtgcatgatcctagggattttcccatttcaccatcatctgcaaggtttcaagttggagcggaggattttgatgagaggattcctgatgattttgtaaggcagtcaccaaaatatcgtcattatgagcctcagtcaccaccacacatggataatttagtctggcttccacctggtgctgtaattcagcaaaatgcaggctttcctggtaatttgagccgttccaacaacttcttggatggaaacagtgtatccgatcattgccgttcgccattccacaagggtcatggttcagtgactgatcctcgctatatggatcctcgttggactcgcactgtccaacaacattttgaccaaccaaacaagactagtgaataccctggtcacccttctaattcttgttcaaattgctgccgccctggtgagcattatgtgggaggtcaagatgttagaatggaaaatggtgtctatgtcaaagagcaaaatggtggtcatgctcccatgttttacaacgagtcacattcgcatgaaagacttcggcatgcacataccagccaaagtcatcaacggtatgaggatccaaggctgcatcttcctggtaatggtagagtgattgaaccatacattgttgatagcaactctgtgaattctgcatttgcaccaaacaaagtatatgaaatgcattcagcatctcttggtcgttctagccatgaaagtcctcactacttccatggtagtagtgagctcataaatgatgcatatcacaaccaacaagttggaggcagtggagcatatttgcagccagcagggtttgaagaatcccctggtcagcattacaaccactcttcgacatatggtgcagattccttttaccaaatgcaacagaatttgccacctattcaatctttgaggaggagagcgagcagtcctgttcacactgcctcaccatatgattctccacacctgccaatgccaaatgggagcattaacaccaactttgttagaaatacaggtgatgttagtccaaggataccaggtcaacctgcatatgatcgaatgccaaactcatgggctcctcccaatggcagcataccatacagagttgttgggcatgatgttcctgttgccatggaaaacactagtgctcttggtcctaggtctaatccaattactgctcaatatgttcaacctttcattgctcctgaatcaatccagcaacaacacagagctccatcaagggaggtgaaccctgaaagagcatatgctgaacacatgccatcatcatatgttgatggcagagtagctgtttcggcattgccccttgctgatcaatcatccaagttggatactaagacagtgaggaaaccaggtccagaggatgatagctctactcgaaatgtgaatgaaggaactcctttgcacgctgtggacgaaccaagtaccctaccccaccgtgttggagctgtacatgaagttgatcctaagctggggaaaccaaccgagcatgaaagcagaacaaagcaacacgaagctggggcgatagcactgcaggaacaaggggacatttcagaggataggttaaatttccttcctgagttgattgcctctgttaaaaaggctgcactggaagatgcgactcagacacatatagccaaatcagatgctaatgctgctgttgcacctgttcctgatgatgacgataatggaaagaagttggatgtggcaactgctggtaatacagatgcaaatcaggattctgatttgcatggaagcaatgatcagcagaagagctccaaaattgagtctacgactgctgaagctgaagctttgtctaaaggactacagactataaacaatgatgatttggaggaaattagagagcttggttcaggtacatacggggcggtctaccatggtaaatggaggggatgtgatgttgccattaaaagaataaaagcgagttgctttgctggaagaccgtctgagagagagcgtttgattgcggatttctggaaagaagcccagatcctaagctcacttcatcatccaaatgtggtttcattttatggtgtagttcgtgatggtccagatggaagcttagcaacagttactgagtttatggtcaatgggtctctcaagcagttcctgaggaaaaaagacaggacaattgatcgccggaagcgagtaatattagccatggatgctgcatttggcatggagtatttgcatgggaagaatatagtccatttcgacctgaagtgtgagaatctactcgtgaacatgagggatccacagcgtccaatctgcaagatcggtgatcttggactatcaaaggttaaacaacatactttggtatctggtggtgttagaggaaccttaccatggatggcaccagagcttctaagtgggaaaagtaatatggtttcagagaagattgatgtctattcatttggtattgtcatgtgggagctgcttactggagaagagccatactctgatatgcgtgccgctgaaattattgggggcatcgtgaacgattctctacgtcctcaaatcccttcatggtgtgatcctgagtggaaggcgttgatggaaagctgctggtccagtgatccaactgggagaccgtccttcactgatatatctcaaaggttgagaaaaatggctgctgcaatgaatgtgaagtaaaggctcagaagcccctaaagggatcgtcatctcaggtcaccctactctaagtgataattttattaagtgcttcgtggaagaaaacttttgtcatggaagttccaaaggacgcttaatgaactttttatcctggagtaatcagttatcattttgccttccccttaaacagtttgttatagggtatcaacttgatgggaactgttggactgtaatgtaaataacttttgttttgctttatcctgctggcacatgttagatgtgcgcagtaataggcacggttcaatggtggacacagctatcttttttcccctacagattgtgtccatggagagatggaacgaactcgaatagatagatatccttgttcagattgtacatagtttatgaataagagttctatattgttttttctgtatatatcatcattatttccaatttgaactcatcacacgcttatttacatcccgggtgtcgcctccggtgcaaatatattcgcctgtctggtctgaaagttttgtattggacggaggagcactcagcccaacccctagtcactgcaaggaaaatgagctaattttcatgtcaatcctaattctgtctgtctaaacagagtcttggatgtactatgttgcttgcctgacattgctgtggtggtgagtgattagctccatttgctgccattttcaatgcaatttgactctgatttcata

SEQ ID NO: 10048 - DNA, 4410 bp, Setaria italica
cgcccagccgcaccaccacccccacgaaccaaaccggcgccgacgagccgcggcacccaatggcggcggccttcctcgccctggcgtccgcgtgacatgatccctagcccccgtgggttgggaatatccgcgcgcgcccgaatcgcacaccaccccctccagccagcccaccccaatcctcgcctccccaccgcaaatccttcctccgtctctctccttctccaccaccgcctccaggcgcccggcggccgcagttggttgctcgagctcccgtagccccggatcgctggacaggaaggggctcattggtgctgtgaatagaacttgctggatttgagtcgtgtcatatactcagactcactgctgatccagtgatcctaaccccaccagcttgatcaaagtctcacactgagtatggcaccccctgctgctgcagcaggcggctctgaggctgagggtgcaccacgcatggccaagttcctctgcagctttggaggcagtatccttccccgtcctgtcgatggctgtcttcgatatgtcggcggtgatactaggatcgtcatgttgccacgtgatatatcatatgctgacctagcagcacggatgagagagctctacaaggacgctgatatcatcaaatatcagcaacctgatgaggatctagacgcgctggtctcagttgtgaacgatgatgatgtggtgaacatgatggaggaatatgacaaagtcattgcctcaggggaggttttcacccggctcaggatcttcttattttctcagaatttggatgatgatgctgcatcagcggttgtgcattacaatgtagatgagcgggaaactgagagaagatatgttgacgcactcaataaccttggtgatgttaacacaccttcgtctcctgtatcagtggagcagctttttggaattgtaggcaatgactctggaattcctgattttgctggcttgaggcatttgaatgttccgcgtccatcacagagtcagaggtacggagagatggattctccttggagccctgcgtatgtctcaccaggccagtacgcagtgcatgatcctagggattttcccgtttcaccatcatctgcaaggtttcaagtcggagcggaggattttgatgagaggactcctgatgactttgtaaggcagtcaccaaaatatcgtcattatgaggctcagtcaccaccgcacatggacaatttagtatggcttccacctggtgctgtaattcagcaaaatgcaggatttcctggtaatttaagtcgctccaacaactttttggatggaaacagtgtaggtgaacatggccgtttgccattccagcagggtcaaggttcaatgactgatcctcgctatatggatcctcgttggactcgccctgcccaacaacattttgaccaaccaagcatgactaatgaataccctggtcacccttctaattcttgttcaaattgctaccgctctggtgagcattatatgggaggtcaagatattagaatggaaaatggtgtctatgtcaaagagcaaaatggtggtcatcctcccatgttttataacgagtcacatttgcacgatagagtttggcatgcacatactagccaaagtcatcaaaggtatgaggatccaaggctgcatcttcctggcaatggtagagtgattgagccatacattgtagataccaaccctgtcaattctgtatttgcaccaaacaaagtatatgaaatgcattcagcaactcttggtcgttctagccatgaaagtccccactacttccatggtagttgtgagctcataaatgacacatatcacaaccaacaagttggaggcagtggatcatatgtgcagccagcagggtttgaagaatcccctggtcagcattacaaccactcttcgacatatggtgcagattccttttaccaaatgcagcagaatttgccacccattcaatctctcaggaggagagcgaacagtcctgtccacgctggctcgccatatgattctccacacctgccaatgccaaatgggagcattccaatgccaaatgggagcattaacaccaactttgttagaaatacaggtgatgttagtccaaggataccaggtctacctgcatatgagcgaatgccaaacccatgggctcctcctaatggcagcataccatatagagttgttgggcatgatgttcctgctgccatggaaagcactagtgctcttggtcctaggtctaatccaattactgctcaatatgttcagcctttcattgcccccgagtcagtccagcatcaacacggagccccatcaagggaggttaaccctgaaagagcgtatgctgaccacataccaccaccatatgttgatggcagagtagctgtttctgcattgcccctcactgatcaattatcgaggttggatactaacacaatgaagaaacctgaaggtccagagtatgataactctactcgaaatgtgaatgaaggaactcctttgcatgctgtggatgaaacaaataccctaccccgccatgttggagctgtacatgaagttgatcctaagcagaaaccaaccgaacatgaaatcagaacaaagcaacttgaagctggggtgacagcactgcaggaatgtggggacatttcagaggataggttgaatttcgttcctgagttgattgcctctcttaaaaaggctgcactggaagatgcgactgagacacagatggcccaatcagatgctaatgctgctgtttcacctgttcctgatgatgacgataatggaaagaagttggatgtggcaactgctggtaatacagacgcaattcaggactctgatttgcatggaagcagtgatcagcagaagagctccaagattgagtctacaactgctgaagctgaagctttgtctaaaggactgcagactataaacaatgatgatttggaggaaattagagagctgggttcaggtacttatggggcggtctatcatggtaaatggaggggatgtgatgttgccattaaaagaataaaagcaagttgctttgctggaagaccatctgagagagagcgtttgattgcggatttctggaaagaagctctgatcctaagctcagttcatcatccaaatgtggtttcgttttatggtgtagttcgtgatggtccggatggaagcttagcaacagttactgagtttatggtcaatggttctctcaaacagttcctgaggaaaaaagacaggacaattgatcgccggaagagagttatattagccatggatgctgcatttggcatggagtatttgcatgggaagaatatagtccattttgacctgaagtgtgagaatctgctcgtgaacatgagggatccacagcgtccgatctgcaagattggtgatctcggactatcaaaggttaaacaacatactttggtatctggtggtgttagaggaaccttaccatggatggcaccagagcttctgagtgggaaaagtaatatggtgtcagagaagattgatgtctattcatttggtattgtcatgtgggagctgcttactggggaagagccctactctgacatgcgtgctgctgaaattattgggggtattgtgaacgattcgttacgccctcaaatccccgcatggtgtgatcctgagtggaaggcgttgatggaaagctgttggtccagtgatccaactgagagaccatcattcactgatatatctcaacggttgaggaaaatggctgctgcaatgaatgtgaagtaaaggctcagaaactctaaagggatcatgtgagttttcccgcatccaatatatgattacaagaggaaggcaaagttcaaactggattatatggagtaaatatttttcaaatgtcttggcagcatctcaatttaccctactctaagtgatagttttattaagtgcttcatggaagaaaagtttttgtcatggagattccaaagcatgcttaatgaactttttatcctggagtaaccagctttcattttgccttctgctctaaacagtttgctatatagggtatcatctcttgatgggaactgttggactgtaatgtaaataagttttgactcgcttcatccggctggcacatgttagatgtgcacagtaaaataggcacggttcagagctggacacagctatccttttttccctacagattgtgtccttggagagatggaacgaactcgaatagatagccttgttcagattgtacatagtttacgaataagagttctatattgtttttcctgtatatatcatcttttccaatttgaaatcgcatggttatttagatcgcccggatgtcgcatttcacctgttattgtttgaaagttttgttgtggatggaaaagtacttggcccaatccccaattaatgcaaggg

SEQ ID NO: 10049 - DNA, 1217 bp, Setaria italica
cgcttctttccccaaccgcaaaccaccaccggcgcagccatggcggagggagccgccgctacgcccgccgccacctccagcttcgaggtggacctcggcaacctcatggcgtacgacccgtcgcaccacctcaccgccgcctcctccagggaggagctgaggcaggagtgcctgcagaaggggacggagctggcgcaggcggtggccgacgccctcttcgcgctgccgcccagcgaggaccgagacggccccatcgtccacctcccgccgcccaccatccggctcccgcgcgagaagcatctacccaagccaaagccaccaaccaagtgggagctgtttgcaaaggcgaaagggattaccaagcgcaagaagaacaagcgtgaatgggacgagcaaactcaatcctggaagcggacttatggttatgaccgtgttaatgatgacaaggacattccaatcattgatgccaaagccactgatgagcctggtgttgatccttttgcactaagaaggcaagacaagaagaagcgggtagaaaagcaagaaaagagcagactggagaacttaaagaaagctgcaaaagttggtgctttgccaagtcatatacagcttgctgcaaaggcgttgcccatcacaggaactaaagctgatcttccgaaaaaatctagaaaagaagatcttgagaatgttgctggcatggcttcatcagcaacagcaagtggtgggaagtttgatgagaagttgcctggcgagaaacctctaaagcatcctggcaaacatcgaaagttcctcccagttgctgaagggaagggaatgggcaacctggagaaacagcagaatgacaagatcctgaactctctacttgccagaaattctgatgaacagcttgatgtgggcaaggcaattacaatgtacaaggtgaagaaggaaaagcaaagaagtaaagataaaaagatgtcctcgaaatctgataagcttaagccccagaagaaacccctcaagaaatcatcaaagaaaaaggcttaggtccacatctttcttgtgacttgctttaggaggtgaccacagttttgaagtctcaaggagacacctgtcacatcttgctattgtatttgtccggtttgaatctatgttagaaatattattgtaccgtttactggttatgacacaaagacctgaatggtgttataagatatgctgctctgatatgatgtatt

SEQ ID NO: 10050 - DNA, 1261 bp, Echinochloa colona
ccccaagtaaaaccctagctcctcgccgcttcgcttctttccccaaccgcaaaccaccaccgccacgcaccggcgcagccatggcggagggagccgccgctacgcccgccgccacctccagctgcgaggtggacctcggaaacatcatggcgtacgacccgtcgcaccacctcgccgctgccgcagcctccagggaggagctgagggcggagtgcctgcagaaggggacggagctggcgcaggcggtggccgacgcccttttcgcgctgccgccccacgaggaccgcgacggccccctcgtccacctcccgccgcccaccgtccgactcccacgcgagaagcatctacccaagccaaagccaccgaccaagtgggagctgtttgcaaaggctaaaggtattaccaagcacaagaagaacaagcgtgaatgggacgagcaaactcaatcctggaagcggacttatggctatgaccgtgttaatgatgacaaagacattccgattattgaagctaaatccactgatgagcctggagttgatccttttgcacaaagaatgcaagagaagaagaagcgggtagaaaagcaagaaaagaacagactagaaaacttaaagaaagctgcaaaagttggtgctttgccaagtcatatacaacttgcagcaaaggccttgcccatcacaggaactaaagctgatcttccgaaaaaatctaaaaaggaggatcttgagaatgttgcaggcatggcttcttctgcaacagcaagtggtgggaagtttgatgagaagttgcctggcgagaaacctccaaagcatcctggcaaacatagaaagttccttccagttgctgaagggaagggaatgggcaacctggagaaacaacagaatgacaaaatcctgaactctctacttgcgagaaactctgatgaacagcttgatgttggcaaggcaatcacaatgtacaaggtgaagaaggagaagcaaagaaggaaagacaaagagatgtactcaaaatcggataagctcaagacccagaagaaacccttcaagaaatcatcaaagaaaaaggcttaggtcccaccttttttgtgacttgttttaggaggtgaccgcagttttgatggctcaaggagacctgtcacatcttgctattgtatttgtccggtttgaatctatgggtgtgggagaaatattatattgttccttttactgcttattatgagttatgacccaggcctgaatgatgatataacatatgctgccca

SEQ ID NO: 10051 - DNA, 1173 bp, Echinochloa colona
ccccaagtaaaaccctagctcctcgccgcttcgcttctttccccaaccgcaaaccaccaccgccaccccggcgcagccatggcggagggagccgccgctacgcccgccgccacctccagctgcgaggtggacctcggaaacctcatggcgtacgacccgtcgcaccacctcgccgctgccgcagcctccagggaggagctgagggcggagtgcctgcagaaggggacggagctggcgcaggcggtggccgacgcccttttcgcgctgccgccccacgaggaccgcgacggccccctcgtccacctcccgccgcccaccgtccgactcccacgcgagaagcatctacccaagccgaagccaccgaccaagtgggagctgtttgcaaaggctaaaggtattacaaagcgcaagaagaacaaacgtgaatgggacgagcaaactaaatcctggaagcggacttatggctatgaccgtgttaatgatgacaaagacattccaattattgatgctaaatccactgatgagcctggagttgatccttttgcacaaagaatgcaagagaagaagaagcgggtagaaaagcaagaaaagaacagactagaaaacttaaagaaagctgcaaaagttggtgctttgccaagtcatatacaacttgcagcaaaggccttgcccatcacaggaactaaagctgatcttccgaaaaaatctaaaaaggaggatcttgagaatgttgcaggcatggcttcttctgcaacagcaagtggtgggaagtttgatgagaagttgcctggcgagaaacctccaaagcatcctggcaaacatagaaagttccttccagttgctgaagggaagggaatgggcaacctggagaaacaacagaatgacaaaatcctgaactctctacttgccagaaactctgatgaacagcttgatgttggcaaggcaatcacaatgtacaaggtgaagaaggagaagcaaagaaggaaagacaaagagatgttctcgaaatctgataagctcaagacccagaagaaacccttcaagaaatcatcacagaaaaaggcttaggtcccatctttcttgtgacttgttttaggaggtgacggcagttttgaaggctcaaggagacctgtcacatcttgctattgtatttgtccggtttgaatctatggg

SEQ ID NO: 10052 - DNA, 1502 bp, Panicum virgatum
cctgccaccccatgtaaaaccctagctgctcgctacttcgcttcgttcccccaaccgccagccacgcaacggcgcagccatggcggacggagccgcccctacgcccgccgccgcctccagcttcgaggtggacctcggcaacctcatggcatacgacccgtcgcaccacgccgccgccacctccagggaggagctgaggcaggtgtgcctgcagaaggcgacggagctggcgcaggcggtggccaactcccttttcgcgctgccgcccagcgaggaccgtgacggccccatcgtccacctcccgccgccaaccatccgacttccgcgcgaaaagcatctacccaagccaaagccaccgaccaagtgggagctctttgcaaaggcgaaagggattactaagcgcaagaagaacaagcgtgaatgggacgagcaaactcaatcctggaaacggacttacggctatgaccgtgttaacgatgacaaagatgttccgatcattgatgccaaagccactgatgagcctggtgttgatccttttgcacaaagaagacaagagaagaagaagcgggtagaaaagcaagaaaaaaacagactggagaacctaaagaaagctgaaaaagttggcgctttgccaagtcatatacagcttgctgcaaaggccttgccgatcacgggaactaaagctgatcttctgaaaaaatctagaaaagaggaccttgagaatgttgctggcatggcttcatcagcaacagcaagtggtgggaagtttgatgcgaagttgcctggcgagaaacctccaaagcatcatggcaaacatagaaagttcctcccagttgctgaagggaagggaatgggcaacctggagaaacagcagaacgataagatcctgaactctctacttgccagaaactctgacgagcagcttgatgttggcaaggcaatcacaatgtacaaggtgaagaaggaaaagcaaagaaggaaagacaaagagacgttctcaaaatctgataagcttaagcctcagaaaaaatccctcaagaaatcatcgaagaaaaaggcttaggctcacatcttccttgtgacgtgctttagggaggtgaccacagttttgaaggctcaaggagacctgttgcatcttgctattgtatttgtgatttgtccggttggaatctatggtagaaatattattgttccttttactggttgtaacacaaagacctgaatgatataacatatgctgccctgatatgcacacattatatttttgaaattttgtttggatgtggtttacaagtcatctctatcgcttgagtaataataagtgcattgtgcatggttgggacgataggatgaagagttgtttattactaataatactgcatacaaattgtgttgtgtccctgtccggtgtagcttgtgtggcttgctgcgttgcagtgccgtttgtaagatgagactccagtaatttcacatggttgctcgttcagctgtttgtgctgtcc

SEQ ID NO: 10053 - DNA, 1197 bp, Sorghum bicolor
ccccagccagccgcgagcctcataccggcgcagccatggcggaggtgcccgccgtcgtcgccgccgcttccagctgcgaggtcgacctcggcaacctcatggcgtacgacccgtcacaccacgtcgtctccgccgccgccgccgcctccagggaggaactgaggcaggagtgtctacggaaggggacggagctggcgcaggcggtggccgacgctctcttcgcgctgcctcccagcgaggaccgcgacggccccatcgtccacctcccgccgcccaccgtccgactcccgcgcgagaagcatctacccaagcccaagccaccgaccaagtgggagctgtttgcaaaggcgaaaggaataaccaagcgcaagaagaacaagcgcgagtgggatgagcaaactcaatcctggaagcggacttatggctatgaccgtgttaatgatgacaaagacattccaatcgttgaagccaaattgactgatgagcctggtgttgatccctttgcgcaaagaagggatgagaagaagaagagggttgaaaagcaagaaaaaaacagactagagaacttaaagaaagctgcaaagattggcgctttgccaagtcatatacagcttgctgcaaaggccttgcccatcacaggaactaaagctgaccttccaaaaaaatctagaaaagaggatcttgagagtgttgttggcatggcttcatcagcaacagcaagcggtgggaagtttgatgagaagttgcctggcgagaaacctccaaagcactctggcaaacacagaaagttcctcccagttgccgaagggaagggaatgggcagcctggagaaacagcagaatgacaaaatcctgaactctctacttgccagaaactctgatgaaccgcttgatgttggcaaggcaatcacaatgtacaaggtgaaaaaggaaaagcagagaaggaaagagaaagatatgtcatcgaaatctgataagcttaagccccagaagaaaccccacaagaagtcatcgaagaaaaaggcttaggtccacatctttcaggtgaccacagttttgaaagctcaaacaaggaggcctgtcacaaattcgattgtatttgtgcgcttgaatctatgcgagaaattgttattccgtttactggttatgacacaaaaacctgaatgctgttataatatattgtgccctgatatgcgcc

SEQ ID NO: 10054 - DNA, 1172 bp, Zea mays
ctctatccgcgagcctcgtaccggcgcagccatggcggaggagcccgccgttgtcgtggcctcctccagctacgaggttgacctcgggaacctcatggcgtacgatccgtcgcatcacgtcgccaccgcctccagggaggagctgagacaggagtgcctgcggaagggtacagagctggcgcaggcggtggccgacgtcctcttcgcgctgccgcccaacgaggaccgcgacggccccattatccacctcccgccgcccaccttcagactcccgcgggagaagcatctacccaagcccaagccaccgaccaagtgggagctgtttgcaaaggcgaaaggaattaccaagcgcaaaaagaacaagcgtgagtgggatgagcaaactcaatcctggaagcggactcatggctatgaccgtgttaatgatgacaaagacattccaatcattgaagccaaattgactgatgagcctggtgttgatccatttgcgcaaagaagggatgagaagaagaagagggttgaaaagcaagaaaaaaacagactggataacttaaagaaagctgcaaaggttggcgctttgccaagtcatatacagcttgctgcgaaggcgttgcccatcacaggaacaaaagctgaccttccaaaaaaatctagaaaagaggatcttgagagtgttgtcggcatggcttcatcagcaacagcaagtggtgggaagtttgatgagaagttgcctggcgagaaacctccaaagcaccctggcaaacacagaaagttcctcccagttgccgaagggaagggaatgggcagcctggagaaacagcagaatgacaaaatcctgaactctctacttgccagaaactctgatgaaccacttgatgtcggcaaggcaattacaatgtacaaggtgaaaaaggagaagcagagaaggaaagagaaaggcatgtcatcgaaatctgataagcttaagccccagaagaaaccccacaagaagtcatcgaagaaaaaggcttaggtccacatctttcaggtgaccacagttttgaaagctcaagcaaggaggcctgtcagcatattcaattgtatttttctgctttgaatctatgagagaaatattgttattccgtttactggctatgacacaaaaacctgaatgctgttataatatatgccca

SEQ ID NO: 10055 - DNA, 1384 bp, Zea mays
ctcgatttctttccctttccctttcccttccccagtcagccgcgagcctcgtaccggcgcagccatggcggaggagcccgccatcgtcgtcgccgcctcctccagctgcgaggtcgacctcggcaacctcatggcgtacgacccgtgtcaccacgtcgcagccgccgcctccgcctccagggaggagctgaggcaggagtgcctgcggaaggggacggagctggcgcaggcggtggccgacgccctcttcgcgctgccgcccaccgaggaccgcgacggccccatcgtccacctcccgccacacaccgttcgactcccgcgcgagaagcatctacccaagcccaagccaccgaccaagtgggagctgtttgcaaaggcgaaaggaattaccaagcgcaagaagaacaagcgtgagtgggacgagcaaactcaatcctggaagcggacttatggctatgaccgtgtaaatgatgataaagacgttccgattcttgaagccaaactgactgacgagcctggtgttgatccctttgcacagagaagggatgagaagaagaagagggttgaaaagcaagaaaaaagcagattagagaatttaaagaaagctgcaaaggttggtgctttgccaagtcatatacagcttgctgcgaaggccttgcccatcacaggaactaaagctgaccttccaaaaaaatctagaaaagaggatcttgagagtgttgttggcatggcttcgtcagcaacagcaagcggtgggaagtttgacgagaagttgcctggcgagaaacctccaaagcaccctggcaaacatagaaagttcctcccagttgctgaggggaagggaatgggcagcctggagaaacagcagaatgacaaaatcctgagctctctacttgccagaaactctgatgaaccgcttgatgtcagcaaggcaattacaatgtacaaggtgaaaaaggaaaagcagagaaggaaagagaaaaatatgccatcaaaatctgataagcttaagccccagaagaaaccccacaagaaatcatcgaagaaaagggcttaggtccacgtctttcagttgaccacagttttgaaagctgaagcaaggaggcctgtcacatattggattgtatttgtgagctttgaatctctgggagaaatattgttattccgtctaatggttatgatacaaaaacctgaatgctttgccatggtatgcgcccatcttgtacttttcaaattatgtttgggatgtggtttgtagcttggtaagagtccctccctttggttctgaaacctgttcaaaggagctgtcctggaaacagtaccaatgaagctactgtctagtgtcgatggtactgatttgttgttggcctctgagtttactcta

SEQ ID NO: 10056 - DNA, 1375 bp, Brachypodium distachyon
ctgcagcctccatcccctcgaaccccaaacccccacctcgcgacctacacatggcggaagaaaccgccgccgccgcgacctccatggccaccaactacgaggtggacctgggcaacctgatggcgtgcgacccgtcgcaccacatcgccgccgcgcagtcctccagggaggagctgaggaacgagtgcctgcagaaggcgacggagctggcgcaggcggtcgccgacgcgctcttcgctctgccggccaccgtgggccgtgacgggccctccgtccgcctccctccgcccgtccaccgcctcccccgcgagaagcatttaccaaggccgaagcctcctactaagtgggagcagtttgcaaaatcgaaagggattgttaaacacaagaagaacaagcgtgaatgggatgagcaaactgcttcgtggaagcgtacttacggctatgatcgtgttaacgatgacagagacgttcctatcattgaagccaaaatgacagatgagcctggtgttgacccctttgctaaaagaagggacgagaagaagcagagggtcgaaaagcaagaaaagaacagactagggaatttgaagaatgctgcgaaagttggtgctctgccaagtcatattcagcttgctgctacagctgtgcccatcacaggaactaaagctgatctgcctaaaaaagctaagaaggaagatcttgagaatgttgctggcatggcttcttcagcgacagctagtggtgggaagtttgacaaaaagttgcctggtgagaaggctcctaagaaagctggcaaaaatagaaagttcctccctgttgttgaagggaaaggaatgggcaacctggagaaacagcaaaacgacaagatcctgaacagtctactggccaaaaactttgaggaaccattggatgtcagcaaggcaatcacgatgtacaaagtgaagaaggacaacaagagaaggaaagagaaacagtcgtcttccgggtcaaataaaaagctgaagcctcagaagaaactccagaagaaatcttcaaagaagaccgctgcttaggttgaggcttgctgtagtaggacgtaagcgtggtctctccaagcaggcaggggagatttagcaaattttgtatggttattgtcctgtttaagtctggtgttggacacgtcgtgttcgggcgactgctggttatgacgcaagaacctgaatgttgtcatggcatagctgtggctatatctatatgcacgtattacattttcagttctggaaatgtggtctgtagaactgttggcgctatagtaaaagtaagcaatcctaatcgaaggaaatccatgtctgtgaacgggaaccttcagtgtgtcaattttgcttgggtttgtgttgta

SEQ ID NO: 10057 - DNA, 1301 bp, Pseudoroegneria spicata
gcctgcgcctcccccccacccccctaccctcgccgcagccatggcggaagaagcagccgcctccgcctccgccgccgccaccaacttcgaggtggacctgggccacctcctggcctacgacccctcccaccacctcgccgccgccccgtcctcccggcccgagctgcgcgacgagtgcctgcggaaggccacggagctcgcgcaggccgtcgccaacgccctcttctcgctgcccgccaccgagggccgcgacggccccgtcgtccgcctccccccgcccaccaaccgcctcccccgcgagaagcatttaccaaggcccaagcctcctaccaagtgggagcacttcgccaactcgaaagggattatcaagcacaagaagaacaagcgtgcatgggatgagcaaactaattcctggaagcggacttacggctatgatcgtgtcaatgatgaccgcgacgttcccatcattgaagccaaattgacagatgagcctggtgttgatccttttgctcaaagaagggaagagaagaagagcagggtcgataaacaagaaaagaacagacttgggaatttgaagaatgctgcaaaagttggtgctctgccaagtcatatacagctcgctgccacgtccgtgcccatcacaggaactaaagctgatctgcccagaaaagctaagaaggaagacctcgagaatgtcgctggtatggcttccgccgcaaccgctagcggtggaaagttcgacaaaaagttgcctggcgagaaacctctcaagaaggctggcaaaaacagaaagttcctccctgttgttgaagggaaaggaatgggcaacctagagaaacaacaaaacgacaagatcctgaacagtctactggccaagaactttgaggagccattggatgtcagcaaggcaatcacgatgtacaaggtgaagaaggacaacaagaggaggaaagacaaacaatcatcatcatctggatcaaataagttgaagccccagaagaaaatccacaagaaatcttcaaagaaaagtgcttaggtcagcatcatcctcaagacgtggtttgctgtaggcggcgagcgcagtttccaagcatcatggagagtgttggcaagttttgtatggttgttgtcctgtttaagtccaagagagaaatattgataatccatttactgattatgacacaagaacctgaatgttgttatgacatagctgtccggctatgcacgtattatatttttagaagtttggaaaaatgtttctgcaaagctttcttggcaatatagaaatcaacctaacacca

SEQ ID NO: 10058 - DNA, 1008 bp, Saccharum officinarum
cccttccccagccagccgcgagcctcataccggcgcagccatggcggaggtgcccgccgtcgtcgccgccgcctccagctgcgaggtcgacctcggcaatctcttggcgtacgacccatcgcaccacgtcgccgccgccgcctccagggaggagctgaggcaggagtgtctgcggaaggggacggagctggcgcaggtggtggctgacgccctcttcgcgctgcctcccagcgaggaccgcgacggccccatcgtccacctcccgccgcccaccgtccgactcccgcgcgagaagcatctacccaagcccaagccaccgaccaagtgggagctgtttgcaaaggcgaaaggaattaccaagcgcaagaagaacaagcgcgagtgggacgagcaaactcaatcctggaagcggacttatggctacgaccgtgttaatgatgacaaagacattccgattgttgaagccaaattgactgacgagcctggtgttgatccctttgcgcaaagaagggatgagaagaagaagagggttgaaaagcaagaaaaaaacagactagagaacttgaagaaagctgcaaagattggcgctttgccaagtcatatacagcttgctgcaaaggccttgcccatcacaggaactaaagctgaccttccaaaaaaatctagaaaagaggatcttgagagtgttgttggcatggcttcatcagcaacagcaagcggtgggaagtttgacgagaagttgcctggcgagaaacctccaaagcaccctggcaaacatagaaagttcctcccagttgccgaagggaagggaatgggcagcctggagaaacagcagaatgacaaaatcctgaactctctacttgccagaaactctgatgaaccgcttgatgttggcaaggcaattacaatgtacaaggtgaaaaaggaaaagcagagaaggaaagaaaaagaaatgtcatcgaaattgataagcctaaaccccagaagaaacccacaagaagccatcga

SEQ ID NO: 10059 - DNA, 1535 bp, Triticum aestivum
cagttcctgatctccctcgcgttgtcgcgctctcaagtgcatcacgatagtctagacatgaagccgagcgccggcgtcctcctcgccgccgtcgtggcgctgctcttggtcgccgctgtgcggggcgatgacgactgcgggtcgccggagtcggcggcgcaggaccgcgcgcgggcgaaccctctcaaaatcgcggccttcttctccatcctggtctgcggggcgctgggctgctccctgcccgtgctggggcggcgggtgcccgcgctccggcccgagggcgacgtcttcttcctggtcaaggcgttcgcggcgggggtcatcctcgcgacggggttcatccacatcctcccggacgccttcgagaacctcacgtcggactgcctgccttccgatgggccgtggaaggacttcccgttcgccgggctaggggccatggtcggcgccatcggcacgctcgtcgtcgacaccgtcgccacggggtacttcacgcgcgcccacctgaacaaggacggagcgcacggccacggggcggtaagcagcagcgccgtcgtcgtggacgaggagaaacaggccgctgccgccgccagcgaggaagcgcgccgtcacgagggcggggagcacgaggtacacgtccacacgcacgcgacccacggccacgcccacgggtcggcggcgctcgttgcggccgtcggcggcgccgaggacgaaaaggacacgatccggcatcgcgtaatctctcaggtacttgagttgggcattgtggtgcactcggtgatcatcggcatctccctcggcgcgtctcaggacccggaaacaatcaaacctctcgtggtcgccttgagcttccaccagatgttcgagggaatgggccttggtggctgcatagttcaggcaaagttcaaggccaggtccatcgtgaccatgatcctcttcttctgcctgacaacgccggtgggcatcgccgtcggctatggcatatcgcgagtgtacaacgagaacagcccgacggcgctggtggtggagggcggcctcaactccgtggcagcggggatcctcgtctacatggccctcgtcgacctcctcgccgaggacttcatgaaccccaaggtgcagagcagggggaagctgcagctcggcatcaacgtctccatgctggtcggtgctggcctcatgtccatgctcgccaaatgggcctagccggaagcctacaacatgaaacagttttgttccatgacatatgagttcaggatatacgcagatatatttgatcgtcgatgttgaaacgacataatcttcgtgcatatgctttatctcccaaactggtaatggcaaccgtagcgtaggcatctaaagaaaaccaatagtgtaggttttgcaccgagagtttgaaaggtgtggaaagtgtgagttctcacaaggaatgtcgacattatctcgtcaactttgacaaggctctcaaattaaagtattgaaaagaaattcttcatataaatgataccagatccgccaaatgaaacgattatattattgac

SEQ ID NO: 10060 - DNA, 1572 bp, Hordeum vulgare
cgtcaccttgtgacagagacagtcgttttcgcctcaaccgatcgcctataaaccctaatcaatggcgattcctggctgcagcagagctgttcctcacttcatacgtctatataaacactcctgcaaccaccgtagctagcgtcatcgcccactcgccgcggtacgtgcatcacgatcgacagcccagccatgaagccgagcgccgccgtcctcctcgctgccgtagtggcgctgctcctggtctcggccgtgcggggcggggacgactgcgggtcgccggagtcggcggcgcacgaccgcgcgcgggcgaggccgctcaagatcgtggccttcttctccatcctcatctgcggggcgctgggttgctccctgcccgtactggggcgccgcgtgcccgcgctccggcccgacggcgacgtcttcttcctggtcaaggcgttcgcggcgggggtcatcctcgccaccgggttcatccacatcctccccgacgcgttcgagaacctcacgtcggactgcctgcccgccgccgggccgtggaaggacttcccgttcgcggggctaggagccatggtcggcgccatcggcacgctcgtcgtcgacaccgtcgccacggggtacttcacgcgcgcccacttgaacaaggaccgagcccacggcagcagcgccgccgtggtggacgaggagaaacaggctgctgctgctgctgccgccaccgccgccagcgaggaagcgcacgagggacacgttcacttgcacacgcacgcgacccacggccacgcccacgggtcggcggcgctcgttgcggccgttggcggcgccgaggacgaaaaggacacgatccggcatcgcgtaatctctcaggttcttgagttgggtattgtggtgcactcggtgatcatcggcatctccctcggcgcgtctcaggacccggaaacgatcaaacctctcgtcgtcgcattgagcttccaccagatgttcgagggaatgggccttggtggctgcatagttcaggcaaagttcaaggccaggtccatagtgaccatgatcctcttcttctgcctgacaacgccggtgggcatcgccatcggcttcggcatatcgagagtgtaccacgagaacagcccgacggcgctcgtggtggagggcagcctcaactccgtggcggccgggatcctcgtctacatggccctcgtcgacctcctcgccgaggacttcatgaaccctatggtgcagagcaggggaaagctgcaactcggtatcaatgtctccatgctggtcggtgcaggcctcatgtccatgctcgccaaatgggcctagtcggaagccgaaaacatgaaacagttttgctccatgacatatgaatcgagaggatgtttataactttatatagacttatgtatattggatcgtcgaggttgaaacgatgtgatcttggcacatattcttcatctccccaaactggcaagagcatggttaataatatagccggctgctgcctataaggctatctatagcttatcttatagttaacatgtacaatatttgattaaaaaaatgtatcattattttatt

SEQ ID NO: 10061 - DNA, 1432 bp, Hordeum vulgare
gtcatcgcccactcgccgcggtacgtgcatcacgatcgacagcccagccatgaagccgagcgccgccgtcctcctcgctgccgtagtggcgctgctcctggtctcggccgtgcggggcggggacgactgcgggtcgccggagtcggcggcgcacgaccgcgcgcgggcgaggccgctcaagatcgtggccttcttctccatcctcatctgcggggcgctgggttgctccctgcccgtactggggcgccgcgtgcccgcgctccggcccgacggcgacgtcttcttcctggtcaaggcgttcgcggcgggggtcatcctcgccaccgggttcatccacatcctccccgacgcgttcgagaacctcacgtcggactgcctgcccgccgccgggccgtggaaggacttcccgttcgcggggctaggagccatggtcggcgccatcggcacgctcgtcgtcgacaccgtcgccacggggtacttcacgcgcgcccacttgaacaaggaccgagcccacggcagcagcgccgccgtggtggacgaggagaaacaggctgctgctgctgctgccgccaccgccgccagcgaggaagcgcacgagggacacgttcacttgcacacgcacgcgacccacggccacgcccacgggtcggcggcgctcgttgcggccgttggcggcgccgaggacgaaaaggacacgatccggcatcgcgtaatctctcaggttcttgagttgggtattgtggtgcactcggtgatcatcggcatctccctcggcgcgtctcaggacccggaaacgatcaaacctctcgtcgtcgcattgagcttccaccagatgttcgagggaatgggccttggtggctgcatagttcaggcaaagttcaaggccaggtccatagtgaccatgatcctcttcttctgcctgacaacgccggtgggcatcgccatcggcttcggcatatcgagagtgtaccacgagaacagcccgacggcgctcgtggtggagggcagcctcaactccgtggcggccgggatcctcgtctacatggccctcgtcgacctcctcgccgaggacttcatgaaccctatggtgcagagcaggggaaagctgcaactcggtatcaatgtctccatgctggtcggtgcaggcctcatgtccatgctcgccaaatgggcctagtcggaagccgaaaacatgaaacagttttgctccatgacatatgaatcgagaggatgtttataactttatatagacttatgtatattggatcgtcgaggttgaaacgatgtgatcttggcacatattcttcatcaccccaaactggcaagagcatggttaataatatagccggctgctgcctataaggctatctatagcttatcttatagttaacatgtacaatatttgattaaaaaaatgtatcattattttatt

SEQ ID NO: 10062 - DNA, 1557 bp, Triticum aestivum
acttcctccatctatataaaccccctgcaaccaccgtagctacctccgaagctcttcagttcagtctcctggtctccctcgcgtcatcgcccactcgccgcgtgcgtgcatcacgacagcctaagccatgaagccgagcgccgctgtcctgctcgccgccgtcgtggcgctgctcctggtctcggccgtgcggggcgaggacgactgcgggtcgccggagtcggcggcgcgcgaccgcgcgcgggcgaggccgctcaagatcgcggccttcttctccatcctgatctgcggggcgctgggttgctccctgcccgtgctggggcgacacgtgcccgcgctccggcccgacggcgacgtcttcttcctggtcaaggcgttcgcggcgggggtcatcctcgccacggggttcatccacatcctccccgacgccttcgaaaatctcacgtccgactgcctccctgccgccgggccgtggaaggacttcccgttcgccgggttgggagccatggtcggcgccatcggcacgctcgtggtcgacaccctcgccacggggtacttcacgcgcgcccacttgaacaaggaccgagcccacggcagcagcgccgccgtggtggacgaggagaaacaggctgctgctgctgccgccgccagcgagttagcgcgccactaccacgacgacggggagcacgagggacatgttcacttgcacacgcacgcgacccatggccacacccacgggtcggcggcgctcgtcgcggccgttggcggcgccgaggacgaaaaggacacgatccggcatcgcgtaatctctcaggtacttgagttgggtattgtggtgcactcggtgatcatcggcatctccctcggcgcgtctcaggacccggaaacaatcaaacctctcgtcgtcgccttgagcttccaccagatgttcgagggaatgggccttggtggctgcatagttcaggcaaagttcaaggctaggtccattgtgaccatgatcctcttcttctgcctgacaacgccggtgggcatcgccatcggcttcggcatatcgcaagtgtacaacgagaacagcccgacggcgctggtggtggagggcagcctcaactccgtggcagcggggatcctcgtctacatggccctcgtcgacctcctcgccgaggactttatgaacccaaaggtgcagagcagggggaagctgcaactcggtatcaatgtctccatgttggtcggtgcaggcctcatgtccatgctcgccaaatgggcctagccggaagccagaaacatgaaacagttttgctccatgacatgagtccaggatatatatatagatttacgtatattggatcatcgaggctgaaacgatgtaagcttggcacatattcttcatctacccaaactggtaatgccaacccagtagtgtaggcatctaagcaaaccagtaatgttggttttggaccaagagtttgggaggtacgaaaagtgtgtgtgcttatcacaagggaaatctacattatgtcgtcacctttgacaagccttttaaaataaaccgttgaa

SEQ ID NO: 10063 - DNA, 1618 bp, Brachypodium distachyon
ccagagcagctagctagcagagcttcttcttccacggttcaaaatcgcacgcagcagcctagcaagcagcaatgaagccgagcgcggcgattcttctcggcgccgccatcgcggcgctgctgctggtctcggcggtgcgcggcgagggggaggaggacgagtgcgggtcggcggagtcggcggcggcggaccgcgcgcgggtgcggccgctgaagatcgcggccttcttctccatcctggtgtccggcgcgctgggctgctcgctccccgtcctggcccggcgcgtgccgggcctgcggcccgacggcgacgtgttcttcctggtcaaggcgttcgcggcgggggtcatcctcgccacgggcttcatccacatcctcccggacgccttcgagaacctcggctcgccatgcctgccgtccgacgggccctggaaggacttccccttcgccgggctcggcgccatggtcggcgccatcggcacgctcgtcgttgacaccctcgccaccggctacttcacgcgcgcgcactccaagaagggcggcggcgccgttgtcgacgaggagaagcaggccgccgccgccgccggggaagaagacgtgcacgtgcacacgcacgcgacgcacggccacgcgcacgggtccgcggcgctcgtcgcggccgtgggcggcgccgaggacgacaagatggacaccatccggtatcgcgtaatctctcaggtccttgagctgggtatcgtggtgcactcggtgatcatcggcatctctctcggcgcgtctcaggaaccggacaccatcaagccgctcgtggtcgcgctgagcttccaccagatgttcgagggcatgggccttggtggctgcatcgttcaggccaagttcaaggcaaggtccatcgtgacgatgatcctcttcttctgcctgacgacgccggtgggcatcgcggtgggcgtcggcatatcgcgggtgtacaacgagaacagcccgacggcgctggtggtggaaggcggcctcaactccgtggcggcggggatcctcgtctacatggcgctcgtcgacctcctcgccgaggacttcatgaaccccaaggtgcagagcagggggaagctccagctcggcatcaacctctccatgctcctcggcgccgggctcatgtccatgctcgccaaatgggcctgattgttttttgggttattttttgcgctgccaaatgggcctaattacgcgctttactattgatttacagtagtttgctccgtgacttttgggtcaaggatatatatacagtagtgcttgtttactagccggttggaacgatgtaattttcgtgcacgcttggcctcaaactgggtttggaatggaatggcaaccgtgtaggtttgtttgagagtgagagtgagagtgagagggtgcagaaagtgtgcgtgcttaattgcttatctcagagacggggtgtcgacactatgtaaatgatgaacgaagcagcaagaaagtcagggttagagccggtttgactgaagaacctgcagcaaaattcagcgcggcggccattctctgtagtactgttttcacactttacaagctgggctgaaactacggagcgacccacttgacagtttttgcga

SEQ ID NO: 10064 - DNA, 1937 bp, Panicum virgatum
gcttgcttcagaaaaaccatatccatccatccatccattattccagcatccaacctccatccatcctcttcacacacacacacacactgactgtacacagagcgaggtataggcagtgagatcggctgccgacgccgacggcatggccataggcgccttcgcggaaggccccgccggcgccggctacagcggccgggtcacgtccttcgtggtgctctcctgcatcgtggccggcagcggcggcatcctcttcggctatgacctcggaatctcaggtggggttacctccatggagtccttcctcagcaagttcttccagatgaaaggggacaagaacgtcagcaactactgccgtttcgacagcgagctcctcaccgtcttcacctcctccctctacgtcgccggcctcgtctccacgctcttcgcctcctccgtcacgaggaggttcggccgccgagcctccattctcatcggcggctccgtcttcatcgtcggctccgtcttcggcggggcagccgtcaacgtctacatgctcctcctcaacaggatactgctcggcataggactaggcttcaccaaccagtctattccactgtacctatcagaaatggcgccaccccagtaccgtggggccatcaacaatggctttgagctctgcataagcattggcatcctcatcgcaaacctcatcaacttcggagtcgagaaaattgtagatggatggggctggagaatctctctctccctggcagctgtgccagctgcattcctaaccatgggcgcaatattcctgcctgagacacccagcttcataatccaacgtgatggcaacattgatgaggcaaagatcctgctccagaggctacgtggcacaactagaatccagaaagagcttgatgatttggtctctgctagcaatgtctcgaggacaatacaacatccactccggaacatattcaagaggaagtacaggccacagcttgtcatagcactcttggttccattcttcaaccaggtcacaggaatcaacgtcatcaacttctatgcgccagtcatgttccgaaccatcgggctcaaggagagtgcatccctcatgtcagcggttgtcacacgcatctgtgcaacagttgccaacattgtagcaatggttgtcgttgacaggtttgggcgtaggaagctcttcctagtaggtggcattcagatgatcttgtcacagatcatggtaggggcagtcctagctgcaaagttcaaggaccatggaggaatggaaaaggagtatgcatacctagtcttgatcatcatgtgcgtgttcgttgcaggctttgcatggtcttggggacctctgacctacttggtcccgacggagatttgcccactggagatcaggtcagccgggcagagtattgtcgttgctgtgatcttcttggtgacgtttgtgattggccagaccttcctcgcaatgttatgccatctcaagtttggaacattcttcctctttggtggatgggtgtgtgtgatgacactcttcgtatacttcttcctgccagagacgaagcaactgccaatggagcaaatggagcaggtctggaggaggcactggttttggagaaggattattgtaggggaggaagaggaagaggaagagagagaggcaagaagcatagctttgtccaacacatagtgattttcttttaggatcaagttaatttggtgaaacctgcagaaacgatacaccgtaccattttgattagtaaatatgcatgcatcaaggtatattattgtatagctgcgcaaattgtatcctaactagtaactgcattagttagtctcctaatttgacgcttctggcattgtgtaacctataaagggcttccagaattatagcaagtaagaagaactttcagtgcttcgcaaatagcacagcaggtatctttgag

SEQ ID NO: 10065 - DNA, 2093 bp, Zea mays
cttttgcgacattgcgcaccagctggagtctgtgctcggttaactgatgagagtatgatcagagaaaggaagcgcctccctacctccagctccaataaataggggaagagagagagagagaactataagcctgctgctgtatgtaacccagatccaccccattcgcatctctgcttctttctgcttgggtgccctctgccctgaccacagggcccaaccatatcttcttcctcacacagagacactgagcgagcgagcttgagatcgatctcaggaggcggccggcggcggcagcagcagcagagcttgttggcgccgccatggcgataggtggcttcgtggaagcccctgccggcgccgactacggtggccgcgtgacgtccttcgtggtgctctcctgcatcgtagccggtagcggcggcatcctcttcggctacgacctcggcatctcaggtggggttacctccatggagtcgttccttagaaagttcttcccggacgtgtaccaccagatgaaaggagacaaggacgtgagcaactactgccgcttcgacagcgagcttctcaccgtcttcacctcctccctctacatcgccggcctcgtcgccacgctcttcgcctcctccgtcaccaggaggttcggccgccgcacctccatacttatcggaggcaccgtcttcgtcatcggctccgtcttcggcggggcagccgtcaacgtatacatgctcctactcaacaggatactccttggagtaggcctcggattcacaaaccagtccatcccgctgtacctctcagagatggcgccaccgcagtaccgtggcgccatcaacaacggcttcgagctctgcatcagcatcggcatcctcatcgccaacctcatcaactacggcgtggagaagatagcaggtggatggggctggaggatctctctgtccctggccgccgtgccggccgcgttcctcaccgtcggcgccatctacctgcccgagacgcccagcttcatcatccaacgccgcggcggcagcaacaacgtcgacgaggcaaggctgctcctccagaggctgcgtggcaccaccagggtccagaaagagctcgacgatctcgtgtccgcgaccaggacgaccaccacagggcgtcccttccgcaccatactgaggcgcaagtacaggccgcagctggtcatagctctcctcgtacccttcttcaaccaggtcaccggcatcaacgtcatcaacttctacgcgccggtcatgttccggaccatcgggctcaaggagagcgcgtccctcatgtcggccgtggtcacgcgcgtctgcgccacggccgccaacgtggtggccatggtggtcgtggacaggttcggccgccggaagctcttcctggtgggcggcgtgcagatgatcctgtcgcaggccatggtgggagcggtgctggccgccaagttccaggagcacggagggatggagaaggagtacgcgtacctggtgctcgtcatcatgtgcgtcttcgtcgcgggcttcgcctggtcctggggccctctcacctacctggtgcccaccgagatctgcccgctggagatcaggtcggcggggcagagcgtcgtcatcgccgtcatcttcttcgtcaccttcctcatcggccagaccttcctggcgatgctgtgccacctcaagttcggcaccttcttcctcttcggcggctgggtgtgcgtcatgacgctcttcgtgtatttcttcctgccggagaccaagcagctgcccatggagcagatggaacaggtctggaggacccactggttttggaaaaggattgtagacgaagatgcagcaggggagcaaccgagagaggaagcagcaggaaccatagctctgtcgtccacgtccaccacaacatagtcatcatcaacaatactcatggcatgggcctgccctgtatagatagataattaactagctgcaccgcacagattgtctccgactataagctagctagctagttggatgcatgcatgcatgcattctgttatttctgtgaccatgaatcaaagggccttccaacagaacagaatatgagatgagatgaatcttatt

SEQ ID NO: 10066 - DNA, 2802 bp, Sorghum bicolor
cttgtaccgctcggcattgcatttgccactgacattgcgcacccaccaggcaccagctgatcgagctcaacgtaagtactccctccattgtaaaagtcattctaagaatcttggagagtcaaagtatttttacgtttgaccaaaattatagagaaaaatactaagatttgtaacgtaaagtgagtatactattaaaatataattaagaaagaatctaaggatatttagttagtaccataataataattattttataatataaatttagtcaaacttagaaaagtttgactctccaaaatttttagaatgacttacaatttggaacgaagagagtataaagtaactcaactgacaagagagtgaaggaaaggagagaaggcagcacagcagcagctgcgtcgccaataaatacaagaggaagggagctaacccagatagatgcatccacccatgattcccatccatctctgctctgcttgggtgccctgccctgccctgcccataacaacaaccgtatccatccatcccaccacccatcttccttccttggttcctcttgacagttgagagttgacacacacacacccacccagataactactgagtgagtgagtgagtgagtgagtgagtgagtgagcgagcgagcgagccagccagccatcgagcgagcgaccttgagatcgatctcagctttgtttgttggcccgccgccgccatggcgataggtggcttcgtggatgcccctgccgctgccgccggcgccgactacggtggccgcgtgacttccttcgtggtgctctcctgcatcgtggccggcagcggtggcatcctcttcggctatgacctcggcatctcaggtggggttacgtcgatggagtcgttcctgagaaagttcttcccggatgtgtaccaccagatgaaaggagacaaggacgtcagcaactactgccgcttcgacagcgagctcctcaccgtcttcacctcgtctctctacgtcgccggcctcgtcgccacgctcttcgcctcctccgtcaccaggaggttcggccgccgcacctccatactcatcggcggcactgtcttcgtcctcggctccgtcttcggcggggcagccgtcaacgtatacatgctcctcctcaacaggatcctccttggtataggcctcggcttcaccaaccagtcgattccactgtacctatcagagatggcgccaccgcagtaccgtggggcaatcaacaatggctttgagctctgcatcagcatcggcatcctcatcgcgaacctcatcaactacggcgtggagaagatcgccggtggatggggctggaggctgtctctgtccctggccgccgtgccggccgcgttcctgaccgtcggcgcgatcttcctgcccgagacgcccagcttcataatccaacgcggcggcgggggcagcgacatcgacgaggcaaggctgctgctgcagaggctgcgtggcacgaccagggtccagaaagagctcgacgatctggtgtccgcggctagcgaggcgtcgaggacgacggcaacccggcggccgttccggaacatactgaggagcaagtacaggccgcagctggtgatagcgctgctggttcccttcttcaaccaggtgacgggcatcaacgtcatcaacttctacgcgccggtcatgttccggaccatcgggctcaaggagagcgcgtcgctcatgtcggcggtggtgacgcgcgtctgcgcgacggccgccaacgtggtggccatggtggtggtggacaggttcgggcggcggaagctcttgctggtgggcggcgtccagatgatcctgtcgcaggtgatggtgggggcggtgctggcggccaagttcaaggaccacggagggatggacaaggagtacgcgtacctggtcctggtcatcatgtgcgtcttcgtcgcgggcttcgcctggtcctggggccctctcacgtacctggtgcccaccgagatctgcccgctggagatcaggtcggcggggcagagcatcgtcatcgccgtcatcttcttcgtgacgttcctcatcggccagaccttcctggcgatgctgtgccatctcaagttcgggaccttcttcctcttcggcggatgggtgtgcgtcatgacgctcttcgtgtatttcttcctgccggagacgaagcagctgcccatggagcagatggagcaggtctggaggacccactggttttggaaaaggattgcagatgcagatgcagatgcaggggaggaagaagagcaaggccaaaggagacccagacccagaggagaggcagcaggaaccatagctctgtccgccacatagacactatacattgcattggttgccaatcattattaattaagctactatatatataggtgatctgatgatcaaagtatacatacacatgcatacattatatttggtgaaaccgcgcgcgcctgcagaaatcgtatagctaggcgcatgcatggtacaccactttgttgattacacacactagctagtatatatactatactctagtaaataataaatccatgcaaatatatatatatatgtaatgggcttgcattgtatagctaactagctgcacacaaattgtttgtatcctagctagctagggagcaaatgcatttcaataagctagtttatttgatgcatgcattctgtaatgtaaaggggctatcctatccatgaaggaagaattcaaggggcttccactccagcagaagtgcgaattaattattaatctttgagagtggcaatatatatatgatataaagatgcat

SEQ ID NO: 10067 - DNA, 2631 bp, Secale cereale
gactagtaggcgcgcgctagcagcagcagcagcacggggaggagggagtaggagtaggcggaaaaaggaggcgtgagcgcgagggggacggaggcggagagagagagagacgcgcggatcaaacgcccgctcgccccgccccgccccgtccgcaccagctcgagccctctgttccaccgttccgccgcgccggaggcggtggtggcggaggaggggctcgcggcctccctccttcccgatccggatcgagcggcggatctccctctcccccggcgagagtggaggctccagtggctgtacatatagtttcggatcagtgatcatcagttctagaataggctggcccctgatcatttaggctgcatttgcggagaatgtcagagagcaatatcgacggcatagagatatctgtcagtaatgacgagaggagggacagagcggatgccgagaactcggaggacgagccaaagcacaggaggatgcggtcgctgaggaagaaggcgctgcacgcttcaaccaagctgacacactcgctgaagaagagggggaagaggaaagtggactgcagagtgccgagaataccgatagaggatgtcagggatgctggtgaagagcaggcggtcagctcgttccgcgaggttttgtttgccaggaacctattgcctgaaaggcatgatgattaccatatgatgcttagatttttgaaagctagaaagttcgacgttgaaaaggcagcacaaatgtgggatgagatgctccagtggaggaatgaatttgggacagacacaattttggaagattttgaatttcatgagctagaggaggtactgcagtattatcctcagggttatcatggggttgacaaggatggaaggcctgtctatatcgagttgcttggaaaagtagaacccaataaacttgtgcaaaccacaacagtggaacgatatatcaagtaccatgtgcaagagttcgagagagcattccgtgagaagtttcctgcctgctcaatttctgctcaaaagcatatagatacaacaaccacaatattggatgtccatggcgtgggctggaagaactttggtaagattgcaagggatttagtgcgctgtatgcagaaaatagatggtgactattatcccgagacactacatcaaatgttcattgtaaatgctggagctggtttcaaactgatctggagcactataaagggacttcttgaccccaaaacatcatcgaaaattcatgttctaggagcaaaataccagagcaggcttcttgaagctattgacgcaagccaattaccagagttttttggtggtttgtgcacatgcactaaccagggaggatgcctgaggtccaacaaaggcccttggagtgaccctttaattatgaagatcgtacatagcatggaatcatctgcattaagggatatcctgcaagtatctgatatagaagaaacaattacaggctctgtaagattgcgtgcgctcaagttaccagaaagaattagtgatacatcaaatgctgaatcaggttcagatgttgatgatcttggatcccctatagcccctgaagatgttgaatatcatagtttggctccagtccgtgaggaagccagggaatcaggatcaacaacatatggctgttcagacgatcgacctctttcagtggataaagctgtcgagtccaacaaaagatataaccttgctggaaatgtattaaggcagtacaacacacgacaaaattcatcgatgaatagagtttctcctgagccaggtcgtgccccaaatgttcgtgaaggcgatgcagatgatgggattttgaaattattttcaagaaaagttcttgctgtaattctcaaagtactctctcttttgcgtttgttcactcgccatcagcaacagttggaaaatgttcatccgcatactgcagccgtaccgagtaatcaaccaaatcttcagatagtaaaggaagaccgagtaaatccttgtctggagcgtcttgaaagacttgagtcgatgtgtaatcaactcagcagaaagcctcctgagatcccacaggataaggatcgtgctatacaggattcttttgataggataaaatccattgaatttgatctggagaagacaaagaaggtattgcatgcaacagtgatcaaacaaatgcagatggctgaaacattggagtccgtgacggagtctggtcatagaagaaggaaattttgtacataataaactcacagcaatgtacattaacaagaaaaacagagatggcgacttcagtgtctgcttaccgacaggattaaacagcattgctttgtatatggctgctcagtctcacttctctttttggtcaatcaaaaagatgcgtgatgttaataagaagatagatagttggtgacctgagaaaaacggagcggatggtaaagaaagagcgtcctggaagataactgaatatagcgcggcttatatagaccaaaagaaagttaagaggaatccggacgcacagctcattttgtgtctgttttctgttttctctgcctctatgcgcctcctgatctgctgtatgcctgtatttgaatgtttctgcgcattttcattgtcagaacagttgaggctgggctctcataat

SEQ ID NO: 10068 - DNA, 2468 bp, Triticum aestivum
ggaggctccagtggctgtacatatagtttcggatcagtgatcatcagttctagaataggctgacccctgatcatttaggctgcatttgcggagaatgtcagagagcaatatcgacggcatagagatatctgtcagtaatgatgagaggagggacagagcggatgccgagaactcagaggacgagccaaagcacaggaggatgcgctcgctgaggaagaaggcgctgcacgcttcaaccaagctgacacattcgctgaagaagagggggaagaggaaagtggactgcagagtgcccagaataccgatagaggatgtcagggatgctggtgaagagcaggcggtcagctcgttccgtgaggttttgtttgccaggaacctattgcctgaaaggcatgatgattaccatatgatgcttagatttttgaaagctagaaagttcgatgttgaaaaggcagcacaaatgtgggatgagatgctccagtggaggaatgaatttgggacagacacaattttggaagattttgaatttcatgagctagaggaggtactgcaatattacccccagggttatcatggggttgacaaggatggaaggcctgtctatatcgagttgcttggaaaagttgaacccaataaacttgtgcaaaccacaacagtggaacgatatatcaagtaccatgtgcaagagtttgagagagcattccgtgagaagtttcctgcctgctcaattgctgctcaaaagcatatagatacaacaaccacaatattggatgtccatggcgtgggctggaagaactttggtaagattgcaagggatttagtgcgctgtatgcagaaaatagatggtgactattatcccgagacactacatcaaatgttcattgtaaatgctggagctggtttcaaactgatctggagcactataaagggacttcttgaccccaaaacatcatcaaaaattcatgttctaggagcaaaataccagagcaggcttcttgaagctattgacgcaagccaattaccagagttttttggtggtttgtgcacatgctctaaccaaggaggatgcctgaggtccaacaaaggcccttggagtgaccctttaattatgaagatcgtacatagcatggaatcatctgcattaagggatatcgtgcaagtatctgatatagaagaaacagttacaggctctgtaagattgcgtgcgctcaagttaccagaaagaattagtgatacatcaaatgctgaatcaggttcagatgttgatgatcttggatcccctgtagcccctgaagatgttgaatatcatagtttggctccagtccgtgaggaagccagggaatcaggatcaacgacatacggctgttcagacgatcgacctctttcagtggataaagctgttgagtccaataaaagatataaccttgctggaaatgtattaaggcagtacaacacacgacaaaattcatcgatgaatagagtttcgcctgagccaggtcgcgccccaaatgtccgtgaaggcgatgcagatgatgggattttgaaattattttcaagaaaagttcttgctgtaattctcaaagtactctctcttttgcgcttgttcactcgccatgagcaacagttggaaaatgttcatccacatactgcagccgtacccagtaatcaaccaaatcttcagatagttaaggaagaccgagtaaatccttgtctggagcgtcttgaaagacttgaatcgatgtgtaatcaactcagcagaaagcctcctgagatcccacaggataaggatcgtgctatacaggattcttttgataggataaaatccattgaatttgacctggagaagacaaagaaggtattgcatgcaacagtgatcaaacaaatgcagatggctgaaacattggagtcggtgacagagtctggtcatagaagaaggaaattttgtacgtaataaactcacagcaatgtacatgaacaagaaaaaaaaacagagatggcgacttcaatgactgctttccgacagaaactaaacagcattgctttgtatatggctgctcagtctcgcttctctttttggtcaatcaaaaagatgggtgatgttaataagaagagtagatagttggtgacccgagaaaaactgaggggatggtcaagaagagcgtcctggaagataactgaatatagcgcggcttatatacagcaaaggaaagttaaaagaggaatcccgacgcacagctcatgttctgtttatgttttctgttttctctgcctctatgcgcctcctgatctgctgtatgcctgtatttgaatgcttctgcacattttcattgtcagaacagttgaggctgggctctcgtaattaacaccattctttggttgatgacgtcatgcatataggggctatttggattgctgcccacagccgcccgtccaaaatattggtcgttgaccaggctggtgcggtcgtt

SEQ ID NO: 10069 - DNA, 2413 bp, Triticum aestivum
tttgcggagaatgtcagagagcaatatcgacggcatagagatatctgtcagtaatgacgagaggagggacagagccgatgccgagaactcagaggacgagccaaagcacaggaggatgcggtcgctgaggaagaaggcgctgcacgcttcaaccaagctgacacattcgctgaagaagagggggaagaggaaagtcgactgcagagtgccgagaataccgatagaggatgtcagggatgcgggtgaagagcaggcggtcagttcgttccgtgaggttttgtttgccaggaaccttttgcctgaaaggcatgatgattaccatatgatgcttagatttttgaaagctagaaagtttgatgtcgaaaaggcagcacaaatgtgggatgagatgctccagtggaggaatgaatttgggacagacacaattttggaagattttgaatttcatgagctagaggaggtactgcaatattatccccagggttatcatggggttgacaaggatggaaggcctgtctatatcgagttgcttggaaaagttgaacccaataaacttgtgcaaaccacaacagtggaacgatatatcaagtaccatgtgcaagagtttgagagagcattccgtgagaagtttcctgcctgctcaattgctgctcaaaagcatatagatacaacaaccacaatattggatgtccatggcgtgggctggaagaactttggtaagattgcaagggatttagtgcgctgtatgcagaaaatagatggtgactattatcccgagacactacatcaaatgttcattgtaaatgctggagctggtttcaaactgatctggagcactataaagggacttcttgaccccaaaacatcatcaaaaattcatgttctaggagcaaaataccagagcaggcttcttgaagctattgacgcaagccaattaccagagttttttggtggtttgtgcacatgctctaaccaaggaggatgtctgaggtccaacaaaggcccttggagtgaccctttaattatgaagatcgtacatagcatggaatcatctgcattaagggatattgtgcaagtatctgatatagaagaaacaattacaggctctgtaagattgcgtgcgctcaagttaccagaaagaattagtgatacatcaaatgctgaatcaggttcagatgttgatgatcttggatcccctgtagccccagaagatgttgaatatcatagtttggctccagtccgtgaggaagccagggaatcaggatcaacgacatacggctgttcagacgatcgacctctttcagtggataaagctgtcgagtccaataaaagatctaacgttgctggaaatgtattaaggcagtacaacacacggcaaaattcatcgatgaatagagtttcgcctgagccaggtcgcgccccaaatgtccgtgaaggcgatgcagatgatgggattttgaaattattttcaagaaaagttcttgctgtaattctcaaagtactctctcttttgcgcttgttcactcgccatcagcgacagttggaaaatgttcatccacatactgcagctgtacccagtaatcaaccaaatcttcagatagttaaggaagaccgagtaaatccttgtctggagcgtcttgaaagacttgaatcgatgtgtaatcaactcagcagaaagcctcctgagatcccacaggataaggatcgtgctatacaggattcttttgataggataaaatccattgaatttgacctggagaagacaaagaaggtattgcatgcaacagtgatcaaacaaatgcagatggctgaaacattggagtccgtgacagagtctggtcatagaagaaggaaattttgtacgtaataaactcacagcaatgtacatgaacaagaaaaaaaacagagatggcaactttgatgactgctttccgacagaaactaaacagcattgctttgtatatggctgctcagtctcgcttctctttttggtcaatcaaaaagatgggtgatgttaataaggatagatagttggtgaccggaggaaaactgaggggatggtcaagaagagcgtcctggaagataactgaatatagcgtggcttatatacagcaaaagaaagttaaaagatgaatcccgacgcacagctcatgttctgtttatgttttctgttttctctgcctctatgcgcctcctgatctgctgtatgcctgtatttgaatgcttatgcgcattttcattgtcagaacagttgaggctggggtctcataattaacaccattctttggttgaaggcgtccatgcatatactagttttaccccctactttcagagtaagcaataccacatactttctttcggtgagccactcatctgacctgttgctgcaacaaaccaaacaagcaggacatgg

SEQ ID NO: 10070 - DNA, 2720 bp, Brachypodium distachyon
ggagcactagcagcagcagcagcagtacggggaacaaagagtaggcggaaaaggaggaggccatggaagcgtaagcgccggggagattagatagagagacgcgcggatcaaacgcgacgcgcgcgccccactcgatttcccttcgcgtcgatcggaaaccctcgccgcctccccctcgattcctcccactctccctccccgtggggaggaggaggtcgagctcgtgatcctcccgcccgatccggatcgagccggagcaagcaggcgccacagatcccccccactccagtggcgagagtggaggctcgctactcaaggaaattcagtatcggaccagtgatcagttagagaatacgggtgtgagaagcctgacctgatcgtttgggctgcatttgtggagaatgtcagagagcaatattgatggcatagagatatcagtcagtaatgacgataggagggacagagcagatgccgagaactcagaggatgagccaaggcacaggaggatgcggtcactgaggaagaaggcgctgcacgcatcaacgaggctaacacattcgctgaagaagaggggaaagaggaaagtagactgcagagtgccgcacatagcgatagaagatgtcagggatgcagaggaggagcaggcagtcagctcgttccgggaggttttgtttgccaggaatctattgcccgagaggcatgatgattaccatatgatgcttagatttttgaaagctaggaagtttgactttgaaaaggcatcacaaatgtgggaagagatgctgcagtggaggaaggggtttggggcagacacgattttggaagattttcaatttcatgagctagaggaggtactgcaatattatcctcagggttatcatggggttgacaaggaaggaaggcctgtctatatcgagttgcttgggaaagttgagcccaataagcttctgcaaaccacaacaatggaacgatatcttcagtatcatgtacaagagtttgagagagcattccgtgagaagtttcctgcctgttcaattgctgctaaaaagcatgtagatacaacaaccacaatattggatgtccatggtgtgggctggaagaactttggcaaggttgcaagggatttggttcgctgtatgcaaaaaatagatggtgattattatcctgagacactacatcaaatgttcattgtaaatgctggaactggtttcaaactgatctggagcactgtgaagggacttcttgaccctaaaacatcatctaaaatccatgttctaggagcaaaattccaaagcagacttcttgaagctattgacgcaagccaattaccagagttttttggcggtttgtgcacgtgctctcaccagggaggatgcctgaggtccaacaaaggaccttggagtgatcctttaattatgaagattgtacatagcatggaatcatctgcactgagggaagttgtgcaagtatctgatatggaagaaacacttacaggctctgtaagattgcgtgcatgcaagttaccagaaagaattagtgatacatcaaatgctgaatcaggttcagatgttgatgatcttggatccccaatagcgcctgcagatattgaatatcatagtttggctccagtccgcgaggaagccagggaatcaggatcaacaacatgcgaccgttctgatgactggcctctttcggtggataaagctgttgagtccaataaaagatataaccttgctggaaatgtgttaaggcagtacaacacacgacaaaattcatcaacgaacagagtttcacctgagccaggtcccgccccgaacgaccgtgaaggcattgcagatgatgggattttgaaatatttttcaagaaaaattcttgctgtaattctgaaaatactctctcttttgcgctttttcacccgccgtcggcaacagttggaaaacgttcatccacatactcctactgtatccggcagtaatcaggcagatcttcaggtagttaaggaagaccgtgtaaatccgtgtcttgagcgtcttgaaagacttgagtcaatgtgtaatcaactcagcagaaaacctccagagatcccacaggacaaggatcgtgctatacaggattcttttgataggataaaatccattgaatttgatctggagaagacaaagaaggtattgcatgcaacagtgatcaaacaaatgcagatggctgagacattggaagctgtgaaggactctgatcttaggagaaggaaattttgtacataataaacttagcagcaatgtacaggaacaagaaaaaagagatgggacttaccaatgtctgctctcgaacagaagactgaacagcattgctctgtatatggttaccctgtctcgcatctctccttttggtttatcagagagatgagcgaagcttagtgttaataaaaaagatagatagttggtgacccaaggaaaactgaggggacggtcaagaatagcttcctggaagatgaacatagcccggcttatagagcaaaagaatttcaaagaggaactccaatacacacctaatgtcttgtctatgtgtctgatatgctcctttgagcctcctgacctgttgtatgcatgccatgctcttgtgcattttcttcagaacagttgaggcttgactcataattcacaccattctttggttagtaacttttagtatcttcaataacatgtaccagcttctccccttca

SEQ ID NO: 10071 - DNA, 3121 bp, Setaria italica
actagcggcggcaaggcaacaagtctaggggggagagagggaggagtagtaggcggaaacgaagcaacggaagcgtaagcgttaggagacgggcgccgagggaaggaggcaagcggaggccccgcgctccgatcacaccaaacgcttcgtgctgctgcccccgccgtgatcccagggcggcgggccgatctcaccgcggccgcggaggcgagctttttaggcgcgccaccgccgtccgacgccgcgatccagatccagcgtggggggttcgtgccactttatctgtatacacggaatcagtgatcgatcagagtaatacgaagagggagggcctgatcgtttgatctgctctagtagagaatgtcagagggaaatgtggatggcatcgagatagcaattagtaatgatgagaggagggacagagcagatgtcgagatctcagaggacgagccgaggcacacaaaaatacggttgctgaggaagaaagcgctgcatgcatcgacaaggctgacacactcgctgaagaagagggggaagaggaaagtggactgcagagtacaaaggatagcgatagaggatgtcagggatgctgaggaagagcaggcggtgagctcgtttcgggaggttttgtttgctaggggcttgttgccagtcaagcatgatgactaccatatgatgcttagatttttaaaagcaaggaagttcgaccttgagaaggcagcacagatgtgggcagacatgctgcactggagaaaggagttcgggacagacacaatttttgaagattttgaattccacgagctagaggaggtcctgcaatactatccccatggttatcatggggttgacaaggaaggaaggccagtatacattgagttgcttgggaaagtagaacccaacaagcttgtacaaattacatcagtggagcgctacattaagtatcatgtgcaagagttcgagagagctttccgtgagaaatttcctgcatgctcaattgctgccaaaaggcacatagataccacaactacaatattggatgtccatggcgtgggctggaagaattttagcaagattgcgagggatctggtgcgttgtatgcaaaaaatagatggtgactattatcctgagacactacaccaaatgtttattgtaaatgctggacctggtttcaagctgatctggagtactgtgaagggacttcttgaccccaagacatcatctaaaatccatgttctaggaacaaaatatcaaagcagacttcttgaagctattgatgcaagccaattacctgaatacttcggtggatcatgctcatgtcctaaccacggagggtgcctgaggtccaacaaaggcccctggagcgatccttcaatcatgaagcttgtacatagcatggagtcattgagggaaattgggcaagtatctgatatagaggaaacaattacaggctctgtcagattgcgtgctctcaagttaccagaacgaattagtgacacatcaaatgctgaatcaggttcagacattgacgatcttggatcccctgtggctcctgaagatgttgaatatcctagtttggcaccagttcgtgaggaagtgagggaatcaggatctacaacttacagtggttctgatggcacatctcatatggcggataaagttgtaggatccaaccaaagatacaacactgctggaaatgaagctagacagttcaatactgaacaacgttccttcgtaaatggggctttacctgcaccaggtcggcgtgtcccgaacaatggtgggggcaatgctgatgatgggatcttgaaacatttatcaagaaaagttgttgctgtatttcttaaagtactctctcttttgcggtttttcattcgtcggcgacaacacttggaaaacgttcatccgcatgctacaaccgtgccccgtaatcaggcagatcttcagattattagggaagatcgtgtgaatccttgccttgagcgtcttgatcgacttgagtcagtgtttaatcagctgagcagaaagcctccagagcttcctcaggacaaggatcaggccatacaagattcttttgacaggataaagtccattgagtttgatctggagaagacaaagaaggtattgcatgcaacagttatcaaacaaatgcagatggctgagaccttggaagctgtgaaggagtctgatcttaggaggaggaaattttgtacataatacacctaattgcaattgtacagaaacaagaaacaagttggttacttactaatatctgatacccgacagaatcaaaccacattgctttgtacatggctgccctggcctacagagatgagcaaatagcaatggcatcttagcctcaataacaacagatagttgtcgacctgtacactgaggagatggtcaaaaacagcatcctggaaaatgcccaaacaccgtccagttttatagagcaaaaggaattataaaagagcattgcacagcttatgccctcaccatgcttctgtatatgctcctttgagcgttggccctcctgatctgccatatgtattccaatgctcagtgcattttctcctctcatttttcggaacagttagtttcacttataattcaatccattttttggttgattacttaatacacctatcaaacttcatgattcaacttggtggtgttaaccgggatcaagtgagaacaagtttgaacttatttccgccatgcccaatggtcaagtttttgcaagtttgcatttatacaccgtcagcatatcgaggaatgatgctcatcagcatcatgagctgtctggcagtcgaagatgcatccactgagctgtcaaggagaccacagccagatgccagctgggaggcgtcatattctggcagaacagaagtcctgggcagcgaggacgaggatgggtgagccgtgagcatgcgagagcgcacatgtccgcgaggaaagggtggcggaaaggtccaactctgagcatttgaacctgtcgatgatgagagaatttgtgtaattttgactttgccctctgacccaggatgtaccagtgccccattgattgtgacacttccgtaagataaatgtttgcagctgcaaatcatccttgccttaactgccc

SEQ ID NO: 10072 - DNA, 2423 bp, Triticum aestivum
agagcaatatcgatggcatagagatatctgtcagtaatgacgagaggagggacagagcggatgccgagaactcagaggatgagccaaagcacaggaggatgcgatcgctgaggaagaaggcgctgcatgcttcaaccaagctgacacattcgctgaagaagagggggaagaggaaagtggactgcagagtgccgagaataccgatagaggatgtcagggatgctggtgaagaacaggcggtcagctcgttccgtgaggttttgtttgccaggaaccttttgcctgaaaggcatgatgattaccatatgatgcttagatttttgaaagctagaaagttcgacgttgaaaaggcagcacaaatgtgggatgagatgctccagtggaggaatgaatttgggacagacacaattttggaagattttgaatttcatgagctagaggaggtactgcaatattatccccagggttatcatggggttgacaaggatggaaggcctgtctatatcgagttgcttggaaaagtagaacccaataaacttgtgcaaaccacaacagtggaacgatatatcaagtaccatgtgcaagagtttgagagagcattccgtgagaagtttcctgcctgctcaattgctgctcaaaagcatatagatacaacaaccacaatattggatgtccatggcgtgggctggaagaactttggtaagattgcaagggatttagtgcgctgtatgcagaaaatagatggtgactattatcctgagacactacatcaaatgttcattgtaaatgctggagctggtttcaaactgatctggagcactataaagggacttcttgaccccaaaacatcatcaaaaattcatgttctaggagcaaaataccagagcaggcttcttgaagctattgacgcaagccaattaccagagttttttggtggtttgtgcacatgctctaaccagggaggatgcctgaggtccaacaaaggcccttggagtgaccctttaattatgaagatagtacatagcatggaatcatctgcattaagggatatcgtgcaagtatctgatatagaagaaacaattacaggctctgtaagattgcgtgcgctcaagttaccagaaagaattagtgatacatcaaatgctgaatcaggttcagatgttgatgatcttggatcccctgtagcccctgaagatgttgaatatcatagtttggctccagtccgtgaggaagccagggaatcaggatcaacaatatacggctgttcagacgatcgacctctttcagtggataaagctgttgagtccaataaaagatataaccttactggaaatgtattaaggcagtacaacacacgacaaaattcatcgatgaatagagttttgcctgagccaggtcgtgccccaaatgtccgtgaaggcgatgcagatgatgggattttgaaattattttcaagaaaagttcttgctgtaattctcaaagtactctctcttttgcgcttgttcactcgccatcagcaacacttggaaaatgttcatccgcatactgcagccgtacccagtaatcaaccaaatcttcagatagttaaggaagaccgagtaaatccttgtttggagcgtcttgaaagacttgagtcgatgtgtaatcaactcagcagaaagcctcctgagatcccacaggataaggatcgtgctatacaggattcttttgataggataaaatccattgaatttgacctggagaagacaaagaaggtattgcatgcaacagtgatcaaacaaatgcagatggctgaaacattggagtccgtgacagagtctggtcatcatagaagaaggaaattttgtacttaataaactcacagcaatgtacatgaacaagaaaaaaaaacagagatggcgactttgatgactgctttccgacagaaactaaacagcattgctttgtatatggctgctcagtctcgcttctctttttggtcaatcaaaaagatgggtgatgttaataagaaggatagatagttggtgaccggaggaaaactgaggggatggtcaagaagagcgccctggaagataactgaatatagcgaagataactgaatatagcgcggcttatatacagcaaaagaaagttgaaagatgaatcccgacgcacagctcatgttctttgtatgttttctgttttctctgcctctatgcgcctcctgatctgctgtatgcctgtatttgaatgcttatgcgcattttcattgtcagaacagttgaggctggggtctcataattaacaccattctttggttgatggcgtccatgcatatactagttttaccccctactttcagagtaagcaataccacatactttcttttcgtgacgccactcatctgacctgttgctgcaacaaaccaaacaagcaggacatgg

SEQ ID NO: 10073 - DNA, 2369 bp, Avena sativa
cagcagctagatatgtggtggcgtggctccctcttcctcgaagcacctctccgtcggcacatacctcgcagtttcggtgctatcggtgttacgatggacctgctattttgaaccctacaggcaaaatttcggacggacgtcaagtggagcaaacggaagcacaaatcaccataccacatccaacggatctaagtgggtgcacagtggccaccgcgggcagcaaatccgcgtctatatatatagagagagactgactgcctgatcagttgtagaatagggagtgcgaagcctgaaccctgatcgtttgggctgcatttggggagaatgtcagagagcaatattgatggcatagagatatcggtcagcaatgacgagaggagggacagagcggatgccgagaactcagaggatgagccaaagcaccggagaatgcggtcgctgaggaaaaaggcactgcacgcgtcgacgaagctgacacattctctgaagaagagggggaagaggaaagtggactgcagagtgcccagaatagcgatagaggatgtcagagatgcagaggaagagcaggccgtcagctcgttccgggaggttttgtttgctaggagcctgttgcccgagcggcatgatgattaccatatgatgcttagatttttgaaagctaggaagtttgacttcgaaaaggcagcacaaatgtgggatgagatgctgcaatggaggaatgagtttggcacggatactattttggaagattttgaatttcatgagctagaggaggtgctgcagtattatccccagggttatcatggggttgacaaggatggaaggcctgtctatatcgagttgcttgggaaagttgaacccaataagcttgtgcaaaccacaacagtggaacggtacattaagtaccatgtacaagagtttgagagagcattccgtgagaagtttcctgcctgctcaattgctgctaaaaagcacatagatacaacaaccacaatattggatgtccatggtgtgggttggaagaactttggtaagattgcaagggatttagtgcgttttatgcagaaaatagatggtgattattatcccgagacactacatcaaatgttcattgtaaatgctggagctggtttcaaactgatctggagcactattaagggacttcttgaccccaaaacatcatctaaaattcatgttctaggaacaaaataccaaagcaggctccttgaagctattgacgcgagccaattaccagatttttttggtggtttgtgtacgtgctctaaccagggaggatgcctgaggtccaacaaaggcccttggagtgatcctttaactatgaagattgtacatagcatggaatcatctgcattaagggaaattgcgcaaatatctgatatagaagaaacaattacaggctctgtaagattgcgtgcactcaagttgccagaaagaattagtgatacatcaaatgccgaatcaagttcagatgttgatgatcttggatccccgacagcccctgaagatgttgaatatcatagtttggctccagtccgtgaggaagccagggaatcaggatcaacaacatacagccgttctgatgaccggtctctttcggtggataaagctgttgattccaataaaagatataaccttactggaaatgtactgaggcagtacaatacacgacaaaattcattgatgaatagaatttcacccgagccaggccgcgtcccgaatgaccatgaaggcgatgcaggcgaaggaattttgaaattattttcaagaaaagttcttgctgtaattctgaaagtactctctctttttcgttttttcattcgccgtcggcaacagttggaaaatgttcatccgcatactgccaatgtacccagtaatcaagaaaatcttcagatagttaatgaagaccgagtaaatccttgtctggagcgtcttgaaagactcgaatcgatgtgtaatcaactcagcagaaagcctccggagatcccacaggataaggatcgtgctatacaggattcttttgataggataaaatccattgaatatgatcttgaaaagacaaagaaggtattgcatgcaacagtgatcaaacaaatgcagatggctgagacattggagtctgtgaaggagcctgatcataggagaaggaaattttgtacataataaacttacagcaatgtacatgaacaagagaaatagagatggcggcttcagtgtctgctttccgacagagaattaatcagcattgcattgtatatggttatctcgcttttcttttttggtcaatataaaagatgagcgatggttactgtgaataaggatagatagctggtgacccgagaaaaacagag

SEQ ID NO: 10074 - DNA, 3470 bp, Panicum virgatum
ttcagatcgtgctaattagttagactgtgtaattaattattttttaactgtatttaatactttatgtatgtgttatactacaaatcttagcatttctcacatcgtcttctcaaaaccgacacgtgggtcccacgctcagtgcccgcggtgaccctgcacgtgagcgtcggcgcacgctggctgcgaaagcagtcacgcaacgcgggcgcggcgagcggagcgagcgagtcaatcggccccctcccggcgtaggagtacacggcagcgccgctgacgccgggccctggagcaacaagaaccgggaaaaagaacgccgccgcccagtacccgagcactagcggcaaggcagcccgtactcctagggagggaggagtaggcggaaacgaagcaacggaagcgtaagcgttaggagacgggcgccgagggaagggaggcaagcggaggccccgctccgatcacaccaaacgcttcgttcgtgctgctgtccccgcctcctctcgtcgtgatcccgggcggcgggtcggtctcgccgcggccgcggaggctacctttttttttttttggcgcgccaccgccatccgacgccgcgatccagatccagtgtggcggttcgttccactgtatctgtatacacggaatcagtgatcgggcagagtaatacgaggagggagggcctgaccatttgagctgcttttgtagagaatgtcagaggggaatgcggatggcatcgagatattaatctgtaatgatgagaggagggacagagcagatgccgagatatcagaggacgagccgaggcacacgaaaatgagggcgctgaggaaaaaagcgctgcatgcatcaacaaggctgacacactcgctgaagaagagggggaagaggaaagtggactgcagagtaccaaggatagcgatagaggatgtcagggatgctgaggaagagcaggcggtgagctcgtttcgggaaattttatttgctaggagcttgttgccagtcaagcatgacgattaccatatgatgctcagatttttaaaagcgaggaagtttgactttgagaaggcagcacagatgtgggcagacatgctgcagtggagaaaggagtttgggacagacgcaatttttgaagattttgaatttcacgagctagaggaggtcctgcaatactatccccatggttatcatggggttgacaaggaaggaaggcctgtatatattgagttgcttgggaaagtagaacccaacaagcttgtacaaattacatcagtggagcgatacattaaataccatgtgcaagagtttgagagagctttccgcgagaaatttcctgcatgcttaattgctgccaaaaggcacatagacaccacaactacaatattggatgtccatggcgtgggctggaagaattttagcaagattgcgagggatctggtgcgttgcatgcaaaaaatagatggtgactattatcctgagacactgcatcaaatgtttatcgtaaatgctggacctggtttcaagctgatatggagcactgtgaaggggcttcttgaccccaagacatcatctaaaatacatgttctaggaacaaaatatcaaagcagacttcttgaagctattgatgcgagccaattgccggaatactttggtggatcgtgtgcatgtcctaaccacggagggtgcctgaggtccaacaaaggcccctggagcgatccttcaatcatgaagcttgtacatggcatggagtcattgagggaaattgggcaagtatctgatatagaagaaacaattacagggtctgtaagattgcgtgctctcaagttaccagaacgaattagtgacacatcaaatgctgaatcaggttcagatgtcgacgatattggatcccctgtggctcctgaagatgttgaatatcctagtttggcgccagttcatgaagaagcgagggaatcaggatctacgacttacagtggttctgatggcacatctcatatggcggataaagtagtaagatccaagcaaagatacaatgctgctggaaatgaagctagacagtttgatacagaacaaaattccttagtaaatggggctttgcctgtgccaggttggcatgccctgaacgatggtgttggcaatgctgatgatggggtcttgaaacatttatcaagaacagtcattgctgtatttgttaaagtactctctattttgcgttttttcattcctcggcgacaacacttggaaaatgtccgtccacatactgcaactgtgcccagtaatcaggcagatcttcagatgattagggaagatcgtgtgaacccttgtctggagcgtcttgagcgacttgagtcagtgtttaatcagctcagcagaaagcctccagagcttccacaggataaggatcgggccatacaagattcttttgacaggataaagtccattgagtttgatctggagaagacaaagaaggtattgcatgcaacggttatcaaacaaatgcagatggctgagactttggaagctgtgaaggagtctgatcttaggaggaggaaattttgtacatagtacacctaattgtaatgtacagaaacaagaaaacaagttggcgacttactaatgtctgatacccgacagaatcaaacaacattgctttgtacatggctgccctggtctacagagatgagcagatagcgatggcatcttagcctcaataacaaaagatagttgtcgacctgtacactgaggaaatagtcaaaaacagcatcctggaaagtgcccaggcaccgtccagtttcactcataattcaatccattttttggttgattactccatacatctatcacactttcatacatctgggtcaggtctttgcaagtttgcatttatacaccgtcagatctcgaggaatgatgttcgtccggatcatgagctgtctggcagtcaaagatgcatcggactgagctgtcaagtagacaacagcccgacagccggattccagaagggagacgccggattctggcagaagtggagacctgggcagcgaggacgaggatggggtgagccgtgagcgcgcgagagcgcacatgtccgtgaggaaatggtcgcgggaaggggtccaaccacgaagcatccgaatctgtaaatgatgtgagaatttgtgtaattttgtcttgccctctgacccagggtgttaaccattgattggcacgctgacgtaagtttaatgcttctcaattgcaaattatcctgcctcgccttgctcagtttttactgaggaaaagagcttttactatattatatgctccctggctgaccggttactgcatcaatctagagtaatctgctcgactcgatgtgaggtttacagtttacaccttcaccacttccgctgacttcttcagctatctgtcccatcaggaacctgccgtatacgaaatacagtactccatccgtttcaaattataagtcattctaagaa

SEQ ID NO: 10075 - DNA, 2441 bp, Zea mays
gcgctgctctttcttacccgagccgtgagccgagagcgcggcgatccagaagatccagtgttcgggctgccgtatgcaatgaatcagtgatcgggcagagtaacgcaaagagggagggcctgatcatttgagctgcttttgttgacaatgtcagagggtaatatatggataacatcgaaatatctgtcagtaatgatgagaggaggaataggacagatgccgatatctcggaggacgagccgaggcacaccaggatgcggtcgctgaggaagaaagccctgcatgcatcgtcaaggctgacacactcgctgaagaagagagggaagagaaaagtggactgcagagtgccaagaatagctatagaggatgtcagggatgctgaagaagagcaggctgtgagctcgtttcgggaggttttgtttgctaggggcttgttaccaatcaagcatgatggttaccatatgatgcttagatttttgaaagcgaggaagttcgattttggaaaagctgcacagatgtgggcagacatgctgcggtggagaaaggagtttggtacagacacaatttttgaagattttgaatttcatgagctagaggaggtcctgcagtattaccctcatggttaccatggggttgacaaggaaggaaggcctgtgtacattgagttgcttgggaaagttgaacccaacaaacttatgcaaattacgacagttgagcgctatattaagtatcatgtacaagagtttgagagagttttccgggagaaattccctgcatgctcaatttctgccaaaaggcatatagatactacaactacgatattggatgtccacggtgtgggctggaagaactttagcaagatcgcgagggatttggtgcgttgtatgcaaaaaatagatggtgactattatcctgagacattacatcaaatgtttattgtaaatgctggacctggtttcaagctgatatggagcactgttaagggacttcttgacccaaaaacgtcatctaaaatacacgttctaggaacaagatatcaaagcagacttcttgaagctattgatgcaagccaattgccggattactttggtggttcatgcacatgttctaaccatggagggtgcctgaggtctaacaaaggtccctggagtgatccttcaataatgaagcttgtacatagcatggaattgttgaaggaagttgcgcacatatctgatatagaagaaacaattacaggctctgtgagattgcgtgctctcaagttacccgaacaaattagtgacacatcaaatgctgaatcaggctcagatgttgatgaccttggatcccctgtggctcctgaagatgttgaatatcctagtttggccccagttcgagaggaagtgagggaatcatggtctacaacgtacagtggttcgattggcatgtctcgtatggcggataaagttgtaggatccaacaggagatacaactctactggaaatgaaattaggcagttcaatacagaacaagattccctgacaaatgggggtttacctgcaccaggttggcgtgcccaaaatgatggtgaaggcaatgatgatgggttcttgaaatatatatcaagaagagtcattgctatatttcttaaagtactctcttttttgcggttcttcattcgtcgacgacaacacttggccaatgatcatccacatactgcaagtgcacccagtaatctggcagatcttcagacaattaaggaagatcgtgtaaatccttgcctggaacggcttgataggcttgagttaatgtttaatcagctgagcagaaagcctccagagcttccacaggataaggatcgggccatacaagattcttttgacaggataaagtccattgagtttgatctggagaagacaaagaaggtattgcatgcaacagttatcaaacaaatgcagatggcagaaaccttggaagcagtaacggagcctgatcttaggcggaggaaattttgtacataatacacttacctgcaatgtacagaaacaaaagggctatttactaacgtctgctgcctgacagaattgaactagatcgcttggtacttgtacatggcccgatggccgccctttgcgattatctttctcactattctcagtctactatagagatgagtgccatggcatggtagcctcaataacaacagatatagtttacttgtgataaactgaagagatagtcatgaacagcgtcctggaaaatcaccagatactgcccaatctgaatctatagagctaagggaattctgtctgtgttatgctcctctaagtgctgagcctcctgatctgatgtatgtatctcaatgctccgtgcgttttcttttccttcttttttcagaacatttagtttcacccggaattcaatcgatttttttggttggtggatactgtatgaacatctga

SEQ ID NO: 10076 - DNA, 886 bp, Cirsium arvense
ctccctccattcccatttccattcactccatcatcaatcatcatcatctacccattccaactaacaaaacacaaattgtgtgcttatatcttctagggtttcttttttctttaattcacatagagagagatggttggaccagcagataggccgcagatcgtattatttggatcatcaatcgttcagctcagtttcagcaacgatggttggggcgccattctcgccgatgtctacgctcgtaaggcggatatagtattgcgaggatactatggctggaattctagacgtgctatcaaggtcctcgatcaagtttttccaaaggattccgctaatcagccatcgctggtcatcgtttactttggcggtaacgattcaatgggacctcactcctcaggtcttggtccccatgtccctctccctgaatacgtcgaaaacatgagaaaaattgcaactcatctccagggcctttcggagacaacccgtataatttttctcagttgcccaccggtggatgaagtcagagttcgtgaaaacacaagctcaatttttagtgaacttgttcgaacaaatgagttatgccgaatgtattcagaagcttgcgtagagttgtgcaacgagatgggagtgaaagttattgatctttggactgcatttcagaaacgagatgattggatgactgcctgctttacggatggggtgcatttatctggtgagggtagcaagatagttgttgcagagatactaaaagtgctgaaagaagcggaatggaagccgagcctacactggaagtcgatgcccacggagttttcggaagactcgccctacgacttagtctattcagacggaaaaactacgctaaacccgtcggattggaccttccacagag

SEQ ID NO: 10077 - DNA, 1043 bp, Carthamus tinctorius
cggggaagaagaagaaaagaagtaatgtagttatgaaagaaaaatggaaataaaaaagtgtagacatttgaatttgaattaaagagggttgttagaagttgctaaatgcaagcagaaaagaagaccaattgaagaagagaaaatcaatcaatcatataaatctccctccattcccccccttctctgaaaccccatcatcatcatcatcatcatcatcatcatctacccttccaactaacaaaacataaattgcctacttccatctatcttctagggtttcttttccttctttttaacatggttggaccagcagataggccgcagatcgtattgtttggatcatcaatcgttcagcttagtttcagcaacgatggttggggcgccattctcgccgatgtctacgctcgtaaggcggatatagtattgcgaggatactatggctggaattccagacgtgctatcaaggtcctcgatcaaatttttccaaaggattccgctaatcagccatcgctggtcattgtttactttggcggaaacgattcaatgggacctcactcctcaggtcttggtccccatgtccctcttcctgaatatgttgaaaacatgagaaaaattgcaactcatctccagggcctttcagagacaacccgtatcatttttctcagttgcccaccggttgatgaagtcagagttcgtgaaaacacaagctcaatttttagtgaacttgttcgaacaaatgagttatgccgaatgtattcagaagcttgcgtagagttgtgcaatgagatgggagtgaaagttattgatctctggactgcatttcagaaacgagatgattggacgactgcatgctttacggatggggtgcatttatcaggtgagggcagcaagatagttgttgcagagatactaaaagtgctgaaagaagcggaatggaagccgagcctacactggaagtcgatgcccacggagttctccgaagactcgccctacgacttagtctattcagacggaaaaacacgctaaacccgtcggattggacc

SEQ ID NO: 10078 - DNA, 810 bp, Taraxacum officinale
ctcggcggggagatctcatcccaattacgtgagcaaccagctcttcagctgccggaatctctcaaaattagggcttttacggagagatgatcggaccagggagaccgcagattgtattattcggatcatcaattgttcagctcagcttcagcaatgatggttggggcgccattctcgccgacgtctacgctcgcaaggcggatatagtactgcgaggatactatggctggaattccagacgtgctatcaaagttctcgatcaagtttttccaaaggatgctgcaaatcacccttcactgatcattgtttactttggtggtaatgattcaatgggaccccactcatctggtttaggcccccacgttcctcttcctgaatacattgaaaacatgagaaaaatcataactcatctcaagagcctttcagacacaacacggttaattttccttagctgtccaccagtagacgaagtcaaactcagtgaaacagcaagctcattttttagcgaacttgtgagaacaaatgaattatgccggatttattcagaagcttgtgtggatttatgcaatgaaacgggagtaaaagttattgatctttggaccgcgtttcagaaacgagatgattggaaaaccgcgtgtttcacggatggagtgcatttatcaggtgagggaagtaagatagttgttgaagagattataaaagtgcttaaagagtctgaatggaagccaagtctattttggaaaaatatgcctacagagttttcagaagactcgccttatgacttagtctattcagacggaaaaaccactt

SEQ ID NO: 10079 - DNA, 927 bp, Leymus cinereus x Leymus triticoides
ccgcccccgtcccttccacaggcaagcaagtggtagaggttcagacatggcagctccgagagcattcgtcctcggcgtcctgctggcgatcgccgtcgccaacgccgaggcggcatccgtggtcgtcggcctggccaagtgcgccgactgcaccaggaagaacatgaaggccgaggaagccttcaaaggtctccaggtcgcgatcaagtgcaagaacgtccacggcgagtacgagagcaaggcggtgggcggcctcgacggcaccggcgccttcagcgtgcccctcgccgctgacctccacggcgccgactgcgtcgcgcagctccacagcgccgcctccaacgcgccgtgctctggccaggagccatctaagatcgtgccggtgtccgagggaaccaccttcggtgttgtcgccggcgccaagacgaacgctgtggcatccccagagtgcgcgtccgcaaccctgtgcgggccgatcaagaagcacatcatcgagcacttccaccacaagcagcccgtgccgccgaagccggagccgaagccccagccccacccggactaccaccccgtgcccaagccggagcccaagccgcagccccatccggactaccaccctgtccctcccacgcccacctacggcggcggcggcggcggtggataccacggacaccactgactccgacctgccaccctcccgcccagcagtgaaatggcttgttgcagtcagtgagtgagtgacgttgctatttatatgtgcacgggttcgcttggtcttctatcattcagaataacagttgcgagggataagtatgtgtcaggcaaatgtacgggtgatggaccattttttacaaggtttgtaatatcggtgtgaatttttgtaatgagaagttcctatatctgaatcaaccaagtacactcaaaaaaaaa

SEQ ID NO: 10080 - DNA, 727 bp, Pseudoroegneria spicata
cgattcagaggttcaggcatggcagctccgagagcactcgtcctcgccgtcctgctggcgatcgccgtcgccaacgccgaggcggcgtccgtggtcgtcggcctggccaagtgcgccgactgcaccaggaagaacatcaaggccgaggaagccttcaaaggtcttcaggttgcgatcaagtgcaagaacgtccacggcgagtacgagagcaaggcggtgggcggcctcgacggcaccggcgccttcagcgtgcccctggccgccgacctccacggcgccgactgcgtcgcgcagctccacagcgccgcctccaacgcgccatgctccggccaggagccatctaagatcgtgccagtgtcccagggcaccaccttcggtgtggtcgccggcgccaagacggacgtggcggcatcgccacagtgcgcgtccgcgaccctgtgcgggccgatcaagaagcacatcatcgagcacttccaccacaagcagcccgtgccgccgaagccggagcccaagccccagccccaccctgactacggccccgtgcccaagccggagcccaagccgcagccccaccccgactaccaccccgtccctcccacgcctacctacggcggcggcggcggcggcggtggataccacggacaccactgactccgatctaccactctcccacccagcactgaaatccccatggtttcatgctctgagtgacgttgctatttatgat

SEQ ID NO: 10081 - DNA, 1019 bp, Triticum aestivum
agcaaagtggtagtgcgactcagaggttcaggcatggcagctccgagagcatcactcgtcctcgccctcctgctggcgatcgccgttgccaatgctgaggcggcgtcggtcgtcgtcggcctggccaagtgcaccgactgcaccaggaagaacatcaaggccgaggaagccttcaagggtcttcaggtggcgatcaagtgcaagaacgtcaacggcgagtacgagagcaaggcggtgggtgcccttgacggcaccggcgctttcagcgtgcccgtggccgccgacctccacagcgccgactgcgtcgcacagctccacagcgccgcctccaacgcaccgtgctccggccaggagccatcaaagatcgtgccggtgtctgagggcaccaccttcggggtcgttgccggcgccaagacgaacgcgctggcatcgccagagtgcgcgtcggcgaccctgtgcgggccaatcaagaagcacatcatcgagcacttccaccacaagaagcccgtgccaccgaagccggagcccaagccccagccccacccggactacgggcccgtgcccaagcccgagccgaagccgcagccccacccggactaccaccccgtccctcccacgcccagctacggcggcggtggtggcggtggataccacggacaccactgagtccggtctaccaccctcccgccaagcgatgaaattggtaaagttcctctgtatcttagccatggcttgttgctgttagtgagtgagcgacgttgctatttatgtcacgggttagctttatcttctacgtatcattcagaataacagttgtgagggataagtatgtgtgtaaggcaaatgtacgtgtgatggttcagtttttttacaaggtttgtaatatcgatctgtgtgaatttttgtaatgagaagttcctcactggtagaaaaagggcctgttgtctcggttctggaaccgggactaaagggtcgttactaaaacctccctctttagtcccggttcttacacaattttt

SEQ ID NO: 10082 - DNA, 941 bp, Triticum aestivum
atccatccatcagccacttcacacaggcaagcaagtggtagaggttcagacatggcagctccgagagcactcgtcctcgccgtcctgctggcggtcgccgttgccaacgccgaggcggtgtccgtcgtcgtcggcctggccaagtgcgctgactgcaccatgaagaacatcaaggccgaggaagccttcaagggtcttcaggtggcgatcaagtgcaagaacaacgctggtgactacgagagcaaggcggtgggtgccctcgacggcaccggtgccttcagcgtgcccctcgccgccgacctccacggcgccgactgcgttgcacagctccacagcgccgcctccaacgcgccatgctcgggccaggagccatccaagatcgtaccggtgtctgagggcaccaccttcggtgtcgtcgccggcgccaagacagacacggtggcatcgccagagtgcgcgtccgcaaccctgtgcgggccgatcaagaagcacatcatcgagcacttccatcacaagaagcccgtgccgcccaagccggagcccaagccccagccccacccggactatggccccgtgcccaagcccgaacccaagccgaagccccacccggactatcaccccgtccctcccacgcccacttacggcggcggcggtggcggtggcggtggataccacggacaccactgactccgatctgccaccctcccgcccagcactgagatggcttgttgctgtcagtgagtgaatgaggttgctatttatatgtgcacgggttagcttggtcttctatcattcagaataacagttctgagggataagtacgggtgtcaggcaaatgtatgggtcatgggccattttttcccaaggtttgtaataccggtgtgaattttggtaatgaaaagttactcgatcattatatcttgatcaatcaagtacattca

SEQ ID NO: 10083 - DNA, 963 bp, Secale cereale
gatcgagcagccacttcacaccagcttgtggcagtagtgcgattcagaggttcaggcatggcggctccgacgagagcactcgtcctctgcgtcctgctggcgatcgccgtcgccaacgccgaggcggcgtccgtcgtcgtcggcatggccaagtgcgccgactgcaccaggaagaacatgaaggccgaggaagccttcaagggtcttcaggtggccatcaagtgcaagaacaacgccggagattacgagagcaaggcggtgggcggcctcgacggcaccggcgccttcagcgtgcccctggctgccgacctccacggcgccgactgcgtcgcgcagctccacagcgccgcctccaacgcgccgtgccccggccaggagccgtccaagattgtgccggtgtccgagggcaccaccttcggcgtcgtcgctggcgagaacaccgccacgccgtcctcggcgtcgccggagtgtgcgtccatgaccctgtgcgggccgattaagaagcacatcatggagcacttccaccacaagaagcccgtgccgcccaagccggagcccaagcctcagccccacccggactacggccccgtgcccaagcccgagcccaagccgcagccccacccggactaccaccccgtgcctcccacgcccacctacggcggtggcggcggcggcggtggataccacggacaccactgactcagagtctcagaccagtcagtgagtgatcgacgttgctatttatgatccgtttgaatgcgtgggtgtattgtttggtgttctgccattcgctgccccgttttagtatttgcactacagaattgagagttcagaataacagtcacgtactacgggtgtatcaggcgagtgctgtttgctttatcaagattttgtaatttcagtgtgtgtttttggtataagaagttattatgaatcaagtaattccaacagtcgatttgtaac

SEQ ID NO: 10084 - DNA, 959 bp, Triticum aestivum
agctccaagagcactcgtcctcggcttcctgctggtgatcgccatcgccaacgccgaggcggcgtccatcgtcgtcggcctggccaagtgcgccgactgcaccaggaagaacatcaaggcagaggaagcctttaagggtcttcaggtggcgatcaagtgcaagaacgtcaacggcgagtacgagagcaaggcagtaggtacccttgacggcaccggcgctttcagcgtgcccgtggccgccgacctccacagcgccgactgcgtcgcgcagctccacagcgccgcctccaacgcaccgtgctccggccaggagccatcaaagatcgtgccggtgtctgagggcaccaccttcggggtcgttgccggcgccaagacgaacgtgctggcatcgccagagtgtgcgtcggcgaccctgtgcgggccgatcaagaagcacatcatcgagcacttccatcacaagaagcccgtgccgcccaagccggagcccaagccccagccccaccctgactaccaccccgtgcccaagccggagcccaagccgcagccccacccggactaccaccccgtccctcccacgcccacctacggcggcggcagcggcggcggtggataccatggacaccactgactccgatctgccaccgtccggcctagcagtgaaatttcatggcttgttgctgtcagtgagtgagcgacgttgctatttatgtcacgggttagcttgatcttctatcattcagaataacagttgtgagggataagtatgtgtgtcaggcaaatgtacgggtaatgggtcagtttttttttacaaggtttgtaatatcggtgtgaatttttgtaatgagaggttcctatatactccatccgtttcaaattactcgtcgcaaaaatggatgtatctagaactaaaatacatttagatacatccatacctgtgacaagtaattcggaacggaggg

SEQ ID NO: 10085 - DNA, 930 bp, Secale cereale
cagggaagtagtggagttcgattcaggggttcaggcatggcaactccgagagcactcgtcctcggcgtcctcctggtgatcgccgtctccaacgctgaggcggcgtccgtcgtcgtcggcctggccaagtgcgccgactgcaccaggaagaacatcaaggccgaggaagctttcaaaggtcttcaagtggcaatcaagtgcaagaatgtccacggcgactacgagagcaaggcagtgggtgccctcgaccgcaccggcgccttcagcgtgccccttgcttccgacctccatggcgccgcctgtgtcgctcagctccacagcgccgcctccaacgcgccttgctctggccaggagccatcaaagattgtgcccgtgtctgagggcaccaccttcggcatcgtcgccggtgaccacaccgccacaccgtccgtggcgtcgccggagtgcgcatccatgaccctgtgcgggcccatcaagaagcacatcatcgagcacttccaccacaagaagccggtgccgcccaagccggagcccaagcctcagccccacccggactacggccccgtgcccaagcccgagcccaagccgcagccccacccggactaccaccccgtccctcccacgcccacctacggcggcggcggcggataccacggacaccactgagtccggtcaaccaccatcctgcccagcgatgaaatctcatcagcgggttggtgatcagtgagtggtcgacattggtatttatgatccgtttgcatgcgtgggtgtattgtttggtgttctgccattcgctgccccggttttgtatctgcactgcccagttgtggggtcagtgtgtattttgctttttaaaagatttgtaatttcggtgtgtgctttgtatagaagtttatgttggattcaagtatttaacaagtccatttgaag

SEQ ID NO: 10086 - DNA, 1012 bp, Triticum aestivum
ttcaggcatggcagctccgagagcacttgtcctcgccgtcctgctggcgatcgccgtcgccaacgcggaggcagcgtcagtcgtcgtcggcctggccaagtgcgccgactgcaccaggaagaacatcaaggctgaggaagccttcaagggtctccaggtggcgatcaaatgcaagaacatcgacggcgagtacgagagcaaggcggtgggtgccctcgacggcaccggcgccttcagcgtgcccctcgccgccgatctccatggcgccgactgcgtcgcacagctccacagcgccgcctccaacgcaccgtgctccggccagaagccatccaagatcgtgccggtgtccgagggcaccacctttggtgtcgtggccggcgccaagacggacacggtggcatcgccagagtgcgcgtccgcgaccctatgcggaccaatcaagaagcacatcatcgagcacttccaccacaagaagctcgtgccacccaagccggagcccaagccccagccccaccctgagtacggccccgtgcccaagccggagcccaagccgcagccccacccagactaccaccccgtccctcccacgcctacctacggcggcggcgggggataccacggacaccactgactccgatataccatcatcgggcacaacagtgaaatttcatgccttgttgttatcagggagtgagtgacgttgctatttatgtgcgcgggttagcttggtcttattatacccctgcgtcctaaaattcttatcttagattcgtctagatgcagatgtatctaatactaaaacgtgatttgatacatccgtatttagacaaatttaaaacaagaattttgggacgaaggaagtatcatattcagaataacagttgtgagggataagtatgtgtgtcaggcaaatgtacaggtgatgggtcagtttttacaaggtttgtaatattgaatttttgtaatgagaagttcctatatctgaatcaaacacgtacactcaattttcccc

SEQ ID NO: 10087 - DNA, 845 bp, Triticum aestivum
aagcaagcaagtggtagaggttcaggcatggcagctccgagagcgctcgtcctcgccgtcctgctggcgctcgccgtcgccaacgccgaggcggcgtccgtcgtcgtcggcctggccaagtgcgccgactgcaccaggaagaacctcaaggccgaggaggccttcaagggtctccaggtggcgatcaagtgcaagaacgtccacggcgactacgagagcaaggccgtgggtgccctcgacggcaccggtgccttcagcgttcccctggccgccgacctccacggcgccgactgcgtcgctcagctccacagcgccgcctccaacgcgccgtgccccggccaggagccatccaagatcgtgcctgtttctgagggcaccaccttcggcgtcgtcgccggcgacagcattgccacgccgtctgcagcgtcgccggagtgcgcgtccatgaccttgtgcgggccgatcaagaagcacatcatcgagcatttccaccacaagcagcccgtgccgcccaagccggagcccaagccccagccccaccctgactatcaccccgtgcccaagccggagcccaagccgcagccccatccggactaccaccccgtccctcccacgcccacctacggcggcggcggcggtggataccacggacaccactagtgactccgatctaccaccatccggcacagcaatgaagtgacgctgctatttatatatgtgcacgggttagcttggtcttctatcattcagaataacagttgtgagggataagtatgcgtgtcaggtaaatgtacgggtgtttgtaataccgatgtgattttttgtaatgagaagttcctatatct

SEQ ID NO: 10088 - DNA, 1151 bp, Triticum aestivum
agccacttcacacaggcaagcgagtggtaagggttcaggcatggcagctccgagagcgctcgtcctcgccgtcctgctggcgatcgccgtcgccaacgccgaggcagcgtccgtggtcgtcggcctggtcaagtgcgccgactgcacaaggaagaacatgaaggccgaggaagccttcaaaggtctccaggtagcagtcaagtgcaagaacgtccatggcgactacgagagcaaggcactgggtgccctcgacggcaccggggccttccgcatgcccctcgccgctgacctccacggcgccgactgcgtcgcacagctccacagtgcagcctccaacgcgccgtgtcctggccaggagccatccaagatcgtgccggtttccgagggcaccaccttcggtatcgtcgccggcgacagcattgccacgccgtctgcagcgtcgccggagtgcgcatccatgaccctgtgcgggccaatcaagaagcacatcatcgagcacttccaccacaagaagcccgtgccaccgaagccggagcccaagccccagccccacccggactacggccccgtgcccaagcccgagccaaagccgcagccccacccggactaccaccccatccctcccacgcccacctacggcggcggaggtggcggcggataccacggacaccactgagtctggtctaccaccgtcgtcctgcccagcgatgaaatctcatcaacgggttcaaagtcagtgagtgattgacgttgctatttatgatcggtttgcatgcgtgggtggattgtttggtgttgtgccattcgctgccccgttttagtatctgcaccgcagagttgagagttcagaataacagttgtgaggaacacatggatcactgtgtattttgctttttaaagatttgcaatttcggtgtgtgttttgtatacgaagttgtggatcaagtaatttaatcaagtccatttgagccaatggaattaccgcagatgttggcttttttggcttgatcttgttctactgtgtgctgcgtgcgtttagttcatgttttgcctaatgttataggcttgcttttacctttattttcttttaagtttttggttcatgtaataactgtgtggtggttttttaatggaaaaatgctacatcgacg

SEQ ID NO: 10089 - DNA, 899 bp, Secale cereale
agcaagcagcccattcagacatggcggctgcaacgagagcactggtcctcgccgtgcttctcacgatcgccgtcgccaataccgaggctgcgtcggtcgtggtcggcctggccaagtgcgccgattgcaccaggaagaacatgaaggccgaggaggccttcaagggtcttcaggtggcgatcaagtgcaagaacagcgccggtgactacgagagcaaggcggtgggaggcctcgacggcaccggcgccttcagcgtgcccctggccgccgacctccacggcgccgactgtgtcgcacagctccacagcgctgcctccaacatgccgtgccccggccaggagccatccaagatcgtgccggtgtccgagggcaccacctacggcatcgtcgcaggcgaaaacagagccacaccgtccgcggcgtcgccggagtgcgcgtccatgaccctgtgcgggccgatcaagaagcacatcatcgagcacttccaccacaagaagcctgtaccgcccaagccggagcccaagccccagccccacccggactacggccccgtgcccaagcccgagcccaagccgcagccgcatccggactaccaccccgtgcctcccacgcccacctacggcggcggtggtggcggtggataccacggacaccactgagtcccatctcccatctaccacaccatcctgcccagcgatgaaatctcatccccgagattcatggtcagtgggtgatcgacgttgctatttatcatcagttgcatgcgttggtatcgtttggtgttctgccattcgctgcctcgtttttgtatctgcactacgaggaacgtgtattgcttttttaagatttgtattttcggcgtgtgttttgtaagaaaattaccgtgaatcaagtaattt

SEQ ID NO: 10090 - DNA, 1265 bp, Hordeum vulgare
tgtctccgccggccacccttgttcgcttgcagccagatcagatcatcgacgagctgtaccgtatcgctcaatgcggatgcctatataagccatgcttggccagttccatccattaaccaatccatcgagcttctagctacttcacaggcaagcagtagagttcgatccacaggttcaggcatggcggctccgacgagagcactggtcctcgccgtccttctggcgatcgccgtcgccaacgccgaggcggcgtccgtcgtcgtcggtctggccaagtgcgccgactgcaccaggaagaacatgaaggccgaggaagctttcaaaggtcttcaggtggcgatcaagtgcaagaacgtccacggcgagtacgagagcaaggcggtgggcggcctcgacggcaccggcgccttcagcgtgcccctcgccgctgacctccacggcgccgactgcgtcgcgcagctccacagcgccgcctccaacgcgccgtgccccggccaggagccatccaagatcgtgccggtgtctgagggcaccaccttcggcatcgtcgccggtgacaacaccgccacgccgtccgcggcgtcgccggagtgcgcgtccatgaccctgtgcgggcccatcaagaagcacatcatggagcacttccaccacaagaagcccgtgccgccgaagccggagcccaagcccgagccccaccctgactacggccccgtgcccaagcccgagcccaagccgcagccccacccggactaccaccccgtccctcccacgcccacctacggcagtggcggcggcggcggcggcggtggataccacggacaccactgagtccgatcaaccaccttcccgctcagcactgaatcggcatggtttcgtgctgtcggtgactgattgagtgaccgctatttatgattatcgcatcgcatgcatggttggtttggttttcttcagtatctgcggacgagttcacaataagatcgagttatgaggcgaccagatgtatcagtgtgtcagtcaagtgttttctttttctccaaaaaggggagacccggcctctgcatcatcatgatgcacagtcaagcgtacgggcgataagttgttcgtaatatctgtgtgattttgtaaccaaagtttttataaatcaagtactccgtacatctttgtactaaagatgcatcaattaacatggattgaagggagtaatataattcagtccaaaagtaattcattttttctttcatatatacaaagcgagtttccgtcac

SEQ ID NO: 10091 - DNA, 950 bp, Secale cereale
tcagcagccacttcacacagccaggcaagtggtagtgcgattcagaggttcaggcatggcagctccgacgagagcactggtcctcgccgtcctgctggcgatcgccgtcgccaatgccgaggcggcgtccgtcgtggtcggcctggccaagtgcgccgactgcaccaggaagaacatcaaggccgaggaagccttcaaggggctccaggtggcgatcaagtgcaagaacatcgacggcgactacgagagcaaggccgtgggtgccctcgacggcaccggcgccttcagcgtgcccctggcagctgacctccacggctccgactgcgtcgcccagctccacagcgccgcctccaacgcgccgtgcgccggccaggagccatccaagatcgtgccggtgtccgagggcactaccttcggcgtcgtcgccggcgccaacaccgccacgccgtccatggcgtcaccggagtgcgcgtccatgactctgtgtgggccggatcaagaagcacatcatggagcacttccaccacaagaagcccgtcgccacccaagcccggagcccaagccccacgccccaccctgactacggccccgtgcccaagccggagcccaaaccgcagccccacccggactaccaccccgtcccgcccacgccgacctacggcggtggcggcggcggataccacggacaccactgagtctggtctgccaccgtcctgcccggtggtcagtgagtgattgacgttgctatttatgatctgtttgcatgcgtgggtgcattgtttggtgttctgccattcgctgccccgttttagtgtctgcactatagagttgagagttcagaataacatttgtgaggaacgtctattgctttttatttgtaaagatttgtaatttcggtgtgtgttttgtataagaaagttactgtgaatcaagtaatttaatccaaagtc

SEQ ID NO: 10092 - DNA, 972 bp, Pseudoroegneria spicata
gctgctagcctgctacttcacacaaagaaagtatagtagagttcgattcagaggttcaggcatggcagctccgacgagagcactggtcctcgccgtccttctggcgatcgccgtcgccaacgccgaggcggggtccgtcgtcgtcggcctggccaagtgcgccgactgcaccaggaagaacatgaaggccgaggaagctttcaaaggtcttcaggtggcgatcaagtgcaagaacgtccacggcgactacgagagcaaggccgtgggtgccctcgacggcaccggcgccttcagcgtgcccctcgccgccgacctccatggcgccgactgcgtcgcgcagctccacagcgccgcctccaacgcgccgtgctccggccaggagccatcaaagatcgtgccggtgtctgagggcaccaccttcggcatcgtcgccggtgacaacaccgccacaccgtccgcggcgtcgccggagtgctcgtccatgactctgtgcggaccgatcaagaagcacatcatcgagcacttccaccacaagaagcccgtgccaccgaagccggagcccaagccccagccccaccctgactacggccccgtgcccaagccgcagccccacccgaactaccaccccgtccctcccacgcccacctacggcggcggtggcggcggcggcggataccacggacaccactgattccgacctgccaccctcccgccgagcactgaaatccccatggtttcgtgctgtcggtgagtgagtgaccgctatttatgattatcgcatcgcatgcatggttggtttggttttcttcaatatctgcggaactcagagttcacaataacagagttatatcagtgtgtgtcactcaagtgtaagtgtgattttgtatttctttaccggtgtttgtaatatcagtgtgattttgtaaccaaagttattataaatcaagtaatataatatggtccaaaagtact

SEQ ID NO: 10093 - DNA, 994 bp, Pseudoroegneria spicata
atcgaccagccacttcacaccagcaaggtggcagtagtgcgatccagaggttcaggcatggcggctccgagagcactcgtcctctgcgtcctgctggcgatcgccgtcgccaacgccgaggcggcgtccgtggtcgtcggcctggccaagtgcgccgactgcaccaggaagaacatcaaggccgaggaagccttcaaggctctgcaggtggcgatcaagtgcaggaacagcgccggcgagtacgagagcaaggcggtgggcggcctcgacggcaccggcgccttcagcgtgcccctcgccgccgacctccacggcgccgactgcgtcgcgcagctccacagcgccgcctccaacgcgccgtgccccggccaggagccgtccaagatcgtgccggtgtcggagggcaccaccttcggcgtcgtcgctggcgacaacatcgccacgccgtccgcggcgtcgccggagtgcgcgtccatgaccctgtgcgggccgatcaagaagcacatcatcgagcacttccaccacaagcagcccgtgccgccgaagccggagcccaagccccagccccacccggactacggccccgtgcccaagcccgagccgaagccgcagccccacccggactaccaccccgtccctcccacgcccacctacggcggcggcggcggcggcggataccacggacaccactgagtccggtctaccaccgtcctgcccagcgatgaaatctcatcaccgggttcctgatcactagtgatcgacgttgctatttatcatcagttgcatgcttgggtattgcttggtcttctgccattcgctgccgcgttttagtatctgcactgcagagttgagagttcagaataacagctgcgcgtgtgtgtcactgtgtcaggcgagtgtgagggtgtgttgctttatcaagattctgtaatttcggtgtgttttcttgtacaagaggtttttgtgaatcaagtaatttaatcaagtcgatttg

SEQ ID NO: 10094 - DNA, 972 bp, Secale cereale
acttcacacaccagaaagtggcagtagtgcgatccagaggttcaggcatggcagctccgagagcactcgccctctgcgtcctgctggcgatcgccgtcgccaacgctgaggcggcgtccgtggtcgtcggcatggccaagtgcgccgactgcaccaggaagaacatgaaggccgaggaagccttcaaggctctgcaggtggcgatcaagtgcaagaacagcgccggcgagtacgagagcaaggcggtgggcggcctcgacggcacgggcgccttcagcgtgcccctggcctccgacctccacggcgccgactgcgtcgcgcagctccacagcgccgcctccaacgcgccttgccccggccaggagccatccaagatcgtgccggcgtccgagggcaccaccttcggcgtcgtcgccggcgacaacattgccacgccgtctacagcgtcaccggagtgcgcgtcaatgaccctgtgcgggccgatcaagaagcacatcatggagcactttcaccacaagaagcccgtgccacccaagccggagcccaagccccagccacaccctgactacggccctgtgcccaagcccgagccgaagccgcagccccacccagactaccaccccgtccctcccacgcccacctacggcggcggtggtggcggtggataccacggacaccactgagtctggtctaccaccgtcctgcccagctatgaaatctcatcccccagattcatggtcagtgagtgatcgacgtcgttgctatttatgatccatttgcatgtgtggggtgtattgtttggtgttctgccattggctgccccgtttgtgcgtgtgtgtgtcaggcgagtgtgagggtgtgagcgtgttgctttatcaatattttgtagtttcggtgtgtttcctcgtacaagaggttcttatgaatcaagtaagttaatcaagtcaatttgtcaaccgaattaccgtatcc

SEQ ID NO: 10095 - DNA, 1079 bp, Secale cereale
tcagatccatcgagcagccacttcacacaccagaaagtggcagtagtgcgatccagaggttcaggcatggcggctccgagagcactcgccctctgcgtcctgctggcgatcgccgtcgccaacgccgaggcggcgtccgtggtcgtcggcatggccaagtgcgccgactgcaccaggaagaacatgaaggccgagcaagccttcaaggctctgcaggtggcgatcaagtgcaagaacagcgccggcgagtacgagagcaaggcggtgggcggcctcgacggcacgggcgccttcagcgtgcccctggcctccgacctccacggcgccgactgcgtcgcgcagctccacagcgccgcctccaacgtgccatgccccggccaggagccatccaagatcgtgccggtgtccgagggcaccaccttcggcgtcgtcgccggcgacaacattgccacgccgtatgcagcgtcaccggagtgcgcgtcaatgaccctgtgcgggccgatcaagaagcacatcatggagcactttcaccacaagaagcccgtgccacccaagccggagcccaagccccagccacaccctgactacggccctgtgcccaagcccgagccgaagccgcagccccacccggactaccaccccgtccctcccacgcccacctacggcggcggtggtggcggtggataccacggacaccactgagtctggtctaccaccgtcctgcccagctatgaaatctcatcccccagattcatcattcatggtcagtgagtgatcgacgtcgttgctatttatgatccgtttgcatgtgtgggtgtattgtttggtgttctgccattggctgccccgtttgtgcgtgtgtgtgtgtcaggcgagtgtgagggtgtgagcgtgttgctttatcaatattttgtagtttcggtgtgtttcctcgtacaagaggtttttatgaatcaagtaagttaatacaagtactaatttgtcaaccgaattaccgtacgccattcgagacgttgacatgataaaagaaatagtgatttatttatttctactacaaggaaaaaactagagactgaccg

SEQ ID NO: 10096 - DNA, 958 bp, Triticum aestivum
agccacttcacaccagaaattcaggcatggcagctccgacgagagcactagtcctcggcgtcctgctggcgattgccgttgccaatgccgaggccgcgtccgtggtcgtcggcctggtcaagtgcgccgactgcacgaggaagaacatgaaggccgaggaagccttcaaaggtctccaggtggcagtcgagtgcaagaacgtccacggcgactatgagagcaaggcagtgggcgccctcgaccgcaccggcgccttcagcgtgcccctcaccgcagacctccacggcaccaactgcgtcgctcagctccacagcgccgcctccaacgcgccgtgccccggccaggagccatccaagatcgtgccggtttccgagggcaccacctttggcatcgtcgccggcgacagcattgccactccgtctgcagcgtcgcgggagtgcacgtccatgaccctgtgcgggccgatcaaaaagcacatcatcgagcacttccaccacaagaagcccgtgccgcccaagccggaacccaagccccagcctcacccggactacggccccgtgcccaagcccgagccgaagccgcagccccacccggactaccatcccgtccctcccacgcgcacctacggtggtggcggtggcggtggataccacggacaccactgagtccagtataccaccgtcccgcctagcgatgaaatctcatgagcgggttggtgataactgagtcatcgacattgctatttatgatccttttgcatgtgtgggtgtattgtttggtcttctgccattcgctgccccgttttagtatctgcactgcagagttgagtgttcagaataacagttgtgaggaacacagggatcatagtgtattttgcattttaaagatttgtaatttgggtgtgtttttttaacgaagttgttgcagatcaagtaattaatttaatcaagtccatttg

SEQ ID NO: 10097 - DNA, 957 bp, Secale cereale
aactcaagcaagcagcccattcagacatggcggctgcaacgagagcactggtcctcgccgtgcttctcacgatcgccgtcgccaatgccgaggctgcgccggtcgtggtcggcctggccaagtgcgccgattgcaccaggaagaacatgaaggccgaggaggccttcaagggtcttcaggtggcgatcaagtgcaagaacagcgccggtgactacgagagcaaggcggtgggaggcctcgacggcaccggcgccttcagcgtgcccctggccgccgacctccacggcgccgactgtgtcgcacagctccacagcgctgcctccaacatgccgtgccccggccaggagccatccaagatcatgccggtgtccgagggcaccacctacggcatcgtcgctggcgaaaacagagccacaccgtccgcggcgtcgccggagtgcgcgtccatgaccctgtgcgggccgatcaagaagcacatcatcgagcacttccaccacaagaagcctgtaccgcccaagccggagaccaagccccagccccacccggactacggccccgtgcccaagcccgagcccaagccgcagccccatccggactaccaccccgtgcctcccacgcccacctacggcggcggtggtggcggtggataccacggacaccactgagtcccatctcccatctaccacaccatcctgcccagagatgaaatctcatcctcgagattcatggtcagtgagtgatcgacgtagctatttatcttattttatcatcagttgcaagtgttggtatcgtttggtgttctgccattcgctgccccgttttagtatctgcactgtagagttgagagttcaggttcagaataacatttgggaggaacctgtattgtttttttaagatttgtaatttcggcgtgtgtttgtaagaagttactgtgaatcaagtaattaatcaagtcca

SEQ ID NO: 10098 - DNA, 982 bp, Pseudoroegneria spicata
atccatccatcagccacttcacaccagaaattcaggcatggcagctccgagagcacttgtcctcgccgtcctgctggcggtcgccgttgccaacgccgaggcagcgtccgtcgtcgtcggcctggccaactgcgccgactgcgccaggaagaacatgaaggccgaggaagccttcaaaggtctccaggtggcagtcaagtgcaagaacgtccacggcgactacgagagcaagggggtgggcggcctcgacggcaccggcgccttcagtgtgcccctcgccgctgacctccacggcgccgactgcgtcgcgcagctccacagcgccgcctccaacgcgccgtgccccggccaggagccatcaaagattgtgccagtttccgagggcaccaccttcggcatcgtcgccggcgacaacattgccacgccgtctgcatcgtcgcccgagtgcgcgtcaatgaccctgtgcgggccgatcaagaagcacatcatcgagcacttccaccacaagaagcccgtgccaccgaagccggagcccaagccccagccccaccctgactacggccccgtgcccaagcccgagccgaagccgcagccccacccggactaccaccccgtccctcccacgcccacctacggcggcggcggcggtggataccacggacaccactgagtcgggtctaccaccgtccttcccagcgatggaatctcatcgccggtttggtgatcagtgagtgatcgacgttgctatttatgatccgtttgcgtgcgtgggtgtattgtttggtgttctgccattcgctgccccattttagtatctccactgcagagttgagagttcagaataacagttgtgaggaacacatggatcagtgtgtattttgctttttgacgatttgtaatttcggtgtgtgttttgtatacgaagttgttgtggatcaagtaatttaatcaagtccatttgagtcaatggaattactgcaaa

SEQ ID NO: 10099 - DNA, 954 bp, Secale cereale
agccacttcacacaccagaaagtggcagtagtgcgatccagaggttcaggcatggcggctccgagagcactcgccctctgcgtcctgctggcgatcgccgtcgccaatgctgaggcggcgtccgtggtcgtcggcatggccaagtgcgccgactgcaccaggaagaacatgaaggccgaggaatccttcaaggctctgcaggtggcgatcaagtgcaagaacagcgccggcgagtacgagagcaaggcggtgggcggcctcgacggcacgggcgccttcagcgtgcccctggcctccgacctccacggcgccgactgcgtcgcgcagctccacagcgccgcctccaacgcgccttgccccggccaggagccatccaagatcgtgccggcgtccgagggcaccaccttcggcgtcgtcgccggcgacaacattgccacgccgtctgcagcgtcaccggagtgcgcgtcaatgaccctgtgcgggccgatcaagaagcacatcatggagcactttcaccacaagaagcccgtgccacccaagccggagcccaagccccagccacaccctgactacggccctgtgcccaagcccgagccgaagccgcagccccacccggactaccaccccgtccctcccacgcccacctacggcggcggtggtggcggtggataccacggacaccactgagtcttgtctaccaccgtcctgcccagcgatgaaatctcatccccgagattcatggtcagtgagtgatcgacgtcgacacgtcgttgctatttatgatccgtttgcatgtgtggggtgtattgtttggtgttctgccattggctgcgtgtgtgtgtcaggcgattgtgagggtgtgagcgtgttgctttatcaatattttgtagtttcggtgtgtttcctcgtacaagaggtttttatgaatcaagtaagttaatcaagtcaatttgt

SEQ ID NO: 10100 - DNA, 901 bp, Triticum aestivum
aaaaatccttccaacacaggcaagcaagtggtagaggttcagacatggcagctccgagagcactcgtcctcgccgtcatgctggcggttgctgttgccaacgccgaggcggcgtccgtcgtcgtcggactggcctgcgctgattgcaccaggaagaacatcaagaccgagaaagccttcaagggtctccatgtggcgatcaagtgcaagaacgtcgacggcgagtacgagagcaaggcggtaggtgcccttgacggcagcggcgccttcagcgtgcccctggccgccgacctccacggcgccgactgcgtcgcgcagctccacaacgccgcctccaacgcgccgtgctccggccaggagccatccaagatcgtgccggtgtccgagggcaccaccttcggtgtcatcgccggtgccaagacgaacgcgctggcatcaccagagtgcgcgtccacgaccctgtgcgggccgatcaagaagcacatcatcgagcacttccatcacaagaagcccgtgccgcccaagccggagcccaagccccagcgccaccctgactaccaccctgtgcccaagcccgagcccaagccgcatccccacccggactaccacccggtccctcccacgcccacctacggcggtggtggtggcggtggataccacggacaccactgactccgatctgccaccgtccgacacaacagtgaaatttcatggcttgttgctgtcagtgagtgagcgacgttgctatttatgtcacgggttagcttgatcttctatcattcagaataacagttgtgagggataagtatgtgtgtcaggcaaatgtacgggtgatgggtcagtttttttacaagctttgtaatatcggtgtgattttttgtaatgagaagttcctatatctg

SEQ ID NO: 10101 - DNA, 1096 bp, Hordeum vulgare
cattaaccaatccatcgagcttctagctacttcacaggcaagcagtagagttcgatccacaggttcaggcatggcggctccgacgagagcactggtcctcgccgtgcttctggcgatggccgtcgccaacgccgaggcggcgtccgtcgtcgtaggtctggccaagtgtgccgactgcaccaggaagaacatgaaggccgaggaagctttcaaaggtcttcaggtggcgatcaagtgcaagaacgtccacggcgagtacgagagcaaggcggtgggcggcctcgacggcaccggcgccttcagtgtgcccctcgcttctgacctccatggcgccgactgcgtcgcgcagcttcacagcgccgcctccaacgcgccgtgcgctggccaggagccatcaaagatcatgccgatgtctgagggtaccaccttcggcatcgtcgccggtgaccacaccgccacaccgtctgcggcgtcgccggagtgcgcgtccatgaccctgtgcgggccgatcaagaagcacatcatggagcacttccaccacaagaagcccgtgccgccgaagccggagcccaagccagagccccaccctgactacggccccgtgcccaagccggagcccaagccgcagccccacccggactaccaccccgtccctcccacgcccacttacggcagtggcggcggcggcggcggcggtggataccacggacaccactgagtccgatcaaccaccttcccgctcagcactgaatcggcatggtttcgtgctgtcggtgactgattgagtgaccgctatttatgattatcgcatcgcatgcatggttggtttggttttcttcagtatctgcggacgagttcacaataagatcgagttatgaggcgaccagatgtatcagtgtgtcagtcaagtgttttctttttctccaaaaaggggagacccggcctctgcatcatcatgatgcacagtcaagcgtacgggcgataagttgttcgtaatatctgtgtgattttgtaaccaaagtttttataaatcaagtactccgtacatctttgtactaaagatgcatcaattaacatggattgaagggagtaatat

SEQ ID NO: 10102 - DNA, 1061 bp, Triticum aestivum
ggcaagtagtggggttcgattcagaggttcagtcatggcagctccgacgagagggctcgtcctcgccgtccttctggcgatcgccgtcgccaacgccgaggcggcgtccgtcgtcgtcggcctggccaagtgcaccgactgcaccaggaagaacatgaaggccgaggaagctttcaaaggtcttgaggtggcgatcaagtgcaagaacgtccacggtgactacgagagcaaggccgtgggtgccatcgacggcaccggcgccttcagcgtgcccctcgcttctgacctccatggcgccgactgcgtcgctcagctccacagcgccgcctccaacgtgccgtgcgccggccaggagccgtcaaagatcgtgccggtgtctgagagcaccaccttcggcatcatcgccggtgacaacaccgccacactgtccgaggcatcgccagagtgcgcgtccatgaaattgtgcggaccgatcaaaaagcacatcatcgaacacttccaccacaagaagcccgtgccaccgaagccggagcccaagccccagcctcacccggaccatggccccgtgcccaagccggagcccaagccgcagccccaccccgactaccaccccgtccctcccacgcccacctacggcggcagcggcggcggcggtggataccacggacaccactgactccgatctgccaccctcccacccagcactgaaatccccacggttgtttcgtactcggagtgacgttgctatttatgatcgccgcatgcacggttggtttagccttttatcattccctatcctgttttccagtatctgcagaatgagttcagaataactgttatgagggccaggggtcagtgtgtcagacatgtgtgtgggtgttggtgtttctttaccaaggtttgtaatatctgtatcattttttgtaagatgaagttattatgtatgaatcaagctatatataatcaaatccgcgcaaagcatactcatttcccacccttttctattttccgtcaagagttcaagacacaatattatgaggaacactgtgcattcttttctt

SEQ ID NO: 10103 - DNA, 1874 bp, Triticum aestivum
cttcacacaagcaaacaagtggtagaggttcaggcatggcagctccgagagcgctcgtcctcgccgtcctgctcgtgattgccatcgccaacgcggaggcgacgtcggtggtcatcggcctggccaagtgcgccgactgcaccaggaagaacatgaaggccgaggaagccttcaagggtctacaggtggcgatcaagtgcaagaacgtcgacggcgagtacgagagcaaggcggtgggttccctcgacggcaccggcgccttcagcgtgcccctcgcttctgacctccatggcgccgactgcgtggctcagctccacagcgccgcatccaacgcgtcgtgccccggccaggagccatccaagatcgtgccggtgtccgagggcaccaccttcggtgtcatcgccggcgccaacaccgccacgccatccgtggcgtcgcccgagtgtgcgtccatgaccctgtgcgggccgatcaagaagcacatcatcgagcacttccaccacaagaagccggtgccaccgaaaccggagcccaagccccagcctcacccggaataccaccccgtgcccaagccggagccgaagccgcagccccacccagactaccaccccgtccctcccatgcccacctacggcggcggcggtggcggtggataccacggacaccactgactccagtgatccagtctaccacccacccgcccagcactgaagtccccatggtttcgtgctctgagtgacgttgctatttatgatcgccgcatgcacagttggtttggccttttattattccctaccccgttttccagtatttgcagaatgagttcagaataactattatgagggtcagtgtgtcagacaagtgtgtgggtgttgttggaatcttgtcatgaaagatcaattcgccggccttcctagtgaagatgccgctactcatctaaatagcttcgttgatttgtgtgatatgcaaaagaagaaagatgttgacaatgatattgttaaattgaagctatttcctttttcgcttagagatcgtgctaaagcttggttttcgtctttgcctaaaaatagtattgattcatggaataagtgcaaagatgcttttatctctaagtattttcctcccgctaagatcatctctcttagaaacgatattatgaattttaagcaacttgatcatgaacatgttgcacaagcttgggagaggatgaaattaatgatacgtaattgccctacacatggtttgaatttgtggatgattatacaaaatttttatgccggattgaattttgcttctagaaatcttttagattcggccgcgggaggcacttttatggaaatcactttaggagatgctactaaactcctagataatattatggttaattattctcaatggcacactgaaagatctactaataaaaaagtgcatgcgatagaagaaattaatgttttgagtggaaagatggatgaacttatgaaattatttgctactaagagtgtttcttctgatcctaatgatatgcctttgtctactttgattgagaataacaatgaatctatggatgtgaattttgttggtaggaataattttggtaacaacgcttatagagggaattttaatcctaggccatatcctagtaatccttctaataattatgggaattcctacaacaactcttatggaaattataataagatgccctctgaatttgagaatagtgttaaagaatttatgaattcacaaaagaattttaatgctttgcttgaagagaaattgcttaaagttgatgatttggctaggaacgttgatagaatttctcttgatgttgattctttgaaacttagatctattccacctaagcatgatatcaa

SEQ ID NO: 10104 - DNA, 1270 bp, Triticum aestivum
caagagcgctcgtcctcggcgtcctgctggcgatcacggtcgccaacgccgaggcggcgtccgtcgtggtcggcctggccaagtgcgccgactgcaccaggaagaacatcaaggccgaggaagccttcaagggtcttcaggtggcgatcaagtgcaagaacaacgccggagactacgagagcaaggccgtgggtgcgcttgacggtaccggtgccttcagcgtgcccctcgccgccgacctccacggcgccgactgtgtcgcacagctgcacagcgccgcctccaacgcgccatgccccggccaggagccatccaagatcgtgccggtgtcggagggcactaccttcggcatcgtcgccggcaacaacattgccacgccgtctgctgcatcgtcgccggagtgcgcatccatgaccctgtgcgggccgatcaagaagcacatcatcgaacacttccaccacaagaagcctgtgccacccaagccggagcccaagccggagccccaccctgactacggccccgtgcccaagccggagcccaagccgcagccccaccccgactaccaccccgtccctcccacgcctacatacggtggcggcggtggtggataccacggtcatcactgactccgatctgccaccatccggcccagcactgaaatctcatcaccgagtgcatgatcagtgtcagtgagtgaccgacgttactatttatcatcagttgcatgcatggccgcgtgggtattctttggtggtcttcggccattcgatgccccgttttagtatctgcactgcagagttgagagtgagagttcagaataacatttgtgaggaacatgtgtattttttttaaccgggctttttaccccttttcattgcaaagaacggaaatacaaccagttcaaacgagaaggtcagggggagggaaagaagtaaagcgagttctagcactaccaggaaacccaccatactcgctcgccatcgaaacgagtatcatggggcgaaaacctggatagcacgacataacatctatcctattacaatctcaaaagctcaggatcaagtatcagaacacaactgcaaagtcaagtaaacagatggtaatcttcgccgagatagaacagcatcgaggttgcgcgcccgtcttcctttcaagcgccctggattggttgcttgacagcgccacacatcttcatcagctgcatcgtgccagtcctgatcatctcggctccagaacgaagatctttggcgtcctctccttgttgtagccc

SEQ ID NO: 10105 - DNA, 899 bp, Triticum aestivum
atcgagctgctagctacttacttcacacaggcaagtagtggagttcgattcaggggttcaggcatggtggctccgagagcactcgtcctcgccgtcctgctggcgatcgccgtcgccaacgccgaggcggcgtcggtcgtcgtcggcctggccaagtgcgccgactgcaccaggaagaacctcaaggccgaggaggccttcaagggtctccaggtggcgatcaagtgcaagaacgtccacggcgagtacgagagcaaggcggtgggcggcctcgacggcaccggtgccttcagcgttcccctggcggccgacctccacgacgctgactgcgtcgctcagctccacagcgccgcctccaacgcgccgtgctccggccaggagccatccaagatcgtgcctgcttccgagggaaccaccttcggcatcgtcgccggcgacagcattgccacgcggtctgcagcgtcgccagagtgcgcgtccatgaccttgtgcgggccgatcaagaagcacatcatcgagcatttccaccacaagcagcccgtgccgcccaagccggagcccaagccccagccccatcctgactatcaccccgtgcccaagccgcagccccacccggactaccaccccgtccctcccacgcccacctacggcggcggcggcggcggtggtggataccatggacaccactagtgactccgatctaccaccatccggcctagcagtgaaatttcatggcttgttgctgtcagtgagcgacgttgctatttatgtcaggggttagcttgatcttctatcattcagaataagagttgtgagggataagtatgtgtgtcaggcaaatgtacgggtgatggtcagtttttttacaaggtttgtaatatcggtgtgattttttgtaa

SEQ ID NO: 10106 - DNA, 1040 bp, Secale cereale
cacacacgcaggtagtggagttcgattcaggggttcaggcatggcagctctgagagcactcgtcctcggcgtcctgctggtgatcgccgtctccaacgccgaggcggcgtccgtagtcgtcggcctggcaaggtgcgccgactgcaccaggaagaacatcaaggctgaggaagccttcaaggatcttcaggtggcgatcaagtgcaagaacgttcacggtgactacgagagcaacgccgtgggcgggctcgacggcaccggcgccttcagcgtgcccctggccgccgacctccacggcgccgactgcgtcgcgcagctccacagcgccacctccaacgcgccgtgccctggccaggagccgtccaagatcgtgccggtgtctgagggcaccacctaccgcatcatcgctggcgacaacaccgccacgccgtccgcggcgtcgccggagtgcgcgtccatgactctgtgcgggccgatcaagaagcacatcatggaacacttccaccacaagaagcccgtgccgcccaagccggagcccaagccccacgccccaccctcgactacggccccgtgcccaagccggagcccaagccgcagcccaccccgagtaccaccccgtccctcccacgcctacatacggtggtggtggtggcggcggcggtggataccatggtcaccactgactccaatctgccactgtccggcccagcactgaaatctcattaccgagttgattgtcagtgagtgatcgacgttgctatttatcatcagtttttttttacgggtgagctatttatcatcagttgcatacgtggccgtgtgggttttctttggtggtcttctgccattcgctgccccgactgcagagttgagagttcagaataacatttgtgagaaatgtgtattgcttttttaagatttgtaatttcggtgtgtgttctgtacagtaagttactgtgaatcaagtaattcaatcaagtccatttgagtcgatggaattactgaagccgttcgagtgaatggatgattgggtatgggta

SEQ ID NO: 10107 - DNA, 1001 bp, Leymus cinereus x Leymus triticoides
atcagccacttcccaccagcaagtggcagcagtgcgatccagaggttcaggcatggcagctccgagagcactcgtcctctgcgtcctcctggcgatcgccgtcgccaacgccgaggcggcgtccgtcgtcgtcggcctggccaagtgcgccgactgcaccagcaagaacatcaaggccgaggaagccttcaaggctctgcaggtggcgatcaagtgcaagaacagcgccggcgagtacgagagcaaggcgatgggcggcctcgatggcaccggcgccttcagcgtgcccctggccgccgacctccacggcgccgactgcatcgcgcagctccacagcgccgcctccaacgcgccgtgccctggccaggtgccatccaagatcgtgccgttgtccgaaggcaccacctacggcatcgtcgctggcgacaacaccgccacgccgtccgcggcgtcgccggagtgcgcgtccgtgaccctgtgcgggccgatcaagaagcacatcatcgagcacttccaccacaagaagcccgtgccacccaagccggagcccaagccccagccccacccggactacggccccgtgcccaaacccgagccgaaaccgcagccccacccggactaccaccccgtccctcccacacccacctacggcggcggcggcggcggtggataccacggacaccactgagtccgatcaaccaccgtccagcccagcactgaaatctcatcactgggttcgtggtaagcgagtgctcgacgttgctatttatcatcagttgcatgagtgggtgtattgtttggtgttctgccattcgctgccccgttttagtatctgcactgcagagttgagagttcagaataacagctgtgcgcgtgtgtgtcacagtgtcaggcgagtgtgagggtgtggttggtgtgttgctttgtcaagattttgtaatttcggtgtgtttttcttgtacaagaggtttttatgaatcaagtaatttaatcaaaaaaaa

SEQ ID NO: 10108 - DNA, 974 bp, Triticum aestivum
catggcagctccgagagcagtcgtcctctgcgtcctgctggcggtcgccgtcgccaacgcggaggcggcgtcggtgatcgtcggcctggccaagtgcgccgactgcaccaggaagagcatgaagtccgaggaagccttcaaggctctgcaggtggcgatcaagtgcaagaacagcgctggcgagtacgagagcaaggccgtgggcgccctcaacggcactggcgcttttagcgtgcccctggccgccgacctccacggcgccgactgcgtcgcgcagctccacagcgcgtcctccaacgcgccgtgccccggccaggagccgtccaagatcgtgccggtgtccgagggcagcacctacggcgtcgtcgctggcgagaacaccgccacgtcgtccgcggcgtcgccggagtgcgcgtccatgaccctgtgcgggccgatcaagaagcacatcattgagcacttccaccataagaagcccgtgccgcccaagccggagcccaagccccagccccacccggactacggccccgtgcccaaaccagagcccaagcagccccacccggactaccaccccgtccctcctacgcccacctacggcggcggcggtggcggtggataccacggacaccactgactcagagtctcagatcagccaccgtacgtccagcccggcactgaaatctatcaccggccggttcatggtcagtgagtgatcgacgtcgttgctatttatgatgcgttgcatgcgtgggaattgtttggtgctccgccattcgctgctccgttttactatgtgcattacagaattgagggttcagaataacagtcatgtactacgagtgtatcaggcgagtatgagggggtggtttgtgtgttgcttgctttatcaagattttgtaatttcagtgtgtattttgtataacaagttattatgaatcaactaatttaaacaagtcgatttgtcaaaaaaaaaa

SEQ ID NO: 10109 - DNA, 758 bp, Triticum aestivum
ccgagagcactcgtcctcgccgtcctgctggcgctcgccttcgccaacgccgaggcagcgtcggtcgtcgtcggcctggccaagtgcgccgattgcaccaggaagaacctcaaggccgaggaggccttcaagggtctccaggtggcgatcaagtgcaagaacgtccagggcgagtacgagagcaaggcggtgggtgcccttgacggcaccggcgccttcagcgtgcccctggccgccgacctccacggcgccgattgcgtcgctcagctccacagcaccgcctccaacgcgccgtgctccggccaggagccatccaagatcgtgccggttttcgagggcaccaccttcggcatcgtcgccggcgacagcattgccacgccgtccgcggcgtcgcccgagtgcgcgtccatgaccttgtgcgggccgatcaagaagcacatcatcaagcatttccaccacaagcagcccgtgccgcccaagccggagcccaagccccagccccaccctgactatcaccccgtgcccaagccggagcccaagccgcagccccacccggactaccaccccgtccctcccacccccacctacggcggcggcggcggcggcggataccatggacaccactagtgactccgatctaccgcgatccggcacagcaatgaagtgacgctgctatttatgtgcacgagttagcttggtcttctatcactcagaataacagttgtgagggataagtatgtgtgtcaggtaaatgtacg

SEQ ID NO: 10110 - DNA, 741 bp, Triticum aestivum
gcacgaggctcagacatggcagtttcgagagcgctcgtcctcggcgtcctgctggcgatcgccgtcgccaatgccgaggcagcgtccgtcgtggtcggccaggtcaagtgcgccgactgcaccaggaagaacttgaaggccgaggaagccttcaaggatcttcaggtggcgatcaagtgcaagaacgtccaccgcgactacgagagcaaggcagtgggtgccctggaccgcaccggcgccttcagcgtgcccctggccgccgacctccatggcgccaactgcgtcgcgcagctccacagcgctgcctccaacgcgccgtgctccggccaggagccatccaagatcgtgccggtgtccgagggcaccaccttcggcgtcatggccggcgccaacactgccacgctgtccgcggcgtcgcctgagtgcgcgtccatgaccctgtgcgggctgatcaagaagcacatcatcgagcacttccaccacaagaagcccgtgctgcccaagccggagcccaagccccagccccacccggactacggccccgtgccaacccgagcccaagccgcagcccagccggactaccacccggtccctcccacgcccacctactcgggccggcgggccggccggcggtcggataccaccgggccaccgactcgaggtcctggtccttcggccaacgtcgtccggctaacgcaccaaagtcccataccgaccggttaccgactcgagtacgtacgg

SEQ ID NO: 10111 - DNA, 1160 bp, Triticum aestivum
gaaggtagaaaaatccatccatcgatcgagcagccacttcacaccagctagtggaagtagtgcgatccagaggttcaggcatggcagctccgagagcactcgtcctctgcgtcctgctggcgatcgccgtcgcccacgccgaggcggcgtcagtcgtcgtcggtctggccaagtgcgccgactgcaccaggaagaacatgaaggccggggaagccttcaaggctgtgcaggtggtgatcaagtgcaagaacagcgccggcgagtacgagagcaaggcggtgggcggcctcgatggcaccggcgccttcagcgtgcccctcgtcgccgaccttcatggcgccgactgcgtcgcgcagctccacagcgccgcctccaacgcgccctgccccggccaggagccgtccaagatcgtgccgctgtccgagggcaccaccttcggcttcgtcgctggcgagaacaccgccaggccgtccgcggcatcgctggagtgcgcgtccatgaccctgtgcgggccgatcaagaagcacatcatcgagcacttccaccacaagaagcccgtgccgcccaagccggagctcaagccccagccccacccggactacggccccatgcctaagccggagccgaagccgcagccccacccagactaccaccccgtccctcccacgcccacctacggtagcggtggcggcggtggtggataccacgggcaccactgagtcagttctacccccgtcctgcccagcgatgaaatctcatcatcagcgggttggtgatcagtgagtggtggacggtgctaattatgattggtttgcatgcgtgggtatcgttaggtcttctgccattcccgcgaagccccgtttattatctgcactgcagagttgggagttcagaataacagatgtgcgtgtgtgtcgctgtgtcaggcgagtgtgagggtgtgttggtgtgttgctttatcaagattttgtaatttcagtgtgtgttttgtataagaagttattatgaatcaagtaatttaaccaagtcgatttgtcagccgaacaactgcagctgttcgagacgattggcatgataaagatagtgtgattttacttcaactcaattttcagatccgtgaactgaaactgaagtgaaattcaggcgtgtgcaatgcatcc

SEQ ID NO: 10112 - DNA, 999 bp, Secale cereale
tgcttctcacgatcgccgttcgccaatgccgaggctgcgtcggtcgtgggtcggcctggccaaagtgcgccgattgcaccaggaagaacatgaaggccgaggaggccttcaagggtcttcaggtggcgatcaagtgcaagaacagcgccggtgactacgagagcaaggcggtgggaggcctcgacggcaccggcgccttcagcgtgcccctggccgccgacctccacggcgccgactgtgtcgcacagctccacagcgctgcctccaacatgccgtgccccggccaggagccatccaagatcgtgccggtgtccgagggcaccacctacggcatcgtcgctggcgaaaacagagccacaccgtccgcggcgtcgccggagtgcgcgtccatgaccctgtgcgggccgatcaagaagcacatcatcgagcacttccaccacaagaagcctgtaccgcccaagccggagcccaagccccagccccacccggactacggccccgtgcccaagcccgagcccaagccgcagccccatccggactaccaccccgtccctcccacgcccacctacggcggcggcggtggataccacggacaccactgagtctgatctgccaccgaaatctcatcaccgagttgatgatcagtgttagtgagtgatcggcgttgctatttatcatcagttgcatgcgtggccgcgtgggtattctttggtggtctcctgccattcgctgccccattttagtatctgcactgcagagttgagacttcagaataacatttgtgaggacgtgtattgcttttttaagatttgcaatttctgtgtgtgttttgtacaagaaagtggtgtgtgttttgtacaagaaagttactgtgaatcaagtaatttaagtctaaggttccggtttaagggtaaaaaaactaaaaaaaaaaaaaaaaaaaaaaagaaaaaaaaaaaaaacgtaaaagtaagaacgtacgacgaacgaactacgaaaccg

SEQ ID NO: 10113 - DNA, 965 bp, Secale cereale
cgtcaggccacttacaaacaagaaattaccaggacggtagcgagctccgagagacacgttcgtcctcgccgtccttcgtcggcgatcgccgtcgcaacgccgagcggggtccgtcgtggtcggcctggccaagtgcgccgactgcaccaggaagaacctcaaggccgaggaagctttcaaaggtcttcaggtggcgatcaagtgcaagaacgtccacggcgactacgagagcaaggccatgggtgccctcgacggcaccggcgccttcagcgtgccccttgcttctgacctccatggcgccgactgcgtcgctcagctccacagcgccgcctccaacgcgccttgctccggccaggagccatcaaagatcgtgcccgtgtctgagggcaccaccttcggcatcgtcgccggtgaccacaccgccacaccgtccgcggcgtcgccgttgtgtgcgtccatgaccctgtgtgggccgatcaagaagcacatcatggagcacttccaccacaagaagcccgtgccgcccaagccggagcccaagccccagccccacccggactacggccccgtgcccaagccggagcccaagtcgcagccccacccggactaccatcccgtccctcccacgcccacctacggcggtggcggcgggggataccacggacaccactgactccgatctgccaccctcccgcccagcactgaaatcgcctggttttcgtgctgtcgttgagtgagtgaccgctatttatgattatcgcatcgcatgcatggctggtttggttttcttcagtatctgcggaagggttcagaataagagttatgaggggagcagatggatcagtgtgtgtcagtcaagtgtacgggtgataggtatttctttaattaccggtgtttgtaatatcagtcagtgtgattttgtaaacaaaagttattataaattgagtaacgaaatatgtatttgg

SEQ ID NO: 10114 - DNA, 875 bp, Secale cereale
ccaacgccgaggcggggtccgtcgtggtcggcctggccaagtgcgccgactgcaccaggaagaacctcaaggccgaggaagctttcaaaggtcttcaggtggcgatcaagtgcaagaacgtccacggcgactacgagagcaaggccgtgggtgccctcgacggcaccggcgccttcagcgtgccccttgcttctgacctccatggcgccgactgcgtcgctcagctccacagcgccgcctccaacgcgccttgctccggccaggagccatcaaagatcgtgcccgtgtctgagggcaccaccttcggcatcgtcgccggtgaccacaccgccacaccgtccgcggcgtcgccggagtgcgcgtccatgaccctgtgcggaccgatcaagaagcacatcatggagcacttccaccacaagaagcccgtgccgccgaagccggagcccaagccccagccccaccctgactatggccccgtgcccaagccggagcccaaaccgcagccccacccggactaccaccccgtccctcccacgcccacctacggcggcggcggcggcggcggataccacggacaccactgactccgatctgccacccagccgcccagcactgaattcgcctggttatcgtgctgtgtcgatgagtgagtgaccgctatttatgattatcgcatcgcatgcgtggttggtttggttttcttcagtatctgcggaagagttcacaataagagttatgaggggagcagatggatcagtgtgtgtcactcaattgtacgggtgataggtattttttaccggtgtttgtaatatcagtgtgattttgtaaacaaaaattattatagactgtgtaatacaatcaagtccgaattaaag

SEQ ID NO: 10115 - DNA, 1318 bp, Lolium multiflorum
tccagctcctacttcactagtccacacaggcaagtggagaagaggttcttcaggcatggcagctccgagagcacttgtgctcggcttttgcgccctcctgctggcgatcgccgtcgccaatgccgaggcggggtccgtcgtcgttggtctggccaagtgcgccgactgcactaggaagaacatgaaggccgaggaagctttcaagggcctccaggtggcgatcaagtgcaagaacatccacggcgagtacgagagcaaggcggtgggcggcctagacggttccggcgccttcagcgtgcctctcgccgccgacctccacggcgccgactgcgtcgcgcagctccacaatgctgcctccaacgctccgtgccctggccaggagccgtccaaggtcgtccctgtctccgagggcaccacctacggtgtcgtcgccggcgtcaagactaccacagcgtcgccagagtgtgcgtccgtgactttgtgcgggccgatcaagaagcatttcctggagcacttccaccacaagaagcccgtgccgcccaagccagagcccaagccgcagccccatccagactatcaccccataccgcccaagccagagcccaagccacagccccacccagactatcaccctgtccctcccactcccacttatggcggtggaggtggacacccctccgctccgatctaccacgcagagtcaaagaccatgttgggcccaatcaaaaagcacatccttgaccacttccaccacaagaagcccgtgccaccaaagccagagcccaagccacagcctcatccggactaccaccccgtgcctcccacccccacctacggaggaggaggtggacacccttccactccgatctaccacgcagaatcaaagaccatgttaggaccgatcaagaagcacatcctagaacacttccaccacaaaaagcccgtgccgcccaagccagagcccaagccgcaaccccaccccgactatcaccccgttcctcccaccccgacctatggcagcggaggtggacacccctcgaccccgatctaccaccctccttcccagcactgaaatctatatggtttcatgttcagatcagtgagtgatcgacgccgttgctatttatgatctgttggatgcacggtgggttttggtatttctacagttctctgcccccttttcttaagtatccccagaacccagagttcaaaataacagttatgaaggatagatgggtttcaagcattgtacgggtaatgtgtgtttctttgccaaggcttgtaatatcggtgtgtttttttttggaaatatgaatga

SEQ ID NO: 10116 - DNA, 590 bp, Secale cereale
agagcactggtcctcgccgtgcttctcacgatcgccgtcgccaatgccgaggctgcgtcggtcgtggtcggcctggccaagtgcgccgattgcaccaggaagaacatgaaggccgaggaggccttcaagggtcttcaggtggcgatcaagtgcaagaacagcgccggtgactacgagagcaaggcggtgggaggcctcgacggcaccggcgccttcagcgtgcccctggccgccgacctccacggcgccgactgtgtcgcacagctccacagcgctgcctccaacatgccgtgccccggccaggagccatccaagatcgtgccggtgtccgagggcaccacctacggcatcgtcgctggcgaaaacagagccacaccgtccgcggcgtcgccggagtgcgcgtccatgaccctgtgcgggccgatcaagaagcacatcatcgagcacttccaccacaagaagcctgtgccgcccaagccggagcccaagccccagccccacccggactaccgccccgtgcccaagccggagcccaagccgcagccccatccggactaccaccccgtgcctcccacccccacctacgctga

SEQ ID NO: 10117 - DNA, 2879 bp, Sorghum bicolor
cacccgtcgtctccgcgcgtggcgtggcctttggcccttgcccccttgtgctatacaaacggaacggacggcacggacacattgtcgcggcgcagaccggagagagggccgaggggagcagagcagagcagtccagtcagcggggagcggagcgggagcggaccgcaggttctaggagccgagcccccgccgcgtcggagatggacacgcccgaccgcgccgccgctccgtctgcggcctcgcgcgccgaggactcgccagttttcagcttcctcaacaacctgtcgccgatcgagcctctcaagtcggcttacaacacgaacagcctccaagggtttcagtccatcaacataacgtccatttcctcaatcttcacttctccgcatgacaatgtgaacaaggaaccgaggctcccaaagagttcacttggtgacatttctgaaaacgaggtttgtgctgacggcgctgatacaaacaagccatccaagtcttcaaatgctgttaggttgtttgcctgcactagcactgtgactcgagaaacccactctgttacttgttccggtgtagttgatcctccaactgggccatgtgatttggctcaacctggtcagttcgataatggcagtccagaccataacacgacaccctgccatggtgtcagatcagaccttaaactggataagactaggaagttagaagctgcacaaactgttaaaaatacattggagaaaaggaaatgcttgttttccactgatatccagctcctggatggcagcagcgagcctgtgaatgacaatgatcaagtcttgggatgtgaatggtccgacttgatctccacaacctcagctgagcttttggcctttgactccacgatggatgagcatcacagaggagtgcatttggcagctaaaaacgcagaatcatgtggatatttgctatcaaaacttaccggagatggtgacgtctcagacagagcacatcctagtgcatctggtcaggtatactatcaagaacttgtgatgggagaagatcagacagaaaatgctgaaatatttcaggatggtcaagaaaccatctcaactgaagaaattcaggataatatttgtgaagcgaatggatgtcttccattagagtacaaggtggagggccaacaacaacgtggcgtacgaagacgctgcctggtttttgaggcatctgggttttcaaatagtgttgtgaaaaaagggactgttgaaaatctctctgtctcaacatgtaaaggcaaaagtcctgtacaaacccaaccacgtggattgcgaggcatcggtctacatttgaatgcccttgcattaacaccaaaagggaaaatggcttgtcaggatcctacagcttctgctttgcttccgtcatcagcatctgaaaaggatgtgcatggcaggttgctttctgcaggagagaattttacacattcaggtggtgaactgttagaattccccgtggatgattgttcagctggaggttttcctgtaaatgatcatgtttcaggtcaaagtgtcagccctcaaaagaagagacgtaaaacagataatggtgatgatggtgaggcatgcaagcgatgcagctgtaagaagtcaaagtgcctgaaactttattgtgagtgttttgctgctggtgtatactgctcggaaccttgttcatgtcaaggatgtctgaacaaacccatacatgaggaaattgttctctccactcggaagcagatagagtttcgtaatccactagcgtttgctccaaaagtgatccgtatgtctgatgctggtctggaaactggggaagatcctaacaatactccagcttcagctcgtcacaagagaggatgcaattgcaagaagtcaagctgtctcaagaaatactgtgaatgctatcagggaggtgttggatgctccaccaactgcagatgtgagagttgcaaaaatacttttggcagaagagatgccgagagtgaactcactgaagaaatgaaacaagaaagtgaacaaacagaaaattgttcacaagaaaaggagaatggtcaacaaaaagcaaatgtacagagcgaagatcaccccctccttgaccttgtcccaataacacctccttttgatctttccagttctctgctcaaactgccaaatttctcaagcgcgaaaccaccgagaccgtccaaacctcgcagtgtgaactcccgttcgtctgcttcgaaagctactgcaacagtacagccttgtaaatcgtccaagattgctgttagtggtatcgatgaggagatgccagatattctaaaagaacctaattctcctagtaactgtgtcaagactacttcacccaatggaaaacgggtctcaccgccacataatgcgctcagtatttccccaaaccgaaaaggtggtaggaagttgatactgaagtcaattccctcatttccgtcacttgcgggagacacaatcagcggttctgcaatgaacaacactgatagcacattcagcgtgtcacctctcactttaggaccatcttaaagctgtgaagttggccatgggaccggagtacgacttgtagtccgaatatgtgcctcacaatctacggcaaggctggaggtaccgtcagagaatagtaagttagtttttaagttgtagtaatctgtttttgtaaaatatggtagccccaataatctgtatgtaagatgctgtgatgcttgaagctgttatctttattaaattgtagcaacattacaaatcacctcttgagtaggtttcataaatccagtccatgtttatttttcaaaaggattccagtccatgttttccattgcaaactcttttccatgtctgaagccacctctgtcagtgaacaattaaactaaaccc

SEQ ID NO: 10118 - DNA, 2568 bp, Panicum virgatum
ggcactggaagaaatttggcgccttgctggtttgtgctcgatgctcataacccagactcgccggttttcagcttcatcaacaacctgtctcccattgagccgctcaagtccgcttacaacgcgaacagcctccaggggtaccagtccatcaacataacctccatttcttccatcttcacttccccgcacgacaacgcgcacaaggaaacaaggctcgcaaagagctccctcggtgaaatttctgaaagtgaggcctgtgctgatggcagcaaaacaaacaagccagctaagtcttcaaatgctgtcaggttgtttgcctgtgctagcactgtcactcgagaaacccgcacagttacatgttcggatgcggctgatcctccaactgggccatgcgatttggctcaccctgttcgattcgataatggcagtccagaccataacaccactccttgccatggtgtcaaatcagaccttaagcaggacaagtgtcggaaactagacgttgtccagaccgttaaaaatacagtggagaaacggaaatgcttgttctccactgaaatccagctcctggatggtggccagcctgtgaatggcagtgatgacgtcttgggatgtcaatggtcggacttagtctccacaacctcgggtgagcttttggcctttgactccacgatggatgaccatcacagaggaatgcatctcgcagctaaaaatgcagaatcttgtggatacttgctgtcgaaacttacaggaggtggtgaaatctcggacagagcacatcctagtgcatctggtcaagtatactatcaagaactcgtgatgggagaagatcagacagaaaatcctcaaatatttcaggatggtcaacaaaccatctcaacagaagaaattcaggataacatttatgaagagaatggatgtattccattagactacaaggtggaaagccaacaacgtggcatacgaagacgctgcctggtatttgaggcagctgggttctcaaatactgttgtgcagaaagagacggttgagagtctctctgtctcaacatgtaaaggcaagagccatgtacaaacccagccacgtgggttgcgcggtataggtctacatttaaatgcccttgcattaacaccaaaaggcaaaatggccaaccaggatcctatggcttctggtttgcatccatcatcaggatctgaaaaggatgcgcatggcaagtttctctcagcaggagagaattttccaaactctggcggtgacctgttagaatttcccatggatgattgttcagctggaagttttcctgtaaatgatcatgtttcaagtcaaagcgtcagtcctcaaaagaagaggcgtaaaacagataataatggtgatgatggtgaggcatgcaagcggtgcagctgtaagaagtcaaagtgcctgaaactgtattgtgagtgttttgctgccggtgtttactgctctgaaccttgttcgtgtcaaggatgtttgaacaaacccatacatgaggaaattgttctctccactcggaagcagatagagtttcgtaatccgctagcatttgctccaaaagtgattcgtatgtctgacgctggtccggaaactggggaagatcctaacagcactccagcgtcagctcgtcataagagaggatgcaattgcaagaagtcaagctgtctcaagaaatactgtgaatgctatcagggaggtgttggatgctctagcaactgcagatgtgagagttgcaaaaacactttcggcagaagagatgctgacactgaactcactgaagaactgaaacaagaaggtgaacaaacagaaaattgtggaaaagagaaggagaatgatcaacaaaaggcaaatgtacagaacggagatcatcccctccttgagcttgttccaataacacctccttttgatctttccagttctctgcttaaactgccaaatttctcaagtgcaaagccaccaagaccttccaaagctcgcagtgggaactcccgttcgtctgcttcaaaagctactgcaacattgcagtcttctaaatcatccaaggttgctggtagtgttatcgatgaggagatgccagatattctaaaagaagctgattctcctaacaactgtgtcaagtctacttcacccaatggaaaacgagtctcgccaccgcataatgcgcttagtatttccccgaaccggaaaggtggtaggaaattaatattgaagtcaattccctcatttccatcacttatgggagagtcaaacagtggttctacgatgaacgatactgataacacattcagcacatcgcctctcgttttaggaccatcttaaagctgtgaagtcgactacgggaccggagtacgacttgtagtccgaatatgtgcctcacatcctacagctgcagcaaggctcgaggtactgtcagagaatagtaacttagatttaagatgtagtgatctgtatttgtaaaataggtagcctatcaataatctgtatgtaagatgctgtgtcgcttgtagctgttatttttattgaattgtagtaacactataaatgacctcttgagga

SEQ ID NO: 10119 - DNA, 1480 bp, Sorghum bicolor
ttcgtcaggctacgagccgacgagactgacagactgagaagagctcgtcgcccgattccatctggatttccgccggccagcggcgagatgtccttcttcttccgggccgctacgcggcagcgcccgtcgccgcaggagatcgcgcgctccatcaaggactccctcgttgccctcgacaccaagaccggcgccaaggctctcgaggatgctgagaaaaacatacttacgttgaggcatacacttgctggtgatggagaagtagaaccaaatcaagagcaggttctgcaggtagcccttgagatctgcaaggagggtgttctttcgctctttgttcagaatcttccttccttgggttgggaggctagaaaggatcttgtccactgctggtgtattttgttgagacagaaggttgatgaaggctattgttgcgtccagtatattgaaaatcattttgatcttttggatttccttgttgtttgctacaagaacttggaagttgcgttgaattgtgggaacatgttgcgagaatgcataaaatatcctacacttgcaaaatatatattggagtcaagtagcttcgagttgtttttccagtatgttgaattgccaaactttgatattgcttctgatgctctgaacaccttcaaggatttgctaaccaaacatgaagatcaagtttctgaatttctgagctctcattatgaacagttttttggactctacacaaaacttttatcttcaactaattatgtgacacgaagacaatcagtgaagtttctttcagagtttctgttggaggccccaaatgctcaaataatgaagcgttacattttggaagttcggtatttaaacattatgatgggtcttctgaaggattcaagcaaaaatatcaggatatgttccttccacatatttaaggtatttgttgccaatccaaacaagcctcgtgagattattcaggttttggttgacaatcacagagaactgttgaagctactccacaatctccccacaagcaaaggtgaagatgaacaacttgatgaggagagagatctaattatcaaagagatcgagaagcttgtgcggttgtccgtataaaccctcaggaaattcaaacatatccttgatgctgatgttgaggaaaagtctacccctttgtcccctcaatattttgaagacatccttcctgtgtaatatgctgccctgtatagagcttgtctttcatatatggaaaaagtttggccacaaattgcattctccgtgagaacacttagcattcctatcagaaatttgttgacgtgatgccgatacactggtagcagaattcgtaacaggaataatctgcattatggtgtggtgttgataccattacgaattggctgagagtgtctggcatttgaactgggttcacttgtcatgtagtatattttgaattttgatgcctaacgtaacgtttgcaaattcttggcaacttttgcgt

SEQ ID NO: 10120 - DNA, 1364 bp, Pennisetum glaucum
ggagcgcgacgggagtggaaggagcaaaagggggagcagcagcagcgctccccgatccgtttggatttgcgccggccaccagccgagcccgcgaagatgtcattcttcttccgtggcgggtcgcggcagcgcccgacgccgcaggagatcgtccgctccatcaaggactccctcgtcgccctcgacaccaagaccggcgccaaggctctagaggatgctgagaaaaacatactcacgttgaggcatacgctttctggtgatggagaagtagaaccaaatcaggagcaggttttgcagattgcccttgagatctgcaaggagggtgttctttccctctttgttcaaaatcttccttccttaggttgggagggtagaaaggatcttgtccactgctggtgtattttgttgagacagaaggttgatgaaagctattgctgcgtgcagtatattgaaaatcatgtggaccttttggatttcttagttgtttgctacaagaacttggaagttgcattgaactgtggaaatatgttgcgagaatgcataaaatatcctacacttgcaaaatatatactggagtcaagtagcttcgagttgtttttccagtacgttgaattgccaaactttgatattgcttctgatgctctgaacacattcaaggatttgctaaccaaacatgaagatgcagtctctgaatacctgagctctcattatgaacagttttttggactctacacaaggcttctatcttcaactaattatgtgacaagaagacagtcagtgaagtttctttcggaatttctgttggaggccccaaatgctcaaataatgaagcggtacattttggatgttcattacttaaacatcatgattggtctgctgaaggattcaagcaaaaatatcaggatatgtgccttccacattttcaaggtttttgttgccaatccaaacaagcctcgcgagatttttcgagttttggttgacaatcacagagaattattgaagctactccacaatcttcccacaagcaaaggtgaagatgaacaacttgatgaggagagagatttaattatcaaagaaatcgagaagcttgtgcgtttatcagtataaaccctcaagaatatccttgggatcaggacaaggcagcccctttctcccattaatattttgaagaagacatactgtgcaatatgctgccctgtatagaggttgtttttttcatacggaagaaatttggctacgaaattcatcctacgcaagaatacttgtggatacggtacattggtaaatggaaatcgcaacagattccaggtatggaataatttgcatgatgacgtgttaccatcgggaatcaggagagatgcagt

SEQ ID NO: 10121 - DNA, 1369 bp, Setaria italica
caggactgaaggagcaagggaaggcgctccccgatccatttgtttgcgccggccagccgcgagatgtccttcttcttccgtggcgggtcgcggcagcgcccgacgccgcaggagatcgtccgctccatcaaggactccctcgtcgccctcgacaccaagaccggcgccaaggctctagaggatgctgagaaaaacatacttacgttgaggcatgcgctttctggtgatggagaagtagaaccaaatcaagagcaggttttgcagatagcccttgagatctgcaaggagggtgttctttccctctttgttcagaatcttccttccttgggttgggagggtagaaaggatcttgtccactgctggtgtattttgttgagacagaaggttgatgaaagctattgctgtgtgcagtatattgaaaatcatgttgaccttttggatttccttgttgtttgctacaagaacttggaaattgcgttgaactgtgggaacatgttacgagaatgcataaaatatcctacacttgcaaaatatatactggagtcaagtagcttcgagttgtttttccagtacgttgaattgccaaactttgatattgcttctgatgctctgaacacattcaaggatttgctaaccaaacatgaagatgcagtctctgaatttctgagctcccattatgaacagttttttggactctacacaaggcttttatcttcaactaattatgtgacaagaagacaatcagtgaagtttctttcggaatttctgttggaggccccaaatgctcaaataatgaagcggtacattttggatgttcattacttaaacatcatgattggtctgctgaaggattcaagcaaaaatatcaggatttgtgccttccacatttttaaggtatttgttgccaatccaaacaagcctcgtgagattgttcgagttttggttgacaatcacagagaattgttgaagctactccacaatctccccacaagcaaaggcgaagatgaacaacttgatgaggagagagatttaattattaaacaaatcgagaagcttgtgcgcttatcagtataaaccctcaagaatatccttgggatcaggacaaggcaacccctttctcccgttaatattttgaagacatcccgtgtaatatgctgccctgtatagaggttgttttttatagggaagaaatttggccacgaatttcattctacgcaagaatacttggcattcctatctgaatttgtggacatgatacattggtaaatggaaatcgcaacagattccatgtctggaataatttgcatcatgacgtgttaccattggggattaggagagaatgtcagacgtttgatgatttgaaatggag

SEQ ID NO: 10122 - DNA, 1736 bp, Panicum virgatum
cgagggttcatactgcaacgacttctcccctgctgcaaagccgccggagctccgcccctgccctgccctgccctgcccggtgagatcccttctagagacgggaatacggtttacgagtgcgacaggagtacaggagtgaagaaggagcaagggaagcgctccccgatccatttggatttgctccggccagcggcgggatgtcgttcctcttccgaggcgggtcgcggcagcgctcgtcgccgcaggagatcgtccgctccatcaaggactctctcgttgccctcgacaccaagaccggcgccaaggctctcgatgatgctgagaaaaacatacttacgttgaggcatatgctttctggtgatggagaagtagaaccaaatcaagagcaggttttgcagatagccattgagatttgcaaggagggtgttctttccctctttgttcagaatcttccttccttgggttgggagggtagaaaggatcttgttcactgctggtctattttgttgagacagaaggttgatgaaagctattgctgcgtgcagtatattgaaaatcatgttgaccttttggatttccttgttgtttgctacaagaacttggaaattgcattgaactgtgggaacatgttgcgagaatgcataaaatatcctacacttgcaaaatatatactggagtcaagtagctttgagttgtttttccagtatgttgaattgccaaactttgatattgcttccgatgctctgaacacattcaaggatttgctaaccaaacatgaagatgcagtctctgagtttgtgagctcccattatgaacagttttttggactctacacaaggcttttatcttcaactaattatgtgacaagaagacaatcagtgaagtttctttcggagtttctgttggaggccccaaatgctcaaataatgaagcggtacattttggatgttcattacttaaacattatgattggtctgctgaaggattcaagcaaaaatatcaggatatgcgccttccacatttttaaggtatttgttgccaatccaaacaagcctcgtgagattgttcaagttttggttgataatcacagagaagtgttgaagctactccacaatctccccacaagcaaaggcgaagatgaacaacttgatgaggagagagatttaattatcaaagaaatcgagaagcttgtgcgcttatcagtataaaccctcagtaaactcaaatatatccttgtgtttcaggacaaggcaacccctttctcaccttgatattttgaagacatcctgtgtaatatgctcccctgtatagagtatagactatagaggttgtctttttggggaatgactttgtggacatgatatactggtacacggaaatcgcaacagattccatgtccagaataatttccattttggtgtggtaccattgggaattagtctcatgtttgcaaagtctcacaaggtttgcatgtgattcaggccacatagtgaagattgagctgctgaaaacacattaattgattcaaattctacataagtgtggacaataagagctagaacagtttctctttttttttagctatcgatccttctttacatatctgatacctatcaggtatggtatactttatatatttgcaattggcaatggggacaatttacaggaaggaattaattgaatcctattgggatttctgagctgccgtacgtgagagtatggggggtcacaacggc

SEQ ID NO: 10123 - DNA, 1081 bp, Echinochloa colona
cgcaagagacgcgcttcccgatccatttggatttgcgccgggcagcggcgagagatgtccttcttcttccggggcgggtcgcggcagcgcccgtcgccgcaggacattgtccgctccatcaaggactctctcgttgccctcgacaccaagaccggcgccaaggctctcgaggatgctgagaaaaatatacttacgttgaagcatacgctttctggtgacggagaagtggaaccaaatcaagaacaggttttgcagatagcccttgagatttgcaaggagggtgttctgtccctctttgttcagaatcttccttccttgggttgggagggtagaaaggatcttgtccactgctggtgtattttgttgagacaaaaggttgatgaaaactattgctgcgtgcagtatattgaaaatcatgttgaccttttggatttccttgttgtttgctacaagaacttggaagttgcgttgaactgtgggaacatgttgcgagaatgcataaaatatcctacacttgcaaaatatatactggagtcaagtagcttcgagttgtttttccagtacgttgaattgccaaactttgatattgcttctgatgctctgaacacgttcaaggatttgctaaccaaacatgaagatgcagtctctgaatttctgagcgcccattatgaacagttttttggactctacacaaggcttttatcttcaactaattatgtgacaagaagacagtcagtgaagtttctttcagagtttctgttggagaccccaaatgctcaaataatgaagcggtacattttggatgttcattacttaaacatcatgattggcctgctgaaggattcaagcaaaaatatcaggatatgtgcctttcacatttttaaggtatttgctgccaatccaaacaagcctcatgagattgttcaagttttagttgacaatcacagagaattgttgaagctactccacaacctccccacaagcaaaggggaagatgaacaacttgatgaggagagagatttcgttatcaaagagatcgagaagcttgtgcgcttgtcagcttaaaccctcaagaaatgca

SEQ ID NO: 10124 - DNA, 1415 bp, Oryza sativa
cgccccaggtcaacgcccccacagccgaatggcaggtcaagttcctgagtcctgacgaacgaagagagagttgggaggccctggctgagaccaacaccaccagatttcaccagagttgggaggtcctgactgagagttgggcggagatgtccttcttcttccgggcggcgtcgcggccggcgcgcccgtcgccgcaggagctcgtccgctccatcaaggagtccctcctcgccctcgacaccaggaccggcgccaaggctcttgaagatgttgagaaaaatgtatctactttgaggcagacactttctggcgatggagaagttgaaccaaatcaggaacaggttctacagatagcccttgaaatttgcaaggaggatgtcctttcgctctttgttcagaatatgccttccttgggttgggagggtagaaaggaccttgcccactgctggagcattttgttgaggcagaaggttgatgaagcctattgctgcgtgcagtatattgaaaatcattttgatcttctagatttccttgtagtttgctacaagaacttggaagttgcattgaactgtgggaatatgttgcgagaatgcataaaatatcctacacttgcaaaatatatattggagtcaagtagcttcgagttgtttttccagtatgttgaattatcgaactttgatattgcttctgatgctctgaacaccttcaaggatttgctcaccaaacatgaagccgcagtttctgagtttctgtgctcccattatgaacagttctttgagctctacacaagacttctaacttcaactaattatgttacaagaagacaatcagtgaagtttctttcagagtttttgttagaggccccaaatgctcaaataatgaagcggtacattgtggaagtcagttatttaaatatcatgattggcctgctgaaggatacaagcaaaaatatcaggatatgtgccttccacattttcaaggtatttgttgccaatccaaacaagcctcgtgatattattcaagttttggtagacaatcacagagaactgttgaagctactaggcaatcttcccacaagcaaaggtgaagacgagcaacttgaagaggagagagatttaatcatcaaggaaatcgagaagcttgtgcattcatcggtatagaccctcaagaaattcaaatccatccgttcaagtttcgctggtcaagaaatgtgatccctttcttcccttcttgtttttaagacctgtgtaatgtgatccctgtatagagggtgtttatcatagggaaatagtttgaccaagaagtatgttggtcacaagaacactttaccattgctgtgtgcatttccattgtgaaaatttttggaacaactggtgggcacatgttcgaattatgaatgacagctgatgtcaaac

SEQ ID NO: 10125 - DNA, 1617 bp, Oryza sativa
gagatatttctctttggatcgatcggatccctccaggcaggcgcaccaccccgccgccgagcgccgccgctgccactggactgtgctggccaccccagctcaccgcccccaccgccgagcgccggcccaccaccccgccgccgagtgccaccaccgccccaggtcaacgcccccacagccgaatggcaggtcaagttcctgagtcctgacgaacgaagagagagttgggaggccctggctgagaccaacaccaccagatttcaccagagttgggaggtcctgactgagagttgggcggagatgtccttcttcttccgggcggcgtcgcggccggcgcgcccgtcgccgcaggagctcgtccgctccatcaaggagtccctcctcgccctcgacaccaggaccggcgccaaggctcttgaagatgttgagaaaaatgtatctactttgaggcagacactttctggcgatggagaagttgaaccaaatcaggaacaggttctacagatagcccttgaaatttgcaaggaggatgtcctttcgctctttgttcagaatatgccttccttgggttgggagggtagaaaggaccttgcccactgctggagcattttgttgaggcagaaggttgatgaagcctattgctgcgtgcagtatattgaaaatcattttgatcttctagatttccttgtagtttgctacaagaacttggaagttgcattgaactgtgggaatatgttgcgagaatgcataaaatatcctacacttgcaaaatatatattggagtcaagtagcttcgagttgtttttccagtatgttgaattatcgaactttgatattgcttctgatgctctgaacaccttcaaggatttgctcaccaaacatgaagccgcagtttctgagtttctgtgctcccattatgaacagttctttgagctctacacaagacttctaacttcaactaattatgttacaagaagacaatcagtgaagtttctttcagagtttttgttagaggccccaaatgctcaaataatgaagcggtacattgtggaagtcagttatttaaatatcatgattggcctgctgaaggatacaagcaaaaatatcaggatatgtgccttccacattttcaaggtatttgttgccaatccaaacaagcctcgtgatattattcaagttttggtagacaatcacagagaactgttgaagctactaggcaatcttcccacaagcaaaggtgaagacgagcaacttgaagaggagagagatttaatcatcaaggaaatcgagaagcttgtgcattcatcggtatagaccctcaagaaattcaaatccatccgttcaagtttcgctggtcaagaaatgtgatccctttcttcccttcttgtttttaagacctgtgtaatgtgatccctgtatagagggtgtttatcatagggaaatagtttgaccaagaagtatgttggtcacaagaacactttaccattgctgtgtgcatttccattgtgaaaatttttggaacaactggtgggcacatgttcgaattatgaatgacagctgatgtcaaacatatctttgttcataattgaaatgaaatatttcgagatctgtgacagc

SEQ ID NO: 10126 - DNA, 1026 bp, Hordeum vulgare
ggcggcgagatgtccttcttcttccgggcggcgtcgcggccgcgttcgtcccagcaggacctcgtgcgctccatcaaggactccctcctcgcgctcgacaccaagaccggcgccaaggccctcgaagatgttgagaaaaacatatttacattgagacagacactttctggtgatggagaagttgaaccgaaccaggatcatgtcttacagatagcccttgaaatttgcaaggagggtgtcctttctctttttgttcagaacctgccttcgttgggttgggagggtagaaaggatcttgcccactgctggtgcattttgttgaggcagaaggttgatgaaagtcactgctgcgtgcagtatatcgaaaatcatgttgatcttctagatttccttgttgtttgctacaagaacttggaagtcgcattgaactgtggaaacatgttgcgagaatgcattaaatatccttcacttgcaaaatatatattggagtcaaatagcttcgagttgtttttccagtatgttgaattgccaaactttgatattgcttctgatgctctgaataccttcaaggatttgctcactaaacatgaagatgcagtctccgagtttctcatttcccattatgaacagttctttgaactctacaaaaggcttttaacttctgataattatgtgacaagaagacaatcagtgaagtttctttcagagtttctgttggaggccccaaatgctcagataatgaagcggtatattttggaagttcgttacttgaacattatgatgggtctactaaaggattcaagcaaaaatatcaggatatgttcctttcacatttttaaggtatttgttgccaacccaaacaaacctcgtgatattattcaagttttggtagacaaccacaaagaattattgaagttactccatgctcttcctgcaagcaaaggtgaagatgaccaacttgacgaggagcgagacttgattatcaaggaaattgagaagcttgtgcgcttgtcagtatagaccctc

SEQ ID NO: 10127 - DNA, 1484 bp, Hordeum vulgare
ggaggattaaccaaactgtacgccatcggcctgtgaaaacggaaacaaggaaggaagaaagctggaactcgcttcgcactgctcggtcgtcgtcctcgactcctcgtctcgtctcggctctgcccccaaccgctcgccacgccgccggttcagtcccctccgccggcggcgagatgtccttcttcttccgggcggcgtcgcggccgcgttcgtcccagcaggacctcgtgcgctccatcaaggactccctcctcgcgctcgacaccaagaccggcgccaaggccctcgaagatgttgagaaaaacatatttacattgagacagacactttctggtgatggagaagttgaaccgaaccaggatcatgtcttacagatagcccttgaaatttgcaaggagggtgtcctttctctttttgttcagaacctgccttcgttgggttgggagggtagaaaggatcttgcccactgctggtgcattttgttgaggcagaaggttgatgaaagtcactgctgcgtgcagtatatcgaaaatcatgttgatcttctagatttccttgttgtttgctacaagaacttggaagtcgcattgaactgtggaaacatgttgcgagaatgcattaaatatccttcacttgcaaaatatatattggagtcaaatagcttcgagttgtttttccagtatgttgaattgccaaactttgatattgcttctgatgctctgaataccttcaaggatttgctcactaaacatgaagatgcagtctccgagtttctcatttcccattatgaacagttctttgaactctacaaaaggcttttaacttctgataattatgtgacaagaagacaatcagtgaagtttctttcagagtttctgttggaggccccaaatgctcagataatgaagcggtatattttggaagttcgttacttgaacattatgatgggtctactaaaggattcaagcaaaaatatcaggatatgttcctttcacatttttaaggtatttgttgccaacccaaacaaacctcgtgatattattcaagttttggtagacaaccacaaagaattattgaagttactccatgctcttcctgcaagcaaaggtgaagatgaccaacttgacgaggagcgagacttgattatcaaggaaattgagaagcttgtgcgcttgtcagtatagaccctcaagaaattcgaaattacccgttaaaaaagaaaacagtggtcgagcgaggcaatccatttcttctgtccttatttaaaaacctccagtgtaatgtgataccctgtatagaattgtttagcattttatcatatttacagaaacagcttgtcatttctcaagaacatgaagcattgctgcatgcatatatggttcacatgaattcatcacaccggattctatacacataccataattcgtagacaagatgaagcccagcattttgtgtgttttatcgtttcatgtttgtgagttctg

SEQ ID NO: 10128 - DNA, 1399 bp, Secale cereale
ctcggctttgccccccaattgctccccacgccgccggttcagtcccctccgccggcggcgagatgtccttcttcttccgcgcggcgtcgcggccgcgttcgtcgcagcaggaccttgtgcgctccatcaaggactccctcctcgcgctcgacaccaagaccggcgccaaggcccttgaagatgttgagaaaaacatatccaccttgagacagactctttctggtgatggagaagttgaaccaaaccaggatcatgtcttacagatagcccttgaaatttgcaaggagggtgtcctttctctttttgttcagaacctgccttcgctgggttgggagggtagaaaggatcttgcccactgctggtgcattttgttgcggcagaaggttgatgaaagtcactgctgcgtgcaatatatcgaaaatcatgttgatcttctagatttccttgttgtatgctacaagaacttggaagtcgcattgaactgtggaaacatgttgcgagaatgcataaaatatccttcacttgcaaaatatatattggagtcaaatagcttcgagttgtttttccagtatgttgaattgccaaactttgatattgcttctgatgctctgaataccttcaaggatttgctcactaaacatgaagatgcagtctccgagtttctcatttcccattatgaacagttctttgaactctacaaaaggcttttaacttcagataattatgtgacaagaagacaatcagtgaagtttctttcagagtttctgttggaggctccaaatgctcagataatgaagcggtacattttggaagttcgttacttgaacattatgatgggtctactaaaggattcaagcaaaaatatcaggatatgttcctttcacattttcaaggtatttgttgccaatccaaacaagcctcgtgatattattcaagttttggtagacaaccacaaagaattattgaatctactccatgctcttcctgcaagcaaaggtgaagatgaacaacttgatgaggagcgagacttaattgttaaggaaatcgagaagctcgtgcgcttgtcagtatagaccctcaagaaatccaaattagcctttgaaaagaaaaacagtggtcgagaaaggcaatccatttccttcgtcgttatttaaaaacctcctgtgtaatgtgataccctgtatagaattgtttagtgttttatcatatttacagaaacagcttgtcatttcacaagtacatgaagcattgctgcatgcatatatggttcaaacaaatctgccgaaccagattcgatatatataccgtaatttgttgtcattctggagatgcgagaatgcgcctcacctggtacgattaagtttggggacaacatgaagcctattcaattttaaaagtt

SEQ ID NO: 10129 - DNA, 1630 bp, Triticum aestivum
cgtcgtcctcaactccccgtctcgtctccgctttgctcccaaccgctccccacgccgccggttcagtcccctcagccggcggcgagatgtccttcttcttccgcgcggcgtcgcggccgcgttcgtcgcagcaggacctcgtgcgctccatcaaggactccctcctcgcgctcgacaccaagaccggcgccaaggccctcgaagatgttgagaaaaacatattcaccttgagacaaacactttctggtgatggagaagttgaaccaaaccaggatcatgtcttacagatagcccttgaaatttgcaaggagggtgtcctttctctttttgttcagaacctgccttcgctgggttgggagggaagaaaggatcttgcccactgctggtgcattttgttgaggcagaaggttgatgaaagtcactgctgcgtgcagtatatcgaaaatcatgttgatcttctagatttccttgttgtatgctacaagaacttggaagtcgcattgaactgtggaaacatgttgcgagaatgcataaaatatccctcacttgcaaaatatatattggagtcaaatagcttcgagttgtttttccagtatgttgaattgccaaactttgatattgcttctgatgctctgaatacgttcaaggatttgctcactagacatgaagatgcagtctccgagtttctcatttcccattatgaacagttctttgaactctacaaaaggcttttaacttcagataattatgtgacaagaagacaatcagtgaagtttctttcagagtttctgttggaggccccaaatgctcagataatgaagcggtacattttggaagttcgttacttgaacattatgatgggtctactaaaggattcaagcaaaaatatcaggatatgttcctttcacatttttaaggtatttgttgccaatccaaacaagcctcgtgatattattcaagttttggtagacaaccacaaagaattattgaagttgctccatgctcttcctgcaagcaaaggtgaagatgaacaacttgacgaggagcgagacttaattgtcaaggaaatcgagaagctcgtgcgcttgtcagtatagaccctcaagaaattcaaaattaccctttgaaaaaaaaaacagtggtcgagaaaggcaatccatttcttcctgtgtaatgtgataccctgtatagaattgtctagtgttttatcatatttacagaaacagcttgtcatttcacaagaacatgaagcattgctgcatgcatatatggttcaaacaaatctgccgcaccagattcgatatatataccgtaatttgttgtcatcctgaagatgtgagagcgcgccgcacctgtatgataaattcgggggcaacatgaagcctagcattttttgtatattttgttgttttcatgtttgcgaatacttgcaggtttatgttgccagtatgaaattcatgaagattgagcaaaataagtaaatgtggcaaaactgacaatgaacggctacatatgcttctctttgtaatctggcacttgttgcgtacgtatggtactataactttatacattttcacttgacagaggagacggtggtaatatacagcaaggaattaattgaatccgacta

SEQ ID NO: 10130 - DNA, 1297 bp, Brachypodium distachyon
attccgtccaccaacgtctcggttcgccctgaatcgcgctccccacccaaacccctccgccggagtccggcgagatgtccttcttcttccgggcggcgtcgcgcccgcggtcgtcgcagaacgagctcgtgcgctccatcaaggactccctcctcgcgctcgacaccaagaccggcgccaaggctctcgaggatgttgagaaaaatatatttaccttgaggcagacactttctggtgatggcgaagttgaaccgaatcaggagcaggttttgcagatagcccttgaaatttgcaaggagggcgtcctttctctctttgttcagaatctgccttcattgggttgggagggtagaaaggatcttgtccactgctggggtgttttattgaggcagaaggttgatgaaagtcactgctgtgtgcagtatattgaaaatcatgttgatcttctagatttccttgttgtttgctacaagaacctggaagttgcattgaactgtgggaacatgttgcgagaatgcataaaatatcctgcacttgcaaaatatatactgaagtcaagtagcttcgagttgtttttccagtatgttgaattgccaaacttcgatattgcttctgatgctctgaataccttcaaggatttgctcaccagacatgaagatgcagtctccgagtttttgagttcccactatgaacagttctttgaactatacacaaggattttaacgtcgaataattacgtgacaagaagacaatcagtgaagtttctttcagagtttctgttggaggccccgaatgctcagataatgaagcggtacattttggaagttcgttacttaaacattatgattggtctgctgaaggattcaagcaaaaatatcaggatatgtgcttttcacatttttaaggtatttgttgccaatccaaacaagcctcgtgatattatccaagtgttggtagacaatcacagagaactgttgaagctactcactgatcttcctgcaggcaaaggtgaagatgaccaacttgatgaggagagagatttaattatcaaggaaatccagaagctcgtgcgctcatcagtatagaccctcagcaaaatttaaaattatccttgcatattttactggtcaagaaaggcaacattgtctccctttcttatttctagacctcccgtgtaaaatgatatgtacagtggttgcttaatgtttaccatctttatatgggaatagtttgcccaagaagtgtggtcttcacaaaacacagagaattgccgtaaacatttatcgttaaacgaatt

SEQ ID NO: 10131 - DNA, 1280 bp, Avena sativa
cctcgtttcgtccaccacaacatcggctttgcccccaatcgctccccgccgccgccggttcaattccctccgccggcggcgagatgtccttcttcttccgggcggcgtcgcggccccgtcagccgcagcaggagctcgtgcgctccatcaaggactccctcctcgcgctcgacaccaagaccggcgccaaggctctcgaagatgttgagaaaaacatattcaccttgagacagacactttctggtgatggagaagttgaaccaaatcaggagcaggttttacagatagcccttgaaatttgcaaggaaggtgtcctttctctctttgttcagaatctgccttccttgggttgggagggtagaaaggatcttgtccactgctggtgcattttgttgaggcagaaggttgatgaaagttactgctgtgtgcagtatattgaaaatcatgttgatcttctagatttccttgttgtttgctacaataacctggaggttgcattgaactgtgggaacatgttacgagaatgcataaagtatcctgcgcttgcaaatgctctttcagatatatattggggtcaaatagctttgaattgtttttccagtatgttgagttgccaaactttgatattgcttctgatgctctgaacaccttcaaggatttgctcaccaaacatgaagatgcagtctccgagtttctgatttcccattatgaacagttctttgaactctacaaaaggcttttaacttcagataattatgtgacaagaagacagtcagtgaagtttctttcagagtttctgttggaggcccctaatgctcagataatgaagcggtacattttggaagttcgttacttaaacattatgattggtctactgaaggattcaagcaaaaatatcaggatatgcgcctttcacatttttaaggtttttgttgccaatccaaacaagcctcgcgatattattgaagttttggtagacaatcacagagaattgttgaagttactccacgatcttcctgcaagcaaaggcgacgatgaacaatttgatgaggagcgggacttaattatcgaggaaatcaagaagctcgtgcgctcatcagtatagaccatcgagaaattcaaaattacccctttaaaattcagtggtcaagaatggcaatccctttcttccagtcttctttcagaacctcctgtgtaatatgttaccctgtacagagctttttaacatttatatcatatttatagtgaatcaatttgtcccccgacgtgaggtctttcac

SEQ ID NO: 10132 - DNA, 1222 bp, Leymus cinereus x Leymus triticoides
gttcgtcgcagcaggacctcgtgcgctccatcaaggactccctcctcgcgctcgacaccaagaccggcgccaaggccctcgaagatgttgagaaaaacatattcaccttgagacagacactttctggtgatggagaagttgaaccaaaccaggatcatgtcttacagatagcccttgaaatttgcaaggagggtgtcctttctctttttgttcagaacctgccttcgcttggttgggagggtagaaaggatcttgcccactgctggtgcattttgttgaggcagaaggttgatgaaagttactgctgcgtgcagtatatcgaaaatcatgttgatcttctagatttccttgttgtatgctacaagaacttggaagtcgcattgaactgtggaaacatgttgcgagaatgcataaaatatccttcacttgcaaaatatatattggagtcaaatagcttcgagttgtttttccagtatgttgaattgccaaactttgatattgcttctgatgctctgaataccttcaaggatttgctcactaaacatgaagatgcagtctccgagtttctcatttcccattatgaacagttctttgaactctacaaaaggcttttaacttcagataattatgtgacaagaagacaatcagtgaagtttctttcagagtttctgttggaggccccaaatgctcagataatgaagcggtacattttggaagttcgttacttgaacattatgatgggtctactaaaggattcaagcaaaaatatcaggatatgttcctttcacatttttaaggtatttgttgccaatccaaacaagcctcgtgatattattcaagttttggtagacaaccacaaagaattattgaagttactccatgctcttcctgcaagcaaaggtgaagatgaacaacttgacgaggagcgagacttaattatcaaggaaatcgagaagctcgtgcgcttgtcagtatagaccctcaagaaattcaaaattaccctttgaaaaaaaacagtggtcgagaaaggcaatccatttcttccgtccttatttaaaaacctcctgtgtaatgtgatgccctgtatagaattgtttagtgttttatcatatttacagaaacagcttgtcatttcacaagaacatgaagcattgctgcatgcatatatggttcaactaaatctgcctcaccagattcgatatatatataccgtaatttgttg

SEQ ID NO: 10133 - DNA, 1279 bp, Oryza sativa
gcatagcaacaccgtaattccgttccgttccgttccgttccgtcgccccccccggccggcgagggcgagggcgatgtccttcttcttccgcatggcgtcgcggctgcggccgtcgacgccggaggaggtggtccgctccatcaaggactccttccaggccctccacaccaagaacggcgccagggctctagaagaggttgagaaaaacctctcgtcattgaggcaaatgctgtctggtgatggagaagcagaaccaaatcaagaacaagtcttgcaaataacccttgagatttgcaaggaggatgtcctttccctctttgttcagaatctgccttcgcttggttggggagtacgaaaagatctggttcactgctggtgcattttgctcaggcagaagtttgatgagagctactgctgtgtgaagtacattgagaaccatctggagcttttagatttcctagttggctgctacaagaacttggacgttgcactgaattgcgggaacatgttgagagaatgcataaaatacccaacacttacaaaatacatattggattccagtagcttcgaactgttttttgagtatgtggagctgccaaacttcgatattgcttctgatgctctgaacaccttcaaggatctgcttaccaaacatgaaacagttgttgctgagttcttgagttcccactacgagcagttctttgaactctacacaaggctcttaacatcacctaattatgtaacaagaagacaatcagtgaagttcctttcggaatttctgttggaggctccaaacgctcgaataatgaagcgttatattacggaagttcgtttcttaaatattatgattactctactgaaggattcaagcaaaaatatcagaatatgcgccttccatgtttttaaggtttttgttgccaatccgaacaagcctcgcagtatcatcgaggctttgatcgaaaatcgcagagaactgctgaagctactccaaaatcttcctacaagtaaaggcgaagatgaacttgatgaggagaggaatctaatcattcaggggattcagaagctggcctgctcatcagcatagacacttgaattaatggaatagctggtttagggaaactgcctttactgaaaatacatgacagggtgtgcctataagaattgcgtctttttggagtttgaaatgaaatagttgcaaatagatgcacaatacaaaatgagtgcaacgaattttgttctttagggacagtactaatgttgatatgtttttttctctgtt

SEQ ID NO: 10134 - DNA, 1390 bp, Oryza sativa
acccgcgatagcatagcaacaccgtaattccgttccgttccgttccgttccgtcgccccccccggccggcgagggcgagggcgatgtccttcttcttccgcatggcgtcgcggctgcggccgtcgacgccggaggaggtggtccgctccatcaaggactccttccaggccctccacaccaagaacggcgccagggctctagaagaggttgagaaaaacctctcgtcattgaggcaaatgctgtctggtgatggagaagcagaaccaaatcaagaacaagtcttgcaaataacccttgagatttgcaaggaggatgtcctttccctctttgttcagaatctgccttcgcttggttggggagtacgaaaagatctggttcactgctggtgcattttgctcaggcagaagtttgatgagagctactgctgtgtgaagtacattgagaaccatctggagcttttagatttcctagttggctgctacaagaacttggacgttgcactgaattgcgggaacatgttgagagaatgcataaaatacccaacacttacaaaatacatattggattccagtagcttcgaactgttttttgagtatgtggagctgccaaacttcgatattgcttctgatgctctgaacaccttcaaggatctgcttaccaaacatgaaacagttgttgctgagttcttgagttcccactacgagcagttctttgaactctacacaaggctcttaacatcacctaattatgtaacaagaagacaatcagtgaagttcctttcggaatttctgttggaggctccaaacgctcgaataatgaagcgttatattacggaagttcgtttcttaaatattatgattactctactgaaggattcaagcaaaaatatcagaatatgcgccttccatgtttttaaggtttttgttgccaatccgaacaagcctcgcagtatcatcgaggctttgatcgaaaatcgcagagaactgctgaagctactccaaaatcttcctacaagtaaaggcgaagatgaacttgatgaggagaggaatctaatcattcaggggattcagaagctggcctgctcatcagcatagacacttgaattaatggaatagctggtttagggaaactgcctttactgaaaatacatgacagggtgtgcctataagaattgcgtctttttggagtttgaaatgaaatagttgcaaatagatgcacaatacaaaatgagtgcaacgaattttgttctttagggacagtactaatgttgatatgtttttttctctgttatgtgttgtgtactgcatattcacaatctagattgtagagcactgttgatactaatgggttacagtttctgagaatacgtatgattcaaattcaaattccg

SEQ ID NO: 10135 - DNA, 4123 bp, Sorghum bicolor
ctccagtccagagcaagaggtaggaggagggaggaacaaaaaaagtccagagcaaataaaaaagttggttatgtgctgctgcctgctagtagctcttgcaaaggcaatgaatgcaacctcctcttcatcatgatgcgctgcatttagtggcattgaaaacacctgcaaggggtttggtgaggagctagggtgtgtgtggctggagctggtttctgcatctgcctctgagctcaagtttcgttcttcccccatctgggaatcgagctggactctgttctttctcctgtttgtagatttcaggaactattcagtcatatctcatccaatcccatcccattcccatttcattcatttaccaagtggttcttggtgaacagctggagaagaggcggaaaaagtggagtcaaatcctttgtgtttctctgctttctttttccccccttgtttgatgctcgtctgttttctttaatttgagttcttgatcctgccaaaagcaaaagccctcgccttttgtttgcaaaggtgaggtgtgtcctggcagttcaaaccctcccaccccaaagctccaatttctgcctgcagtttcctcgcctctgaatcccgttccctccacgaaaacctcagatttccacgcccactgctccaccgccgctgttcttgattcgcgcagaaccagctatcctgagatccagtttttcctcccgaaactgcagttttcctgcactcgttggtccaaaatctccccatttcgcacggaaatctcgggggtttgcccactccatgcctcactccgctcgttgatccagaccgccaccggagagctgcgatttttccgccccgggagcggcgtcttctcgatccgaggcccatgcatctgtcgctatggaagccgctatcccactgcgccgccgtcctcctcgccaagaaccaccggcgccgtggcggcgggggcggtgggcacggtggtggcagcaacggccaccgtgacgacccggcctccttcctgcggcagctacgggacgcgctcgacgccgcgtcggaggatggctccctctgcccgccgccagacaccgccggcgccgatgcggacgccgccgtgtcccgctcccgctccctggcgcgcctgcgcgcgcagcgggatttccttcgcgccacggccctggccgccgccgccggtccgttccggtctctctccgacctcccgctgctcccgcacgccatcgccaccttcctcgccatgtacccggactacgcctcaaccgccgatgtcgaccgcctccgcgtcgaccattattcccacctcgacgcccccggtgccggcagggtctgtctagactactgcggcttcggcctcttcgactccagttgggattcctcctcctcgtccttcacattgcacgagctcaatgccaatttgagcaaccatgcgctctatggcggcgctgagcccggcaccgtggagaatgacatcaaagagcgcatcttggagtacctgaatgtgccagccagcgagtatgcgctggtgttcacagtgagccgtgggtcagccttccggctgctcgctgagtgctaccccttcgagaccaaccggaggctgctgaccatgttcgaccatgagagccagtcagtcaattggatggcacagagcgcacgggcaaagggtgccaagacgcgcactgcatggttccgctggccaacactgaagctctgctcaacggagttgcggaaggagattgtcggcaagaagaaggggcggcgacgggatgctgcagttgggttgtttgtcttcccggcgcagtctcgcgtgaccggtgccaagtactcctaccagtggatggcgctggcgcaacagaatgggtggcatgtgatgcttgatgctggtgcacttggccccaaggacatggattcgctggggctctcactatttcggccggacttcattataacttcgttctatagggtgtttggtgcagacccaactgggtttggttgccttctgatcaagaagtcagtaattgggacactgcaggggagaaatgggtgtaatgcatcaggaatggtgaggattgttccagtgtttccacagtatctcagtgactcagttgatggatttgatgcatttgatgggcttgaagatgatgcaggcattaacaaagatgaaaagccatcttctaatgctcaaaatgggtcacagctgccagcattttcaggtgtctacacgtctgctcaggttagagagacttttgagagtgatcctggtcgggacagcagctcggacagggatggggctagcaccatctttgaagaaactgagagtgtctccatgggtgaggtcatgaggagtccagcattcagtgaggactgttcatcagagaactctttctgggttgatgtcggccagagcccattggggtcagagaagtctggtcagttcaagaaagggaaactgggttcaccattaccatcttcttggttcaacggaagaaagtgtaacaagaggatgtccccaaacttaacttccaggatatctagaagcccactttatgatggtcatgtgatttcctttgatgcagctgtgctatcagtctcgcaagatgcagactgcctcaaggaagaccctgaagaagacaattttgagaatggccggagaactcatttcaggcaggttagtgaaatacaagaggagccagaggtcgaagaggtggcatgccaacgtgctatgaatggtaatgcagagcacaaagaaagcgcgataagaagggagactgaaggggaattccgtctgctgggtggtagggatggcaacagcagatttaccggggggcgactcttcggtgttgaagagattgatggaggtttaagcatggggcgcagagtttctttcagcgcagaggctaatatcattgctgacaggctgactcgggcctcagatgctgctgaagcttctgggtatacattccgtgatgatgatggttgtgcaagtgatggatatgatgatgctcaggactggggcaggagggagccagagataatttgcaggcacattgatcatgttgatatgatgggactcaaccgaactactcttaggttgagatacttgatcaattggctagtaacttcacttttgcaactgaagttgccagactcaaaaggtggtgatggagtccctcttgtacacatctatggtcccaagattaagtatgaaaggggagcagctgttgcttttaatgtgaagcaaagtgatggaacatttattaatgctgaagttgttcaaaagattgctgagaaaaatggcatatctgttggcattggttttctcagtcatataaaagtagacatgaaccagaaacagttaaatggcacgctcgatatacctgaggcttcattttataagaatggacggagagacaataaaaaggtgaccataagagttgaagttgtgactgcttcacttggcttccttactaactttgaagatgtttacaatatgtgggcttttgttgctaagttccttgatccttcatttcttgaaagtgaacgcctcaccattgctgctgaccactcagaaggacaaaattaagcatgacatgtaacatagcaacaaaaagtgagaggaaggtgatttctccttctgttgaagcatatgttgtcttctatgctttcaaggggtagccagtagtggatttagcagatttgtttattctttgctagttcctcgatatgagtcatatgactttgtttttgttcatgtagagtttgctcaactcaaatatgtaccagcagctcatcagtagagctctttcccacggaacaatgtctgtaaagcagctcattggaaatgaaatagtttgagtggttttgtgcaagttcaattttgtgagatactcagtctcagatgtgtgttcgtaatgtggattttacgtcttagcaaacgtttcattttggtcaacttatgtgcatctcttcttgtgatctgaaagtttgaatatgttctgtggatccttgtgacatatggatgttgctgaatacttcttatctgttcataaagtaaaaccagaaacttagaatgctgtgaatttaggtttcaatattcttccaatttgcatctaaggctgcttaatct

SEQ ID NO: 10136 - DNA, 3999 bp, Setaria italica
aaaaagttggtggtgtgctgctgcagctgctagcagtagctcttgcaaggcaatgaatgcaacctccccctcatcatgatgcactgcatttagtggcattgaaaacacttgcaaggtgtttggtgagaggagcgagggtgtggctgctctctgcatctgagcttgagcgtcttcccccatctggaaatcgagcttggctctgttcttctcctgtttgtagctgtagatttcaagaactattccagcacatcccaccccatttcgtttcaccggtggttcgagcattgttctagctgctccacagctcaagagggagaaaaaaagtggagtcaaatcttttgtatttctcagctttcttttccccctccttgtttgatgctgtgctcttttctttaatttgagttcttgatcctgccaaaagcaaaagccctcaccttttgtttgcaaaggtgaggggtgtcctcgcatttcaaaccctctccaatccctcccactacagagctccaatctctccctacctgcagtttccccacccccaaatccgtttcccttccccggaaacctcggatttccacacccagagctccaccgccgcagttcttgattcacccagacccagttatccaaagatccagttttcgcacccgaaactgcagttttcctgcattgttggtccaagagcacaccgaaatctccccatttcccacggaaatctcggggtttcccccgctccatgcctcactccgctcgttgatccagaccgccgccggaaagctgcgatttttccgcccgggagcggcggtttctcgatccgaggcccatgcatctgtcgctatggaagccgctctcccactgcgccgccgtcctcctcgccaagaaccaccggcgccgcggcggcgggggcggctggcacggtggccacggcaacaacggccaccgtgacgatccgtcctccttcctccggcagctgcgggacgcgctcgacgcggcgtcggaggacggctccctctgcccgccgccggacgccgccggagccgatgcggacgccgccgtgtcccgctcccgttccctggcgcgcctccgcgcgcagcgggacttcctgcgcgccacggccctcgccgccgccgctggcccgttccggtcgatctccgacctcccgctgctcgcccacgccatcgccaccttcctcgccatgtatccggactacgcctcaactgccgatgtcgaccgcctccgcgtcgaccattactcccaccttgacgcccccggcgccggcagggtctgtctagactactgcggctttggcctcttcgactccagctgggattcctcctcgtcgtcctttacattgcacgagctcaatgccaatttgagcaaccatgcactctatggcggtgctgagcctggcaccgtggagaatgatatcaaagagcgcattttggagtacctgaatgtgccagccagcgagtatgcgctggtgttcacagtgagtcgtgggtcagcattccggctgcttgctgagtgctaccccttcgagagcaacaggaggctgctgacgatgttcgaccatgagagccaatcggtcaattggatggcgcagagtgcacgggcaaagggtgccaagacacgcgccgcgtggttccgctggccaacgctgaagctgtgctcgacggagctgcggaaggagatcgtgggcaagaagaaggggcggcgacgggatgctgcagttgggttgtttgtgttccctgcacagtctcgagtgaccggtgccaagtactcctaccagtggatggcgctggcacagcagaatgggtggcatgtgatgcttgatgccggtgcacttggtcccaaggacatggattcgctggggctctcgctgtttcggccagacttcattataacctcgttctacagggtgtttggttcagacccgactgggttcggttgccttctgatcaagaagtcagtaattgggagcttgcaggggagaaatgggtgtaatgcatcggggatggtgaggattgttcctgtgtttccacagtatctcagtgactcggttgatggattcgatgcatttgatgggcttgaagatgactcgggcattaacaaagatgaaaaaccagcttctaatgctcaaaatgggtcacagctgccagcattttcaggtgtctacacgtctgctcaggttagagagacttttgagagtgatcctggtcgtgacagcagctcggatagggatggggcaagcaccatctttgaagaaactgagagcatctctatgggcgaggtcatgaggagtccagcattcagtgaggactgttcatcagagaactctttctgggttgatgttggccagagcccattggggtcagagaaatctggccagttcaagaaggggaaactgggatcaccattaccatcttcttggttcaatggaagaaagtgtaacaagaggatgtcaccaaacttaacttctaggatatctagaagcccactttatgatggccatgtgatttcctttgatgcagctgtgctatcagtctcgcaagatacagactgcctcaaggaagaccctgaagaagaaatttttgagaatggccggagaaaccatttcaggcaggttagtgagatccaagaggagcctgaggtcgaagaggtggcatgccaacatgctatgaatggtggtgcagagcacaaagaaagcgcgataaggagggagacagaaggggagttccggctgctgggagggagggatggcaacagcagatttactggggggcgactctttggtgttgaagagattgatggaggtttaagcatggggcgcagagtttcattcagcacagaggctaatattattgctgacaggttgaatcgagcctcagatgctgctgaagcttctggatatacgttccgtgatgatgaaggttgtgcaagtgatggatatgatgatgctcaggactggggcaggagggagccagagataatttgcaggcacatcgatcatgttgatatgatggggctcaacagaactacccttaggttaaggtacctgatcaattggctagtaacttcacttttgcagctaaagttgccagactcaaaaggtggtgacggagtccctcttgtccacatctacggtcccaagattaagtatgaaaggggagcagctgttgcttttaatgtgaagcaaagtgatggaacatttgttaatgctgaagttgttcaaaagattgctgagaaaaatggtatatctgttggcattggttttctgagtcatataaaattagatatgaaccagaaacagttaaatggcacgcttgatatacctgaggcttcgttttataagaatggccgcagagacaataaaaaagtgactgtaagagttgaagttgtgactgcttcacttggcttccttactaattttgaagatgtttacaagatgtgggcttttgttgccaagttcttagatccttcatttcttgaaagtgagcgccttaccatttctgctgaccacttggaaggacaaacttgagcatgacatgtaacatagcaaccaccaaccaacaaatgagaggaaggtgatttctccttctgttgaagcatatgttgtcttttatgctttcgaggggtaatcaatagtggatttagcagatttgtttattctttgcttagttcctcgatatatgagttgtatgacttgtttttgttcatgtagaatttgctcaaatttgtaccagcagctcatcagtagaactctttcccatggaacaatgtttgtaaatcagctcactggaaatgaaatagttttgagtggctttgtgcaagttctattcgatcagatgtgtgttcataatggagcttttacatcttcggctaacatttcattttggtgtacttatgtgtgcttcttgattaaaattagcaacttagaaattctggggttccttgtaagacatggattttgctgagtacttccaccgtttctttttgtagggc

SEQ ID NO: 10137 - DNA, 4265 bp, Zea mays
ctacactactttattactactactccagtccagagcaagagggagcaaataaaaaaaaagagctggtggatgagcctgctgcctagcagagcttgcaagggcaatgaatgcaacctcctcctcctccaccaccatcatgacgcgctgcatttagtgggcattgaaaacgcctgcaaggggtttggtgcgagagaggagaggaggagcgagctagggtgtgtgtgtgtgtccgtgtgtggctgggtgctgcatctgcgtcgtctgatgatgatgatgagctcgagctccgtatcttccccctcacaccttgttgtgtgaatgaatcgagctgggccggccggactctgttcttctttctcctgtttgtggctgtagatttggagagctattactgttcttcagacatctcctgtccgatcccattctcattcgtttacgctatcccctggtggttcttgctcagctgctctgctggggaggggaggggcggaaagagaagagaagaggaggggagtcaaaaaaaaaatttctttgttgtgtttccctgcttttgttttgcctcccccaccccttgtttgatgatgctgtgttcttttctttaatttgagttcttgatcctgccaaaagcaaaagccctcacacccttctgctcgcaaaggcgagggctgtgtcctgccgcttcaaaccctccccacaaagctcggatttctgtctgcagtttccttacctctgaatcccgttccctccacgaaaacctcggatttccacgcccagtgttccaccaccgcaaagatccagtttttttcccctcccgaagccgcagtttccctgcgcgagctggtctggtccaagaacacacaccaaaaatctctctccccattgcgcacggaaatctcgggggggaggggtttccccgccccatgcctcagtccgtccgttgatccagaccgccacgccaccgggttcggtagctgcgggttttttccgcccgggagccgggagcggcgtcgtctcgatccgaggcccatgcatctgtcgctatggaagccgctgtcccactgcgccgccgtcctcctcgccaagaaccaccggcgccgcggcggcgggggcggcagcaacggccgccgtgacgactcgtccgccttcctccggcagctgcgggacgcgctggacgcggcgtcggaggacggctccctctgcccgccgccggacgccggcggcgccgacgcggacgcagccgtgtcgcgctcccgctccctggcacgcctgcgcgcgcagcgggacttcctccgcgccacggccctcgccaccgccgccggcccgttccggtccctctccgacctcccgctgctgccccacgccatcgccaccttcctcgccatgtacccggactacgcctccaccgccgacgtcgaccgcctccgcgtcgaccattactcccacctcgacgcccccggcgccggcagggtctgtctggactactgcggcttcggcctcttcgactccggctgggactcctcgtcctcgtccttcacattgcacgagctcaacgccaatctgagcaaccacgcgctctatggcggcgctgagcccggcaccgtggagaatgacatcaaagagcgcatcttggagtacctgaacgtgccagccagcgagtatgcgctggtgttcacggtgagccgtgggtcggcgttccggctgcttgctgagtgctaccccttcgagaccaaccggaggctgctcaccatgttcgaccatgagagccagtcggtcaattggatggcgcagagtgcgcgggcaaagggtgccaagacgcgcactgcatggttccgctggccaacactgaagctttgctcaacggagttgcggaaggagatcgtgggcaagaagaagggccggcgacgggatgccgcggttgggctgtttgtcttcccggcgcagtctcgcgtgaccggtgccaagtactcctaccagtggatggcgctggcgcagcagaatgggtggcatgtgatgcttgatgctggtgcacttggccccaaggacatggattcactgggtctctcgctattccggccggacttcattataacttcgttctacagggtctttggtgcagacccaactgggtttggttgccttctgatcaagaagtcagtaattgggacactgcaggggagaaacgggtgtaatgcatcgggaatggtgaggattgttccggtgtttccacagtatctcagtgactcggttgatggctttgatgcattcgatgggtttgaagatgatccaggcgttgacaaagatgaaaagccctcttctaatgctcaaaatgggtcgcagctgccggcattttcaggtgtctacacgtctgctcaggttagagagacttttgagagtgatcctggtcgggacagcagctcggacagggatggggcaagcaccatctttgaagaaacggagagtgtctctatgggtgagatcatgaggagtccagcattcagtgaggactgttcatcagagaactctttctgggtagatgttggccatagcccattggggtcagagaagtctggtcagttcaagaaagggaaactgggttcaccattaccatcttcttggtttaatggaagaaagtgtaacaagaggatgtccccaaacttaagttccaggatatctagaagtccactttatgatggtcatgtgatttcctttgatgcagccgtgctatcagtctcgcaagatgcagactgcctcaaggaagaccctgaagaagaaaattttgagaatgggcggagagctcatttcaggcaggttagtgaaattcaagaggagccagaggccgaagaggtggcatgccaacgtgctatgaatggtggcgcggagcacaaagaaagcgcaataagaagggagactgaaggggagttccggctactgggaggtagggatggcaacaacagatttaccggggggcgactcttcggtgttgaagagattgatggaggtttaagcatggggcgcagagtttctttcagcacagaagctaatatcattgctgacaggctgaatcgggcctcagatgctgctgaagcttctggatatacattccctggtgatgatggttgtgcaagtgatggatatgatgatgctcaggactggggcaggagggagccagagataatttgcaggcacattgatcatgttgatatgatgggactcaacagaactactcttaggttgagatacttgatcaattggctcgtaacttcacttttgcaactgaagttatcagactcaaaaggtggcgatggagtccctcttgtacacatctatggccccaagattaagtatgaaaggggagcagctgttgcttttaatgtgaagcaaaatgatggaacatttgtgaatgctgaagttgttcaaaagatcgctgagaaaaatggcatatctgttggcattggttttctcagtcatataaaagtagacatgaagcagaaacagttaaatggcacgctcgatataccggaggcttcattttataagaatggacgcagagacaataaaaaggtgaccataagagttgaagtcgtgactgcttcacttggcttccttactaactttgaagatgtttacaagatgtgggcttttgttgccaagttccttgatccttcatttcttgaaagtgaacgccttaccattgctgctgaccactcagaagggcaaacttgagcatgacatgtagcatagcaacaaaaaatgagagggaggtgatttctcctgttgaagcatatgttgtcttttatgctttcaaggggtaatcagtagtggatttagcagatttgtttattctttgcctagttccttgatatgggtcatatgacttgtttttgttcatctagagtttgcgcaactcaactatgtaccagcagctcatcagtagagctctttcccacggaacaatgtgtgtaaagcagctcaatggaaatgaaatagtttgagtgattttgtccaagttcaatttagtcaaatactcaacctcagatgtgtattcgtaatgtggtttttacatcttcagctaacatttcattttggtcaacttagcatctcacttgaaattcgtgatctgaaattttgaatatgttctgtggatcctttcaacatattgatgttgctgaatacttcctatctgttaataaagcaaaaccagaaaaatgctgtgactttaggttccaatattcttccaatttgcatctatggctacttaatctgcg

SEQ ID NO: 10138 - DNA, 3979 bp, Panicum virgatum
caaggcaatgaatgcaacctccccctcatcatgatgcactgcatttagtggctcttgaaacacttgcaaggggtttggtgagaggagctagggtgtgagtggtctctgcatctgagtttcttccccccatctggaaatcgagctaggctcgttctcctgtttgtggctgtagatttcgagagctattccagcacatcccgtcccatttcgtttcaccagttggttcgagcattgttcttgctgttcgacagctcaagagggagaaaaagtggggtcaaatcttttgtattccgctgctttctttctttgcgttatttgatgctgtgctcttttctttaatttgagttcttgatcctgccaaaagtgaaagccctcacctttgcaacaaagttgtgggggtgtcctcgcatttcaacccctcaccaatccctcccactccagagctccaatctctacctgcaatttccccacctccaaatccgtttccctcccaaaaacctcgaatttccacacccctccaccgcagcagttctttattcattcacccagacccagttatccaatgacccagttttccctcccgaaactacagttttcctgcatttgtcggtccaagaacacaacgaaatctccccatctcccacggaaatctcggggttttcgccgctcaatgcctcagactgctcgttgattcagatcgccgtcggaaagctgtgatttttccgcccaggagcggcggtttctcgatcagaggcccatgcatctatcgctatggaagccgctctcccactgcgctgccgttctcctcgccaagaaccaccggcgtcgcggcggcgggggcggcgggcacggtggccctggtagcaacggccaccgtgacgacccgtcctcattcctccggcagctgcgggacacactggacgcggcatcggaggacggctccctctacccgctgccggacgccgccggagccgatgcggacgccgctgtgtcccgctcccgctccctggcgcgcctgcgcgcgcagcgggacttcctgcgcgccaccgccctcgccgccgccgctgggccgttccggtcgctctccgacctcccgttgctctcccacgccatcgccaccttcctcgccatgtacccggactatgcttcaaccgccgatgtcgaccgtcttcgagtcgaccattactcccacctcgacgcacctggtgccggcagggtctgcctagattactgcggcttcggcctcttcgactctagctgggattcttcttcatcgtcctttacattgcacgggctcaatgccaatttgagcaaccatgcgctctatggcggtgcagagcccggcaccgtggagaatgatatcaaagagcgcatcttggagtacctcaatgtgccagccagtgagtatgcgctggttttcacagtgagccgagggtcagcatttcggttgcttgctgaatgctacccctttgagaccaaccgcaggctgctgaccatgttcgaccatgagagccagtcagtcaactggatggcgcaaagtgcacgggcaaagggtgccaagacgcgcaccgcgtggttccgttggccaacactgaagctctgctcgacggagctgcggaaggagattgtgggcaagaagaaggggcggcgacgggatgctgcagttgggttgtttgttttccctgtgcagtctcgggtgactggtgccaagtactcctaccagtggatggcactggcacaacagaatgggtggcatgtgatgcttgatgccggtgcacttggtcccaaggacatggattcgctggggctctcgctgtttcggccagacttcattataacttcattctacagggtgtttggtgcagacccgactgggtttggttgccttctaatcaagaagtcggtgattgggagcttacaggggagaaatgggtgtaatgcgtcagggatggtgaggattgttcctgtgtttccacagtatctcagtgactcagttgatggatttgatgcatttgatgagcttgaagatgactcgggcattaacaaagatgaaaagacagcttctaatgctcaaaatgggtcgcatctgccagcattttcaggtgtctacacgtctgctcaggttagagagacttttgagaatgatcctggtcatgacagcagctcggatagggatggggcaagcaccatctttgaggaaactgagagcatctcgatgggtgaggtcatgaggagtccagcattcagtgaggactgttcatcagaaaactctttctgggttgatgttggccagagcccgttggggtcagagaaatctggccaattcaagaaagggaagctgggatcaccattaccgtcttcttggtttagcggaagaaagtgtaacaagcggatgtcaccaaacttaacctccagaatatcgagaagcccactttatgatggtaatgtgatttcttttgatgcagttgtgctatcagtatctcaagatgcagactgcctcaaggaagaccctgaagaagaattttttgagaatagtcggagaactcatttcaggcaggttagtgagatccaagaggagcccgatgtcgaagatgtagcatgccaacatggtatgaatgggggtgcagagcacaaagaaagtgctataaggagggagactgaaggggagttccggctgctgggagggagggatggcaacaacagatttactggggggcgactctttggtgttgaaaacatcggtggagatttaagcatggggcgcagagtttcattcagcacagaggctaatattattgctgacaggatgaaccgggctttggatgctgctgaagcttctggatatacattccgtgatgatgatggttatgcaactgatggatgtgatgatgctcaggattggggcaggagggagccagagataatttgcaggcacattgatcatgttgatatgatggggctcaacagaattactcttagattaagatacttgatcaattggctagtaacttcacttttgcagctaaagttgccagactctaaaggtggtgacggactccctcttgtacacatctatggtcccaagattaagtatgaaaggggagcagctgttgcttttaatgtgaagcaaagtgatggagcatttgttaatgctgaagttgttcaaaagattgctgagagaaatggtatatctgttggcattggttttctcagtcatataaaattagatatgaaccaaaaacagttaaatggcgtgctcgatatacctgaggcttccttttataagaatggacgcagagacaataaaaaggtgactgtaagagttgaagtcgtgactgcttcacttggcttccttactaactttgaagatgtttacaagatgtgggcttttgttgccaagttcttagatccttcatttcttgaaagtgagctccttaccatttctgctgaccactcggaaggacaaacttgagcatgacatgtaacatagcaaccaccaccaaacaaatgagaggaaggtgatttctccttatgttgaagcatatgttgacttttatgctttggaggggtaatcaatagtggttttagcagatttgtttattcgttgcctagttcctctatatatgagccatatttgtttttgttcatgtagaatttgctcaaatatgtaccagcagctcatcagtggagctctttcccacggagcaatgtttgtaatgcagctcactggaaatgaaaatagtttgagtggctttgtgcaagttctattcgatcagatgtgtgttcataatgcagttttacatcttcagctaacatttcattttggtgtactcatgtgttctttgttaaaattggcaaattaaaaattctgggagtccttgtaacacctggatgttgctgaatactcctacattttcttttttgtagggcgtataggaattcagaaaagtcaaacttcacaagattgactgacagttag

SEQ ID NO: 10139 - DNA, 3378 bp, Panicum virgatum
gcccatgcatctgtcgctatggaagccgctctcccactgcgccgccatcctcctcgccaagaaccaccggcgtcgcggcggtgggagcggccggcacggcggccacggtagcaacggccaccgtgacgacccgtcctcattcctccggcagctgcgggacacgctggatgcggcatcggaggacggcttcctccacccgctgccggactccgccggagccgatgcggacgccgccgtgtcccgctcccgctccctggcgcgcctgcgcgcgcagcaggacttcctgcgcgccaccgccctcgccgccgccgctgggcctttccggtcgctctccgacctcccgttgctctcccacgccatcgccaccttcctcgccatgtacccggactatccttcaaccgccgatgtcgaccgtcttcgcgtcgaccattactcccacctcgacgcacctggtgccggcaaggtttgcctagattactgcggcttcggcctcttcgactctagctgggattcttcttcgtcgtccttcacattgcacgggctcaatgccaatttgagcaaccatgcgctctatgggggtgcggagcctggcactgtggagaatgatatcaaagagcgcatcttggagtacctcaatgtgccagccagcgagtatgcactggtttttacagtgagccgagggtcggcatttcggctgcttgctgaatgctaccccttcgagaccaaccgcaggttgctgacgatgttcgaccatgagagccagtcagtcaactggatggcgcagagtgcacgggcaaagggtgccaagacgcccaccgcatggttccgttggccaacactgaagctctgctcgacggagctgcggaaggagattgtgggcaagaagaagggtcggcgacgggatgctgcagttgggttgtttgttttccctgcgcagtctcgggtgaccggcgccaagtactcctaccagtggatggcactggcacagcagaatgggtggcatgtgatgcttgatgctggtgcacttggtcccaaggacatggattcgctggggctctcgctgtttcggccggacttcattataacttcattctacagggtgtttggtgcagatccgactgggtttggttgccttctaatcaagaagtcggtaattgggagcttacaggggagaaacgggtgtaatgcgtcggcgatggtgaggattgttcctgtgtttccacagtatctcagtgactcagtcgatgggtttgatgcatttgatgagcttgaagatgactcgggcattaacagagatgaaaagccagcttctaatgctcaaaatgggttgcaactgccagcattttcaggtgtttacacgtctgctcaggttagagagacttttgagaatgatcctggtcgtgacagcagctcggatagggatggggcaagcaccatctttgaagaaactgagagcatctcgatgggtgaggtcatgaggagtccagcattcagtgaggactgttcatcagaaaactctttctgggttgatgttggccagagcccgttggggtcagagaaatctggccaattcaataaagggaagctgggatcaccattaccgtcttcttggtttaacggaagaaagtgtaacaagaggatgtcaccaaacttaacctccaggatatcgagaagcccactttatgatggtaatgtgatttctttcgatgcagttgtgctatcagtatctcaagatgcagactgcctcaaggaagaccctgaagaagaattttttgagaatggtcggagaactcatttcaggcaggttagtgagatccaagaggagcccgatgtcgaagaggtagcatgccaacatggtatgaacgggggtgcagagcacaaagaaagtgctataaggagggagactgaaggggagttccggctgctgggagggagggatggcaacaacagattcactggggggcgactctttggtgttgaagatatcggtggaggtttaagcatggggtgcagagtttcattcagcacagaggctaatattattgctgacaggatgaaccgggcttcggatgctgcggaagcttctggatatacattccgagatgatgatggttgtgcaactgatggatatgatgatgctcaggattggggcaggagggagccagagataatttgcaggcacattgatcatgttgatatgatggggctcaacagaactactcttagattaagatacttgatcaattggctagtaacttcacttttgcagctaaagttgccagactctaaaggtggtgacgaactccctcttgtccacatctatggtcccaagattaagtatgaaaggggagcagctgttgcttttaatgtgaagcaaagtgatggaacatttgttaatgctgaagttgttcaaaagattgctgagaaaaatggcatatctgttggcattggttttctcagtcatataaaattagatatgaaccaaaaacagttaaatggcatgctcgatatacctgaggcttccttttataagaatggacgcagagacaataaaaaggtgactgtaagagttgaagtcgtgactgcttcacttggcttccttactaactttgaagatgtttacaagatgtgggcttttgttgccaagttcttagatccttcgtttcttgaaagtgagctccttacaatttctgctgaccactcggaaggacaaacctgagcatgacatgtaacatagcaaccaccaccaaacaaatgagaggaaggtgatttctccttttgttgaagcatatgtttgacttttatgctttcgaggggtaatcaatagtggttttagcagatttctttattctttgcctagttcctctatatatgagccatatttgtttttgttcatgtagaatttgctcaaatatgtaccagtagctcatcagtagagctctttcccacggaacaatgtttgtaaagcagctcactggaaatgaaaatagtttgagtggctttgtgcaagttctattcgatcagatgtgtgttcataatgcagttttacatcttcagttaacatttcattttggtgtactcatgtgttattctttcttaaaattggcaaatcaaaaattctgggagtccttgtaacacctggatgttgctgaatactccgacagttttaaattgttgattctttgttgccgccctcggggatgtgcaaatcagcctacacatccattggtcacttgaggaaaattgtgaagaatacaaccattggccattaatatataaaaacacttgcgaaatcttaagtatcgttatgtgcctgcaattgatttggtaattgagtataaatactatgctttcttccatatctagatcccataatta

SEQ ID NO: 10140 - DNA, 3817 bp, Brachypodium distachyon
aaaaaggttggtgctgctggtgctggctgctagtagtagttcctggaaatgaatgcaacctctcctattcatggtgatgcaattgcatttaagtggcattgaaaccgcttgcaaggagtttggtgagaggagggaggatctggagttggagtgagtgaactgagcagagcagaggctgctgcttgctttgtcagctcatccccattcctgagagctgaccgctctcgctggatttccatttcctgagaggagagctcttgatgctgcagaagcaaagaaagcggagtcaaatctttgggatttcttttttccatcctgttttctttctccttctttgccttgccacccctttaatttgagttcttgatcctgccaaaagcaaaagcccccactttctgctgggaaaggcgaagggtgtcattgcatttcgtttcatttcaacctccctcccctccatttccgcttcgaagaaatctgcagttttccccaacctcaaatccacaagaaatttctcaaggagtgctcaggttctggcgcttctgatccccattgcccccctccagagatctaaattttcgttccacaagaagctgcaggctttccgcgctttgttgtttgttgatccgaaatctacccagaaatcccggggattttttccgttccgctccatgcctcgttgaatccatccaaactgccgcagaggaggagctgcgatttttccggctgcgagcgccgccgatccgagagtactcaggggaggtcccggccccatgcatctctccctgtggaagccgctctcccactgcgccgccatcctcctcgccaagaaccaccggcggcgcggcgggggcggtgggggcggtggaggcggcggcggccatggcagcaacggccgccgtgacgacccgtcgtcgttcctccggcagctgcgcgacgcgctcgacgccgcgtcggaggagggctccctctgcccgccgccggatgcgcaggccggagcggacgcggacgccgccgtgacccggtcccgctccctggcgcgcctccgcgcgcagcgcgacttcctccgagccaccgccctcgccgccgccgccggcccgttccgctcgccctccgacctgccgctcctcgcccacgccatagccaccttcctctccatgtacccggaatacgcctccacctctgacgtcgaccgcctccgcctggaccattactcccaccttgatgctcccggcgcaggcagggtctgcctggactactgcggcttcggcctcttcgactccagctgggactcctcctcatcgtgcttcacattgtccgagctcaatgccaatctgagcaaccatgctctatatggtggtgccgagcctggcaccgccgagaacgacatcaaggagcggatcttggagtacttgaatgtgccggccagcgagtatgccctggtgttcacggtgagccgggggtcagcgttcaagctgcttgctgagtgctacccgttcgagagcaatcggaggctgctcaccatgttcgaccatgagagccagtctgtgaactggatggcgcagagtgcgcgagcaaagggtgccaagacgcgcaccgcattgtttcgctggcccactcttaagctctgctcaacggagctgcggaaagagatcgtgggaaagaggaagggaaggcggcgggatgctgcagccgggttattcgtcttccctgcgcagtctcgggtgactggcgccaagtactcctaccagtggatggcactggcgcagcagaatggctggcatgttatgcttgatgccggcgcgcttggtcccaaggacatggactctctggggctctcgctgttccggccggacttcattataacctcattctacagggtgtttggtgcagacccaactgggtttggttgccttctgatcaagaagtcggtgattgggatcttgcaagggaggaatggctgtaatgcctctgggatggttaagattgttccagtgttcccacagtacctgagtgactccatcgatgaatttgatgcactggaagctgatgggctcgaagatgactctggcgctccaaaagatgaaaatccagtgtctgatgtccggaatgggtcgcagttgccagcattttcgggcgtttacacatctgctcaggtcagagagacatttgattgtgaccctggtcgtgacagtagctcggatagggatggggcgagcaccatttttgaagaaacagagagcttatcagtcggcgaggtcatgaggagcccagcattcagtgaggactgttcgtcagagaactctttctgggttgatgttggccagagcccattgggatcagagaagtctggtcagttcaagaaagggaaactgggatcaccattaccatcttcttggttcactggcagaaagaataacaagaggatgtcgcctaacctagcgtcgaggatatcaagaagcccactttatgatggcaatgtgatttcttttgatgctgctgtactatcggtttcacaagatgtagattgcctcagggaagaccctgatgaagaaatccttgagaatggccggagaaatcatttcaggcaagtcagtgaaatccaagaggagccagaggttgaagaggttgcatgtcggcatgctatgaacggcggtgtggatcacaaagaaagtgcaataagaagggagactgaaggagaattccggctgctgggagggagggacggaaacagcaggtttaccgggggtcgtctgtttggcgttgaagagattgatggaggtataagcatggggcgcagggtttcattcaacactgaggcgaatatgattgctgacaggctacatcgggcctctgacgctgctgaagcttcaggatatccattccgtgatgatgatggttgcataagtgatgcgtatgatgatgatgctcaggactggagcaggagggagccagagatagtttgtaggcacattgatcatgttgatatgatggggctcaacagaacaactcttaggctaaggtaccttatcaattggctagtaacttcgttgttgcagctgaggctgccaggctcaaaagacgttgatggggtccctcttgtccacatttatggcccaaagattaagtacgaaaggggagcagctgttgctttcaatcttaagcaaagtgatggcactttcatcaatgcagaagttgttcagaagattgctgagaaaaattgcatatctctcggcatcggttttcttagtcatataaagatagatccaaaccagaaacagtcaaatggagcactagatatacccgaggctaccctttacaagaatggccggagagacagtaaaaaggtgactttaagagttgaggttgtgaccgcttcgcttggcttccttactaactttgaagatgtgtacaagatgtgggcatttgttgccaagtttctagatccttcatttctggaaagtgaacgcctcgccatagccactgaccactcagaaggacaaatttgagcttgatgtatcatttggcaactagcaaaggagaggaaggtgacctttctccttttgttgagccatcgtttatgtttcgaggggtaattggtagtggatttagcagatttatttattctttgcctagttcctcgacatgtgacttatttttgtgtcatgtagagtttgctcaaatatgtaccagcagctcatcagtagagctcctttccactgaacattgtttgtaaagcagctcactgaaaatgaaagttttgagtgctttgttacattcttgttggaaatgtgttcatgatgaatatacatcttcagtt

SEQ ID NO: 10141 - DNA, 1816 bp, Panicum virgatum
ccttcccctggtttcctcaacgctttccctatcttctccattccctccgcccccacttctctctgccgccaacgatattgcggcactgctaaaaaaaacgatattgcagcaagctccgaggcaacgaaaaggaagccgatcagatcgaacaacatccatcgttccgtccatgggaaggcgggagatgagcgggcggctgtcggccgagtaccagggcctggaggtgaaggtgcccagcctcttccggtgccccatctcgctggacgtcatgcggtcgccggtgagcctctgcaccggtgtcacctacgagcgcgcctccatccagcgctggctcgactccgggaacactacctgcccggccaccatgctcccgctcccctccacggaccttgttcccaacctcaccctgcgccgcctcatcgcgctctgggcgtccactgccgcgcccgcctctccctcctcctcatcgtcgccccccgcggcgtccgccgtcggtcccacgccggccgccgccgcggctgagctccttcgccgggtcgccggccccggcgccgacccctgccccccgctccggaagctcgcggcttttctaaacgacgacgacgtggacgagttcgacaagaacgcgttcgcgagggcggccggcgccgcggagaccgtggcgtccgtcctccggcgggcggagaaggaggagggcctcgaggcagcggaggccgccgtgcgcgtcctggccgcgatcgcggcgtccgactgcatcgaggaggagaacaagcggcgcgtggccgcggcgctcgcggccgacgcggcgtccacggcggcgtccctggcgcgcgtgctgcggtgcgggagcgcgctggaggcccgcgtcgacgcggcgcggctggtggagtcgctgctccgcaatgcggcggcgccgggcgcgcgcgcggcggtggccgagtccgagccgctggtcgcggagctggtccgcctgatcggccccgcggacgagaagggcggcctggaccggagcgccgtggcggcggggctgtcgtgcctggcggccatcgcggcgacgcggcgcgcccgcgcggagatggtccggctgggcgccgtgcccgcggccgtgcgcgtgctgaccgccgacgccgggtgcccggcccaggcgctgcgcgtgctggaggccgcggtggggtgcgccgagggccgcgccgcgatctgcgagtccgcggagacggccgtcccggcggtggtgtcgcggatgatgaagggcgggatgggcggcgcggaggcggccgtgtcggtgctgtgggcggtgtgccaccggtaccgggaccggagggcggtggcggcggcggcggcggtgcgagggcgggctggcgcggctgctgctgctgatgcagagcgggtgctcggcggcggcgcggcagatggcgtcggagctgctcaagatcttcaaggtgaacggcaagagctgcctcggcgggtacgactccaagaccagccacatcatgccgttctgaccggcgaccaccccaagcgggtgatgcatgccaattgccatgggtggtgggcggatggaacaggggaaattcctctgtttttctctcttttttcctgattcgcattcttggttgggtggaagttgataggagaaaagaaattattggttcccggggaggaagacaaacctgtacatgggtagatcattttggtagaaaaaaaaaggaaattcaaggatgagaaaaattcatctccacggttcgattcaacccaattctcggtgtttgttgttggccaaatcacatggttgctcttctcatacggtcaaacaaaa

SEQ ID NO: 10142 - DNA, 4599 bp, Panicum virgatum
cggactcgttcctgcttgctgcttcctgcttgctgcttcctgcggacttcgtcttctcccccccactcggtgctcggagacgagctcaccaaatccaccccttccgatccccactattactagtactccccctcccccttcacccctcgctccgtccccagagcttccctccccattgccaccgccggcccagtgccccctcctcttcccttcagttccttcaccagagactagttcaatcaaggaagaggaggagcaccgcacgccgccattactctccccttcctgcttgcgcctttgacccgccctcggttcggagtcgaatgatcaaccactgaccgatccctagctgctccacttccctgaaacggacgccatggcctccaacggcggcggcggcctccgccacagcaacagcagccgcctctcgcgcatgtcctactccggcgaggacggccgcggcgcccaggcccccgccgccgaccgccccatggtcaccttcgcccgccgcactcactccggccgctacgtcagctactcccgcgacgacctcgacagcgagctcggcggcgacttctcgcccgaccaccaggagttccacagctaccacgtccacatcccggctacgcccgacaaccagcccatggaccccgccatctccgcccgcgtcgaggagcagtacgtctccaactcgctcttcaccggcggcttcaacagcgtcacgcgcgcccacctcatggacaaggtcatcgagtccgaggccagccacccgcagatggccggcgccaaggggtcctcctgtgccatcaacggatgcgacgccaaggtcatgagcgacgagcgcggcgaggacatcctcccctgcgagtgcgacttcaagatctgcgccgagtgcttcggcgacgccgtcaagaacggcggcgccgtctgccccggctgcaaggagccatacaagaacacagagctggaggatgtggttggcggcgcggctggggcgagggccaccctgtcgctgccaccgccgcctggtgccggtggcactgcagcgtccaggatggagaggcggctgtcgataatgcggtcgcagaaggcaatgaccaggagccagaccggggactgggatcacaaccgctggctctttgagacgaaagggacatatgggtatggcaatgcaatatggcccaaggagaatgaggtggagagcggtggtggtggtggaggcgggctaggtggagctgacggccagccggctgagttcaccaccaagccatggaggccgctcactcgcaagctttccatccctgctggcatccttagcccgtacagacttctcattctgattcgtatggccgtccttggtctgttccttgcatggagaattaagcacaaaaatgaggacgcaatgtggctgtggggcatgtctgttgtttgtgaactctggtttggcttttcatggctactcgatcagttgccaaagttgtgccctgtgaaccgagcaaccgaccttgctgtcctgaaagacaagtttgagactccaactccgtcgaaccctactggacgatcagatctaccagggcttgatatatttgtgtccactgctgatccagagaaagaacctccactggtcacagcaaacactatcctctccatccttgctgctgattaccctgtggagaagctttcttgctatgtttctgatgatggaggagctctcctgacatttgaagccatggctgaagctgcaagctttgccaacatgtgggttcctttctgtcgcaagcacaacattgagcctcgcaatcctgagagctacttcaacctgaagagggatccatacaagaacaaggtgcgtccggactttgtcaaggacagaaggagggtgaagagggagtacgatgagttcaaggtcaggatcaatgggctgcctgattcaatccgccgtcgctctgatgcataccatgccagggaggaaatcaaggccatgaaaaggcagcgagaggctgctcttgatgatgcagtggagcccgttaagatccctaaagccacctggatggctgatggcacacattggcctggtacctggattcagccttccgctgagcatacccgtggtgaccatgctggaataattcaggtgatgttgaaacctcctagtgatgatcccttgtatggcagccctggtgaagaagacagacctcttgatttcactgaggttgacatccgtttgccaatgttggtgtacgtgtcccgagagaagcgccctggttacgaccacaacaagaaggctggtgcgatgaatgccttggtccgttcatctgctgtgatgtcaaatggccccttcatcctcaatcttgactgcgaccactacgtttacaactcccaagctttccgtgaaggaatgtgcttcatgatggaccgtggtggtgaccgtattggttatgtccagttcccgcagcggtttgagggcattgatccatctgatcggtatgctaaccacaacactgtcttctttgatgtcaacatgcgcgcactggatggtctcatgggaccagtctatgtgggcactggctgtcttttccgccgtgttgcactatatggatttgaccctccccgcaccaaggagcatggtggctgctgcagctgctgcttccctcagagacgcaaggtcaaaacttcagctgctgcaccggaagagacccgggctctgcggatggcagactttgatgaggatgaaatgaacatgtcatcattccccaagaagtttggtaactcgaacttcctcatcaactctattccaattgctgaattccaagggcgtcctctggccgatcaccctggtgtcaagaatggccgccctccaggtgctctcactgtgccccgcgaccttcttgatgcctccacagttgctgaggccatcagtgtcatctcatgctggtatgaagacaagactgagtggggccaccgtgttggttggatttatggttcagtcacagaggatgtggttactgggtaccggatgcacaaccgtggatggaaatctgtgtactgtgtcaccaagcgtgatgctttccgtggcactgcaccaattaatctcactgaccggctccaccaggtgctccgatgggctactggttcagtggaaatcttcttctcccgcaacaacgctctgctcgcaagccgcaagatgaaggttcttcagaggatcgcgtacctgaatgtgggcatctacccattcacatcaatcttcctcattgtctactgcttcctgccagcgctgtccctcttctctgggcagttcattgtgaagcaactcaacgtgaccttcctgacatacctgctggtgatcaccctaactctgtgcatgcttgcggtgctggagattaagtggtcagggatcagcctggaggaatggtggaggaacgagcagttctggctgatcggaggaacgagcgcccatcttgccgctgtgctgcagggccttctgaaggtgattgccggcatcgagatctccttcacactgacatccaagtcaggcggtgatgatgtggacgacgagtttgcagacctgtacaccgtgaagtggacgtcgctgatgatcccgccgatcgtgatcatgatggtgaacctgatcgccatcgcggtggggttcagccggaccatctacagcgagatcccgcagtggagcaagctcctgggtggcgtgttcttcagcttctgggtgctggcccacctgtacccgttcgctaaggggctgatggggcggaggggccggacgccgaccatcgtcttcgtctgggccggcctcttgtccatcaccatctcgctgctgtgggtggccatcaacccgccctcgcagaattcccagatcggtgggtcgttcacgttcccgtgagcggtcacaccattacatgaattccttgcttcgtgccggttgctcagcgctggtgggaaggggaattctgactgctgaaaaggctaagtgcttcggttaaaatccatagtgctgtcatatgagttacaatagttcttttgttctttatttaatttttgccctgtactgtcccgatatgagaattggttctgctggaccatgaaacgagtacaaattttcaagttgttccactgtgcctgtgtttttcgctaggtgttgggatgcttgtgctgcattggctactctgaattatcgtgtacagtgtcaagacatcagcaatgacagtgaaagctcctcggcagcatgcttgtgcgatacacctgtggcgttgctgggtctgcaagaccaggcatggcggagaagaggtcagaggagagtgcgtgctgtttctttctgtgacccattcaggttcgctcggagcctggcgattgtttcttgtggggtttggtacgagcgagagagggattgacagagagttttggatagagacgtggcacgacttgttggcccatacgctttcttctcttcctgagcaaccacaatgtatataagtagtctatatggatagtttttgtgtaagtagtctatagctattgctgttgctgaaatgtatatggatctgttataatggaatctggagtgagagagaataagatggaagagagagt

SEQ ID NO: 10143 - DNA, 3609 bp, Echinochloa colona
cgccgaccgccccatggtcaccttcgcccgccgcacccactccggccgctacgtcagctactcccgcgacgacctcgacagcgagctcggcggcagcggcgacttctcccccgaccacgaggagttccacagctaccacgtccacatcccggccaccccagacaaccagcccatggaccccgccatctccgcccgcgtcgaggagcagtacgtctccaactccctcttcaccggcggcttcaacagcgtcacgcgcgcccacctcatggacaaggtcatcgagtccgaagccagccacccgcagatggccggcgccaagggatcctcctgcgccatcaacgggtgcgacgccaaggtcatgagcgacgagcgcggcgaggacatcctcccctgcgagtgcgacttcaagatctgcgccgagtgcttcggcgacgccgtcaagaacggcggtggcgtctgcccaggctgcaaggagccctacaagaacacggagctggaggatgttgtcagtggcgcggccgggccaagggccacactctcgctgccgcccccgcccggtgctggcggcggcgccgcgtccaggatggagaggcggctgtcgataatgcggtcgcagaaggccatgaccaggagccagaccggggactgggatcacaaccgctggctctttgagacaaaagggacatatgggtatggcaatgccatatggcccaaggagaatgaggtggagagcggcggtggcggcggaggcgggcttggtggaaccgatggccagccagctgagttcaccaccaagccatggaggccgctcactcggaagctttccatccctgctggcatccttagcccatacaggcttctcattcttatccgtatggccgtgctcggtctgttccttacatggagaattaagcacaagaatgaggatgcaatatggctgtggggcatgtctgttgtttgcgaactctggtttggcttttcatggctactcgatcagttgccaaagttgtgccctgtgaaccgagctactgaccttgctgtcctcaaagacaagtttgagaccccgacgccatcgaaccctactggacgatcagatctaccaggcctcgacatctttgtgtccactgctgatccagagaaagaacctccattggtcacggcaaacactatcctctccatccttgctgctgactaccctgtggagaagctttcctgctatgtttctgatgatggaggggctctgctgacatttgaagccatggctgaagctgctagctttgccaacatgtgggttcctttctgtcgcaagcacaacattgagcctcgcaatcctgagagttacttcaacctgaagaaggatccatacaagaacaaggtccgtcaggattttgtcaaggacagaaggagggttaagagggagtatgacgagttcaaggtcaggatcaatgggctgcctgactcaatccgccgccgctctgatgcttaccatgccagggaggaaatcaaagccatgaaaaggcagcgagaggctgctcttgatgacgcagtggagcctgttaagatccctaaagctacctggatggctgatggcacacattggcctggtacctggattcagccttccgctgagcatacccgtggtgaccatgctggaataattcaggtgatgctgaaacctcctagtgatgaccccttatacggcagcactggtgaagaaggcagacctcttgatttcactgaggttgacatccgtttgccaatgttggtctacgtgtcccgagagaagcgccctggttatgaccacaacaagaaggctggtgcaatgaacgccctagtccgttcatctgctgtgatgtcaaatggccccttcatccttaaccttgactgtgaccactacgtttacaactcccaagctttccgtgaaggcatgtgcttcatgatggaccgtggtggtgaccgtattggctatgtccagttcccacagcggtttgagggaattgatccatcagatcggtatgccaaccataacactgtcttctttgatgtcaacatgcgtgctctggatggtatcatgggaccagtctatgtgggcactggctgtctcttccgccgtgttgctctctatggatttgaccctccacgcaccaaggagcatggtggctgctgcagctgttgcttccctcagaggcgcaagatcaaagcttcagctgcccaaccagaagagacccgggcactgcggatggcggactttgatgaggatgaaatgaacatgtcatcattccccaagaagtttggtaactcgaacttcctcatcaactctattccaattgctgaattccaagggcgcccgctagcagatcatcctggtgtcaagaacggccgccctccgggtgctctcactgtcccccgggaccttcttgatgcctccacagtcgctgaagccatcagtgtcatttcatgctggtatgaagacaagactgagtggggccaccgtgttggttggatctatggttcagtcacagaggatgtggtcactgggtaccggatgcacaaccgtggatggaaatcagtgtactgtgtcaccaagcgagatgccttccgtggtactgcacccatcaatctcactgaccgtctccaccaggtgctccgatgggctactggttcagtggaaatcttcttctcccgcaacaatgcactgctcgcaagccgcaagatgaagttccttcagaggattgcatacctgaatgttggcatctacccattcacatcaatcttcctcattgtctactgcttcctgccggcgctgtccctcttctctggacagttcatcgtgaagacactcaacgtggccttcctgacctacctgcttgtcatctcactgacactgtgcatgctggcggtgctggagatcaagtggtcagggatcagcctggaggaatggtggcgtaacgagcaattctggctgatcggaggaacgagcgctcacctggccgctgtgctgcaggggctcctgaaggtgattgccggaatcgagatctccttcacgctgacgtctaagtcaggtggcgacgacgtggacgatgagtttgcggacctgtacattgtgaagtggacgtcactgatgatcccgccaatcgtgatcatgatggttaaccttatcgccatcgcggtggggttcagccggaccatctacagtgagatcccgcagtggagcaagctcctgggcggggtgttcttcagcttctgggtgctggcccatctgtaccccttcgccaaggggctgatggggcggaggggtcggacgccgaccattgtcttcgtctgggccggcctcctgtccatcaccatctcgctgctgtgggtggccatcaacccgccgtcgcagaactcccagatcggcggatcgttcacgttcccgtgagcgctcctcgtgccagattatcctcacatggaagggagttctgtgtgcagaaatggctaggcgtatctgttaaaattgatatataccagttattataatagttctttcgttcttttgattttgttctgttacaatatgagagttggttctgttggaccatgaaatgagtacaaatttttcaagtttta

SEQ ID NO: 10144 - DNA, 4333 bp, Musa acuminata
aaaaggccgctccttttctaagcccctctctcccttcctcccgtcactttcccacagccaaaccctgaccaaagcagtccgccatggtgacgatctggtgatacagcgagaggcgccacctccgctcgccggccagcttcctccctcgatcgcgctccatcgtaggccacgtcgcctccccttgatccggttctcgcaggaacaagacaggagctgaaccgttcagctgtgttgtctgagtgaagaatcggtcgggatctgcgtcaaatccagcaacctctgaaacgcctcttatagaaagacctggtcgagcgccctctcacactcggagaagaagcattattagtttatcccccctctctctcgtcggactctcaggtccttgtctctgtccctttttcccaagtttgtggatagtggaacggggatatttacgtatttaagagcgaagagacatggattcaaacaatgttcttagggtcagtagatccgtgcgggtagcctcgtcatctgatcagcagcaggccgatggtagaccgacgaatgtgccgcccactgtcacctttgcccgtcgaactccgtcgggccggtatgtcagctactccagggatgatcttgacagtgattttggaagtggtgatttcgacaaggaatatacgaactatcatgtccacatcccgccaactccggacaatcaacccatggatcctgttatctccgcgaaggtcgaagagcaatacgtctcaaattcattgttcacaggtggatgcaatagtgtcactcgtgctcatctgatggacaaggtgatcgagtcggaggcgagccatcctcagatggctggtgccaagggctcatcctgcgcgatgccaggatgtgactcgaaggtcatgagtgatgagcgtggggttgatatccttccttgtgagtgtgattttaaaatctgtgccgagtgcttttcggatgcagtgaaggttggtggtgggatctgtccaggatgcaaagaaccatataaaactattgagttggaggaggtggtcagcaacgctgtagctggacgaccactttcattgccagctccacatggaatgtcaaagatggaaaggaggctttcgataatgagatcacagaaaatgaccaggagtcagacaagtgattgggatcacaatcgatggctttttgaaacgaaggggacctatggttatggtaatgcaatctggccaactgagaataaagttgatggtggggatggaggaaatgcacagcctacagaactaacaaacaaaccatggaggcctctcactagaaagttgaagatccctgctgcagtattgagcccatataggcttctcatctttgtccgcatggctgttcttgccctgtttcttgcatggagaattaaacacaaaaacgaggatgccgtttggctgtgggggatgtctgtcgtctgtgagctgtggtttgcattctcctggctattggatcaactccctaagctcgccccagtaaaccgtgctgcagaccttgctgttttaaaggaaaagtttgagactcctacagctaccaaccctagtggaaagtctgatcttccaggcgttgatgtctttgtttccacagctgaccctgagaaagaacctccacttgtaactgcaaacaccatactctccatccttgctgctgattaccctgttgaaaagctagcatgctatgtctcagatgatggtggtgcccttctgacttttgaagcaatggctgaggctgctagctttgcaaatatatgggtccctttctgccgtaaacatggtgttgagcccagaaatcctgaaagttactttaacttgaagaaggatccttacaagaacaaagtgcgacctgactttgtcaaggaccgaaggcgggtaaagagagagtatgatgaattcaaggttcggatcaatgggttgcctgattcaatccgacggcgatctgatgcttaccatgcacgtgaggagatcaaagcaatgaaacgacaaagggaggttgctggtgatgatctggtagaatctgtaaagattcctaaagcaacatggatggctgatggtacccattggcctggaacttggatgaacccctcatcggagcatacgcggggtgatcatgctggaatcattcaggtaatgttgaagcctccaagtcatgaaccattatttggaaataatgaagagggtggaccgcttgatttcactgttgtagacattcgtctgcccatgctggtctatgtatctcgtgagaagcgcccaggctatgaccacaacaagaaagctggggctatgaatgctcttgttcgtgcctctgcaattatgtcaaatggtccttttattctcaaccttgattgtgaccactacgtctataactcgcaggccctccgagagggcatgtgctttatgatggatcgtgggggtgaccgcatttgctatgtccagtttccgcagcggtttgagggcattgatccctctgaccgttatgcgaacaacaacactgtcttttttgatgtcaacatgcgagccctcgatggtcttcaagggccagtttatgttggtactggctgcctatttcgacggattgctctctatggctttgatcctcctcgatccaaagaacgccatggaagttgctgcagctgctgttttccccaaaagcgcaagacacatgcagccgtggcatctgaggagactcgagctcttcgcatgggagactctgacgatgatgagatggccatctctacctttcctaagaaatttggaaactcaacctttctgatcgactccattcctattgctgagctccaaggccgccctcttgctgatcatcctgctgttaaaaatggccgcgcgcctggtctccttactgctcctcgtgaccttcttgatgcatccaccgtagctgaagcaatcagtgccatctcatgctggtatgaggataagactgagtggggacagcgcgttggatggatctatgggtctgtcactgaagatgttgttactggctacaggatgcacaatagagggtggaagtcagtctactgtgtaactaaacctgatgccttccgtgggactgctccaattaacctaaccgatcggctccaccaagttctcaggtgggctacaggctctgtcgagatcttcttctcccgtaacaatgcattgcttgcaagtccaagaatgaagattcttcagaggattgcgtatctcaatgtcgggatctacccatttacctccatcttccttattgtctactgcttcctacctgcactttctctcttcactgggcagttcattgtgcagaccctcaatgtgaccttcctcacgtaccttctcatcatcacattaacattatgcatgctcgctgttcttgagatcaagtggtctggtatcgaacttgaagaatggtggcgaaatgaacagttctggttaattggaggaaccagtgctcatcttgctgctgtgctccagggattgctgaaggtgattgctgggattgagatctcattcacccttacttcaaaatcagcaggtgatgatgagaatgatgaatttgctgatctctacatagtgaagtggacctcactgatgataccacccatcaccatcatgatggtgaatttgatagcaatagctgttggatttagccgcactatatatagtacgataccacagtggagcaagctgttgggtggggtgttcttcagcttctgggtgttggcacatctgtacccattcgcaaaaggtctaatgggacggagaggaaggacgccaaccattgttttcgtgtggtctgggctcattgctataactatttcactgctttgggttgcaatcaatcccccatctggtagtaactcacagattggtggctccttcacgttcccttgattcattataatgttgcagtcttgaggtattggcaagatggttgttgtgatggtaaaacagttttggcatgttgctggttctgctctgagctctttataggaatcccagaagagcaacctcagaaagagcagcagaatgctagtcagttctactctaattttgggggagtttttattcacttctataattttttattaatttggacatctatggttcacaggtgagaaggggagagtctgcatatgatgggaggtaatgtgttgggcatatctgtttgtacttggaagatgtgattttgcagccatctgcttgttatctttcgtaattatcaaatgtggacttttaagcagtttttactatgtaggcatcattttaaagcaatctgttaatgtatgttctttggaactctggacttggcactcgag

SEQ ID NO: 10145 - DNA, 4252 bp, Musa acuminata
cgctcctttctccctcctcttttctctgtcactccaccaagagcacggccgaaccctaacacccacacgctccgcgacggtgacgttctggtggtggcagcctccggtgaactcccttcctgacagcgtcgcctccccttttgacccagttcgtaagaaaagatggaaaggaaacggggctgaactgttccgcgttgttgtccgagtcggagtcggtgtcaaatcggacgttctttcggacacttcgtctttaaagacccgtcgtgttttctctctctctctctggctctctctctcggagaagaagcatcgagtggggaggtcttgatctctgttttctttctcgatctggcaaggggccatgacttcgaacaatgttcttagggccagtcgatccgtgcgggtagcctcgtcatccgattcacagcagggcgatggtagaccacctaatgcgcccgtcgtgacctttgcccgacggactccgtcgggccggtacgtcagctactccagggacgatcttgacagtgatttcggcagccgtgattttgacaaggaatacatgaactatcatgtccacatcccgccgactcccgacaaccaaccgatggatactgttatctctgccaaggttgaagagcaatacgtctcgaattcactgtttaccggtggatgcaacagtgtcactcgtgctcatctgatggacaaggtcatcgagtcagtggccaaccatccacagatggctggtgccaagggctcatcttgcgctatgccgggatgcgactcaaaggtcatgagcgacgagcgaggggttgatatcctcccttgtgagtgcgacttcaagatctgtgctgagtgcttttcggatgcagtgaaggttggtggcgggatctgtccaggatgcaaagaaccatacaagactactgaattggaggaggtggtcaacaatgctgtggctggacaaccgctctcgctgccagctccacatggagtgtcgaagatggagaggaggctttcgataatgaggtcacagaagatgaccagaagtcagacgggtgattgggatcacaaccgttggctctttgagacgaaggggacctatggctacggtaatgcaatttggccgacggaggatagaggtgaagggggggatggaggaaatgaacagcctacagaactgatgaacaaaccatggagaccactcactcgaaagttgaagatccctgctgcagtattaagtccgtataggctcctcattgttatccgcatggcttttcttgccctgtttcttgcatggagaataaagcacaaaaatgaggatgcagtttggctgtgggggatgtctgtcgtctgtgagctgtggttcgcattttcctggctgttggatcaactcccaaaactctgccctgtgaaccgtgctgctgacctcgccattctaagggaaaagtttgagactccttcggcaaacaaccctagtggaaaatctgatcttccaggtattgatgtctttgtctccacagcggaccctgagaaagaacctccacttgtaactgcaaataccatactctccatccttgctgctgattaccctgtagaaaagctagcatgctatgtttcagatgatggtggtgcccttttgacttttgaagcaatggctgaggctgctagcttcgccaatatctgggttcctttctgccgtaaacatggtgttgagcctaggaacccagaaagttactttaatttgaagagagatccatacaagaacaaggtgcgatctgactttgtcaaggaccggaggcgggtaaagagagagtatgatgaattcaaggttcgaatcaatgggttgcctgattcaatccgacggcggtctgatgcataccatgcacgtgaagagatcaaagcaatgaaacgacaaagggaggttgcaggtgatgatccagtagaacccgtgaagattcctaaagctacatggatggccgatggcacccactggcctggaacttggatgaacccctcatcggagcacactcggggtgatcatgctggaatcattcaggtaatgttgaaacctccaagtcatgaaccattatttgggaacaacgaagagggtaggccactagatttcactgatatagatattcgtcttcccatgctggtctatgtctctcgtgagaagcgtccaggatatgaccacaacaagaaggctggggctatgaatgctctcgttcgtgcctcagcaattatgtcaaatggccctttcattctcaaccttgactgcgaccactatgtctataactcgcaggccctccgagagggcatgtgcttcatgatggatcgtggtggtgaccgcatctgctacgtccagtttcctcagaggtttgagggcatagatccttctgatcgttatgccaacaacaacacagtcttctttgatgtcaacatgcgagctcttgatggccttcaggggccagtttatgttggtactggctgccttttccgacgtattgctctctatggctttgatcctcctcgatccaaagaacaacatggtggatgctgcagctgctgttttccccaaaagcacaagactcacgcagctgtggcatctgaagagacacgggctcttcgcatgggagactctgaagatgatgagatggccatgtctacttttcctaagaaatttggaaattcaacctttctcattgactccattcctgtttctgagttccaaggacgccctcttgctgatcatccagctgttaagaatggtcgtgcacctggtctcctaaccgctcctcgtgaccttcttgatgcatccactgtagctgaagcaatcagtgttatttcatgctggtacgaagacaagactgagtggggtcagcgtgtcggatggatctatgggtcagtgactgaagatgtcgttactggctacaggatgcacaacagagggtggaagtcagtatactgtgtgaccaagcctgatgccttccgtgggactgctccaatcaacctaaccgatcggctccaccaagttctcaggtgggctacaggctctgttgagattttcttctcccgtaacaatgcacttcttgcaagtccaagaatgaagattcttcaaaggattgcatacctcaatgtcgggatatacccatttacctccatctttcttattgtctactgcttcctacccgcgctctctcttttcacgggacagttcattgtgcaaaccctcaatgtgaccttcctcacataccttctgatcatcacattgacactctgtatgctcgcggttcttgagatcaagtggtctggaattgaacttgaagaatggtggcgaaatgagcagttctggctgataggaggaaccagtgctcatcttgcagctgtgctccaggggttgcttaaggtgattgctgggattgagatctcattcaccctcacatcaaaatcagcaggagatgatgaggatgatgaatttgctgatctctatatagtgaagtggacctcactgatgataccacccatcaccatcatgatgatgaatttaatagccatcgccgtgggagttagccgtactatatatagtaccataccacagtggagcaagcttctgggcggggtcttcttcagcttttgggtgttggcgcatttatacccgtttgctaaaggtttaatgggacggagaggaaggacgccaaccattgttttcgtgtggtctggactcatttctatcactatatcactgctttgggttgcgatcagtcccccatctggtggtaattcacagattggtggatccttcacttttccttgattcatcacaatgttgcagtctgagattggcaagatggggatcgtcatgatggaagagttctcgtatgctactggtcctgcctttagccactttgtaggagatacaaatgagcaacctaagaaagagtagcaggctgccatggctttcttcttactctttgtgggagtttttattcttataattttttttattttactgattacattggacatatatggttggttcacagcagaggaggaagaggggtgggggggagggggagagttctatgcatatgatggaaggtagtatattggacaagctgtttgtactagttagatgtgaatttgaggccatctgtctacagtatttttcatagtcatcaagtctcaacttctctgctgcttgtattttagtagacatgtcttctatagaatttttttttgtagttaccaaatgtgg

SEQ ID NO: 10146 - DNA, 4252 bp, Elaeis guineensis
cgcactcgaaaaacctaataaacccggaaccctagagaagaaaaaaaaagggctcaattcgtcccccaagccaaggtgccgtctttggagagctgtcgaccttgtctcctcttatcgttgcctctgcggcacggaaactgccgactgtcgtttttcgagtaaagaaatggcccctggtggcttctagttcttggtcgcttgagccgcttggatctggtcgcagctctcctccggttgtacaacatctgcttgagctccaatctgaagcttcctgcagcgagcatggaggtcaggtgtcgtggtctcatcgtcgtcaagtgaaggataaatccgcttgttatatggcccggctctttggatccggtcgtatactctgattcgatggagaactagctcggattccggattcggatattctaaggctttgactttttatctgtggaattttggacacggtgaggagatggcttcaaacagtgctctcagagccagccgatccgcccggatgtcgtcgactggggtcgagctgcagcacggcggaaacaagccgccagcggcgcccaccgtgaccttttgccggaggactccatccggtcgcttggtgaactactcccgagatgatcttgacagtgagctgagtggtgagttctccagggagtttctgaattaccatgtcaccatcccgccgaccccggacaaccaaccgatggacccctcgatctctgccaaggtcgaggagcagtatgtgtcgaattccctcttcactggtggattcaacagcgtcactcgtgctcatttgatggataaggtgatcgagtcggaggcgatgcacccccagatggccggcgccaagggatcatcttgtgccatcccagggtgtgactccaaggtattgagcgatgagcgtgggattgacattctcccttgtgagtgtgacttcaagatctgtgccgactgcttcaacgattcagtgaaggctggtggagcggtctgcccaggatgcaaggagccgtataaagcgactgagttggaggaggtgatgaacaatgccggggctgctgcgcggcggctgtcgctgccaccgccacccccgggggtgtcgaggatggagaggaggctgtcattgatgaagtcgacgaagatgacccggagccagactggtgactgggatcacaaccggtggttgttcgagaccaagggaacatatggctatgggaatgcaatctggcccaaggagagtgggggtgacggtgggaatggagaagtgggacagccatcggagctgacgagcaagccttggaggccactcacccgcaaattgaagatccctgcagcagtcctcagcccatataggcttcttattgttttccgcatggctgcccttggactgttccttgcttggagagtcaagcacaaaaatgaggatgcagtatggctatgggggatgtctgttgtgtgtgagctgtggtttgctttctcttggctcttggaccagcttccgaagctttgtcctgtcaaccgtgccactgaccttgcagtgttgagagacaagtttgaaactcctacacccagcaatcctaccgggaagtctgatcttcctggcattgatgtctttgtttctactgccgacccagaaaaagagcctcctctggtcactgcaaacaccatactctccatcctcgctgctgattaccctgttgagaagctctcttgctatgtttctgatgatgggggagccctactgacatttgaagcaatggcagaagctgcaagctttgccaatacatgggttcctttctgtcgtaaacatgacatcgaaccgagaaacccagagagctacttcaatttgaagaaggatccttataagaacaaggtgcgctctgactttgtcaaggaccgaagacggctgaagagagagtacgatgagttcaaggtccgcatcaatggattgccagattctattcgccggcggtctgatgcatatcatgctcgtgaggagattaaggccatgaaacgacagcgagaaacagctggtgatgatgttgtagaacctgttaagatccccaaagccacttggatggctgatggtactcattggccaggcacttggattaacccctcctcagagcatactcggggtgatcatgctggaattattcaggtaatgctgaagccaccaagtgatgaaacactgtttggggacaaggaagaaggaaagcccctggatctcaccgatgtcgacatccgtctgcccatgctggtctatgtctcacgtgagaaacgcccaggctacgaccataacaaaaaggcaggggccatgaatgcccttgtccgtgcctctgccatcatgtctaatggccccttcatcctgaatcttgattgtgaccactacatctacaactccgaggccctccgggagggcatgtgcttcatgatggatcgtggtggtgaccgtatctgctatgtccagttcccgcaacggttcgagggtatcgacccctctgaccgttatgccaatcacaacaccgtcttctttgatgtcaacatgagagcgcttgatggtcttcagggcccagtatatgtgggtaccggttgcctcttccgccgcgttgcgctctatggttttgaccctcctcgtgccaaagaacaccaacctggctgctgcagctgttgcttccctaggcgcaagagtcctgctgctgttgcctctgaggagacccgtgctcttcgaatgggagactctgatgatgaggaaatgaacctttcaacattccccaagaagtttgggaactcgagtgtccttgttgattcaatcccagtggctgagtatcaaggccgacctcttgccgatcaccctgctgtcaagaatggccgcccgcctggcgccctcaccatcccacgtgacctccttgatgcatctactgtagctgaggccatcagtgccatctcatgctggtatgaggacaaaaccgaatggggccagcgtgttggatggatctatgggtctgttactgaagatgtcgtcacaggctataggatgcacaacagagggtggaagtcagtctactgtgtcaccaagcgtgatgccttccgtgggactgcgccaattaacctcaccgaccggctccaccaggtccttcggtgggccacaggctccgttgagatcttcttctctcgcaacaatgccttgcttgccagctccaggatgaagctcctccagaggattgcttacctcaatgttggcatctatccatttacctctttcttcctcctcgtctattgcttcctcccggcgctctccctcttctcaggacagttcattgtgcagactctcaatgtgacattcctcacctaccttctcttgatcactttaacactttgcatgattgccatgcttgagataaagtggtcaggtgtttcacttgaagagtggtggcgaaatgaacagttttggctgattggaggaaccagcgctcaccttgctgctgtgctccaggggttactaaaggtgattgcagggatcgaaatctcattcaccctcacttcgaaatcagctggtgatgatgtggatgatgagtttgccgacctctacattgtgaaatggacatctttgatgataccgcccatcacaatcatgatggtcaatttgattgcgattgcagttggtgtcagtcgaactatatatagtgtgttgccgcagtggagcaggctgctaggtggggtgttcttcagcttctgggtcttggcacatctttacccattcgcaaaggggctgatggggaggagaggaaggaccccaaccattgtatttgtgtggtctggactcattgctatcactatatcactgctttgggttgcgattaatcccccatcagcgaactctcagattggtggctccttcacattcccttgagccattccattttggtagttcaatagaattcatggcaaggtagagtgaaatgcatccagaccattagctgttttggttaccaattattttgatactttgcagcttctgttttcagactccttccttgatgccgcatagtgcaagcaacttttaaatctgaagcagcggattgctgtgctttcaacttgctgaggctttggctttttgtcagctacatatatatatatatataattttattttatttttttttcagtttgctaccactctaattatttgctcagggactgcaggagtgggaagggaaaaagttaaatatgttaaaaagtatatttgatca

SEQ ID NO: 10147 - DNA, 4192 bp, Cocos nucifera
gtaaaaatctctgctccttccctgccatttaaaagtacaacactccttttaagctccaagcttccatctcgctctctaaaaacgtaataaaccccaaaccctagagaaagaaaaaagggctcaatccgtctcccaagccaaggtgccgtctttggagagctctcgaccttgtctcctcttatcgttgcctctgcggcacggaaactgccgagtttcgtttttctagtaaagaaatagcccctggtggcttatagttcttggacgcttgcgccgcttggatcttgtcgcagctctcctccggttgtacaccatctgcttgagctcctatctgaagcttccagcaacgagtacggaggtcaggtctcgtggtctcatcgtcgtcaagtgaaagatcacttgtgatgtggcataaatccgcttgttatatggatctgctctttggattcgttcatatactctgattcgatggagaactagctcgcaatccggattcggagattcaaaggctgtgacttttgatctgtggaattttggacacggtgatcgagagggagaggagatggcttcaaacagttatcttagagccagccgatccgcccggatgtcgtcgtctggggtcgagctgcagcacggcggcaccaagccgccggcggtgcccaccgtgaccttttgccggaagactccgtccggccgcttggtgaactactcccgagacgatcttgacagtgaactgagtggtgagttctccagggagtttctgaattaccatgtcaccatcccgccgacccccgacaaccagccgatggacccctcgatctctgccaaggtcgaggagcagtatgtgtcgaattccctcttcactggtggatttaacagcgtcacccgtgctcatttgatggataaggtgatcgagtccgaggcgatgcacccccagatggccggcgccaagggatcatcttgcgccatccccgggtgtgactccaaggtcttgagcgatgagcgtggaaatgacattctcccttgtgagtgtgacttcaagatctgtgccgactgcttcaacgattcagtgaaggctggtgaagcggtctgcccaggatgcaaggagccgtataaagctactgagttggaggaggtgatgaacaatgctggggctgctgcacggctgtcgctgccaccgccaccccctggggtctcgaggatggagaggaggctgtcattgatgaagtcgaccaagatgaaccggagccagaccggcgactgggatcacaaccggtggttgtttgagacaaagggaacatatggctatgggaatgcaatctggcccaaggagagtgggggtgacggtgggaatggagaagttggacagccatcggagctgacgagcaagccttggaggccactcacccgcaaattgaagatccctgcagcagtcctcagcccatataggcttcttattgttatccgcatggctgcccttggactgttccttgcttggagagtcaagcacaaaaatgaggatgcagtatggctatgggggatgtctgtcgtgtgtgagctgtggtttgctttctcttggctcttggaccagctcccgaagctttgtcctgttaaccgtgccactgaccttgcagtgttgaaagacaagtttgaaacttctacacccagcaatcctactgggaagtctgatcttcctggcattgatgtctttgtttctactgctgacccagaaaaagagcctcctctggttactgcaaacaccatcctctccatccttgctgctgattaccctgttgagaagctctcttgctatgtttctgatgatgggggtgccttgctgacttttgaagcaatggcagaagctgcgagctttgctaatatatgggttcctttctgtcgtaaacatgatattgaaccaagaaacccagagacctacttcaatttgaagagggatccttataagaacaaggtgcgctctgactttgtcaaggaccggaggcgggtgaagagagagtatgatgagttcaaggtccgcaccaatggattgcctgattctattcgccggcggtctgatgcatatcatgctcgtgaggagattaaagccatgaagcggcagcgagaaactgctggtgatgatctggtggaacctgttaagatccccaaagccacttggatggctgatggtacccattggccaggcacttggattaacccctcctctgaacattctcggggtgatcatgctgggattatacaggtaatgctgaagcctccaagtgatgaaccactgtttgggaacaatgaagaaggaaagcccctcgacttcacagacgtcgacatccgtcttcccatgctggtctatgtctcgcgtgagaaacgcccgggttatgaccataacaaaaaggctggtgccatgaatgccctcgttcgtgcctccgccatcatgtctaatggccccttcatcctcaatcttgattgtgaccactacatctacaactccgaggccctccgggagggcatgtgcttcatgatggatcgtggtggcgaccgtatctgctatgtccagttcccacagcggtttgagggtattgacccctctgaccgttatgccaaccacaacaccgtcttctttgatgccaacatgagggcgctcgatggccttcagggcccagtgtatgtgggtactggttgtctcttccgccgcattgcactttatggctttgaccctcctcgtgccaaagaacaccaacctggctgctgcagctgttgcttccctcggcgcaggagtcctagggctgctgcccctgaggagacccgtgcccttcgaatgggagactccgacgatgaggacgtgaacctgtcaacattccccaagaagtttggaaactcaaatttcctaattgattcaatcccagtggccgagtatcaggggcgacctcttgctgatcaccctgccatcaagaatggccgcccgcctggtgccctcaccatcccacgcgacctccttgatgcatctactgtagccgaggccatcagtgtcatctcatgctggtacgaggacaaaactgaatggggccagcgtgttgggtggatctatggttctgttactgaagatgtccttaccggcttcaggatgcacaacagagggtggaaatcagtctactgtgtcaccaagcgtgatgccttccgtgggactgctccaattaacctcaccgaccggctccaccaggtccttcggtgggccacgggctctgttgagatcttcttctctcgcaacaatgccctgcttgccagcaccaggatgaagctcctccagaggattgcttacctcaatgttggcatctatccatttacgtctatcttcctcctcgtctattgcttcctcccggcgctctccctcttctcaggacagtttattgtgcagactctcaatgtgaccttcctcacctaccttctcatcatcactttaacacttagcatgcttgctgggcttgagatcaagtggtcggggatttcacttgaagagtggtggcggaatgaacagttttggctgattggaggaaccagtgctcaccttgctgctgtgctccaggggttgctgaaagtgattgcagggattgaaatctcattcaccctcacttcgaaatcagccggtgatgatgtggatgatgagtttgctgacctctacattgtgaaatggacatctttgatgataccgcccatgacaatcatgatggtgaatttgatagcgattgcggttggagtcagtcgaaccatatacagtactgtgccacagtggagcaagctattaggtggggtgttcttcagcttctgggtcttggcgcatctctacccatttgccaaggggcttatggggaggagaggaaggacgccaaccattgtatttgtgtggtccggactcattgcaatcactatatcactgctttgggttgcgatcaatcccccgtcttcgaattcccagatcggtggctccttcacatttccttgagccatttcaattaggtagatccacagaattcatggcaaggtggagtgaaatgtgtccgattgttttgatactctgctgcttcagttcaagctcttcccgtgtttcccaagcaacttttaaattggaagcagagcattgcgggtgcttttcaacttcgtctctgaagttttggcttttcatcagcta

SEQ ID NO: 10148 - DNA, 4170 bp, Cocos nucifera
tttaaaagtacaacactccttttaagctccaagcttccatctcgctctctaaaaacgtaataaaccccaaaccctagagaaagaaaaaagggctcaatccgtctcccaagccaaggtgccgtctttggagagctctcgaccttgtctcctcttatcgttgcctctgcggcacggaaactgccgagtttcgtttttctagtaaagaaatagcccctggtggcttatagttcttggacgcttgcgccgcttggatcttgtcgcagctctcctccggttgtacaccatctgcttgagctcctatctgaagcttccagcaacgagtacggaggtcaggtctcgtggtctcatcgtcgtcaagtgaaagatcacttgtgatgtggcataaatccgcttgttatatggatctgctctttggattcgttcatatactctgattcgatggagaactagctcgcaatccggattcggagattcaaaggctgtgacttttgatctgtggaattttggacacggtgatcgagagggagaggagatggcttcaaacagttatcttagagccagccgatccgcccggatgtcgtcgtctggggtcgagctgcagcacggcggcaccaagccgccggcggtgcccaccgtgaccttttgccggaagactccgtccggccgcttggtgaactactcccgagacgatcttgacagtgaactgagtggtgagttctccagggagtttctgaattaccatgtcaccatcccgccgacccccgacaaccagccgatggaggtgacgatggaccagacaatctctgccaaggttgaggagcagtatgtgtccaattccctcttcactggtggattcaacagcgtcacccgtgctcatttaatggataaggtgatcgagtcggaggcgatgcacccccagatggctggtgccaaggggtcttcttgtgcaatccccggttgcgactccaagatcatgaccgacgagcgcggcaatgacattctcccttgtgagtgtgacttcaagatctgcgctgattgcttcacagatgcggtgaaggttggtggtgcggtctgcccgggatgcaaggagccgtataaagctactgacttagaggaggtgatgaacaatgctgggcctgtgcggcagctctcgctggcaccaccaccccctggggtgtcgaggatggagaggaggctgtcattgatgaagtctacaaagttgacccggagccagactggcgattgggatcacaacagatggttattcgagacaaagggaacctatggatatggaaatgcgatttggcccaaggagagtgagggtgatgatgggaatggaggagatggacagccatcagagctgatgagtaagccttggaggcctctcacacgcaaattgaagatccctgcagcaatcttgagtccctataggctccttattgtcatccgcttggctgctcttggactctttcttgcttggagaattaggcacaaaaatgaggatgcaatttggctgtgggggatgtctgttgtctgtgagctgtggtttgctttctcttggatcttggaccagctcccaaaactttgccctgtcaaccgtgccaccgacctagcagtcttgaaagacaagtttgaaactcctacgcctaacaaccctactgggaagtctgatcttcctggcattgatgtctttgtttctactgctgatccggaaaaagagcctcctttggttactgcaaacaccatactatccatccttgctgctgattaccctgttgagaagctctcttgctatgtttctgatgatgggggagccctactgactttcgaagcaatggcagaagctgcaagctttgctaatatatgggttcctttctgtcggaaacatgacattgaaccaagaaacccagagagctacttcaatttgaagaaggatccttataagaacaaggtgcgctctgactttgtcaaggaccgaagacgggtgaagagagagtatgatgagttcaaggtctgcatcaatggattgccagattctattcgccggcggtctgatgcatatcatgctcgtgaggagattaaggccatgaaacgacagcgagaaacagctggtgatgatgttgtagaacctgttaagatccccaaagccacttggatggctgatggtactcattggccaggcacttggattaacccctcctcagagcatactcggggtgatcatgctggaattattcaggtaatgctgaagcctccaagtgatgaaacactgttgggggacaaggaagaaggaaagcccctggacctcaccgatgtcgacatccgtctgcccatgctggtctatgtctcacgagagaaacgcccaggctatgaccataacaaaaaggcaggggctatgaatgcccttgtccgtgcctctgccatcatgtctaatggccccttcatcctaaatcttgattgcgaccattacatctacaactccgaggcgctccgggagggcatgtgcttcatgatggatcgtggtggtgaccgcatctgctatgtccagttcccgcagcggtttgagggtatcgacccctctgaccgttatgccaatcacaacactgtcttctttgatgtcaacatgagagcgcttgatggtcttcagggccctgtatatgtgggtacaggttgcctcttccgccgcattgcactctatggttttgaccctcctcgtgccaaagaacaccaacctggctgctgcagctgttgcttccctaggcacaagagtccggctgctgttgcctctgaggagacccgtgctcttcgaatgggagactctgatgatgaggaaatgaacctttcaacattccccaagaagtttgggaactcaagtgtccttgttgattcaatcccggtggctgagtatcaaggcagacctcttgccgaccaccctgctgtcaagaatggccgcccacctggtgccctcaccatcccacgtgacctccttgatgcatctactgtagctgaggccatcagtgtcatctcatgctggtacgaggacaaaactgaatggggccagcgtgttggatggatctatgggtccgttactgaagatgtcgtcacaggctataggatgcacaacagagggtggaaatcagtctactgtgtcaccaagcgtgatgccttccgtgggactgctccaattaacctcaccgaccggctccaccaggtccttcggtgggccacgggctctgttgagatctttttctctcgcaacaatgccctgctaggcagcagcaggttgaagctcctccagaggattgcttacctcaatgttggcatctatccatttacgtctatcttcctcctcgtctattgcttcctcccggcgctctccctcttctcaggacagtttattgtgcagactctcaatgtgacattcctcacctaccttctcatgatcactttgacactttgcatgattgccatgcttgagataaagtggtcaggtgtttcacttgaagagtggtggcgaaatgaacagttttggctgattggaggaaccagtgctcaccttgctgctgtgctccaggggttactaaaggtgattgcaggaatcgaaatctcattcaccctcacttcgaaatcatctggtgatgatgtggatgatgagtttgccgacctctacattgtgaaatggacatctttgatgataccgcccatcacaatcatgatggtcaatttgattgcgattgcagttggtgtcagtcgaactatatatagtgtgttgccgcagtggagcaggctgctaggtggggtgttcttcagcttctgggtcttggcgcatctctacccatttgccaaggggcttatggggaggagaggaaggacgccaaccattgtatttgtgtggtccggactcattgcaatcactatatcactgctttgggttgcgatcaatcccccgtcttcgaattcccagatcggtggctccttcacatttccttgagccatttcaattaggtagatccacagaattcatggcaaggtggagtgaaatgtgtccgattgttttgatactctgctgcttcagttcaagctcttcccgtgtttcccaagcaacttttaaattggaagcagagcattgcgggtgcttttcaacttcgtctctgaagttttggcttttca

SEQ ID NO: 10149 - DNA, 3990 bp, Cocos nucifera
cccccctcttgcgccactcggacctggtcgcaggtcttcctccagttgtatcccatcttcttgagcttgtgttgtttgaacgcttcccacaacgaggacagaggaaagaggcggatagagagggagaagaggcgtcagagggagtggatccattcttctctctcttattcgccatttcaagtggagagtcggtcgtgatctggtataaatccagtcgttataagcctccggtgtttggatccggtcgtatcctctgattcgattcgatgggaagctagctcggattcccgattccgaaatcctaagatacattgagatatatacaaccaagcggatggatatggcttcaaacggtgctctcaggagcagccgatctggtcggatggcgtcgtcaggtgtagagttgcagcagggtggcaacaagccaccgccgcagcccagcgtcaccttcggacggcggacgcagtctggccgctacatcagctattcgagggatgatcttgacagcgagctgagtgaggaattctccaaggagtttctgaattaccatgtcaccatcccgccgacccccgacaaccagccgatggaggtgacgatggaccagacaatctctgccaaggttgaggagcagtatgtgtccaattccctcttcactggtggattcaacagcgtcacccgtgctcatttaatggataaggtgatcgagtcggaggcgatgcacccccagatggctggtgccaaggggtcttcttgtgcaatccccggttgcgactccaagatcatgaccgacgagcgcggcaatgacattctcccttgtgagtgtgacttcaagatctgcgctgattgcttcacagatgcggtgaaggttggtggtgcggtctgcccgggatgcaaggagccgtataaagctactgacttagaggaggtgatgaacaatgctgggcctgtgcggcagctctcgctggcaccaccaccccctggggtgtcgaggatggagaggaggctgtcattgatgaagtctacaaagttgacccggagccagactggcgattgggatcacaacagatggttattcgagacaaagggaacctatggatatggaaatgcgatttggcccaaggagagtgagggtgatgatgggaatggaggagatggacagccatcagagctgatgagtaagccttggaggcctctcacacgcaaattgaagatccctgcagcaatcttgagtccctataggctccttattgtcatccgcttggctgctcttggactctttcttgcttggagaattaggcacaaaaatgaggatgcaatttggctgtgggggatgtctgttgtctgtgagctgtggtttgctttctcttggatcttggaccagctcccaaaactttgccctgtcaaccgtgccaccgacctagcagtcttgaaagacaagtttgaaactcctacgcctaacaaccctactgggaagtctgatcttcctggcattgatgtctttgtttctactgctgatccggaaaaagagcctcctttggttactgcaaacaccatactatccatccttgctgctgattaccctgttgagaagctctcttgctatgtttctgatgatgggggtgccttgctgacttttgaagcaatggcagaagctgcgagctttgctaatatatgggttcctttctgtcgtaaacatgatattgaaccaagaaacccagagacctacttcaatttgaagagggatccttataagaacaaggtgcgctctgactttgtcaaggaccggaggcgggtgaagagagagtatgatgagttcaaggtccgcaccaatggattgcctgattctattcgccggcggtctgatgcatatcatgctcgtgaggagattaaagccatgaagcggcagcgagaaactgctggtgatgatctggtggaacctgttaagatccccaaagccacttggatggctgatggtacccattggccaggcacttggattaacccctcctctgaacattctcggggtgatcatgctgggattatacaggtaatgctgaagcctccaagtgatgaaccactgtttgggaacaatgaagaaggaaagcccctcgacttcacagacgtcgacatccgtcttcccatgctggtctatgtctcgcgtgagaaacgcccgggttatgaccataacaaaaaggctggtgccatgaatgccctcgttcgtgcctccgccatcatgtctaatggccccttcatcctcaatcttgattgtgaccactacatctacaactccgaggccctccgggagggcatgtgcttcatgatggatcgtggtggcgaccgtatctgctatgtccagttcccacagcggtttgagggtattgacccctctgaccgttatgccaaccacaacaccgtcttctttgatgccaacatgagggcgctcgatggccttcagggcccagtgtatgtgggtactggttgtctcttccgccgcattgcactttatggctttgaccctcctcgtgccaaagaacaccaacctggctgctgcagctgttgcttccctcggcgcaggagtcctagggctgctgcccctgaggagacccgtgcccttcgaatgggagactccgacgatgaggacgtgaacctgtcaacattccccaagaagtttggaaactcaaatttcctaattgattcaatcccagtggccgagtatcaggggcgacctcttgctgatcaccctgccatcaagaatggccgcccgcctggtgccctcaccatcccacgcgacctccttgatgcatctactgtagccgaggccatcagtgtcatctcatgctggtacgaggacaaaactgaatggggccagcgtgttgggtggatctatggttctgttactgaagatgtccttaccggcttcaggatgcacaacagagggtggaaatcagtctactgtgtcaccaagcgtgatgccttccgtgggactgctccaattaacctcaccgaccggctccaccaggtccttcggtgggccacgggctctgttgagatctttttctctcgcaacaatgccctgctaggcagcagcaggttgaagctcctccagaggattgcttacctcaatgtcgggatctatccattcacctccatctttctcattgtctactgcttcctcccggcgctctccctcttctcaggacagtttattgtgcagactctcaatgtgaccttcctcacctaccttctcatcatcactttaacacttagcatgcttgctgggcttgagatcaagtggtcggggatttcacttgaagagtggtggcggaatgaacagttttggctgattggaggaaccagtgctcaccttgctgctgtgctccaggggttgctgaaagtgattgcagggattgaaatctcattcaccctcacttcgaaatcagccggtgatgatgtggatgatgagtttgctgacctctacattgtgaaatggacatctttgatgataccgcccatgacaatcatgatggtgaatttgatagcgattgcggttggagtcagtcgaaccatatacagtactgtgccacagtggagcaagctattaggtggggtgttcttcagcttctgggtcttggcgcatctctacccatttgccaaggggcttatggggaggagaggaaggacgccaaccattgtatttgtgtggtccggactcattgcaatcactatatcactgctttgggttgcgatcaatcccccgtcttcgaattcccagatcggtggctccttcacatttccttgagccatttcaattaggtagatccacagaattcatggcaaggtggagtgaaatgtgtccgattgttttgatactctgctgcttcagttcaagctcttcccgtgtttcccaagcaacttttaaattggaagcagagcattgcgggtgcttttcaacttcgtctctgaagttttggcttttcatcagctacattt

SEQ ID NO: 10150 - DNA, 3844 bp, Cajanus cajan
gcccaaccccatttctcgcagatctgaaaaccttcgttcttcatcctctctgcaccacccttttctttcacatgcactaacgcttcctcttctacttcaaggtttaagctttacggcaaattttcatgcttatgtgaccagctgggttagaaagcactgaaagagtgagaattgggatattacaatcagtcatagttgtcaaatatgtcatctaaagtgtttagggcaacccgatcatctatatcagcaacatcttctgatgcacctgatggccagaagcctcctttacctccaaccgtaacatttggccggagaacttcctccggtcgctatgtcagttactctagagatgatcttgacagtgagcttgggagtactgacttcatgaattatacagtgcatatacctccaacccctgataaccaacctatggatccatctatctcgcagaaagttgaggagcaatatgtgtcgaattctcttttcacaggtggattcaacagtgttactcgagcccatctaatggataaggtgatagaatctgaagcaaatcatccgcagatggctggtgcaaaaggatcttcatgtgcagttcctggttgtgattctaaggtgatgagcgatgaacgtggtgttgatattcttccatgtgagtgtgatttcaagatatgtagagattgttatgtagatgcagtaaagaccggaggcggggtatgcccgggatgcaaggagcaatataagaacacagaactagatgaaggggctgtagataatggacgtccccttccgcttcctccaccaagtggaatgtctaaaatggagaggagattgtccttgatgaagtcaacaaagtcagcattaatgaggagccaaactggtgattttgatcataataggtggctctttgaaactaaggggacctatggctatggtaatgctatatggccaaaagaaggtggttttggaaatgaaaaagaggatgatgtcgttgagccaactgaattgatgaacagaccatggagaccacttacgcggaaactgaagatacctgctgctgtcttgagtccatatcgtcttattatttttattcgattggttgtcttggcattgttcctggcatggaggatcaaacaccaaaataccgatgcagtctggctatggggaatgtctgttgtttgtgagatatggtttgctttttcctgggtgctggatcaacttcccaaactatgcccagtgaatcgttccacagatctcaatgttctgaaggagaaatttgaaacgccaacccctaacaatcctactggaaaatctgatcttcctggcattgatgtctttgtttctactgctgatcctgagaaagaacctcctcttgtcactgcaaacactatcttgtctattttagctgctgattaccctgtcgagaagctttcttgctatgtttctgatgatggaggtgcacttctaacttttgaggcaatggctgaagctgccagctttgctaatatgtgggttcccttctgccggaaacatgatatagagcccaggaatcctgaatcatacttcaacttaaaaagagacccttacaagaacaaagtgcggtcagattttgtcaaggatcgtagaagggtgaaacgtgagtatgatgaattcaaggttaggatcaatagtctgcctgattctatccgtcgccggtcagatgcctatcatgcaagagaggaaatcaaggccatgaaagttcagagacaaaacagggaagatgaacctgttgaaactgtaaagattccaaaagcaacatggatggctgatggaactcattggccaggaacttggctgagtcctgcatctgagcattctaagggtgaccatgctggtataattcaggtgatgttgaaacctcctagtgatgaacctcttctaggaaatgctgatgatgcaaagctcctggatctgactgatgttgatatccgtcttccccttcttgtttatgtttctcgagagaagcgtccaggctatgatcataacaaaaaagccggggccatgaatgccttggttcgggcctcagctataatgtctaatggcccttttatactcaatcttgactgtgaccactatatctacaactcaaaggcaatgagggagggtatgtgctttatgatggatcgtggaggtgaccgcctttgctatgtccagttcccacaaaggtttgaagggattgatccttctgatagatatgccaaccataatactgtcttctttgatgtcaatatgcgagcccttgatggacttcaagggccagtctacgtgggaactgggtgccttttccgacgaatagcactttatggttttgacccgccccgttctaaagagcaccacacaggttgctgtaattgttgctttggtcgtcagaagaagcatgcatcaatcgcaagcaccccagaagagaaccgtgcactaaggatgggcgattctgatgaagaggaaatgaatctatcacttttccctaagaagtttggcaactcaactttcctcattgactcaattccagtagctgagttccaaggccgaccactagctgatcaccctgccgtgaaaaacggtcggccacctggtgctctcctcataccccgcgatcttctcgatgcgtcaaccgtcgcagaggccatcagtgtcatctcctgttggtacgaagataagactgagtggggacatcgcgttgggtggatctatggatctgtgacagaggatgtggtcactggctataggatgcacaataggggatggaaatcagtttactgcgtgaccaagcgtgacgccttcagaggaactgctcccatcaatctcactgacaggctgcatcaggtcctcagatgggctaccggctcggtcgaaatcttcttctcacgaaacaacgcactcctggctagcccaagaatgaaaattcttcaaagaattgcataccttaatgttggaatctaccctttcacatccatattccttattgtctactgcttccttcctgcactgtccctcttctctggccagttcattgttcaaaccctcaatgtcacttttctctcatacctcttgggaatcactgtcacattgtgcatgcttgcagtgcttgaaatcaagtggtctggcattgagcttgaagagtggtggagaaatgaacagttttggctgattggagggaccagtgctcatctagctgctgtgcttcagggtttgctcaaagtcatagcaggaattgaaatctcattcaccttgacttcaaaatcaggtggtgacgatgtagatgatgagtttgctgatctctacattgtgaaatggacatcacttatgataccacctattacaattatgatggttaacttgatagcaatagcagttggagttagcagaaccatatacagtgtgataccacagtggagccgtttattaggtggtgttttcttcagtttctgggtcttggcacatctctatccctttgcaaaaggtttgatgggaagaagagggaggactccaactatagtttttgtgtggtcaggactcatagcgatcacaatttctctcctctgggtggctattaacccccctgctggttctaaccaaattggaggttcattccagttcccatgatgggtcattctttttgtcagatcaatctgtcaggaatttttttatttaaaattagtttttctttttcttcttctcttgattctacatattgaagctactaatgaatggacttatattatgttgtctattgtgcttatgaattttgtttagatcttgattccagaaatgtgacaatattttctgctgaccaagactggcttcttta

SEQ ID NO: 10151 - DNA, 5389 bp, Glycine max
cttcctctccttgggataatcctccccaaacttctccaaataccacctccggttggcccgggcccttggacccaaattagcaaaagtgtaaacaaaaaagcccagcccggcccatgaccaagtcatcacggcccagcccagccactcgacaatctccccaaagtaattcggacacgccacgagctcgaacaacccaccgcgcggcaccacgtagcccttcccctcgctcttgagccgcaacaaaaccctatcagcccatacattaatccccatccccaataaaaacaccaaaagcccacacaaaaaccggaaccagaaaaaacccgagtcatcatagtgattgatgtagtgagagaccgttcgggcctggaggtaggaattgagaacgttgaaggcgaaggccattagggctacgccgagggggaagcccgttggggttttctttgaaggagtgaggaggaggtggagagggtagaggatggtgcggttgaagtagtggattaggaagggggtgatgagggcttgggctttggggttgtgggagtggaggcccagtgggaagaggaggagggtgagccagagggttgggctttccatgaagagccaggctaaggggggagggaggttgggcccccagccgggcctgtggtgcttgccgtagggggcctggaggaaggtgagggagaggaaggtggggggtgcgattaggaagagggtaaggagggagcggtggaagagagatgagtcggagtagtgttctgggatcattgttgttgggtagggaataatgagagtgaagagtgaagtgagagagggtaatggaccaaaatagcatatattaaattataatgatggaagtgagagagagagagaaaaaaaagactttacggagtccttgggcgttgtttgggaaacctctggatttgcataaagaaagacggagattagagaagatggagagcgtctgaaaatcggaggcgtggaagtggggaggaagatgagctcgatgagtttcaaggtcaaggacttcttcaatggtgggcccaatcaggccgacaagcttgtggaggacgctacttccgaggccctggacgagcccgactgggccctaaatctcgatctctgcgatctcatcaacgccgacaagctcagtagcgtcgaactcgtccgcggaatcaagaagaggatcgtcctcaagagccctagggttcagtacctcgcccttgtcctcctcgaaacccttgtcaagaactgcgagaaggccttctccgaagtcgccgccgagcgtgtcctcgacgagatggtcaggctcatcgatgaccctcagaccgtcgtcaacaaccgcaacaaggccctcatgatgatcgaagcctgggctgagtccaccggcgagttgcgctatctccctgtctacgaggaaacttacaagggaagtcaaaggggtttaccaacttcagctgacttgttaatgtcgtcgttcttgctggttaggggcatcagtgtcaaaggggttgttagttttgttgctgctgagattttgtgagagtgaaaaaaaagagaaaatatttttgggatcttcttctacttctagtgggggtttatggaataaaatgttcatgggttgagtgtctgcatctctgtgcagattccactgaatctctggatattataatcagccttagtcgtcaaatatggcatcaaagttgtttagagcaagccgatcatctatatcatcgtcatctgatgcacctgatgaccagaagccacctttacctccaagtgtacaatttggccggaggacttcctcgggtcgctatgtcagttactccagagatgatcttgatagtgagctagggagtaccgacttcatgaattacacagtgcatataccacctacccctgataaccaacctatggatccatcaatctcacagaaagttgaggaacaatatgtgtcaaattcacttttcacaggtggattcaacagcgttactcgagcccatctaatggataaggtgatagaatctgaagcaaatcatccgcagatggctggtgcaaaaggatcttcatgtgcaattcctggttgtgattctaaggtgatgagcgatgaacgtggtgctgatattcttccatgtgagtgtgatttcaagatatgcagagattgttatatagatgctgtaaaaacaggaggtgggatatgcccaggatgcaaggagccatacaagaacacagagctagatgaagtggctgtagataatggacgtccccttccacttcctccaccaagtggaatgtctaaaatggagaggagattgtccatgatgaaatcaacaaagtcggcactaatgaggagccaaactggagattttgatcataataggtggctctttgaaacaaagggcacctatggctatggcaatgctatatggccaaaggaaggtggttttggaaatgaaaaagaggatgatgttgttcagccaactgaattgatgagcagaccctggagaccacttactcggaaactgaagatacctgctgccgttttgagcccatatcgtcttatcatttttattcgtttggttgtcttggcactgttcttggcatggaggatcaaacaccaaaattctgatgcagtctggctctggggcatgtctgttgtttgtgagatatggtttgctttttcctggctgctggatcaactgcccaaactatgcccagtgaatcgttccacagaccttaatgttctaaaggagaaatttgaaacaccaaaccctaacaatcctactggaaaatctgatcttccaggcatagatatctttgtttctactgctgatcctgagaaagaacctcctcttgtcactgcaaacaccatcttgtctattttagctgctgattacccagttgagaagctttcttgttatgtttctgatgatggaggtgcacttctaacttttgaggcaatggccgaagctgccagctttgctaacatgtgggttcccttctgtcgtaaacatgatatagagcccaggaatcctgaatcatacttcaacttaaaaagagacccttacaaaaacaaagtgaagcctgattttgtcaaggatcgtagacgggtaaagcgtgagtatgatgaattcaaggttaggatcaatagtctgcctgaatctatccgccgccggtcagatgcctatcatgcaagagaggaaatcaaggccatgaaagttcagagacaaaacagggaagatgatcctttagaaactgtgaagattccaaaagcaacatggatggctgatggaactcattggccaggaacttggttgagtcctacatctgagcattccaagggtgaccatgctggtataattcaggtgatgttgaaacctcccagcgatgaacctcttttaggaagtgctgatgatacaaggctcattgacctgactgatgttgatatccgtcttccccttcttgtttatgtttctcgagagaagcgtccaggctatgatcacaacaaaaaagccggggccatgaatgccttggttcgagcctcagctataatgtctaatggtccttttatactcaatcttgactgtgaccactatatctacaactcaaaggcaatgagggaaggcatgtgctttatgatggatcgtggaggtgaccgcctttgttatgtccagttcccccagaggtttgaaggaattgatccctctgatagatatgctaaccataatactgtcttctttgatgtcaatatgcgagcccttgatggactccaaggaccagtctatgtgggaactggatgccttttcagacgggttgcactttatggttttgacccaccgcgttctaaagagcaccacacaggttgctgtaattgttgctttggtcgtcaaaagaagcatgcatcactggcaagcaccccagaagagaaccgtgcactgaggatgggtgattctgatgatgaggaaatgaatctatcattgttccctaagaagtttggaaactctactttcctcattgactcaattccagtggcagagtttcaaggtcgaccactagccgatcaccctgctgtgaaaaatggacgtccacctggtgctctcaccatagcccgcgatcttcttgatgcatcaactgttgcggaagccatcagtgtcatctcctgttggtatgaggacaagactgagtggggaaatcgcgttggatggatctatggatctgtgacagaggatgtggtcactgggtataggatgcacaataggggatggaaatcaatttactgcgtgaccaagcgtgatgccttccgtggaactgctcccatcaatctcactgacaggctgcatcaggtccttagatgggctactggctcggttgaaatattcttctctcgaaacaatgcactcctggctagcccaagaatgaaaattcttcaaagaattgcatacctaaatgttggaatctaccccttcacatccatattcctaattgtctactgcttccttcctgcactatcactattctccggccagttcattgtccaaaccctcaatgtcacttttctttcttacctcttgggcatcactgtgactctgtgcatgcttgcagtgcttgaaattaagtggtctggcattgagctggaagagtggtggagaaatgagcagttctggctgattggagggaccagtgcccatctagctgctgtgcttcaaggtttgctcaaagttgtagcagggattgaaatctcattcaccttgacttcaaaatcaggtggtgatgatgtagatgatgagtttgctgatctctatattgtgaaatggacatcccttatgattccacctatcacaattatgatggtcaacttaatagcaatagcagttggagtaagcagaaccatatacagtgtcataccacagtggagccgtctactaggtggtgttttcttcagtttttgggtcttggctcatctctatccctttgcaaaaggtttgatgggaagaagagggaggacacctaccatagtttttgtgtggtcaggcctcatagcaatcacaatttctctcctctgggtggctatcaacccccctgctggtactgaccaaattgggggttcattccagttcccttgacaggtcattcttttttgtcagatgaatgaatctgtcagctatttttttatttaaaattagtttcttttttctcttgattctacatattggtggttctactaatgaatggacttaaattatgttgtctattgtgcttatgaattttgtttagtacttaattccagaaatgtgatcatatttagcattctgctgattaagggtttcctgtcactgactttttttaatctgttcttacataattatcagcgtttgctcccatttttgac

SEQ ID NO: 10152 - DNA, 4731 bp, Populus trichocarpa
gtccttaccatccctgttccttctcttctctgaattaccaagaagaagatatagagccgttcaggacttacctaacatcgaccggcgatccacatagtaaactctcctccttacaagctgcttgggttgccaagaaccttcttcatttcttaagaataataataaaaaaaacccatctcccactaacaccacacaggcacagctgtgtcatagaagaaaaaaataacatatttagtcccagttacgccctatcagtgcttcacaactcggtccttctttctttcaacacccatttcaccctctctctttatgaatttattcttctttcttgctttctctatgtgagaaatacagagtgtggacggttaaaggtggtggctttctttgaagcattcattttttggttttaacgatttgttcaaattttcttgtcctccttttttccctgccgtttagcatttccaaagctttcaacgaatctgacaaagggatctgttcatctgttatatctatatatatacaaacagaaggtaagcctttatttagttaagacgactactagttctttctaactactacatgatctgcagtgttttgcttggttttaagattgatgtatggcctgattattcattgctcgaaaggtaaaatgttttacggtgaaaaggttttctgggtcttctttttcgtcgcttaaagcaaatgtcattttggatcttgggttgtttctgctactaggcttttgggttcatcttaaagtgtgtaaattgtgacgatgtttgtggaaattatgaggatctgaagagaagtctcttatagtgttaaaatatggcctcaaaatcattcaaggctactcgatcaaacctatcaactagctcggatgctgcggaatctcacaaacctcccctgcctccgtcggtgacatttggccggagaacttcttctggtcgctatatcagctactcaagggatgatcttgatagtgaacttgggagtagtgatttcatgaactatacagtgcacataccaccgacccctgacaaccaacccatggatccatcaatctcacaaaaggttgaagagcaatatgtgtcaaattcgctctttacaggcggttttaatagtgtgactcgtgctcatctcatggacaaggtgattgaatctgaagccagccatccccaaatggctggtgctaagggatcctcttgtgcgattccagggtgtgatgcaaaggtgatgagtgatgagcgaggtgttgatattctcccttgcgaatgtgatttcaaaatatgtagggattgttatattgatgcagtgaaaagtgggggtggaatttgccctggttgtaaggagccttataagaacaccgaattagatgaagtggctgtggacagtggaaggcctcttccacttcctccacctggcacaatgtccaaaatggagaggaggttgtcgttgatgaagtcaaccaaatcagtgctgatgaggagccagactggggactttgatcacaataggtggctctttgaaacaaggggaacttatgggtatgggaatgctatctggccaaatgatgggggttttggcaatgggaatgatgaagaagttggtgagcctaaagaattgatgagcaagccatggaggccacttactcgaaaattaaagataccagctgctgttatcagtccatatcggcttctcattcttattcggattgtgatactcgcattgtttttggaatggagggtcagacaccctaacaatgatgcaatttggctgtgggggatgtcagtggtttgcgagatctggtttgctttttcatggcttcttgaccagcttccaaagctatgcccaatcaatcgtgctacagatcttaatgtcttgaaagataaatttgaaacacccagccttagcaaccccactggtaaatctgatctcccaggcatagatgttttcgtctccactgcagatccagaaaaagaaccgcctcttgtcactgcaaacaccatcttatcaatcctagcagctgattacccagttgaaaagctttcttgttatgtttctgatgatggaggtgcacttctaacatttgaggccatggctgaagcagcaagttttgctaatgtatgggttcctttttgccgtaaacatggtgttgaacccaggaatccagaatcctacttcaatttgaagagggatccttacaagaacaaagtgaagccagattttgtcaaggatcgcagaagagtaaagcgtgagtatgatgagttcaaggtccgtataaatagcttgcctgattctattcgccgccgatctgatgcctatcatgctcgggaggaaatcaaggccatgaagcttcagaaacagcataaggacgatgaacctgtggagagcgtaaagattgcaaaagcgacatggatggcagatggtacccattggccagggacttggctgaattctgcacctgagcactctaggggtgaccatgctggtatcatacaggtgatgctgaaacctcccagcgatgagccactactcggaactgctgacgataccaagataatggacttcactgatgttgatattcgtctcccattgcttgtctatgtttctcgtgagaagcgtccaggctatgatcacaacaagaaggcaggggccatgaatgcgcttgttcgagcctcagctattatgtctaatggccctttcattcttaaccttgactgtgatcactatatttacaactcccaggcaatgagggaaggcatgtgtttcatgatggatcgaggaggtgaccgcctatgttatgttcagtttcctcagaggtttgagggcattgacccctctgatcgatatgctaatcacaacactgttttctttgatgtgaacatgcgtgcccttgatggtcttatgggtccagtctatgttggaactggctgcctcttcagaaggattgccctttatggctttgaccccccacgagcaaaagaaaaccacccaggttgctgcagctgctgcttttcccggcgcaagaagcattcctcgattgcaaacaccccagaagagaacagggctctaagaatgggtgattctgatgatgaagagatgaacctctccctgctccctaaaaagtttggcaactcaacgtttctcattgactcaatcccagtggcagagtatcaaggtcgtcctctcgcagatcacccagctgttaagaatggacgcccacctggtgctctcactattccccgtgagcttcttgatgcatcaactgttgcagaggcaatcagtgtcatatcttgctggtacgaggacaagactgagtggggaaatcgtgttggttggatttatggatctgtcactgaagatgttgtcactgggtataggatgcacaacaggggatggaaatcagtttattgtgtgaccaagcgtgatgccttccgtggcactgctccgattaatctcacagataggcttcatcaagttctcaggtgggctactggttctgttgagattttcttttcccgcaacaatgccctcttagccagccctagaatgaaatttcttcagaggatagcatatctgaacgttggcatctatcccttcacttcaatcttcctgattgtgtactgcttcctccctgcactttccctcttctctggccagttcattgttcagacccttaatgtcaccttccttgcttatctcctaatcatcacactgactctgtgtttacttgctgtgctggaaatcaagtggtctggaattgagctagaggagtggtggaggaatgagcagttttggttgattggaggaactagtgcccaccttgctgctgtgcttcaggggttgttgaaagtcgttgcagggattgaaatttctttcaccttgacttcaaaatcagctggtgatgatgtggatgatgagtttgctgatctctacgttgtcaaatggacatcgctgatgatacctcctatcaccatcatgatggtcaacttaattgcaatagcagttggatttagccgaacaatttacagtgttataccacagtggagtcgattactgggcggggttttcttcagtttctgggtcttggctcatctctacccctttgctaaagggttgatgggaagaagaggaaggacaccaaccattgtttttgtgtggtcaggtcttattgcaatcaccatctctctcctttgggtggcaatcaatcctccgtctggcaccaaccaaatcggtggctctttccagtttccttgataggtctttttttttgtcctttcgagtttaatttattcaatgacattcgtttactaaattcttagttcaaaacatcaatcctgctggagaacagactagttatgttccttgcacccattttgtgtagtggctacttccacaacagttctaccgaagatggagatcaggaccgagaagatgggtggctggttttcttggctttgttgtgtgacaatgcattgcatgaaatactaaaatcagcggacccattttcaggcagatgactagaattgtgctcaatgcattcttttgtaatttagaaaagcgaacgtaaattttaatggaatattttttttattccaatgcttcttcattagttcattccctttgttcatggcaagggcccaaagttgttatatacactttggaagggacgatgattaatcctcggcgtgtccgaagttgtctcaaatgtaagattcttgacctatc

SEQ ID NO: 10153 - DNA, 4432 bp, Glycine max
ctcgttaaggtttggtaggattggaaatttgaaggggcttagtggtgtacaaactaaaaagtttttggtcgcgactaattctccatctgtctttgctctgtctgtctaattcaaattgcgtgtgactgtgtcgtgtatgcgcaagcttataaggttacagttggaaagcaagttcaacacttttaagttttcctttccatcagattcattttcaaacgcttctcttctcttctcatggctttctgctaacatcaccaaacacagatctgaaacaaacaaaagaggatattataatcagccttagtcgtcaaatatggcatcaaagttgtttagagcaagccgatcatctatatcatcgtcatctgatgcacctgatgaccagaagccacctttacctccaagtgtacaatttggccggaggacttcctcgggtcgctatgtcagttactccagagatgatcttgatagtgagctagggagtaccgacttcatgaattacacagtgcatataccacctacccctgataaccaacctatggatccatcaatctcacagaaagttgaggaacaatatgtgtcaaattcacttttcacaggtggattcaacagcgttactcgagcccatctaatggataaggtgatagaatctgaagcaaatcatccgcagatggctggtgcaaaaggatcttcatgtgcaattcctggttgtgattctaaggtgatgagcgatgaacgtggtgctgatattcttccatgtgagtgtgatttcaagatatgcagagattgttatatagatgctgtaaaaacaggaggtgggatatgcccaggatgcaaggagccatacaagaacacagagctagatgaagtggctgtagataatggacgtccccttccacttcctccaccaagtggaatgtctaaaatggagaggagattgtccatgatgaaatcaacaaagtcggcactaatgaggagccaaactggagattttgatcataataggtggctctttgaaacaaagggcacctatggctatggcaatgctatatggccaaaggaaggtggttttggaaatgaaaaagaggatgatgttgttcagccaactgaattgatgagcagaccctggagaccacttactcggaaactgaagatacctgctgccgttttgagcccatatcgtcttatcatttttattcgtttggttgtcttggcactgttcttggcatggaggatcaaacaccaaaattctgatgcagtctggctctggggcatgtctgttgtttgtgagatatggtttgctttttcctggctgctggatcaactgcccaaactatgcccagtgaatcgttccacagaccttaatgttctaaaggagaaatttgaaacaccaaaccctaacaatcctactggaaaatctgatcttccaggcatagatatctttgtttctactgctgatcctgagaaagaacctcctcttgtcactgcaaacaccatcttgtctattttagctgctgattacccagttgagaagctttcttgttatgtttctgatgatggaggtgcacttctaacttttgaggcaatggccgaagctgccagctttgctaacatgtgggttcccttctgtcgtaaacatgatatagagcccaggaatcctgaatcatacttcaacttaaaaagagacccttacaaaaacaaagtgaagcctgattttgtcaaggatcgtagacgggtaaagcgtgagtatgatgaattcaaggttaggatcaatagtctgcctgaatctatccgccgccggtcagatgcctatcatgcaagagaggaaatcaaggccatgaaagttcagagacaaaacagggaagatgatcctttagaaactgtgaagattccaaaagcaacatggatggctgatggaactcattggccaggaacttggttgagtcctacatctgagcattccaagggtgaccatgctggtataattcaggtgatgttgaaacctcccagcgatgaacctcttttaggaagtgctgatgatacaaggctcattgacctgactgatgttgatatccgtcttccccttcttgtttatgtttctcgagagaagcgtccaggctatgatcacaacaaaaaagccggggccatgaatgccttggttcgagcctcagctataatgtctaatggtccttttatactcaatcttgactgtgaccactatatctacaactcaaaggcaatgagggaaggcatgtgctttatgatggatcgtggaggtgaccgcctttgttatgtccagttcccccagaggtttgaaggaattgatccctctgatagatatgctaaccataatactgtcttctttgatgtcaatatgcgagcccttgatggactccaaggaccagtctatgtgggaactggatgccttttcagacgggttgcactttatggttttgacccaccgcgttctaaagagcaccacacaggttgctgtaattgttgctttggtcgtcaaaagaagcatgcatcactggcaagcaccccagaagagaaccgtgcactgaggatgggtgattctgatgatgaggaaatgaatctatcattgttccctaagaagtttggaaactctactttcctcattgactcaattccagtggcagagtttcaaggtcgaccactagccgatcaccctgctgtgaaaaatggacgtccacctggtgctctcaccatagcccgcgatcttcttgatgcatcaactgttgcggaagccatcagtgtcatctcctgttggtatgaggacaagactgagtggggaaatcgcgttggatggatctatggatctgtgacagaggatgtggtcactgggtataggatgcacaataggggatggaaatcaatttactgcgtgaccaagcgtgatgccttccgtggaactgctcccatcaatctcactgacaggctgcatcaggtccttagatgggctactggctcggttgaaatattcttctctcgaaacaatgcactcctggctagcccaagaatgaaaattcttcaaagaattgcatacctaaatgttggaatctaccccttcacatccatattcctaattgtctactgcttccttcctgcactatcactattctccggccagttcattgtccaaaccctcaatgtcacttttctttcttacctcttgggcatcactgtgactctgtgcatgcttgcagtgcttgaaattaagtggtctggcattgagctggaagagtggtggagaaatgagcagttctggctgattggagggaccagtgcccatctagctgctgtgcttcaaggtttgctcaaagttgtagcagggattgaaatctcattcaccttgacttcaaaatcaggtggtgatgatgtagatgatgagtttgctgatctctatattgtgaaatggacatcccttatgattccacctatcacaattatgatggtcaacttaatagcaatagcagttggagtaagcagaaccatatacagtgtcataccacagtggagccgtctactaggtggtgttttcttcagtttttgggtcttggctcatctctatccctttgcaaaaggtttgatgggaagaagagggaggacacctaccatagtttttgtgtggtcaggcctcatagcaatcacaatttctctcctctgggtggctatcaacccccctgctggtactgaccaaattgggggttcattccagttcccttgacaggtcattcttttttgtcagatgaatgaatctgtcagctatttttttatttaaaattagtttcttttttctcttgattctacatattggtggttctactaatgaatggacttaaattatgttgtctattgtgcttatgaattttgtttagtacttaattccagaaatgtgatcatatttagcattctgctgattaagggtttcctgtcactgactttttttaatctgttcttacataattatcagcgtttgctcccatttttgacaattatttctgaaagcagtgttcttgcattccaatgctctcattacgttaattctttcttttcattgatggtgacaacttccatcacttgaaattctagtatgcttgttaatgtagggcagccgcctgcaggatgcattttgctttgattgttatttataattattgactagctacatatcgttgaaggtgaaaaaataattataacaatgaagtaatattagaaagtggtagtgttgagtgtgaggatggtcccaatgtgtgagaggagggaccaaggaaatattagtagggtgctgtatcgctggttggtgagagagaaaaagaccgaggataagacattgacattactcactaatttcatgtttgttacactgattcctttatctacaaggttcgagcatgatacattgcttaaaaga

SEQ ID NO: 10154 - DNA, 3919 bp, Glycine max
tggaacttggaagtggcttagtggtgtacaaagttttggtcacgactaattctccatctgtctttgctctgtctgtcaaattgcgtgtgactgtatcgtgtatgcgcgtctctctgtttgtttgtttaagcctttaaggttacagttggagagcaagttcaacacttttaagcttttctttccatcacattcaaacaccccatctcttctcatgcctttctgctaacatcaccaaatacagatctgaaacaaacaaacaaaagaggatattataatcagccttagtcgtcaaatatggcatcaaaattgtttagggaaagccgatcatctatatcatcatcgtctgatgcacccgatggccagaagcctcctttacctccaagtgtacaatttggccggagaacttcctcgggtcgctatgtcagttactctagagatgatcttgacagtgagctagggagtactgacttcatgaattatacagtgcatataccacctacccctgataaccaacctatggatccatcaatctcacagaaagttgaggaacaatatgtgtcaaattcacttttcacaggtggattcaacagtgtcactcgagcccatctcatggataaggtgattgaatctgaagcaaatcatccacagatggctggtgcaaaaggatcttcatgtgcaattcctggttgtgattctaaggtgatgagcgatgaacgtggtgctgatattcttccatgtgagtgtgattttaagatatgcagagattgttatatagatgcagtaaaaacaggaggtgggatatgcccaggatgcaaggagccatataagaacacagaactagatgaagtggctgtagataatgggcgtccccttccacttcctccaccaagtggaatgtctaaaatggagaggagattgtccatgatgaagtcaacgaagtcagcactggtgaggagccaaactggagattttgatcataataggtggctctttgaaacaaagggaacctatggctatggcaatgctatatggccaaaggaaggtggttttggaaatgaaaaagaggatgattttgttcagccaactgaattgatgaacagaccctggagaccacttactcggaaactgaagatacctgctgccgttttgagcccatatcgtcttatcattttcattcgtttggttgtcttggcactgttcttggcgtggaggatcaaacaccaaaatactgatgcagtctggctatggggcatgtctgttgtttgtgagatatggtttgccttttcctggctgctggatcaactgcccaaactatgcccagtgaatcgttccactgatcttaatgttctgaaagagaaatttgaaacaccaacccctaacaatcctactggaaaatctgatcttccaggcatagatatctttgtttctactgctgatcctgagaaagaacctcctcttgtcactgcaaacactatcttgtctattttagctgctgattaccctgttgagaagctttcttgttatgtttctgatgatggaggagcacttctaacttttgaggcaatggctgaagctgccagctttgctaatgtgtgggttcccttctgtcgtaaacatgatatagagcccaggaatcctgaatcatacttcaacttaaaaagagatccttacaaaaacaaagtgaagcctgattttgtcaaggatcgtagacgggtaaagcgtgagtatgatgaattcaaggttaggatcaatagtctgcctgactctatccgtcgccggtctgatgcctatcatgcaagagaggaaatcaaggccatgaaagttcagagacaaaacagggaagatgaacctttagaagctgtaaagattccaaaagcaacatggatggctgatggaactcattggccaggaacttggttgagtcctacatctgagcattctaagggtgaccatgccggcataattcaggtgatgctgaaacctccgagcgatgaacctcttttaggaagttctgatgatacaaggctcattgacctgactgatattgatatccgtcttccccttcttgtttatgtttctcgagagaagcgcccaggctatgatcacaacaaaaaagccggggccatgaatgcattggttcgagcctcagctataatgtctaatggcccttttatactcaatcttgactgtgatcactatatctacaactcaaaggcaatgagggaaggcatgtgctttatgatggatcgtggaggtgaccgcctttgttatgtccagttcccccagaggtttgaaggaattgatccctctgatagatatgctaaccataatactgttttctttgatgtcaatatgcgagcccttgatggactccaaggaccagtctatgtgggaactgggtgccttttcagacgggttgcactttatggttttgacccaccacgttctaaagagcaccacacaggttgctgtaattgttgctttggtcgtcagaagaagcatgcatcactggcaagcaccccagaagagaaccgttcactgaggatgggtgattctgatgatgaggaaatgaatctatcgttgtttcctaagaagtttggaaactctactttcctcattgactcaattccagtggcagagttccaaggtcgtccgctagctgatcaccctgctgtgaaaaatggacgtccacctggtgctctcaccataccccgcgatcttcttgatgcatcaactgtcgcagaagccatcagtgtcatctcctgttggtacgaggacaagactgagtggggaaatcgtgttggatggatctatggatctgtgacagaggatgtggtcactggatataggatgcacaataggggatggaaatcagtttactgcgtgaccaagcgtgatgccttccgtggaactgctcccatcaatctcactgacaggctgcatcaggtccttagatgggctactggctcagttgaaatattcttctctcgaaacaatgcgctgctggctagcccaagaatgaaaattcttcaaagaattgcatacctaaatgttggaatctaccccttcacgtccatattcctaattgtctactgcttccttcctgcactatctctcttctctggccagttcattgtccaaaccctcaatgtcacttttctttcttacctcttgggcatcactgtgactctgtgcatgcttgctgtgcttgaaattaaatggtctggcattgagctggaagaatggtggagaaatgagcagttttggctgattggagggaccagtgcccatctagctgcggtgcttcaaggtttgctcaaagtcatagcagggattgaaatatcattcaccttgacttcaaaatctggtggtgatgatgtagatgatgagtttgctgatctctatattgtgaaatggacatcccttatgataccacctatcacaattatgatggttaacttaatagctatagcagttggagttagcagaaccatatacagtgtcataccacagtggagccgtctacttggtggtgttttcttcagtttttgggtcttggctcatctctatccctttgcaaaaggtttgatgggaagaagagggaggacacctaccatagtttttgtgtggtcaggcctcatagcaatcacaatttctctcctctgggtggctatcaacccccctgctggtactgaccaaattgggggttcattccagttcccttgataggtcattctttttgtcagatgaatctgtcagcaatttttttatttaaaattagtttcggtttttttcctcttgattctacatattggttctactaatgaatggacgtaaattatgttgtctattgtgcttatgaattttgtttagaacttaattccagaaatatgatcatatttagctttctgctgattaa

SEQ ID NO: 10155 - DNA, 4071 bp, Glycine max
ttaagctttagtaggatagaaaatttggaacttggaagtggcttagtggtgtacaaagttttggtcacgactaattctccatctgtctttgctctgtctgtcaaattgcgtgtgactgtatcgtgtatgcgcgtctctctgtttgtttgtttaagcctttaaggttacagttggagagcaagttcaacacttttaagcttttctttccatcacattcaaacaccccatctcttctcatgcctttctgctaacatcaccaaatacagatctgaaacaaacaaacaaaagaggatattataatcagccttagtcgtcaaatatggcatcaaaattgtttagggaaagccgatcatctatatcatcatcgtctgatgcacccgatggccagaagcctcctttacctccaagtgtacaatttggccggagaacttcctcgggtcgctatgtcagttactctagagatgatcttgacagtgagctagggagtactgacttcatgaattatacagtgcatataccacctacccctgataaccaacctatggatccatcaatctcacagaaagttgaggaacaatatgtgtcaaattcacttttcacaggtggattcaacagtgtcactcgagcccatctcatggataaggtgattgaatctgaagcaaatcatccacagatggctggtgcaaaaggatcttcatgtgcaattcctggttgtgattctaaggtgatgagcgatgaacgtggtgctgatattcttccatgtgagtgtgattttaagatatgcagagattgttatatagatgcagtaaaaacaggaggtgggatatgcccaggatgcaaggagccatataagaacacagaactagatgaagtggctgtagataatgggcgtccccttccacttcctccaccaagtggaatgtctaaaatggagaggagattgtccatgatgaagtcaacgaagtcagcactggtgaggagccaaactggagattttgatcataataggtggctctttgaaacaaagggaacctatggctatggcaatgctatatggccaaaggaaggtggttttggaaatgaaaaagaggatgattttgttcagccaactgaattgatgaacagaccctggagaccacttactcggaaactgaagatacctgctgccgttttgagcccatatcgtcttatcattttcattcgtttggttgtcttggcactgttcttggcgtggaggatcaaacaccaaaatactgatgcagtctggctatggggcatgtctgttgtttgtgagatatggtttgccttttcctggctgctggatcaactgcccaaactatgcccagtgaatcgttccactgatcttaatgttctgaaagagaaatttgaaacaccaacccctaacaatcctactggaaaatctgatcttccaggcatagatatctttgtttctactgctgatcctgagaaagaacctcctcttgtcactgcaaacactatcttgtctattttagctgctgattaccctgttgagaagctttcttgttatgtttctgatgatggaggagcacttctaacttttgaggcaatggctgaagctgccagctttgctaatgtgtgggttcccttctgtcgtaaacatgatatagagcccaggaatcctgaatcatacttcaacttaaaaagagatccttacaaaaacaaagtgaagcctgattttgtcaaggatcgtagacgggtaaagcgtgagtatgatgaattcaaggttaggatcaatagtctgcctgactctatccgtcgccggtctgatgcctatcatgcaagagaggaaatcaaggccatgaaagttcagagacaaaacagggaagatgaacctttagaagctgtaaagattccaaaagcaacatggatggctgatggaactcattggccaggaacttggttgagtcctacatctgagcattctaagggtgaccatgccggcataattcaggtgatgctgaaacctccgagcgatgaacctcttttaggaagttctgatgatacaaggctcattgacctgactgatattgatatccgtcttccccttcttgtttatgtttctcgagagaagcgcccaggctatgatcacaacaaaaaagccggggccatgaatgcattggttcgagcctcagctataatgtctaatggcccttttatactcaatcttgactgtgatcactatatctacaactcaaaggcaatgagggaaggcatgtgctttatgatggatcgtggaggtgaccgcctttgttatgtccagttcccccagaggtttgaaggaattgatccctctgatagatatgctaaccataatactgttttctttgatgtcaatatgcgagcccttgatggactccaaggaccagtctatgtgggaactgggtgccttttcagacgggttgcactttatggttttgacccaccacgttctaaagagcaccacacaggttgctgtaattgttgctttggtcgtcagaagaagcatgcatcactggcaagcaccccagaagagaaccgttcactgaggatgggtgattctgatgatgaggaaatgaatctatcgttgtttcctaagaagtttggaaactctactttcctcattgactcaattccagtggcagagttccaaggtcgtccgctagctgatcaccctgctgtgaaaaatggacgtccacctggtgctctcaccataccccgcgatcttcttgatgcatcaactgtcgcagaagccatcagtgtcatctcctgttggtacgaggacaagactgagtggggaaatcgtgttggatggatctatggatctgtgacagaggatgtggtcactggatataggatgcacaataggggatggaaatcagtttactgcgtgaccaagcgtgatgccttccgtggaactgctcccatcaatctcactgacaggctgcatcaggtccttagatgggctactggctcagttgaaatattcttctctcgaaacaatgcgctgctggctagcccaagaatgaaaattcttcaaagaattgcatacctaaatgttggaatctaccccttcacgtccatattcctaattgtctactgcttccttcctgcactatctctcttctctggccagttcattgtccaaaccctcaatgtcacttttctttcttacctcttgggcatcactgtgactctgtgcatgcttgctgtgcttgaaattaaatggtctggcattgagctggaagaatggtggagaaatgagcagttttggctgattggagggaccagtgcccatctagctgcggtgcttcaaggtttgctcaaagtcatagcagggattgaaatatcattcaccttgacttcaaaatctggtggtgatgatgtagatgatgagtttgctgatctctatattgtgaaatggacatcccttatgataccacctatcacaattatgatggttaacttaatagctatagcagttggagttagcagaaccatatacagtgtcataccacagtggagccgtctacttggtggtgttttcttcagtttttgggtcttggctcatctctatccctttgcaaaaggtttgatgggaagaagagggaggacacctaccatagtttttgtgtggtcaggcctcatagcaatcacaatttctctcctctgggtggctatcaacccccctgctggtactgaccaaattgggggttcattccagttcccttgataggtcattctttttgtcagatgaatctgtcagcaatttttttatttaaaattagtttcggtttttttcctcttgattctacatattggttctactaatgaatggacgtaaattatgttgtctattgtgcttatgaattttgtttagaacttaattccagaaatatgatcatatttagctttctgctgattaagaggctttctttttttgtcttcttacataaatcaaaatcagcgtttgcccccattttttgacaattatttctgaactacttcagaactaaatcacccacatgtaagttgtgcagtaatcggtatttt

SEQ ID NO: 10156 - DNA, 4708 bp, Populus trichocarpa
cccttttgtcttaaaattaaaaataaaaaagatctttatttttacgtccccattttgtccaaacaaattcctctctccttccaaaccccaacagacatactagcatcaaaaagatagagtggctgcaggacttcccaaacatcagccggcgatccacaaaacccactctcctccttacatgctcctcttcttttttggttctctgccctcagtgccaagaacgttcttcctttcttttattacataactagattcataaaaaaaggaagaaaaaccacccctactacgtcacacagtcacagctgtgtaataaggggaaaaaaataatatttagtctcagtcatgccctctttgtgcttgtagttttgttcacgactcagtctttctatcaacacccacacctctgtatacgaatttttctttcttgctttttgtacgtgagaaagagaaatacacagtatgaacggttacaggtggtggctttgaagcattccttttttgcttttaaagattggttcaaattattattacttgccgtttagcatttccgaagctttcaaagaatctgacaaagggatctgtccatctattatccctcccctcaatttatatacacacgcatagatacaaagagaaggcaaaacctttatttagtaagacaagtactagtcctaactactaggtgatctgcagcgtttttcttggttttaagattttctgatggcgtgattagttgctgctgctcgaaaggatttgaagagacgtgtcccttacagtgttaagatatggcctcaagatcattcaaaggcactcgatcaaatctatcaattagctcggatgctgccgaatctcacaaacctcctctacctcagaccgtgacatttggccggaggacttcctctggtcgctatatcagctactcaagggatgatcttgatagtgaacttgggagtagtgatttcatgaactatacagtgcacttacctccgacccctgacaaccaacccatggatccatctatctcacaaagggttgaagagcaatatgtctcaaattcactctttacaggcggttttaatagtgttactcgtgctcatctcatggacaaggtgattgaatctgaagccagccatccccaaatggctggtgctaagggatcctcttgtgcgattccagggtgtgatgccaaggtgatgagtgatgagcgtggtgttgatattctcccttgtgagtgtgatttcaaaatatgccgggattgctttatcgatgcagtaaaaattggaggtggaatttgccctggttgcaaggagccttataaaaacaccgaattggatgaagtggttgtggacagtggaaggcctcttccacttcctccaccaggcacagtgtccaaaatggagaggagattgtcattgatgaagtcaaccaaatcagcgctgatgagaagccagactggggactttgatcacaataggtggctctttgaaacaaggggaacttatgggtatggcaatgctatctggccaagtgatgggggtttcggcaatgggaatgatgaggaagttggtgggcccaaagaattgatgaacaagccatggaggccgcttactcgaaaattaaagattccagctgctattatcagtccatatcggcttctcatttttgttcggattgttattctcgcactattcttgcattggaggatcagacatccaaacaacgacgcaatctggctgtgggggatgtcagtggtttgcgagatctggtttgctttttcttggcttttggatcaacttccaaagctatgccctatcaatcgtgctacagatctgaatgtgttgaaagataaatttgaaacacccagccctagcaaccccactggtaaatctgatctccctggcgtagatgtttttgtctctactgcagatccagaaaaagaaccgccacttgtcactgcaaacaccatcttatcaattctagcagctgattacccagttgaaaagctttcttgttatgtttccgatgatggaggtgcacttttaacatttgaggccatggccgaagcagcgagttttgcaaatgtatgggttcctttctgccgtaaacatgatattgagcccaggaatccagaatcctacttcagtttgaagagggatccttacaagaacaaagtgaagcaagattttgtcaaggatcgtcgaagagtaaagcgtgaatatgatgagttcaaggttcgaataaatagcttgcctgattctattcgccgccgatctgatgcctatcatgctcgggaggaaatcaaggccatgaaacttcagaaacagcacaaggacgatggacctgtggagagtgtaaagattccaaaagctacatggatggcagatggtacccattggccagggacttggctgaatccttctcctgagcactctaggggtgaccatgctggtataatacaggtgatgttgaaacctcccagcgatgagccactacttggaacttctgatgaaactaagataatggactttactgatgttgatatacgtctcccattgcttgtttatgtttctcgtgagaagcgtccaggctatgatcacaacaagaaggcaggggccatgaatgcacttgttcgagcctcagccattatgtctaatggtcctttcattcttaatcttgattgtgatcactatatttacaattcccaggcaatgagggaagggatgtgtttcatgatggatcgaggaggtgatcgcctctgttatgttcagttccctcagaggtttgagggcatagacccttctgatcgatatgctaatcacaacactgttttttttgatgtgaacatgcgtgcccttgatggtctaatgggtccagtctatgttggaactggttgcctctttagaaggattgctctttatggctttgacccaccacgggcaaaagaagatcacccagattgctgcagctgctgctttgcccggcgcaagaaacattcctcagctgcgaacactccagaagagaacagggctctgagaatgggtgattatgatgatgaagagatgaacctctccctgctccctaagaagtttggcaactcaacattcctcattgactcaatcccagtgacagagtttcaaggtcgtcctcttgcagatcacccagctgttaagaacggacgcccacctggtgctctcactattccccgtgagcttcttgatgcatcaactgttgcagaggcaatcagtgtcatatcttgctggtatgaagacaagactgagtggggaaatcgagttgggtggatttatggatctgttactgaagatgttgtcactgggtataggatgcacaacaggggatggaaatcagtttattgtgttaccaagcgtgatgccttccgtggcactgctccaattaacctcacagataggcttcatcaagttctcaggtgggctactggttctgttgaaattttcttttcccgcaacaatgccctcttagccagccgtagaatgaaatttcttcagaggatagcatatctgaacgttggcatctatcccttcacttcgatcttcctgattgtgtactgcttcctccctgcactttccctattctctggccagttcattgttcagacccttaatgtcacttttcttgcttatctcctaatcatcacattgactctatgtttacttgctgtgcttgaaatcaaatggtctggcatcgacctagaggagtggtggaggaatgagcagttttggttgattggaggaaccagtgcccaccttgctgctgtgcttcagggattgttgaaagtcattgcagggattgaaatttctttcaccttgacttcaaaatcaggtggtgatgatgttgatgatgagtttgctgatctctacgttgtcaaatggacatcgctgatgatacctcctattacaatcatgatggtcaacttaattgcaatagcagttggatttagccgaacaatttacagtgttataccgcagtggagtagattactgggtggggttttcttcagtttctgggtcctggctcatctctacccttttgctaaaggtcttatgggaagaagaggaaggacaccgaccattgtttttgtgtggtcaggacttattgcaatcaccatctctctcctctgggtggcaatcaatcccccgtctggcaccacccaaattggtggctcattccagtttccctgataggtctttttctttctttttttgtttaatttattcaattgcgttcctttactaaattcttttttcaaaacatctttctgctggagtacaggctagatatgtttttgcacacattttgtgtagtggctgtttactttcacaaaagttctagtgaaaatggagacaaggactgagaagatgggtaactggttttcttggcactgtttttgacaatgcattacatgaaatactaaaaccagagacccatctttacgtagatgattaggattgtgatcattgtcatgattaggattgtgatcattgtcttcttttgttacatagtaaagtgtatcaattttaagggaaattgccctgtttattccaacgcttcatggctatggcggggcggggccctgtgctgatgctgttatatcgcacgttatcggactgtttgaccttattgaactgcggatatttgaaattgattctccttttaattacaagttaaacaa

SEQ ID NO: 10157 - DNA, 4487 bp, Ricinus communis
accagtactgcccttaccttagattctcctcatctgcctgaaaacccaaattcaccctttccttcaccccctaaattctttccttttcatcttcttgtgttttggtcctaaactcctaagacctcaacttctacttctactcaatcagacatcaaaaggaaaaaaaaaaaaaaaggaaaaaactatagaagccgctctggtcataatacttggccggcgaggcaaaactgaaaacccacttccttttttaatttaatctttctttcatgttctcttcttttagcccctgagccaagaaccaggaaccttctgtcttccctgaattataaattttgaaagaaaataaataaacacttcaaaacccagcaaagcttttgtataaaataaagtatttagtcctgatcatgccctgttagtggcttgttgtttctttctcacgacctggtccttctttcaaccaagaaactttcttttgttatttgattttaactaatgtgagaagttgtggacagttggtgacgttggagctttctcttttctttttaaagattggttcaggttttagtctcttttaacatttctgatagaatcaaacaaaagggatctatctatccatcttcctcttcagtctgtaaagactggttcttatttaaaaagagaaaggatctgaagagactttctgtgataggaataaaatatggcctcaaaatcatttaaacttagcagatcaaatctatcagtgagttcagatgccaatgattctcagaagcctccactgcctccaactgtgacatttggccggagaacttcctcaggtcgctatatcagctattcaagggatgatcttgatagtgaattggggagtagtgatttcatgaactatacagtgcatataccacctactcctgataaccaacccatggatccatctatttcacagaaggtggaagagcaatatgtatcgagttcactctttacaggcgggtttaatagtgttacacgggctcatcttatggacaaggtgattgagtctgaaacaagccatccccagatggctggtgccaaggggtcctcttgttcaatcccaggctgtgatgcaaaggttatgagtgatgagcgtggagtggatattctcccttgtgaatgtgattttaagatatgccgggattgttatattgatgcagtgaaaacaggaggtggaatttgcccaggttgcaaggagtcttataagaacactgaattggatgaagtagctgtggataatgggaggccacttccacttcctccaccaggaacagtatccaaaatggagaggaggttgtcattgatgaagtccacgaagtcggtgctaatgaggagccaaactggggattttgatcataataggtggctgtttgaaacaagggggacttatggatatgggaatgccatatggccaaatgatggaggctttagcaatggaaaagatgaagaagtcgttgaacccaaagagttgatgaataaaccatggaggccacttactcggaaattaaagataccagctgctattatcagcccatataggctgctcatctgtattcgggttgttgtccttgccttgttcttgatgtggagagtctcacatccaaatgaagatgcagtatggctatggggaatgtcagttgtttgtgagatttggtttgctttttcttggcttcttgaccaacttcccaagctatgccctatcaatcgagctacagatcttaatgtcttaaaagagaaattcgaaacaccaacccccagtaatcctactggaaaatcagatcttccgggcatagatgtctttgtctctacagcagatccagagaaagaaccgcctctagtcactgccaacacaattttgtcaattctagctgctgattatccggtcgaaaaacttgcttgttatgtatctgatgatggaggtgcacttctaacatttgaggccatggcagaagcagcaagttttgctaatatttgggtgcctttctgtcgtaaacatgatattgagcccaggaatccagaatcttacttcaatttgaagagggatccttacaagaacaaagtgcgtcctgattttgttaaggatcggaggagggtaaagcgtgaatatgatgaattcaaggttcgaatcaatggcttgcctgattctattcgccgccgatctgatgcctttcacgctcgtgaggaaattaaggccatgaaacttcaaagacagaacagagatgatgaacctgtggagagtgtaaagatcccaaaagctacatggatggcagatggtactcattggccaggaacttggatgcagtctgcacccgagcattctaagggtgaccatgctggtattatacaggtgatgttgaaacctcctagtgatgaaccattgcatggaactgctgatgatacgaagattatagactttactgatgtagatattcgtttgcctttacttgtttatgtctctcgtgagaaacggccaggctatgatcacaataagaaggcaggggccatgaatgcacttgttagagcctcagccatcatgtctaatggcccattcattctcaaccttgattgtgaccactatatttacaattcccaagcaatgagggaaggcatgtgcttcatgatggatcgaggaggtgaccgcatttgttatgttcagttccctcagagattcgagggtattgacccttctgatagatatgccaatcacaacacggttttctttgatgttaatatgcgtgctcttgatggtctcatgggccctgtctatgttggaactggatgtctctttagaagaacagccctgtatggctttgaccctcctcgagcaaaagaacaccacccaggttgctgcgactgttgcttttcccgtcgcaagaagcattcttctgttggaaacaccccggaagagaatagggcattaagaatgggtgattctgatgacgaagagatgaacctttctctgttccctaagaagtttggcaactcaacattcctcgttgattcaattccagtggctgaatttcaaggtcgtccccttgcagatcacccagctgttaagaatggccgcccacctggtgctcttacaattcctcgtgaccttctagatgcatcaactgttgcagaggcaatcagtgtcatttcttgctggtatgaagacaagacagagtggggacacagaattgggtggatttatggttctgttacagaagatgttgtcactggttataggatgcacaacaggggatggaaatcagtttactgtgtgaccaagcgcgatgccttccgtggcactgctcccattaatctcacagataggcttcatcaagtcctcaggtgggctactggttctgttgagattttcttctcccgcaacaatgcccttctagccagcccaagaatgaaactactacagaggatagcatatctcaacgtcggtatctacccgtttacgtccatcttcttgattgtttactgcttcctgcctgcactatcgctcttctctggccagttcattgttcagacgcttaatgtcactttccttgtctacctccttgtcatctctttgactttatgcttactagctttgcttgagatcaaatggtctggcattgaactagaggagtggtggagaaatgaacaattttggttgattggaggtactagtgctcaccttgctgctgtgcttcaagggctgttgaaggttgttgcaggaattgaaatttctttcaccttgacatcaaaatcagctggtgatgatgtggatgatgagtttgctgatctctacgttgtcaaatggacttctttaatgataccaccaatcgtgatcatgatggtcaacttaatagcaatcgcagtcggatttagccgaacaatatacagtgtgataccacagtggagccgtttaataggtggagttttcttcagtttctgggtcttggctcatctctacccttttgccaaagggctgatgggaagacgagggaggacaccgaccattgtttttgtgtggtcaggacttatagcaatcaccatatccctcctctgggtggccatcaatcccccctcaaatactgaccaaattggaggctcattccagttcccttgataggagaccattttttcttgtcgagatgcatttgttcaatgacattccttcattagttctataattttcttttgcccttccctttctttcatctgtcatgttggagaacaggctagatatgatcttgtttcttgtgcaacgcttcatgtatgtgaaagatcggcaggaccaagaaggtgaaatgctagtatcagttttccattttttcatggatgactgcttattgtattcttttgtaatgtagaaagttgaacatcaaattaattacagaggcaactgcctccagatttcttttattcacttaattcatagcttcacatgcttcactgctacctcaaggatactgtccactgtccgt

SEQ ID NO: 10158 - DNA, 3878 bp, Phaseolus vulgaris
cagtgtcgtgtatgcgcgtttgtttgttttgtttgtattttgaagtctacaaggtgacagttgtagagcaagttcaacactttaacttttgagcttttccatcagattcaaattcaaacccatctcttctcttctcctctcctctcatggctttctgatatattcaccattcacagatctgaaacaaagtaaagagcatattataatcagttctgcagtcaactatggcatcaaaaatgtttagagcaagtcgatcatctatatcaacatcatctgatggtgcacctgatggtcagaagcctccattacctccaagtgtacaatttggaaggagaacttcctcaggccgctatgtgagttactctagagatgatcttgacagtgagatagggagtactgacttcatgaactatacggtgcatataccagctaccccagataaccaacctatggatccatcaatctcacagaaagttgaggagcagtatgtgtcaaattcacttttcacaggtggattcaacagtgttactcgagcccatctaatggataaggtgatagaatctgaagcaagtcatccacagatggctggtgcaaaagggtcttcatgtgctgttcctggttgtgattctaaggtgatgagtgatgaacgtggtgccgatattcttccctgtgagtgtgattttaagatatgtagagattgttatatcgatgcagtaaaaacaggaggtggaacgtgcccaggatgcaaggagtcgtataagaacacagagctagatgaagtggctgcagataatggtcatcctcttcaacttcctccaccaggtggaatgtctaaaatggagaggagattgtccttgatgaagtcaacgaagtcggttttaatgaggagccaaactggggactttgatcataacaggtggctctttgaaacaaaggggacctatggctatggtaatgctatatggccaaagcaaggtggttttggaaatgaaatagagaatgatgttgttgagcctactgaattgatgaacagaccctggagaccacttaccaggaaactgaagatacctgctgctattttgagtccatatcgtcttatcatttttattcgtttggttgtcttggcactgttcttggcatggagggtcaaacaccaaaatactgatgcagtatggctgtggggcatgtctgttgtttgtgagatatggtttgctttttcctggcttctggatcaactgcccaaactctgcccggtgaatcgttcgacagatcttaatgttctgaaggagaaatttgaaactcccacccctaacaatccaactggaaaatctgatcttccaggaatagatatctttgtttctactgctgatcctgagaaagaacctcctctcgtgaccgcgaacactatcttgtctattttagccgctgattaccctgttgagaagctttcttgttatgtttctgatgatggaggtgcacttctaacttttgaggcaatggctgaagctgccagctttgctaatgcatgggttcacttctgccgtaaacatgatatagagcccaggaatcctgaatcatacttcagcttaaaaagagatccttacaaaaacaaagtgcggcctgattttgtcaaggatcgcagacgagtaaagcgtgagtatgatgaattcaaggttaggatcaatagtctccctgattctatccgtcgtcgatcagatgcctatcatgctagagaggaaatcaaggccatgaaagttcagagacaaaacagggaagatgaacctttagaaactgcaaagatccctaaagcaacatggatggctgatggaactcactggccaggaacttggttgaatcctacatctgagcattctaagggtgaccatgctggtataattcaggtgatgttgaaacctcccagcgatgaacctcttccaggaagtgctgatgatacaagtctcattgaccagactgatgttgatatccgtcttccccttcttgtttatgtttctcgagagaagcgcccaggctatgatcacaacaaaaaagccggtgccatgaatgccttggttcgagcctcagcaatcatgtctaatggtccatttatactcaatcttgactgtgaccactatatctacaactcaaaggcaatgagggaaggcatgtgctttatgatggatcgtggaggtgaccgcctttgttatgtccagttcccccagaggtttgaagggattgacccctctgatagatatgccaatcataatactgtcttctttgatgtcaacatgcgagccctggatggacttcaagggccagtgtatgtgggaacagggtgccttttcagacggattgcactatatggttttgacccgccacgttccaaagagcacgccaccggttgttgtaattgttgctttggtcgtcagaagaagcatgcatcaatggcaagcaccccagaagagaaccgggcactgaggatgggtgattctgacgaggaggaaatgaatctatcactcttccctaagaagtttggaaactcaactttcctcatcgactcgattcctgtggctgagttccaaggccgaccactggctgatcactcagccgtgaaaaatggacgtccaccgggtgctctcaccataccccgtgatcttctcgatgcatcgaccgtggcagaggccatcagcgtcatctcctgttggtacgaggacaagaccgagtggggaaaccgtgtcgggtggatctatggatctgtgacagaggatgtggtcactgggtataggatgcacaacaggggatggaaatcagtttactgtgtgaccaagcgtgatgccttccgtggaacagctcccataaatctcactgacaggttgcatcaggtccttagatgggctactggctcagttgaaatcttcttctcaagaaacaatgctcttctggctagcccaagaatgaaaattcttcaaagaattgcatatctgaatgttggaatctaccctttcacatccatattcctaatcgtctactgcttccttcctgcactgtcccttttctctgggcagttcattgtgcagaccctcaatgtcacttttctttcttacctcttgggaatcactgtgactctgtgcatacttgcagtgcttgaaatcaagtggtctggcattgagctggaagaatggtggagaaatgagcagttctggctgattggagggacaagtgctcatcttgctgctgtgcttcaaggtttgctgaaagtgatagcagggattgaaatctcattcactttgacttcaaagtcaggtggtgatgatgtagatgatgaatttgctgatctgtatattgtgaaatggacatcccttatgataccacctatcacaatcatgatggttaacttgatagcaatagcagttggagttagcagaaccatatacagtgtcataccacagtggagccgtctactaggtggtgttttcttcagtttttgggtcttggctcatctctatccctttgcaaaaggcttgatgggaagaagaggaagaacacctaccatagtttttgtatggtcaggcctcattgcaatcacaatttctctcctttgggtggccatcaacccccctgctggttctaaccaaattggtggttcattccagttcccttgatagctcattctttttgtcacatcacatgaatctgtcaccaatttctttatttaaattagtttctctctctctctctctctcactatatatatatatatatatacacatttcattctacatatttactaatgaatggacttaaattatgcagtctgttatgcttatgaattttgtttagaacaaaattccagaaatgtgatcatatttggctgtcactga

SEQ ID NO: 10159 - DNA, 3957 bp, Prunus persica
cttgctctttacttgttaacgcaagggacagttggagagccgactctcaccacctttgaattgaacaattcccccattccatgttcagacaaacccctttcactttctctgctggggctttttgataagcctcagcctcagagaccccagagatctgaaacatacatacttgaacaccatttataagacacaggaactaaggataagtaactggtagtggttcaagtatggcttccagatcgtttaaggcgagcagatcgaatctatcatcaaactctgatatgcctgatgcacataacaagcctccagtgcctccgactgtgacatttggccggagaacttcctctggtcgctacatcagctactcaagggatgatcttgatagtgaactcgggagtggtgactttatgaactatacagttcacataccaccaaccccagataaccaacccatggatccatccatctcacagaaggttgaagagcaatatgtgtcgaattcgctttttacaggcgggtttaatagtgttacgcgagctcatcttatggataaggtgatcgaatctgaagcaaaccatcctcagatggctggtgctaaagggtcatcatgtgcaattcctggatgtgatgcaaaggtgatgagtgatgaacgtggagtggatattcttccttgtgagtgtgatttcaaaatatgtcgggattgctatacagatgctgtgaaaacagggggtagtatttgccctggatgcaaggaaacatacaaaaacacagatttggatgaaatggctgtggataatgcacggccaccgctcccacttcctcttccaaacgggatgtctaaaaatgagaggaggttgtcattgatgaagtcaacaaagtcagtgctgatgaggagtcaaactggggattttgatcacaaccggtggctctttgaaacaaagggaacttatgggtatggaaatgccatatggcccaaggagggaggttttggaaatgggaaagatgatgaaatcgttgaaccaacagagttgatgaacaaaccatggaggccactcacacggaaattaaagatacctgcagctattctaagcccgtataggcttctaatatttattcgtatggttgtccttgcactgttcttggcatggagggtcaaccacccaaataatgatgcaatctggctttggggaatgtcagtagtttgtgagatctggtttgctttttcttggctgcttgaccaactgcccaagttatgcccagtcaatcgttctacggatcttaatgtcttgaaggagaagtttgaaacacctagccccaacaaccccaccgggaaatctgatcttccaggcatagatatctttgtctccactgcagatccagataaagaaccacctcttgtcactgcaaacactatcttatctattctggctactgattatcctgttgaaaagctagcttgctatgtttctgatgatggaggtgcacttttaacttttgaggccatggcagaagctgctagttttgctaatatatgggtacccttctgccgtaaacataggattgagcccaggaatcctgaatcttatttcaatttgaagagggatccatacaagaacaaagtgctgcctgactttgtcaaggatcgtcgaagggtaaaacgtgaatatgatgagttcaaggttcggattaatggactgcctgactctatacgccgacggtcagatgcttatcatgctcgggaagaaatcaaggccatgaagcttcaaagagagaacagagaggatgaacctgtggagagtgtgaaggttcccaaagcaacatggatggctgatggaacccactggccagggacttggttgagtgcttcacctgagcattctaagagtgaccatgctggtattatacaggtgatgttaaaacctcccagtgatgaaccgctgcatggagctgatgatgatgctaggctcattgacctcactgacgttgatatccgccttcccatgcttgtttatgtgtcgcgtgagaaacgcccaggctatgatcacaacaagaaggccggagccatgaatgccctcgttcgggcctctgccataatgtccaatggcccgttcattctcaaccttgactgtgaccattatatttacaactctcaggcaatgagggaaggcatgtgcttcatgatggatcgtggaggtgaccgcctttgttatgtccagtttcctcagagatttgagggtattgacccttcagatcgatatgccaatcacaacactgttttctttgatgtcaatatgcgagctcttgatgggcttcagggcccagtttatgttggaactggatgtctctttcgtagaatttccctttatggtttcgacccaccgcggtcaaaagaacatcacccaggttgttgcagttgctgcttttctcgtcgcagaaagcattcctcggtagccaacacccctgaagaaaaccgagccttaagaatgggtgattctgatgatgaagagatgaatctctccctgctgcctaagaggtttgggaactcaagtttcctcattgattcgattccagtggcagagttccaaggtcgtccccttgcagatcacccagctgtgaagaatggacgcccacctggtgctctgaccattcctcgtgagcttcttgatgcatctactgttgcagaggcgatcagtgtcatttcctgctggtatgaagacaagactgagtggggacagcgtgtagggtggatttacggatcagttactgaagatgtggtcactgggtataggatgcataacagaggatggaaatcagtttactgtgtgaccaagcgagatgcattccgtggaaccgctcctatcaatcttactgataggttgcatcaggttctgcgctgggctactggctcagttgagatattcttctctcgcaacaatgccctcctagccagcccaagaatgaagcttctgcaaaggatagcatacctcaatgtgggtatttacccctttacctccatcttcctcatcgtctactgcttccttccggccctttccctcttctctggtcaattcattgtccagagcctcaatgttacattcctgacctatcttttgaccatcaccctcactctatgcatgcttgctgtgcttgagattaaatggtctggcattgagctagaagagtggtggagaaacgagcagttttggttgatcggagggactagtgcccaccttgctgctgtgcttcaggggctattgaaagttattgcagggattgaaatctcttttaccttaacttcaaaatcaggtggtgatgatgaggatgatgagtttgctgacctctatattgtgaaatggtcatctctgatgatcccgccaataacaatcatgatggtcaacttaattgcaatagcagttgggtttagccgaacaatatacagtgtgataccgcagtggagccggttacttggcggggttttcttcagtttctgggttttagctcatctctatccttttgccaaagggttgatggggagacgagggaggacacccaccattgtttttgtatggtcggggctcattgcaattaccatctctcttctttgggtggcaatcaatccaccttctggtaccaaccaaattggtggatcattccagttcccctaataaataggtcattctttgctattaatctgttcagttacattcctttatttgtttcatacctgaacaagttaaatcgtgctttgtggtggcactagcatgtggtgcttcttgttcctatttgaattttgtccagcagtaattaagtaacttggagcaatttgagtatgactctctattatgatgccatgggatgggaccaacaaaggcatagccgcagccgcatagggatgttgtaggtttcccagcatttttttgatgctttaatggagaattaatttgaatgtttcgcttt

SEQ ID NO: 10160 - DNA, 3790 bp, Citrullus lanatus
gcttggttatggcgtctaagtcatttaagctgacccgttcaaatctatcatcaacttctgatgtgtctgatgcacagaagcagccaatgcctcagactgtaacatttgctcggcgaacttcctcgggtcggtatgttcgctattcaagggatgatcttgatagtgaactggggagtggcgactttacaaactacacagtgcacataccgccaacacctgacaatcaacctatggatccatccatctcacagaaggttgaagagcaatatgtctcgaattcgctctttacggggggattcaatagcgtgacacgagctcatcttatggataaggtaattgaatctgaagcaacccatcctcaaatggctggcacaaaaggatcttcctgtgcagtaccggggtgtgatgcaaaagttatgagtgatgaacgtggtaacgacattctcccctgtgagtgcgatttcaagatatgtcgagactgctatgtggatgcagttaaatcagggaatgcgatctgccctggttgtaaggagccatataagaacacagatatggatgaaataactgttgaacatgggcgcccactgccacttcctcccacacgcacaatgtcaaagggtgagagaagattgtcattaatgaaatcaacaaagtccatgatggtgaggagtcaaactggagttggggattttgatcataataggtggcttttcgaaacaaagggtacttatgggtatggaaatgctatatggccaaaggatggggttacgggaaatggaaatgataaagacgatgaggttgttgagccaaaagaatttatgaataaaccatggaggccattgacacggaaacttaaaattcgtgctgctgttctcagcccgtataggcttctaattctggttcgtatggttgttcttggattgtttttggcttggaggattcggcatccaaacacagatgcatattggttgtgggcaatgtcagttgtttgtgaaatatggtttgctttttcttggcttcttgatcaattgcccaagctttgccctgtaaatcgggccacagatcttaatgttctgaaggataagtttgaaacacctagccctagtaatcctactggaaaatctgatcttccaggaatagatgtctttgtttctactgcagacccagaaaaagagcctcctcttgtaactgcaaacacaatcttgtcaattttagctgccgattatcctgttgaaaagcttgcttgctatgtttcagacgacggaggtgcccttctaacttttgaggccatggcagaagcagcaagttttgctaacacatgggttcctttctgtcgaaaacatgatattgaacctagaaatcctgaatcttacttcaatctaaagagagatccattcaagaataaagtgcgatctgattttgtcaaggatcgcagacgtgtgaaacgtgagtatgatgagttcaaggttcgtattaatggacttcctgattctattcgtcgtcgatctgatgcgtatcatgcaagggaggaaatcaaagctatgaagcgtcagaggcaaaatgttggtgaggatgaacctctggagactgtaaagatccctaaagcaacatggatggccgatggaacccattggcctggaacttggatgcaaccttctgctgagcactccaagggtgaccatgctggtataatacaggtgatgctaaaacctccaagtgatgaaccgctacatggaactgctgatgaaactaaactactagacctatcagaggttgacatccgccttcctctacttgtttatgtttctcgagaaaaacgtcctggctatgatcataacaaaaaagcaggggccatgaatgctctagttcgagcatcggctattatgtcaaatgggccatttatcctcaaccttgattgtgaccattatatatacaactcccaggcaatgagagaaggaatgtgtttcatgatggaccgtggaggtgatcgtatttgttacgttcagttccctcaaaggtttgagggcattgatccttcagatcgatatgccaatcacaacactgtgttctttgacgttaacatgcgagcccttgatggacttcaaggtccggtatatgttggaacaggatgtctgtttagaaggattgccctttatggttttgaccctcatagatctaaagagcagcaccctggttgttgtagctgctgctttggtaaacgtaaaaagcatacatcgattgcgaatagccctgaagagcatcgtggactaagaatgggtgactctgatgatgaagagatggacctatccttgttcccgaaaaggtttggaaattctgttttccttgttgattcaattccaattgccgagtttcaaggacggccattagccgatcatccagctgtgaaatatggacgtcctcctggtgctcttaccattcctcgtgagcttctggatgcatcaactgttgcagaggcaatcagtgtcatttcttgttggtatgaagataaaaccgaatggggccaacgggttgggtggatttatggatctgtcacagaagatgtggtcactgggtacaggatgcataataggggatggaagtccatttactgtgtaactaaacgcgatgcttttcgtggaactgcgccgatcaatctcactgataggctgcatcaagtcctccggtgggctactgggtcagtggagattttcttctccagaaataatgcactcttggctagttctagaatgaaaattctgcaaagaatagcctaccttaacgttggaatctacccgttcacttccatcttcctcatagtctactgtttcctccctgcactttccctattttcagggcaatttatcgttcagactctcaatgtagctttcctcacctaccttttagtcatcaccatcactctatgcctacttgctgttcttgaaattaaatggtctggcattgaattagaagagtggtggagaaatgagcagttttggttgattggaggcaccagtgctcatcttgctgctgtgcttcagggtttgctaaaagtcattgctgggattgaaatttctttcaccttgacatccaaatcagctggtgatgatgtggatgatgaatttgccgatctctacatcgtgaagtggacgtccctcatgattccacctatcacaatcatgatgatcaacctaatcgccattgcggtcggggtcagccgcacaatctacagtacaattccacagtggagccgcttgataggtggtgttttcttcagtttctgggttctggttcatctttaccccttcgcgaaggggctcatgggaagaagaggaaggacgccgaccattgttttcgtgtggtcgggacttctcgccatcaccatttctcttctctgggtggccattagtcccccaagtggtgcaaatcaaattggaggttccttctctttcccttgagttctgattgttttttcattgcgttggaaatcatgtcctaaagccattgtcttgggacgcttttttcatcactataatagaggacagttagaattgtattcagaatagaaacacatcatttcttcatatgtaagcatgtaggatatctggcaacattttattttatgatcatgttattcatttttagactacaacatagaggggcctatataggattgatcaagaatgcgtcaaaacgtgaattgtaagccctatcaatattatagggatcgagcatttttcagaactagcttactccccattactcgagttaatttacattcatattacttctt

SEQ ID NO: 10161 - DNA, 3408 bp, Cocos nucifera
acccccgacaaccagccgatggacccctcgatctctgccaaggtcgaggagcagtatgtgtcgaattccctcttcactggtggatttaacagcgtcacccgtgctcatttgatggataaggtgatcgagtccgaggcgatgcacccccagatggccggcgccaagggatcatcttgcgccatccccgggtgtgactccaaggtcttgagcgatgagcgtggaaatgacattctcccttgtgagtgtgacttcaagatctgtgccgactgcttcaacgattcagtgaaggctggtgaagcggtctgcccaggatgcaaggagccgtataaagctactgagttggaggaggtgatgaacaatgctggggctgctgcacggctgtcgctgccaccgccaccccctggggtctcgaggatggagaggaggctgtcattgatgaagtcgaccaagatgaaccggagccagaccggcgactgggatcacaaccggtggttgtttgagacaaagggaacatatggctatgggaatgcaatctggcccaaggagagtgggggtgacggtgggaatggagaagttggacagccatcggagctgacgagcaagccttggaggccactcacccgcaaattgaagatccctgcagcagtcctcagcccatataggcttcttattgttatccgcatggctgcccttggactgttccttgcttggagagtcaagcacaaaaatgaggatgcagtatggctatgggggatgtctgtcgtgtgtgagctgtggtttgctttctcttggctcttggaccagctcccgaagctttgtcctgttaaccgtgccactgaccttgcagtgttgaaagacaagtttgaaacttctacacccagcaatcctactgggaagtctgatcttcctggcattgatgtctttgtttctactgctgatccggaaaaagagcctcctttggttactgcaaacaccatactatccatccttgctgctgattaccctgttgagaagctctcttgctatgtttctgatgatgggggagccctactgactttcgaagcaatggcagaagctgcaagctttgctaatatatgggttcctttctgtcggaaacatgacattgaaccaagaaacccagagagctacttcaatttgaagaaggatccttataagaacaaggtgcgctctgactttgtcaaggaccgaagacgggtgaagagagagtatgatgagttcaaggtctgcatcaatggattgccagattctattcgccggcggtctgatgcatatcatgctcgtgaggagattaaggccatgaaacgacagcgagaaacagctggtgatgatgttgtagaacctgttaagatccccaaagccacttggatggctgatggtactcattggccaggcacttggattaacccctcctcagagcatactcggggtgatcatgctggaattattcaggtaatgctgaagcctccaagtgatgaaacactgttgggggacaaggaagaaggaaagcccctggacctcaccgatgtcgacatccgtctgcccatgctggtctatgtctcacgagagaaacgcccaggctatgaccataacaaaaaggcaggggctatgaatgcccttgtccgtgcctctgccatcatgtctaatggccccttcatcctaaatcttgattgcgaccattacatctacaactccgaggcgctccgggagggcatgtgcttcatgatggatcgtggtggtgaccgcatctgctatgtccagttcccgcagcggtttgagggtatcgacccctctgaccgttatgccaatcacaacactgtcttctttgatgtcaacatgagagcgcttgatggtcttcagggccctgtatatgtgggtacaggttgcctcttccgccgcattgcactctatggttttgaccctcctcgtgccaaagaacaccaacctggctgctgcagctgttgcttccctaggcacaagagtccggctgctgttgcctctgaggagacccgtgctcttcgaatgggagactctgatgatgaggaaatgaacctttcaacattccccaagaagtttgggaactcaagtgtccttgttgattcaatcccggtggctgagtatcaaggcagacctcttgccgaccaccctgctgtcaagaatggccgcccacctggtgccctcaccatcccacgtgacctccttgatgcatctactgtagctgaggccatcagtgtcatctcatgctggtacgaggacaaaactgaatggggccagcgtgttggatggatctatgggtccgttactgaagatgtcgtcacaggctataggatgcacaacagagggtggaagtcagtctactgtgtcaccaagcgtgatgccttccgtgggactgctccaattaacctcactgaccggctccaccaggtccttcggtgggccacgggctctgttgagatcttcttctctcgcaacaatgccctgcttgccagcaccaggatgaagctcctccagaggattgcttacctcaatgttggcatctatccatttacgtctatcttcctcctcgtctattgcttcctcccggcgctctccctcttctcaggacagtttattgtgcagactctcaatgtgaccttcctcacctaccttctcatcatcactttaacacttagcatgcttgctgggcttgagatcaagtggtcggggatttcacttgaagagtggtggcggaatgaacagttttggctgattggaggaaccagtgctcaccttgctgctgtgctccaggggttgctgaaagtgattgcagggattgaaatctcattcaccctcacttcgaaatcagccggtgatgatgtggatgatgagtttgctgacctctacattgtgaaatggacatctttgatgataccgcccatgacaatcatgatggtgaatttgatagcgattgcggttggagtcagtcgaaccatatacagtactgtgccacagtggagcaagctattaggtggggtgttcttcagcttctgggtcttggcgcatctctacccatttgccaaggggcttatggggaggagaggaaggacgccaaccattgtatttgtgtggtccggactcattgcaatcactatatcactgctttgggttgcgatcaatcccccgtcttcgaattcccagatcggtggctccttcacatttccttgagccatttcaattaggtagatccacagaattcatggcaaggtggagtgaaatgtgtccgattgttttgatactctgctgcttcagttcaagctcttcccgtgtttcccaagcaacttttaaattggaagcagagcattgcgggtgcttttcaacttcgtctctgaagttttggcttttcatcagcta

SEQ ID NO: 10162 - DNA, 4030 bp, Gossypium hirsutum
aacttcaaaaacccgtctcttcctttttcttttatgacataacacaactataaacttcacccatccttatgtcttagctctctcctttctataagttttagtagatagcagttggagatcgacaaatgagagaaacttagaaagaaaaagagttttgattgttctgatttaaagaggtttttttgttcaagattagactaaaggaagagatctggaaaagaaaatcgttttttctttcgtaaagtagacaaattaaaagggatctaggagaattctctggtagagctaaaaaccatggcttcaaagtcttttaaagggacccgatcttctttgtcgatctccgctgatgcaactgagtcacagaagcctcctatacctccaactgtgacatttggccggagaacatcctcgggtcgctatgtgagctattcaagggatgatcttgatagtgagcttagtagcagcgatttcatgaactacacagtgcatatacctccaacccctgacaaccaacccatggacccttctatttctcagaaggttgaagagcaatatgtatcgaattcgctttttactggtggattcaatagtgttacacgagcgcaccttatggacaaggtgatagaatctgaagcaaaccatccacagatggctggtgcaaaaggctcttcctgtgctgttcccgggtgtgatgcaaagataatgagtgatgaacgtggtgcggatattctcccttgtgagtgtgatttcaaaatttgtcgggattgttacattgatgctgtgaaatcaggggatggattatgccctggatgtaaggaaccatataagaacacagatctggatgaagcagcagtggataatagttccaggccacttccacttccgccccctgctacaatgtccaaaatggagaggaggttgtctttaatgaagtcaatgaagtcagggctgatgaggagtcaaacaggagatttcgatcacaatcgttggctgtttgagactagaggaacatatggttatggcaatgctatatggccaaaggatggtaatataggtaatggaaaagatgatgaagttgctgagccaacagaattgatgaacaaaccatggaggccacttactcggaaattaaaaataccagcagctgttctcagcccataccggcttctgatatttttgcgaattgttgtccttgggttgtttttggcttggagggtgaaccatccaaacaatgatgctatttggctatggggaatgtctgtggtttgtgaaatttggtttgctttttcatggcttcttgaccaactgcccaagctctgccctatcaatcgttctacagaccttaacgtgttgaaggacaaatttgaaacaccaacccttaacaaccctactggtaaatctgaccttccaggcatagatgtctttgtctctactgcagatcccgagaaagaaccaccacttgtcactgcaaacactatcttgtcaattctagctgcggattaccctgttgaaaaacttgcttgttatgtttctgatgatggaggagcacttttaacttttgaggctatggctgaagcagcaagttttgctaatatatgggttccattttgccgtaaacataacattgaacccaggaatccagaatcttacttcaatcttaagagggatccttacaagaacaaagtcaaaccagattttgtcaaggaccgccgacgagttaaacgcgagtatgatgaattcaaagtccgtatcaatggtttgccagactccatacgccgtaggtctgatgcatttcacgcaagggaggaaatcaaggcaatgaagctgcagagacagaatagggaagatgaacctgtagaggctgtgaagattccaaaagccacatggatggctgatggaactcattggcctgggacttggttaaatccagctaatgagcactcccggggtgaccatgctggtataatacaggtgatgctgaaaccacccagtgatgaaccattacacggaactgctgatgataggctcattgatctaactgatgttgatattcgtctccctttgctagtctatgtttctcgtgagaagcgcccaggctatgaccacaacaagaaggcaggtgccatgaatgcccttgttcgggcatctgcaattatgtctaatggcccattcatcctgaaccttgactgcgatcactatatctacaactctcaggcaatgagggaaggcatgtgcttcatgatggatcgaggaggtgatcgcatttgttatgtccagttccctcaaaggtttgaggggattgacccttctgatcgctatgccaataacaatactgttttctttgatgtaaacatgcgggcccttgatggtcttatgggccctgtctatgtcggaactggatgcctctttcggagggttgccctttatggctttgacccacctcgatcgaaagaacaccaccctggttgctgcagctgctgcttttttggtcgtaacaagaagcattcctcaatggcacacagccctgaggaaaatcgtgctctgagaatgggtgattctgatgacgaggagatgaacctgtccctgcttccaaagaggtttgggaactcaacatttctcattgattcaattcctgtggccgagtttcaaggtcgtccccttgcagatcatccagctgtgaagaatgggcgcccacctggtgctctcaccattccccgtgaacttcttgatgcctcgacagttgcagaggcaatcagtgtcatttcatgctggtatgaggataagactgagtggggacaccgtgttgggtggatttatgggtctgttactgaagatgtggtcacaggatatagaatgcacaacagaggatggagatcagtttattgtgtgactaagcgtgatgcgttccgtggaactgctccaatcaatctcactgataggcttcaccaagtcttgcgttgggctactggttcagttgagattttcttttcccgtaacaatgctctcctagccagtcctagaatgaagattctacagagaattgcctatctaaatgttggaatctaccccttcacctccattttcttgattgtctactgtttccttcctgcactttcgttgttttctggccagttcattgtccagaccctcaacgtaacattccttacttacctcctcatcataacagttactctttgtttactagctgtgcttgaaattaagtggtctggcattgagttggaagagtggtggagaaacgagcagttttggttgatcggggggacaagtgctcatcttgctgccgtgcttcagggcctgttgaaagtgattgctgggattgagatttctttcaccttgacatcaaaatcagcaggagatgacttggatgatgagtttgctgatctctacatagtcaaatggacatccttaatgataccaccgatcacgatcatgatggtcaacttaatagcaatagcagtcgggttcagccgaacaatttacagtgttatccctcagtggagtcgtctactaggtggagttttcttcagcttctgggttctggctcatctctatccttttgctaaagggctgatgggaagaagaggaaggacacctacaattgtgttcgtatggtcaggtcttatggccatcaccatatccctcctttgggttgcaatcaatcccccatccaccactaaccaaattggaggatcattccagttcccttgattggacattttttatgttaaaggtgaaacacttctattatcgtattcctttatttattccttttttcttcctgcttcaagctgatatgctggtgaaaaaactaggcatgttctatattaccatgtgccaattggaatatacttttagcagcaattttagtgagttttcatgggatagatccaacaaaaaactggtttccctgctcttttgttcttattgtatgatgtttacgtgtactcactgaatagttaacttttttcttcaactttttctggtggatcgccatctatatttatgcttc

SEQ ID NO: 10163 - DNA, 4267 bp, Gossypium raimondii
ttctacggtgtgtaaaaaatatatagagaaagccggtgagaggccaatggcagtcagtcttcaatattttagtagccggtgttccaactaagaccaactcattgttgttctacacgttctccgcgacttcacttcaccatttctcaatgaaaacacccatttcaaagaaacttctctttccacttcaaaaacccgtctcttcctttttcttttatgacataacacaactataaacttcacccatccttctgtcttagctctctcctttctataagttttagtagatagcagttggagatcgacaaatgagagaaacatagaaagagaaagagtttcgattgttctgatttaaagaggtttttttgttcaagattagactaaaggaagagatctggaaaagaaaatcgttttttctttcgtaaagtagacaaattaaaagggatctaggagaattctctggtagagcttaaaaaccatggcttcaaagtcttttaaagggacccgatcttctttgtcgatctcctctgatgcaactgagtcgcagaagcctcctatacctccaactgtgacatttggccggagaacatcctcgggtcgctatgtcagctattcaagggatgatcttgatagtgagcttagtagcagcgatttcatgaactacacagtgcatatacccccaacccctgacaaccaacccatggacccttctatttctcagaaggttgaagagcaatatgtatcgaattcgctttttactggtggattcaatagtgttacacgagcgcaccttatggacaaggtgatagaatctgaagcaaaccatccacagatggctggtgcaaaaggctcttcctgtgctgttcccgggtgtgatgcaaagataatgagtgatgaacgtggtgcggatattctcccttgtgagtgtgatttcaaaatttgtcgggattgttacattgatgctgtgaaatcaggggatggattatgccctggatgtaaggaaccatataagaacacagatctggatgaagcagcagtggataatagttccaggccacttccacttccgccccctgctacaatgtccaaaatggagaggaggttgtctttaatgaagtcaatgaagtcagggctgatgaggagtcaaacaggagatttcgatcacaatcgttggctgtttgagactagaggaacatatggttatggcaatgctatatggccaaaggatggtaatataggtaatggaaaagatgatgaagttgctgagccaacagaattgatgaacaaaccatggaggccacttactcggaaattaaaaataccagcagctgttctcagcccataccggcttctgatatttttgcgaattgttgtccttgggttgtttttggcttggagggtgaaccatccaaacaatgatgctatttggctatggggaatgtctgtggtttgtgaaatttggtttgctttttcatggcttcttgaccaactgcccaagctctgccctatcaatcgttctacagaccttaacgtgttgaaggacaaatttgaaacaccaacccttaacaaccctactggtaaatctgaccttccaggcatagatgtctttgtctctactgcagatcccgagaaagaaccaccacttgtcactgcaaacactatcttgtcaattctagctgcggattaccctgttgaaaaacttgcttgttatgtttctgatgatggaggagcacttttaacttttgaggctatggctgaagcagcaagttttgctaatatatgggttccattttgccgtaaacataacattgaacccaggaatccagaatcttacttcaatcttaagagggatccttacaagaacaaagtcaaaccagattttgtcaaggaccgccgacgagttaaacgtgagtatgatgaattcaaagtccgtatcaatggtttgccagactccatacgccgtaggtctgatgcatttcacgcaagggaggaaatcaaggcaatgaagctgcagagacagaatagggaagatgaacctgtagaggctgtgaagattccaaaagccacatggatggctgatggaactcattggcctgggacttggttaaatccagctaatgagcactcccggggtgaccatgctggtataatacaggtgatgctgaaaccacccagtgatgaaccattacacggaactgctgatgataggctcattgatctaactgatgttgatattcgtctccctttgctagtctatgtttctcgtgagaagcgcccaggctatgaccacaacaagaaggcaggtgccatgaatgcccttgttcgggcatctgcaattatgtctaatggcccattcatcctgaaccttgactgcgatcactatatctacaactctcaggcaatgagggaaggcatgtgcttcatgatggatcgaggaggtgatcgcatttgttatgtccagttccctcaaaggtttgaggggattgacccttctgatcgctatgccaataacaatactgttttctttgatgtaaacatgcgggcccttgatggtcttatgggccctgtctatgtcggaactggatgcctctttcggagggttgccctttatggctttgacccacctcgatcgaaagaacaccaccctggttgctgcagctgctgcttttttggtcgtaacaagaagcattcctcaatggcacacagccctgaggaaaatcgtgctctgagaatgggtgattctgatgacgaggagatgaacctgtccctgcttccaaagaggtttgggaactcaacatttctcattgattcaattcctatggccgagtttcaaggtcgtccccttgcagatcatccagctgtgaagaatgggcgcccacctggtgctctcaccattccccgtgaacttcttgatgcctcgacagttgcagaggcaatcagtgtcatttcatgctggtatgaggataagactgagtggggacaccgtgttgggtggatttatgggtctgttactgaagatgtggtcacaggatatagaatgcacaacagaggatggagatcagtttattgtgtgactaagcgtgatgcgttccgtggaactgctccaatcaatctcactgataggcttcaccaagtcttgcgttgggctactggttcagttgagattttcttttcccgtaacaatgctctcctagccagtcctagaatgaagattctacagagaattgcctatctaaatgttggaatctaccccttcacctccattttcttgattgtctactgttttctcccggcactttcgttgttctctggccagttcattgtccagaccctcaacgtaacattccttacttacctcctcatcataacagttactctttgtttactagctgtgcttgaaattaagtggtctggcattgagttggaagagtggtggagaaacgagcagttttggttgatcggggggacaagtgctcatcttgctgccgtgcttcagggtctgttgaaagtgattgctgggattgagatttctttcaccttgacatcaaaatcagcaggagatgacttggatgatgagtttgctgatctctacatagtcaaatggacatccttaatgataccaccgatcacgatcatgatggtcaacttaatagcaatagcagtcgggttcagccgaacaatttacagtgttatccctcagtggagtcgtctactaggtggagttttcttcagcttctgggttctggctcatctctatccttttgctaaagggctgatgggaagaagaggaaggacacctacaattgtgttcgtatggtcaggtcttatggccatcaccatatccctcctttgggttgcaatcaatcccccatccaccactaaccaaattggaggatcattccagttcccttgattggacattttttatgttaaaggtgaaacacttctattatcgtattcctttatttattccttttttcttcctgcttcaagctgatatgctggtgaaaaaactaggcatgttctatattaccatgtgccaattggaatatacttttagcagcaattttagtgagttttcatgggatagatccaacaaaaaactggtttccctactcttttgttcttattgtatgatgtttacgtgtactcactgaatagttacttttttcttcaactttttctggtggatcgccatctatatttatgcttcaatgcaattgcttttttgggtagctttgattgattgatgaacaaaaccatacgaaag

SEQ ID NO: 10164 - DNA, 4420 bp, Prunus mume
gagagagagagctggccatatccaccgcaaccaaacgctttctaacccagaagcttctctttacctgccaccgcgtatttacatgtataaaaccccatttttattaaccaagttgtttttcttttttgaaaacaaaacagagtattattattatgtttagggtatataaaaatataattaaaaaatagagagagccttcaatcatgggttattagtcctcctcacgactgactaagtcccaaactcatactcaaatacttttgtcatctctttgtttcattcgttctcttctcttgttgtatctgaatgctgctgcttgctgggtcctcttgctctttacttgataacgcaagggacagttggagagccgactctcaccacctttgaattgaacaattcccccattccatgttcagacaaacccctttcactttcgctgctggggctttttgataagcctcagcctcacagaccccagagatctgaaacatacatacttcaacaccatttataagacacaggaactaaggataagtaactggtagtggttcaactatggcatccagatcgtttaaggcgagcagatcgaatctatcatcaaactctgatatgcctgatgcacatgacaagcctccagtgcctccgactgtgacatttggccggagaacttcctctggtcgctacatcagctactcaagggatgatcttgatagtgaactcgggagtggtgactttatgaactatacagttcacataccaccaaccccagataaccaacccatggatccatccatctcacagaaggttgaagagcaatatgtgtcgaattcactttttacaggtgggtttaatagtgttacgcgagctcatcttatggataaggtgatcgaatctgaagcaaaccatcctcagatggctggtgctaaagggtcatcatgtgcaattcctggatgtgatgcaaaagtgatgagtgatgaacgtggagtggatattcttccttgtgagtgtgatttcaaaatatgtcgggattgctatacagatgctgtgaaaacagggggtagtatttgccctggatgcaaggaaacatacaaaaacacagatttggatgaaatggctgtggataatgcacggccaccgctcccacttcctcttccaaacgggatgtccaaaaatgaaaggaggttgtcattgatgaagtcaacaaagtcagtgctgatgaggagtcaaactggggattttgatcacaaccggtggctctttgaaacaaagggaacttatggttatggaaatgccatatggcctaaggagggcggttttggaaatgggaaagatgacgaagtcgttgaaccaacagagttgatgaacaaaccatggaggccactcacacggaaattaaagatacctgcagctattctaagcccgtataggcttctaatatttattcgtatggttgtccttgcgctgttcttggcatggagggtcaaccacccaaataatgatgcaatctggctttggggaatgtcagtagtttgtgagatctggtttgctttttcttggctgcttgaccaactgcccaagttatgcccagtcaatcgttctacggatcttaatgtcttgaaggagaagtttgaaacacctagccccaacaaccccaccgggaaatctgatcttccaggcatagatatctttgtctccactgcagatccggataaagaaccacctcttgtcactgcaaacactatcttatctattctggctactgattatcctgttgaaaagctagcttgctatgtttctgacgatggaggtgcacttttaacttttgaggccatggcagaagctgctagttttgctaatatatgggtacccttctgccgtaaacataggattgagcccaggaatcctgaatcttatttcaatttgaagagggatccatacaagaacaaagtgctgcctgactttgtcaaggatcgtcgaagggtaaaacgtgaatatgatgagttcaaggttcggattaatggactgcctgactctatacgccgacggtcagatgcttatcatgctcgggaagaaatcaaggccatgaagcttcaaagagagaacagagaggatgaacctgtggagagtgtgaaggttcccaaagcaacatggatggctgatggaacccactggccagggacttggttgagtgcttcacctgagcattctaagagtgaccatgctggtattatacaggtgatgttaaaacctcccagtgatgaaccgctgcatggagctgatgatgatgctaggctcatcgacctcactgacgttgatatccgccttcccatgcttgtttatgtgtcgcgtgagaaacgcccaggctatgatcacaacaagaaggccggagccatgaatgccctcgttcgagcctctgccataatgtccaatggcccgttcattctcaacctcgactgtgaccattatatttacaactctcaggcaatgagggaaggcatgtgcttcatgatggatcgtggaggtgaccgcctttgttatgtccagtttcctcagagatttgagggtattgacccttcagatcgatatgctaatcataacactgttttctttgatgtcaatatgcgagctcttgatgggcttcagggcccagtttatgttggaactggatgcctctttcgtagaatttccctttatggtttcgacccacctcggtcaaaagatcatcacccaggttgttgcagttgctgcttttctcgtcgcagaaagcattcctcggtagctcacacccctgaagaaaaccgagccttaagaatgggtgattctgacgatgaagagatgaatctctccctgctgcctaagaggtttgggaactcaagtttcctcattgattcgattccagtggcagagttccaaggtcgtccccttgcagatcacccagctgtgaagaatggacgcccacctggtgctttgaccattcctcgtgagcttctcgatgcatctactgttgcagaggcgatcagtgtcatttcctgctggtatgaagacaagactgagtggggacagcgtgtagggtggatttacggatcagttactgaagatgtggtcactgggtataggatgcataacagaggatggaaatcagtttactgtgtgaccaagcgagatgcattccgtggaactgctcctattaatcttactgataggttgcatcaggttctgcgctgggctactggctcagttgagatattcttctctcgcaacaatgccctcctagccagcccaagaatgaagcttctgcaaaggatagcatacctcaatgtgggtatttacccctttacctccatcttcctcatcgtctactgcttcctcccggccctttccctcttctctggtcaattcattgtccagagcctcaatgttacattcctgacctatcttttgaccatcaccctcactctatgcatgcttgctgtgcttgagattaaatggtctggcattgagctagaagagtggtggagaaacgagcagttttggttgatcggagggactagtgcccaccttgctgctgtgcttcaggggctattgaaagttattgcagggattgaaatctctttcaccttaacttcaaaatcaggtggtgatgatgaggatgatgagtttgctgacctctatattgtgaaatggtcatctctgatgatcccgccaataacaatcatgatggtcaacttaattgcaatagcagttgggtttagccgaacaatatacagtgtgataccgcagtggagccggttacttggcggggttttcttcagtttctgggttttagctcatctctatccttttgccaaagggttgatggggagacgagggaggacacccaccattgtttttgtatggtcggggctcattgcgattaccatctctcttctttgggtggcaatcaatccaccttctggtaccaaccaaattggtggatcattccagttcccctaataaataggtcattctttgctgttaatctgttcagttacattcctttatttgtttcatacctgaacaagttaaatcatgctttgtgatggcactagcatgttgtgcttcttgttcctgtttgaattttgtccagcagtaatcaagtaacttggagcaatttgagtatgactcgtgtactatgatgccatgggatgggaccaacaaaggcatagccgcatagggatgttgtaggtttcccggcatttttttgatgctttaatggagaattcatttgaatgtttcgctttgacttggaagattaggattttaaaaataaaaaaaattatattgtttatggtgcacagattattaattatggatttttttttctcttgtgatatcgatcgacttgaaagttagtatgaattctgtcagtttccttccattc

SEQ ID NO: 10165 - DNA, 4364 bp, Eucalyptus grandis
ctctgagccggcgaccccagccctcctctcccccccaaaacccatcttctctttctctctctaggactcaaatctgggaagcttctttcgctggaatataataaaagccctttccccttaataagttatttacctgttcctcctcctccgccacctcctcctctgttgtcttaattcgattcttttccctttttataactgctgggacttcggcttgggtcgtgaccgagtagtgctcgttgtttctctcacgacctggtccatcatctccctctacgacacaactcccttctgtccaagcaatgtgagaacgagacagctagagttcacacttctcccctgtttgaacctttcgtcagcccacctccccccctcaaaaaaaagaagcaaaagaccgcgtctttttaagatttctcatcggaccctccagcagatctttagccctcgccgctgctcacaaaccctcaaaggatttatacatagttttgtgggagtgagcgaggatggcgtccaaatcgttcaaggcaagcagatcgacattatctcaaagctcggagtcagctgacctcaggcctccactgcctcctaccgtgaccttcggtagaagaacttcatcggggcgctatgtcagctactcgagggatgatctcgacagcgaactcgggagtggtgattttgtcaactatacggtacacatccctcccacccctgataatcaaccgatggatccatcgatctcgcagaaggtcgaggagcagtacgtgtcgaattctctctttacgggcggattcaatagtgtcactcgagctcatttgatggacaaggtcatcgaatccgaagctagtcatccccagatggctggcgctaaaggatcctcttgcgcaatccctggttgcgatgccaaggtgatgagtgatgagcggggcatggatatactcccttgtgaatgtgacttcaagatttgccgcgattgctacattgatgcagtgaagacaggcggtggaatttgcccaggatgtaaggagccttataagaacacggatttggatgagattgcagtggataatgggcgcccccttccgcttccaccacctggtggcatgtccaaaatggaaagacggttgtcgctgatgaaatcaacaaaatctgttctcatgaggagccagaccggtgattttgatcataacaggtggttgttcgaaacgaggggcacatatggatatggaaatgctatatggcccaaggatgggggttttactggaaaggacgatgatgtggtggagccaactgagttgatgaacaaaccatggcgtcctctgactaggaaactcaagatccctgctgctattctcagcccatataggcttctcatttttgttcggatggttgttcttgggctgtttctggcatggagagttagtcacccaaacaatgatgctgtttggctgtggggcatgtctgtggtctgtgagatatggtttgctttctcttggcttcttgaccaacttcccaagctctgcccagttaatcgctctacggatcttaatgttttgagagagaaatttgaaactcctgggctgaataatcccactgggaagtctgacctccctggagtcgatgttttcgtctcgactgctgatccagagaaagaaccgcctcttgtcactgcaaacaccatcctgtccattctagctgctgattacccagtcgaaaagctagcttgctatgtttcggatgatggaggtgcacttctaaccttcgaggccatggcagaagctgcaagttttgcaaacatttgggttcctttttgtcggaagcataatatagagcctaggaaccccgaatcatatttcaacctgaaaagggatccttacaaaaataaagtcaaggaagactttgtcaaagatcgtcggcgggtaaagcgtgaatatgatgagttcaaggtacgtatcaatggactgcccgagtcaatccgccgccgatccgatgcctatcatgctagggaggaaatccaggcaatgaagaatcagagaaacaacagagatgatgaaccagtggagactctgaagattccaaaagcgacgtggatggctgatggaacacattggccagggacttggatgaatcctggaccagagcactctaggggtgaccatgctggtattatccaggtgatgttaaaaccgccaagcgatgaaccactgcttggcactgctgatgatgctaagataataaaccttactgatgttgatatccgccttcccttgcttgtttacgtatctcgtgaaaagcgtcctggctatgatcacaacaaaaaggcaggggctatgaatgcgctagtccgtgcctcagccattatgtctaatggccccttcatgctcaaccttgattgtgaccactacatctacaactcacaggcattgagggaagggatgtgcttcatgatggacagaggcggggaccgcatttgctatgtccaatttccccagagatttgagggtattgatccatccgatcgttatgccaatcacaacactgtcttctttgacgtgaatatgcgagcccttgacgggctccaaggccctgtctatgtgggaacaggatgcctcttccggagggttgctctgtatgggtttgaccccccacgtgcaaaagagcatcaacctggttgctgtagctgctgctttgatcgtcgcaaaaaggtggctagtacctcagaagagaaaagggccttaagaatgggtgattctgatgatgaagagatgaacctctccctaatccctaagaggtttgggaactcaactttcctgatcgattcaataccagtggcagaatttcaaggtcgccccctagcagatcaccctgctgtgaagaatggacgtccaccgggtgcgctcaccattcccagggatcttcttgatgcatctactgttgcagaagcaatcagtgtcatctcctgttggtatgaggataagacagagtgggggcaccgtgtgggatggatttatggctcagttactgaagacgtggtcacagggtacagaatgcacaaccgaggatggaaatcagtttattgtgtgactaagcgcgatgccttcaggggaactgctcctattaatcttactgataggctccatcaagtccttcgctgggccactggctcagttgagattttcttctcgcgcaacaatgccctcttggctagcccaagaatgaaactgctccagaggatagcataccttaacgttggtatctaccccttcacatccatattcctgattgtctattgcttcctcccagccctttccctcttttcgggccagttcatcgtccagacgttgaatgttacgttcctcacctacctcttgaccatcacccttactttgtgcatgcttgcggtgcttgagattaagtggtctggtattgagctagaggagtggtggcggaatgagcagttttggctgattggtggcaccagtgcacaccttgctgctgtgcttcaggggttactgaaagtagttgctgggattgaaatttctttcacgcttacatcgaagtctggtggtgatgatgttgatgatgagttcgctgatctctacgtagtcaagtggacatccctgatgataccgccaattactattatgatgacgaatttaattgctatagcagttgggtttagcaggacaatttacagtgtgattcctcaatggagccgtttgataggtggggtcttcttcagtttttgggtcttggctcatctgtatccttttgcaaaggggctcatgggaagacgtgggcgcacccctaccattgttttcgtttggtcaggactcattgcaatcaccatatcacttctttgggtggcaatcagccccccagctgggtcaacccaaatcggtggctctttccagttcccctgataggttattctttttaatatgctttatctgtttagtgacattactccattcttttttaaatgagatgatcatgttgacaaggacgtgggtatgttccgtttcctatgccagtttgaattttgtccaatagatcagttggcgtttagatggctcggcatagaaaaatgggcagtggacaaggctcttgttcattgtttgtattgaatgatgaacgacgtggttctacttattacctatttcagctgcttgtgtagcgtaattacatctgttggcctctattatgttagaaagaggaaatacaaacaaaacctgtccatgggtcctgacgaatgtctagtgaaagagcattctctatatgcaaggaaaatgacattttgtcttcgaaaacgactcatccgtttcgtcgtaataatctgctgatccatggatcatgggcactttggg

SEQ ID NO: 10166 - DNA, 4307 bp, Gossypium raimondii
ccaactcataaactttcatgatcctttcacacgttctcttccccttcacttcaccacttccaatttaaaaagaccccatttattaagaaattttccttttttttattacaaaaatgaatcccaactcatccttaccatatacaaaaaaacacgctcttttctgatttcatgccttaaaataaccatatactcgaccagtcgtgatatcttagtgcttgtagttttgcttctcacgacttggtctctttttcatatttttttcttacaaaggtttaacaggcaacagttggagaccaacaactcaagagaatcatagaatatgaacagtttgaattgttcaggttttttataaggctatgtcaagattggacaaaaaaaagggttttaaataatatccctttttttataaagattttcaagtgctttctttttggaagttgacagaaagtataaaaggatttgttgggatagttctctgttagtactaaaaggatggcatcgaggtccttcaaagggagtcgatcatctttatcgatttcatcggatgcagctgagtcacataagcctccagtgcctccaactgtgacatttgcacggagaacttcctcgggtcgatacgtgagctactcaagggatgatcttgacagtgagcttggttgtagtgatttcatgaactatacggtgcatataccgcccaccccagacaaccaaccaatggacccttctatttctcagaaggttgaagagcaatacgtgtcaaattcactttttaccggtggattcaatagtgttacacgagctcatcttatggacaaggtgatcgagtctgaaacaaaccatccccagatggctggtgcaaagggatcttcatgtgcaattcctgggtgtgatgcaaaggtgatgagcgatgaacgcggtctagatattctcccttgtgagtgtgatttcaaaatctgtcgggattgttacattgatgcggtgaaaactgggggtggaatatgccctgggtgtaaggagccgtataagaacacggatctcgatgaaacagctgtggatagtaataccaggccacttccactacctcctccgagtacaatgtccaaaatggagaggagattgtctttaatgaagtcaacaaagtcggccctgatgaggagtcaaactggagactttgatcacaatcggtggttgtttgagactagagggacttatggttatggcaatgctatatggccaaaggatggtaacctaggaaacggagacgatgatgaagctgctgagccaacagagttgatgaacaaaccgtggaggcctctcactcggaaattaaaaataccagcagccattctgagtccatatcggcttttaatatttatacgagttgttgtccttggcttgtttttggcttggagggtcaccaatccgaacaaagatgcgatatggctatggggaatgtctgttgtttgtgaaatttggtttgctttttcatggcttctcgaccaactgcccaagctctgtccgattaatcgtgctacggaccttaacgtgctgaaggaaaaatttgaaactccgagtcctagcaaccctactggaaagtctgaccttccaggaatcgatgtatttgtctctactgcggatcctgagaaagaaccacctcttgtcactgcaaacactatcttgtcaattctagcagccaactaccccgttgaaaaacttgcttgttatgtttctgatgacggaggagcacttttaacgttcgaggctatggctgaagcagcgagttttgctaatgtatgggttcctttttgtcgtaaacatgatattgaaccgaggaatccggaatcttacttcaatttgaagagggatccttacaagaataaagtcaaaccagattttgttaaggaccgacggcgagttaaacgtgaatatgatgaattcaaggtccgtatcaatggtttgccggactccattcgccgtagatccgatgcctttcatgcaagggaggaaatcaaggcaatgaagcttcagagacagaacagaggggatgaacctatagacagtgtgaaaatcccgaaagcgacatggatggctgatggaactcattggcctgggacttggttgaatccatcaaccgatcactctcggggtgaccatgctggtataatacaggtgatgttgaaacctccaagtgatgaaccactacatggaactgctgaggatgggctaattgatctcactgatgttgatattcgtctcccgttgcttgtttatgtttctcgtgagaagcgcccaggctatgatcacaacaagaaggcaggtgccatgaatgccctggttcgggcgtctgcaattatgtcgaatggtccatttatcctgaacctcgactgtgaccactatatctacaactctcaggcaatgagggaaggcatgtgtttcatgatggatcgaggaggtgaccgcctttgttatgtccagttccctcagaggtttgagggtattgacccttcggatcgatatgccaatcacaatactgttttctttgatgtgaacatgagagctcttgatggtcttatgggtcctgtctatgttggaaccggatgcctctttcgaaggattgcgctttatggctttgacccgcctcgatcaaaagaacaccatgctggttgctgcagttgctgctttggtcgtagcagaaagcattcttcaatggcacacaccccggaggagaatcgtgcgctgagaatgggtgattccgatgatgaagagatgaacctctcgttgcttccgaagcggttcgggaactcaacatttctcattgattcaattccagtggcggagtttcaaggtcgtccccttgcggatcatccagctgtgaagaatgggcgccccccttgtgctttaactattcctcgtgaacttctagatgcctcaactgttgctgaggcaatcagtgttatttcgtgctggtacgaggacaagactgagtggggacagcgtgttgggtggatttatggttccgttaccgaagatgtggtcactggatatagaatgcacaacagaggatggaaatcagtttattgtgtgaccaaacgtgatgctttccgtggaaccgctccgatcaatctcactgatcgacttcaccaagtcctgcgttgggctactggctctgttgagatcttcttttcccgtaacaatgctctcctcgccagtccacgaatgaagttattgcagaggattgcatatctaaacgtcggaatctaccccttcacctcgatttttctgattgtttactgcttccttcccgcactttccctcttctccggccagttcatcgtgcagaccctcaatgtcactttccttacatacctcctcatcattactgtaactctttgtttgcttgccgtgctagaaatcaagtggtccggcattgagttagaagaatggtggagaaacgagcagttttggttaattgggggcacaagtgcccatcttgctgctgtgcttcaagggctattgaaagtgattgctgggatcgagatttcgttcactttgacatcaaaatctgcgggggacgatttggatgatgagtatgctgatctctacgttgtcaaatggacgtccctgatgataccaccgataacaatcatgatggtcaacttaatagcgatagcggtcgggtttagccgaacagtttacagcgtcatacctcagtggagccgtctgctcggtggagttttcttcagtttttgggttttggctcatctctatccctttgctaaagggcttatgggaagaagagggcgtacgcctaccatcgtttttgtgtggtcgggtcttattgccattaccatatccctcctttgggtcgcaataaatcccccatccggtactaaccaaatcggaggctcgttccagttcccttgatccggcattctttacgctaaggcgaatcggttcaatgacattccttcattctttcctttttcccgtacaagccgattatgcctgtgaaaaatactagtcatgttctatatatacatgtccttgctgatgtttttatatggattactcaattgtacctcaatttttttttgttttttttgtttacggatagccgtttttatatgcttaaattgtttactttcgaaacatggattgattgatgagcaaaaaccgaattcaactgtcgtcttatagtaagaaaaacaaacttggatactctctagaattgaagaaaaaaatattgtacatgttgagattggaatatcgtattttcaccgtacttttatgaaaaaattaaatagtag

SEQ ID NO: 10167 - DNA, 1623 bp, Brachypodium distachyon
ggaagcgtttcaaaagccgcgtgctcgctacttaaagcccgcgagggagctgcctcgcgtctcgtctatactttccttctttccttccttccttccgtcgcagattaccgcttctcgtcgtctcgcccacatctttcccggcccttcccatcaattcgagattcatccttttcaaggatcttgagagagagattagtaccggagaccaattctccgttggaattcccgggcgagagagtcagagagcatgaccggagcggaggagcaggggaggaggctgttcggggtgtcgctgacggacaggcccgtctggcagcagttcctcatctgctcctcgggcttcttcttcggctacctcgtcaatggcatctgcgaggaatacgtctacaaccggctccagttcagctatgggtggtacttcaccttcgtgcaggggttcgtgtacctggccctgatacggctgcaggggttcacggtcaagcagatggtgaacccgtggcgcacctacattcgcctctcggccgttctcatgggctccaatggcctcacaaagggctccctcgccttcctcaattaccccgcgcagatcatgttcaaatccaccaaggttttgcctgtgatgataatgggggcatttatccccggtttacgacgcaaatacccattccatgagtatgtatctgcggtgatgctcgtcctcggcctcatactcttcacgcttgcggatgcgcagacatcgcctaatttcagcatggttggcgtggccatggtctccagtgcgctcatcatggacgccttcctcggcaacctgcaggaggccatctttaagatgaacccagacactacacagatggagatgctcttctgctcaactgttgttgggttacctttccttgctgtgccgatggtgttaacaggggagctaaggacagcatggaattcgtgttctcagcatctgtacgtgtacgccgtgctagtgttcgaggcgatggcgacgttcgtggggcaggtgtcggtgctgtccctcatcgcgctcttcggcgccgcgacgacggccatggtgacgacggcgaggaaggcggtgacgctgctcctgtcgtacctgatattcacgaagcccatgacggagcagcacgtcacggggctgctgctgatcaccatggggatcgtgctaaggctcctgccggagaacaaggagaagaagggcccggccgcgctccggcaggccaagatggcggtggcgttgccgcagcgtggcggcggcgaggaggatcggcagcggcagcagtggcggggagacgatgatgtggtagaggaggagggggaggagaaatcgccgttagtatgatggatgaactgaacagaactgatggagtaataacaaaccaaagtgctgtgctgcaggataggatacaagaatagttacatacattttctctgtctgttgagatcctccctctgctactagtactgtttctcaaactttggttttatttgttggtaccagtactgtttttgttcctctggctttccatttcagtcgttgacgtcccagaaactcgtcgaccttgtgttctctgtggaaacggaagtattccctgttatctggtacagtaataaaac

SEQ ID NO: 10168 - DNA, 2818 bp, Oryza sativa
tttccatctgttcagcttgtcttttccggagagaaaaatgtccgtttccttaaaccgttccgaggatgtgggtgacgagcccgtggggcgcaagttggagatggaggacaagcaacagctgagccccgtgtccgttctggatttccccttcgatgacgacgacggcgaggaaggaagcgatgccggcatgtgctcgccgtccttccaacagtgcctcgccgagctccagagatcgaaggcggagctgctgcacaagatccgacggctggagggcctgacgcaggtggtcgtccccgtggatctcgaggcgcaattcaccgagtctgattcctccgagcgcacgcatctcaacgccaactcgactagctcttctgatgacaccgcgacgacggcgcccacgacgccacggcaatgcacggacgaccaagatgtcgttaatcacggcgaggaggaggaggaggagcacagcctgctcgcgcggctgctcgagtcggttgttgtcacggacgaggtctccgagtggctcctgctcgacttctttgccgagggagtggaccggctccggtcgtcggcgtccagctgccctctcaacgattgcgaggaggcggcgctgctgcgcgccgcgggggattgggcgcgcggcgcggggcagcggtggggcgtcggggacgtggtgttctccgggtgggcggcggtggcggacatggagcggagccggaggtggatgtgcgtcgccgaggaggagcgggacgtcggcgcggaggtggacgggctcgtgatggacgcgttggtggacgagctggtcgccgacttggcacttggtggtgcgaccacggtaggggtggaaccaacggaaaaccgtgacgagtccagtgcaatccgtgcatgcacgccctgcgctgccacgcggccggcatccgccaaagcaacaggtcgttcccgcgaactcccaggcagagagcaagggtatgtggtgccatcctcttgtaacgcacacgcgggtcttcctcgtttgcgcaactgcatccacgaacaaaacggctgcctctctctccctccatctccctcgctggagtggagactcttcaaggccaaggagagtagcaggcagccagcacagcagcgagtgataaaaaagaggcagctcttggtcgttggtgtgcatgctcacgcgattcgcgtccaaaaatttatcaggaaacctttttcgaggtcgcgagtatcaatacatcttcgtgctagtgcgtgtgtgagagagagggaggcggccatgaccggaggggaggagcaggggaggaggctgtttggcgtgtcgctgacagacaggcccaggtggcagcagttcttgatctgctcatcggggttcttcttcggctaccttgtcaatggcatctgcgaggaatacgtctacaaccggcttcagttcagcttcggctggtacttcacatttgtgcaggggttcgtgtacttgggtctgattcgcctgcagggattcacggtgaagcagatggtgaacccgtggcggacgtacgtgcggctctcggctgtgctcatgggatcccatggcctcaccaagggttccctcgcattcctcaactaccccgcccaaattatgttcaaatccaccaaggttttgccagtgatgataatgggagcatttatacctggattaagaagaaaatatccgttccatgagtacatatcagcagtgatgcttgttatcggcctcatactattcacgctcgcggacgcacaatcatcacctaatttcagcatgattggtgtggccatggtttctggagcgcttgtcatggatgcatttctaggtaatctgcaagaagccatatttaagatgaaccctgacaccacacagatggagatgttgttctgctcaactgttgttggcctacctttcttggtggtgccaatggtgttaacaggggagctgatgcgggcgtggactgcatgttcccagcatatgtacgtgtacgccgtgctggtgttcgaggcgatggccacgttcgtcggccaggtctcggtgctctccctcatcgcgctcttcggcgccgcaacaacagctatggtgacgacggcgaggaaggcggtgaccctgctcctgtcgtacctgatattcaccaagccattgacggagcagcacgtcaccgggctgctgctgatctccatgggcatcgtgctgaagctcctgctggagaacaaggagaacgtcccgcgcaggcaggtgaggaagacggtgcagcattgggacgacaagcagcgggagatcagagaagtagaagaggagaaagctcccttggtatgaccatttttttagttggcccaagcaaaggctgaacgaatcacaatacaccaattgcaggacaggatagaaaatgctcaaaaaagagtaacaacccctctccctctgtctctctcatgtaatgttttgctgttgtgagattgttttgtgggtctatgccaaaggattcgattgacgataattacagattaatttggttggaggtgatatcgcatcactgccagttcttcattgtttctcgacaattttgcactcaagtaacgtcgacaggatacccggaaaaaaaaagagaaaaggaaaaacgaagtgacgttcacagaccacaaatgtgtgacgttgttgtgctctgcatttatatgggctggtggtgatatgatatcttcttgcttggtcctgtgctcatggcccatctggaccacaaagcccacatttcgcagtcactcatcccacgaggaaagcgaagggacacatctgcagactgcagttcgacgagcagctcag

SEQ ID NO: 10169 - DNA, 1570 bp, Oryza sativa
catcctcttgtaacgcacacgcgggtcttcctcgtttgcgcaactgcatccacgaacaaaacggctgcctctctctccctccatctccctcgctggagtggagactcttcaaggccaaggagagtagcaggcagccagcacagcagcgagtgataaaaaagaggcagctcttggtcgttggtgtgcatgctcacgcgattcgcgtccaaaaatttatcaggaaacctttttcgaggtcgcgagtatcaatacatcttcgtgctagtgcgtgtgtgagagagagggaggcggccatgaccggaggggaggagcaggggaggaggctgtttggcgtgtcgctgacagacaggcccaggtggcagcagttcttgatctgctcatcggggttcttcttcggctaccttgtcaatggcatctgcgaggaatacgtctacaaccggcttcagttcagcttcggctggtacttcacatttgtgcaggggttcgtgtacttgggtctgattcgcctgcagggattcacggtgaagcagatggtgaacccgtggcggacgtacgtgcggctctcggctgtgctcatgggatcccatggcctcaccaagggttccctcgcattcctcaactaccccgcccaaattatgttcaaatccaccaaggttttgccagtgatgataatgggagcatttatacctggattaagaagaaaatatccgttccatgagtacatatcagcagtgatgcttgttatcggcctcatactattcacgctcgcggacgcacaatcatcacctaatttcagcatgattggtgtggccatggtttctggagcgcttgtcatggatgcatttctaggtaatctgcaagaagccatatttaagatgaaccctgacaccacacagatggagatgttgttctgctcaactgttgttggcctacctttcttggtggtgccaatggtgttaacaggggagctgatgcgggcgtggactgcatgttcccagcatatgtacgtgtacgccgtgctggtgttcgaggcgatggccacgttcgtcggccaggtctcggtgctctccctcatcgcgctcttcggcgccgcaacaacagctatggtgacgacggcgaggaaggcggtgaccctgctcctgtcgtacctgatattcaccaagccattgacggagcagcacgtcaccgggctgctgctgatctccatgggcatcgtgctgaagctcctgctggagaacaaggagaacgtcccgcgcaggcaggtgaggaagacggtgcagcattgggacgacaagcagcgggagatcagagaagtagaagaggagaaagctcccttggtatgaccatttttttagttggcccaagcaaaggctgaacgaatcacaatacaccaattgcaggacaggatagaaaatgctcaaaaaagagtaacaacccctctccctctgtctctctcatgtaatgttttgctgttgtgagattgttttgtgggtctatgccaaaggattcgattgacgataattacagattaatttggttggaggtgatatcgcatcactgccagttcttc

SEQ ID NO: 10170 - DNA, 1661 bp, Zea mays
ccatgactgacttgagcgaggacgacgacgctacgactcctcgcctcctcttctcctaggaatagaatcccttggcggcttggcctgcatgcagttggcgtatcttcattttatttatttatttatttattgtgtatatataagggcggttatcatatcttggcgagcagcagctgcggacttgcgagcccaggcaggagaggactcgtccacatctattccttccttgttcagccgcccttcctcagttggggaaggacgacccaagagaggaggaggaggaggaggacagtgccgccatgaccggaggaggggaggagcaggggaggtcgctgttcggcgtgtctctgacaaacaggcccaggtggcagcagttcatgatctgctcctcgggcttcttcttcggctacctcgtcaatggcatctgcgaggagtacgtgtacaacaggcttcagttcagctacggctggtacttcacgtttgtgcaggggttcgtgtacctggcgctgatacggctgcaggggttcacggtgaagcagatggtgaacccgtggcggacctacgtgcgcctctcggcggtgctcatgggctccaatggcctcaccaagggctccctcgccttcctcaattaccctgcacagatcatgttcaagtcaaccaaggttctaccggtgatggtgatgggagccttcatccctggtctgaggcgcaagtacgcgttccaagagtacgtgtcggccgtgatgctcgtcgtcggcctcatactcttcacgctcgcggacgcgcagacgtcgcccaacttcagcatggccggcgtggccatggtgtccggggcgctcgtcatggatgctttccttggcaacctgcaagaagcaatcttcaagatgaacccggacacgactcagatggagatgctgttctgctccactgtcgttggccttccgttcctagcggtgcccatggtgttaacaggagagctcgtgacggcttggacttcctgctcccagcatctgtacgtgtacgcggtgctggtgttggaggcgatggccacgttcgtcggccaggtctccgtgctctccctcatcgcgcttttcggtgcagcaaccacagccatggtgacgacggcgaggaaggcggtgacgctgctgctgtcgtacctgatattcaccaagcccctcacggagcagcacgcgacggggctcctcctcataaccatgggcatcgtcatcaagctcctgccggagaacaaggagagacgcccgcgccggctgcccaagaatgacgacgacgacaagccccgggagagcagagaagcgggggaggaaacagcatgactgctgctatagacccgacacccgagcaaagcagaactgacgccagctcgatcagcaaccctagaagaaattctcagtcctccaaaacagcaatcccaggaggaggatgggatatacatgcaggatagagcactacatacagtaataataacctttttcctcgctcctcccctcgcttttctcatgtgctgtggttaatgttaattgtgcacttcgctctaacatcttaagctttttataaaggcaagggccagaggtctgaattctaattagcgcaatatctaaggtcttgttcagttattcctatcctatgtggattgtatgaga

SEQ ID NO: 10171 - DNA, 1583 bp, Sorghum bicolor
agttgcagacttgcgagcccaggactcgtccacatctgttcctttccgctctgcttcgttcgtcgtccccttacacccttacacttctccttgtcgccccggcggccgggcggccattgacgactggatccttcattcttgttcttgggaaggaaggacccagagagacgacgaggaggaagcgccgccatgaccggaggaggggaggagcaggggaggtcgctgttcggcgtgtctctaacggaccggcccaggtggcagcagttcttgatctgctcctcgggcttcttcttcggctacctcgtcaatggcatctgcgaggagtacgtgtacaacaggcttcagttcagctacgggtggtacttcacgtttgtgcaggggttcgtgtacctggcactgatacggctgcaggggttcacggtgaagcagatggtgaacccgtggcggacctacgtgcgcctctcggctgtgctcatgggctccaatggcctcaccaagggctccctcgccttcctcaattaccctgcacaaatcatgtttaagtcaaccaaggttctaccggtgatggtaatgggagcttttatccctggtttaaggcgcaagtacccgttccaagagtatgtatcagccgtgatgctcgtcattggcctcatactcttcacgctcgcggatgcgcagacatcgcctaacttcagcttggtcggcgtcgccatggtgtccggggcacttgtcatggatgcttttcttggcaacctgcaagaagcaatcttcaagatgaacccagacacgactcagatggagatgctgttctgctccactgttgttggccttccattcctagcagtgccaatggtgttaacaggtgagctcatgacggcatggacttcctgctcccagcatctgtacgtgtacgcggtgctggtgtttgaggcgatggccacgttcgtcggccaggtctccgtgctctccctcatcgcgcttttcggcgccgcaaccacagccatggtgacgacggcgaggaaagcagtgacgctgctgctgtcgtacctgatattcaccaagcctctgacggagcagcacgcgacggggctcctcctgataaccatgggcatcgtcatcaagctcctgccggagaacaaggagggacgtctgcgccggctgccgaagaagacggaggagcgctctggcgatgatgacgacaagccccttgagagcagagaagcggacgcggaaaaggcaagtttggtgtagtgtgatagtgacccaagcagagcaaaacagacgccaggtcgaccaacaatcccaaatgaaattcagtcatccaaaacaacagtcccaaaggaggataggatacatagaggatagagcactacaggaatcaataacgtctttcttcatcccctcgcttttctcatgtgctgtggttaatgttaaaccgttaaagtacagatttgtgctcttgctctaacgtcttaagcttttcatataagggccagacgtctgaattctaattagctttacatgtaatctgctcaatttgatgccaaatcttggctaattagggcctgtttggctcttgccac

SEQ ID NO: 10172 - DNA, 977 bp, Brachypodium distachyon
caccccaacctaaacccccacggaccttctgtaacccgcaagaaccgaaacggcctgcccaaccggaaggcccgaccgaacgagagagagagagagagagctcctacgatgtcggcggacgagttgcggctggacttggaggagctgcggcggctggagagcctcgccacgcgccctcgcgtcctctccctcctctccaacgagatccgcagcgtcgacgcaaagttggccgcacggactgcgactgcaccggcaccggcaccagcgcctcaggcggtcgccgcggtggcccctgctggtgtgaattacgtcacgctggggacattcagctgggaccaggataatgagaagatcacggtttatgtattccttgaggatgtcgaccaagagaaggtggagactacttttaaaccaatgtcggtggatattaagattcatgatgttaaaggcaagaactacaggtgtgccataccaaaactgaacaaggaaatagttcctgagaaatgcaaggttgtggtcaagcctaaaaagattgtcattaccctttgcaaagcttctaaaggcagttggttggacctgcactacaaggaagataagttcaagccaagcacggccaaagataaggatccaatggcaggaatcatggatttaatgaagggcatgtatgaggaaggggacgacaatatgaggcgcacaatagccaaagcatggactgacgctagatccgggaagacagctgattcagcgaaggggttaccttgagccggcagttttgattccagagctgctttatgtgctgagctagtcggtgtgagtgagggtactactatgaatatcgctattgcgtggatgtggtcgctacatgtctgacagaagcacttctagtagtactgaattctctttgaaaatgtgagaaattgtcacgctgagccaattgcagtttcttatttcaaatatgtctgtgtgattaaagggat

SEQ ID NO: 10173 - DNA, 2105 bp, Secale cereale
accaccccgcgcgcgccggcgactcagatcggacccgtcgcctacgtccttcgcctccctctctcagggtacgctgcaatggatgctccaaaggatgcatctccgtcgccgaaactgcacacgaggctgagggtgtgggagtttgcggaccgttatgtgtttgaaccggttgatggccttgccgacctgttcctctcagtaagccggaccaatggatctatgaacctagtgccagagctgccaccgcgcggcccctcggcaaatccaaaagtcaggatagtgtttggtgtggtaggagtgctcaagcttgcagttggatcatgttgcctggtcatcaccgaccgtgattgtgtcgggtcctacatgggacatgctgttttcaaagttacaggactaaaagctctcccctgcaccaccgcatcttcggccgagcagaaaaagatggagagcgaattttcagacctcctggatgctgcagagaggagtataggcctgtacttctcctatgaggccaacttgacacttactttacagaggctatatgatctcggggacacgttcaaagcacttccactttggagacaggcagaacgtagatttatgtggaatggttacttgttggagcctctcattgagaacaaactggaccaatacttattaccggtcattcaaggaagttttcagaatatacatgcagaagttgggtcagataaagtagtagtaaccatgattgcacgcaggtgcacaagaaggataggtacacggtgttggaggcgaggtgctgatccagagggctatgcagcaaattttgttgaatcagagcagataatgcaaacaaaaggatatacagcatcctatgtacaagttcgaggttctatgccttttttgtgggagcagatagttgatttgacatataaacctagttttgacattgttagagtggaggaggcggctcgtgtgcttgagcgacactatcatgatttacaaaagaaatatggagctgtcgtgggtattgatcttgtcaatacaactggtggtgaaggccgcctgtatgaaagatatgcaaaatcgattgagcctattctcagtgaagatataagattcatacattttgacttccataaaatatgtggtcatattcattttgagcggctttcacagttgtatgatcaaattgaggattatcttaagaagcataagtacttccttttggatgatgaaggcaagaaaattgtggggcagactggcactgtcagaacaaattgtgtcgattgtttagatcgtactaatgtgactcagagcatggttggaagaaaaattcttgaaagccagctccaacaactaggtgtttttggtggtaacgatacagtcagcaattatccagcttttgatgcagattacaaagttttgtgggcaaatcatggagatgcaataagcactcagtactctggcactcctgctctcaagggagactttgtccggtatgggaaacggactactcagggaatttttaatgatctgtggaatgcacttgctagatactacttcaacaacttcgcagatggtactaagcaggatgccatggaccttcttcaaggacattacgtatcatcagttagtcgggacgccgcgattccaagcaaacccggagctatgcagtccttccgtgttgcctttgcattgattttttgcgctgctatcttcatgcttatgtctctacgacaagcccggaatgatcttcgccacttggtggtagcgcttgtgtgggccggtctgtgcattggcattgcactatatgtcaaaaagaacggtaggaagttctgcaaccgacctcgtttttacctgtcacgtaattgaccggtgcgcgaaggtacctttgcatgtatgccaagtgatcacggtagcttgtcgcaagctccttgcagtatcttctattgtgtgaagatttgttcatagcatttttttttcttgtagggcgcttgccctccccaattttgtatcgaggtctattctggcacccccgcctacctgcaattttgtatttaaattctgtacctgtctcactacgacacggtttgtttagtttgatataattgtaaaatccg

SEQ ID NO: 10174 - DNA, 2091 bp, Triticum aestivum
tggatgcgccaaaggatgcatctccgtcgccgaaactgcacacgaggctgagggtgtgggagtttgcagaccgttatgtgtttgaaccggttgatggccttgccgacctgttcctctcaataagccggaccaatgggtctatgaacctagtgcaggagttgccaccgcgtggcccctcggcaaatccaaaagttaggatagtgtttggtgtggtaggagtgctcaaacttgcagttggatcatgctgtctggtcatcactgaccgtgattgcgtcgggtcctacatgggacatgctgttttcaaagttacaggactaaaatttctgccctgcactaccgcttcttcggccgagcagaaaaagatggagagcgaattttcagacctcctggatgctgcagagaggagtataggcctgtacttctcctacgaggccaacttgacacttactttacagaggctatatgatctcggggacacgttcaaagcacttccactttggaaacaggcagaacgtagatttatgtggaatggttacttgttggagcctctcattgagaacaaactggaccaatacttattaccggtcattcaaggaagttttcagaatatacatgcagaagttggatcagataaagtagtagtaaccatgattgcacgcaggtgcacaagaaggataggtacacgatgttggagacggggtgctgatccagagggctatgcagcaaattttgttgaatcagagcagataatgcaaacaaaaggatatacagcatcctatgtacaagttcgaggttctatgccttttttgtgggagcagatagttgatttgacatataaacctagttttgacattgttagagtggaggaggcggctcgtgtgcttgagcgacactttcatgatttacaaaagaaatatggagctgtcgtgggtattgatcttgtcaatacaactggtggtgaaggccgcctgtatgaaagatatgcaaaatcgattgagcctattctcactgaagatataagattcatacattttgacttccataaaatatgtggtcatattcattttgagcgcctttcacagttgtatgatcaaattgaggattatcttaagaagcataagtacttccttttggatgatcaaggcaagaaaatggtggggcagactggcactgtcagaacaaattgtgtcgattgcttagatcgtactaatgtaactcagagcatggttggaagaaaaactcttgaaagccagctccaacaactaggagtttttggtggtaacgatacaatcagcaattacccagctttcgatgcagattacaaagttttgtgggcaaatcatggagatgcaataagcactcagtactctggcactcctgctctgaagggagactttgtccggtatgggaaacggactactcagggaatttttaatgatctgtggaatgcacttgctagatactacttcaacaactttgcagatggtactaagcaggatgccatggaccttcttcaaggacattacgtatcatcagttagtcgggacgccgcgcttccaagcaaacccggagttatgcagtccttccgtgttgcttttgcattgattttttgcgctgctatgttcatgcttatgtctctacgacaagcccggaatgatcttcgccacttggtggtagcacttgtgtgggccggtctgtgcgttggcattgcactatatgtcaaaaagaacggtaggaagttctgcaaccgacctcgtttttacctgtcacgcaattgaccgatgcgcgaaggacctttgcatgtatgccaagtgatcacgctagcttgtcgcaagctccttgcagcatcttctattgtgtgaagatttattcttagcatttttctttctttctgtagggcgcttgccctccccaattttgtatcaatgtctattctggcacccccgcctacctgcaattttgtatttaaattctgtccctgtctcactacggcacggtttgtttagtttgacataattgtaaatcccattgtgatacgatagcaatgaattgatgcacatgcactagtatttgatatacctagctccagcc

SEQ ID NO: 10175 - DNA, 2000 bp, Triticum aestivum
ggacgcatcgactcttctcccccaacgctcgccgaggcatccaccaccgcccctcgccaccccgcgcgcgacggcgtcctagatcggaccgttccgattgtctctcgcagggtaccctgcaatggatgcgccaaaggatgcatctccgtcgccgaaactgcacacgaggctgagggtgtgggagtttgcagaccgttatgtgtttgaaccggttgatggccttgccgacctgttcctctcaataagccggaccaatgggtctatgaacctagtgcaagagttgccaccgcgtggcccctcggcaaatccaaaagttaggatagtgtttggtgtggtaggagtgctcaaacttgcagttggatcatgctgtctggtcatcactgaccgtgattgcgtcgggtcctacatgggacatgctgttttcaaagttacaggactaaaatttctgccctgcactaccgcttcttcggccgagcagaaaaagatggagagcgaattttcagacctcctggatgctgcagagaggagtataggcctgtacttctcctatgaggccaacttgacacttactttacagaggctatatgatctcggggacacgttcaaagcacttccactttggaaacaggcagaacgtagatttatgtggaatggttacttgttggagcctctcattgagaacaaactggaccaatacttattaccggtcattcaaggaagttttcagaatatacatgcagaagttggatcagataaagtagtagtaaccatgattgcacgcaggtgcacaagaaggattggtacacggtgttggagacggggtgctgatccagagggctatgcagcaaattttgttgaatcagagcagataatgcaaacaaaaggatatacagcatcctatgtacaagttcgaggttctatgccttttttgtgggagcagatagttgatttgacatataaacctagttttgacattgttagagtggaggaggcggctcgtgtgcttgagcgacactatcatgatttacaaaagaaatatggagctgtggtgggtattgatcttgtcaatacaactggtggtgaaggccgcctctatgaaagatatgcaaaatcgattgagcctattctcagtgaagatataagattcatacatttcgacttccataagatatgtggtcatattcattttgagcgcctttcacagttgtatgatcaaattgaagattatcttaagaagcataagtacttccttttggatgatcaaggcaagaaaatggcggggcagactggcactgtcagaacaaattgtgtcgattgcttagatcgtaccaatgtaactcagagcatggttggaagaaaaactctcgaaagccagctccaacaactaggtgttcttggtggtaacgatacaatcagcaatcacccagcttttgatgcagattacaaagttttgtgggcaaatcatggagatgcaataagcactcagtactctggtactcctgctctgaagggagactttgtccggtatgggaaacggactactcagggaattctaaatgatctgtggaatgcacttgctagatactactttaacaactttgcagatggtactaagcaggatgccatggaccttcttcaaggacattacgtatcatcagttagtcgggacgctgcggttccaagcagacccggagttatgcagtccttccgtgctgcttttgccttgattttttgcgctgcaatgttcatgcttatgtctctacgacaagcccggaatgatcttcgccacttggtggtagcacttgtgtgggccggtctgtgcgttggcattgcactatatgtcaaaaagaacggtaggaagttctgcaaccgacctcgtttttacctgtcacgcaattgaccgatgcgcgaaggtacctttgcatgtatgccaagtgatcacggtagcttgtcgcaagctcctagcaacatcttctattgtgtgaagatttattcttagc

SEQ ID NO: 10176 - DNA, 2130 bp, Secale cereale
ccaccccccgcgcgccggcgactcagatcggacccgtcgcctacgtccttcgcctctctctctctctcagggtacgctgcaatggatgcgccaaaggatgcagctccgtcgccgaaactgcacacgaggctgagggtgtgggagtttgcggaccgttatgtgtttgaaccggttgatggccttgccgacctgttcctctcagtaagccggaccaatggatctatgaacctagtgccagagctgccaccgcgcggcccctcggcaaatccaaaagtcaggatagtgtttggtgtgataggagtgctcaagcttgcagttggatcatgctgtctggtcatcaccgaccgtgattgtgtcgggtcctacatgggacatgctgtttttaaagttacaggactaaaagctctcccctgcactacctcatcttcggccgagcagaaaaagatggagagcgaattttcagacctcctggatgctgcagagaggagtataggcctgtacttctcctatgaggccaacttgacacttactttacagaggctatatgatcttggggacacgttcaaagcacttccactttggagacaggcagaacgtagatttatgtggaatggttacttgttggagcctctcattgagaacaaactggaccaatacttattaccggtcattcaaggaagttttcagaatatacatgcagaagttggatcagataaagtagtagtaaccatgattgcacgcaggtgcacaagaaggataggtacacggtgttggaggcgaggtgctgatccagagggctatgcagcaaattttgttgaatcggagcagataatgcaaacaaaaggatatacagcatcctatgtacaagttcgaggttctatgccttttttgtgggagcagatagttgatttgacatataaacctagttttgacattgttagagtggaggaggcggctcgtgtgcttgagcgacactatcatgatttacaaaagaaatatggagctgtcgtgggtattgatcttgtcaatacaactggtggtgaaggccgcctgtatgaaagatatgcaaaatcgattgagcctattctcagtgaagatataagattcatacattttgacttccataaaatatgtggtcatattcattttgagcgcctttcacagttgtatgatcaaattgaggattatcttaagaagcataagtacttccttttggatgatgaaggcaagaaaattgtggggcagactggcactgtcagaacaaattgtgtcgattgcttagatcgtactaatgtgactcagagcatggttggaagaaaaattcttgaaagccagctccaacaactaggtgtttttggtggtaacgatacagtcagcaattatccagcttttgatgcagattacaaagttttgtgggcaaatcatggagatgcaataagcactcagtactctggcactcctgctctcaagggagactttgtccggtatgggaaacggactactcagggaatttttaatgatctgtggaatgcacttgctagatactacttcaacaactttgcagatggtactaagcaggatgccatggaccttcttcaaggacattacgtatcatcagttagtcgggacgccgcgattccaagcaaacccggagctatgcagtccttccgtgttgcctttgcattgatcttttgcgctgctatcttcatgcttatgtctctacgacaagcccggaatgatcttcgccacttggtggtagcgcttgtgtgggccagtctgtgcgttggcattgcactatatgtcaaaaagaacggtaggaagttctgcaaccgacctcgtttttacctgtcacgcaattgaccgacgcgcgaaggtacctttgcatgtatgccaagtgatcacggtagcttgtcgcaagctccttgcagtatcttctattgtgtgaagatttgttcttagcatatttttcttttctgtagggcgcttgccctccccaattttgtatcgaggcctatcctgcaattttgtatttaaattctgtccctgtctcactacggcacggtttgtttagtttgatgtaattctaaatccccattgtgatatgatagcaatgaattgatgcacatgcac

SEQ ID NO: 10177 - DNA, 2302 bp, Triticum aestivum
ctctcacccgcgactaggaggacgcatcgactcttctcccccaacgctcgccgaggcatccaccaccgcccctcgccaccccgcgcgcgacggcgtcctagatcggaccgttccgattgtctctcgcagggtaccctgcaatggatgcgccaaaggatgcatctccgtcgccgaaactgcacacgaggctgagggtgtgggagtttgcagaccgttatgtgtttgaaccggttgatggccttgccgacctgttcctctcaataagccggaccaatgggtctatgaacctagtgcaagagttgccaccgcgtggcccctcggcaaatccaaaagttaggatagtgtttggtgtggtaggagtgctcaaacttgcagttggatcatgctgtctggtcatcactgaccgtgattgcgtcgggtcctacatgggacatgctgttttcaaagttacaggactaaaatttctgccctgcactaccgcttctttggccgagcagaaaaagatggagagcgaattttcagacctcctggatgctgcagagaggagtataggcctgtacttctcctatgaggccaacttgacacttactttacagaggctatatgatctcggggacacgttcaaagcacttccactttggaaacaggcagaacgtagatttatgtggaatggttacttgttggagcctctcattgagaacaaactggaccaatacttattaccggtcattcaaggaagttttcagaatatacatgcagaagttggatcagataaagtagtagtaaccatgattgcacgcaggtgcacaagaaggattggtacacggtgttggagacggggtgctgatccagagggctatgcagcaaattttgttgaatcagagcagataatgcaaacaaaaggatatacagcatcctatgtacaagttcgaggttctatgccttttttgtgggagcagatagttgatttgacatataaacctagttttgacattgttagagtggaggaggcggctcgtgtgcttgagcgacactatcatgatttacaaaagaaatatggagctgtggtgggtattgatcttgtcaatacaactggtggtgaaggccgcctctatgaaagatatgcaaaatcgattgagcctattctcagtgaagatataagattcatacatttcgacttccataagatatgtggtcatattcattttgagcgcctttcacagttgtatgatcaaattgaagattatcttaagaagcataagtacttccttttggatgatcaaggcaagaaaatggcggggcagactggcactgtcagaacaaattgtgtcgattgcttagatcgtactaatgtaactcagagcatggttggaagaaaaactctcgaaagccagctccaacaactaggtgttcttggtggtaacgatacaatcagcaatcacccagctttcgatgcagattacaaagttttgtgggcaaatcatggagatgcaataagcactcagtactctggtactcctgctctgaagggagactttgtccggtatgggaaacggactactcagggaattctaaatgatctgtggaatgcacttgctagatactactttaacaactttgcagatggtactaagcaggatgccatggaccttcttcaaggacattacgtatcatcagttagtcgggacgccgcgattccaagcagacccggagttatgcagtccttccgtgctgcttttgcattgattttttgcgctgctatgttcatgcttatgtctctacgacaagcccggaatgatcttcgccacttggtggtagcacttgtgtgggctggtctgtgcgttggcattgcactatttgtcaaaaagaatggtaggaagttctgcaaccgacctcgtttttacctgtcacgcaattgaccgatgcacgaaggtacctttgcatgtatgccaagtgatcacggtagcttgtcgcaagctccttgcagcatcttctattgtgtgaagatttattcttagcatttttctttctttctgtagggcgcttgccctccccaattttgtatcaaggtctattctggcacccccgcctacctgcaattttgtatttaaattctgtccctgtctcactacgacacggtttgtttagtttgacataattgtaaatcccattgtgatacgatagcaatgaattgatgcacatgcactagtatttgaaatatctagctccagccattattattcttcatatactttcttcccacagaaggaattaattttaatcaattaaggcctttctattt

SEQ ID NO: 10178 - DNA, 2683 bp, Brachypodium distachyon
cctcaccagcatcggtaacctctcggccccggcgatcgatctcctttctccttcccgccgccatcccccaatcctgcgaccaatttcccctcgcagctcacccgccgcagcccgtcccgtcggccagctcctcccccggccccagatccgtctctgcccaatcccggccacacctgccgctgaccgtcgatcggaagctcctcctcccgtcggccacgtgcctgctcttccgttgagtcccccgccgctgaccggccgagacaagcacaggctgccctgcaatggatgtggcaaatgatgcatgcccatcacctaaactacatacgagactgaggctgtgggagtttgcagaccattatgtatttgagccagttgatggtcttgctgacttatacctgtcagtaagccggcccaaaggatctatgaatctagtggaagagttgccaccgcgtggtccctctacgaatccaaaagttcggatagtgtttggtgtgataggagtgctcaacctttcagttgggtcatattgtctggtgatcactgaccgtgattgtgttggatcctacttgggacatgcagttttcaaagtgacaggactgaaagttctgccttgcaataactcgcatagcacttctgccgaacagaaaaaaatggagaaagaattttcagcactcctggatgctgcagagaggagtataggcctgtacttctcctacgagaccaacttaacactgacttcacagaggctttatgatttgggggacaagttcaaggcacttccactttggagacaggcagaaccaagatttctatggaatggttacttgttggagcctctaattgagaacaaactggaccaatacttattaccagtcattcaaggaagttttcagaatatacatgcagaagttgggtcagataaggtaaatgtgaccatgattgcacgcaggtgcacacgaaggataggtacaaggtgttggagacgaggcgctgatccagagggctatgcagcaaattttgttgaatcagagcagataatgcaatccaaaggatttacagcatcgtatgtacaagttcgaggttctatgccgtttctgtgggagcagatagttgatttgacatataagcctagttttgatgttattagagtagaggaggcggcgtgtgttcttgagcgacacttccatgatttacaaaagaaatatggagctgttgtggctatcgatcttgttaatacaactggtggtgaaggccgcctctatgaaagatatgcaaaatcgattgagcctatcctcagcgaagatataagattcgtgcattttgacttccataagatctgtggtcatattcattttgagcgcctttctcagttgtatgatcaaattgaggattaccttaagaagcataagtactttcttttgaatgatgaaggcaagacaatggaggagcagactggcactgtcagaacaaattgtgtcgattgtttagatcgtactaatgtaactcagagcatggttgggagaaaaattctggaaagccagctccaacgattaggtgttcttagtgctaacagtacaatcagtgattatccagcttttgatgcagattacaaagttttgtgggctaatcatggagatgcaataagcacccagtactctggtactcctgctttgaagggagattttgtccggtacggaaaaagaactacccagggaattttcaatgacctgtggaatgcacttgagagatactacttgaacaactttgcagatggtacaaagcaggatgcgatggatcttcttcaaggacattacatatcctctcttagtcgggacattgcagcttcaagcaaagcaggacttattgagaattatgcgtcatgccgccttgcttttgcgttgattgttgttgctgttatgttaatgatgatgtcacttcgacaagcccgaaatgatcttcgccatttggtgttagcacttctgtgggccggtctttgcattggcatcgtacgatttgtcaaaatcaatggtcgtaagttcaccaaccgacctcgttttcacctgtcacgccattgatgtgcatggatacgatttgcatgtccagtgatcctggtagcttatcaccagatctttcagcatcttctgttgtgtgaagatttgttcatggtatttttttgtagggcacttgccctccccatttgtttttcgagttctatgctcttgttttcccttcccaattttgtatttagttctgtttccaacttaccacaattttgtccacctttccacaattttgtctccagattctgttcagccctcaccatggagatttgtgtgccatggtttcttaattcatcgtagttgtaaaacccgattaatggtgatataatagcagttaactgttgacatgctctaccatttgatagttaatttacctcaaccagtcgttattatccttcccatactttttcccaatgaaggaatggattgtaattcataaaccttttctgtttcccatataactgttattttcttattttggattattcttttctttactcttataattcttccccatgaaggaatgtaatgtagtaaagatttgtgttggtggaagtatgctcaccctcactctttcagttacgagtagttgatttagtcgatgtatattttgagataatttt

SEQ ID NO: 10179 - DNA, 2221 bp, Oryza sativa
atcgccccgcttctagtgtggcccttccctctcccgcgttcatctcactaccgctagttccatccccttctccacttctccgaggcgattccccttctccaatccattcattccaccctcttccgatccccaaccgccgctggtccgtatccattccactctcctccgacccctaccgctgccggagtgctagggcatcacacgatgagtgttgcaactgaagcatgcccttcaccaaagctacacacaagactaaggctgtgggagtttgcagaccgttacgtatttgaaccagttgacggtcttgctgatttgttcctgtcagttgatcggacaaatggatcaatgagtctagtggaagagttgccacctcgtggtccctctacaaatcctaaagttagaatagtttttggtgtgattggagtgctcaaacttgcagttcggtcgtactttcttgtgatcactggccgtgattgtgttggatcctacttggggcatgcaattttcaaattgacgggactaaaagttctgccatgcaataactcgttaaatacttcttctgctgagcagaagaaaatggaatcagaattttcggaacttctggatgcagcagagaggactataggcctgtacttctcctatgatgtcaacttaacactaacttcacagaggctgcatgatctaggagatcagtttaagtcacttccactttggagacaggcagaaccaagatttctttggaacggttacttgttggagcctctaattgagaacaaactgcaccaatacttactaccagtcattcaaggaagttttcagagtatccatgcagaagttgggtcagagaaggtaaatgtgaccctgattgcacgtcggtgtacacgtaggataggtacccggatgtggaggcgaggagctgatccagagggttatgctgcaaattttgttgaatcagagcagataatgcaatcgaaagaatttacagcatcatatgtgcaagttcgaggttctatgccttttttgtgggaacaaattgttgatttgacatataaacctagttttgatgttgtcagagtagaggaggcgcctcgtgtacttgaacggcattttcatgatttacaaaagaaatatggagctgtcgtggctgttgatcttgtcaatacacatggtggcgaaggtcgcctgtatgaaagatatgcaaaatcaattgagcctatcttgagtgaagatataagatttgtgcattttgacttccatcaaatctgtggtcatattcactttgaacgcctttctcaactgtatgatcaaattgaggattatcttaagaagcataggtacttccttttaaatagtaaaggtgagaaaatggaagagcagaccggaaccgttagaacaaattgtgtcgattgtctggatcgtactaatgtaactcagagcatgatcgggagaaaaatattggaaagccaactgcaaaaaatcagtgttcttggtgacaacaatacaatcagcgattatccggcatttgatgcagattacaaagttttgtgggccaaccatggcgatgcaataagcactcagtactctggaactcctgccttgaagggagactttgtgcggtacggaaagcgaactacacagggaattttaaatgatctgtggaatgcaatggctagatattacctgaacaactttgcagatggtactaaacaggatgccatggatcttcttcaaggacatcacatatcctcagttagtcgggatatgccaactccaaccaaaggacttatagagaatcacgcgtccttccgccttgcttttgctctgcttttggctgccgtgatattcttgataatgtcactgagaagagcacgtaatgatgttttccatttggtgctgtcactactatggtctggtttttgctttggcatcacgcgttatgtcaaagctaacggacggaagttcacgaaccgtcctcgctttcacctatcgcgccattgatgcgaacaaaagggattatatacacactcatggtcgactcacctttctgggcatgcatgtgtgctctcagttttgtatcaagtttaactttccctctttgtaagattttgcacatgttctgaccatcacggctttatattttcttgttgaatgggaacatcaggaattgatttgttctattgcatttatttatttatttatttatttatataaacgttttgca

SEQ ID NO: 10180 - DNA, 2290 bp, Oryza sativa
catcgccccgcttctagtgtggcccttccctctcccgcgttcatctcactaccgctagttccatccccttctccacttctccgaggcgattccccttctccaatccattcattccaccctcttccgatccccaaccgccgctggtccgtatccattccactctcctccgacccctaccgctgccggagtgctagggcatcacacgatgagtgttgcaactgaagcatgcccttcaccaaagctacacacaagactaaggctgtgggagtttgcagaccgttacgtatttgaaccagttgacggtcttgctgatttgttcctgtcagttgatcggacaaatggatcaatgagtctagtggaagagttgccacctcgtggtccctctacaaatcctaaagttagaatagtttttggtgtgattggagtgctcaaacttgcagttcggtcgtactttcttgtgatcactggccgtgattgtgttggatcctacttggggcatgcaattttcaaattgacgggactaaaagttctgccatgcaataactcgttaaatacttcttctgctgagcagaagaaaatggaatcagaattttcggaacttctggatgcagcagagaggactataggcctgtacttctcctatgatgtcaacttaacactaacttcacagaggctgcatgatctaggagatcagtttaagtcacttccactttggagacaggcagaaccaagatttctttggaacggttacttgttggagcctctaattgagaacaaactgcaccaatacttactaccagtcattcaaggaagttttcagagtatccatgcagaagttgggtcagagaaggtaaatgtgaccctgattgcacgtcggtgtacacgtaggataggtacccggatgtggaggcgaggagctgatccagagggttatgctgcaaattttgttgaatcagagcagataatgcaatcgaaagaatttacagcatcatatgtgcaagttcgaggttctatgccttttttgtgggaacaaattgttgatttgacatataaacctagttttgatgttgtcagagtagaggaggcgcctcgtgtacttgaacggcattttcatgatttacaaaagaaatatggagctgtcgtggctgttgatcttgtcaatacacatggtggcgaaggtcgcctgtatgaaagatatgcaaaatcaattgagcctatcttgagtgaagatataagatttgtgcattttgacttccatcaaatctgtggtcatattcactttgaacgcctttctcaactgtatgatcaaattgaggattatcttaagaagcataggtacttccttttaaatagtaaaggtgagaaaatggaagagcagaccggaaccgttagaacaaattgtgtcgattgtctggatcgtactaatgtaactcagagcatgatcgggagaaaaatattggaaagccaactgcaaaaaatcagtgttcttggtgacaacaatacaatcagcgattatccggcatttgatgcagattacaaagttttgtgggccaaccatggcgatgcaataagcactcagtactctggaactcctgccttgaagggagactttgtgcggtacggaaagcgaactacacagggaattttaaatgatctgtggaatgcaatggctagatattacctgaacaactttgcagatggtactaaacaggatgccatggatcttcttcaaggacatcacatatcctcagttagtcgggatatgccaactccaaccaaaggacttatagagaatcacgcgtccttccgccttgcttttgctctgcttttggctgccgtgatattcttgataatgtcactgagaagagcacgtaatgatgttttccatttggtgctgtcactactatggtctggtttttgctttggcatcacgcgttatgtcaaagctaacggacggaagttcacgaaccgtcctcgctttcacctatcgcgccattgatgcgaacaaaagggattatatacacactcatggtcgactcacctttctgggcatgcatgtgtgctctcagttttgtatcaagtttaactttccctctttgtaagattttgcacatgttctgaccatcacggctttatattttcttgttgaatgggaacatcaggaattgatttgttctattgcatttatttatttatttatttatttatataaacgttttgcagaaaatgttgcaaagatgtatatgatgatcaaaattgcaaatggtttagggtttcatatattttgggc

SEQ ID NO: 10181 - DNA, 2910 bp, Setaria italica
catggtcaatgtttcaggtatcccaccatggatgtgccaaataactcatgtccttcaccaaaactccacacaagactcaggctgtgggagtttgcagatcaatatgtatttgaaccggttgatggtcttgctgacttgtttttgtcagttagccgggtcaatggatcaatgagtctagtggaagagttgccacagcgtggtccctctacaaatccaaaagttcaaatagtgtttggtgtcataggagtgctcaaacttgaagttgggacatattttctagtgatcactgaccgtgattgtgttggatcctacttgggacatgcagtttttaaagtgacaggcctaagagttctgcgctgcaataattccattaatgcttctgctgagcagaaaaatatggacacagaatttttggaacttctggatgctgcagagaggaccataggcctgtacttctcctatgattccaacttaacagtaacttcgcagaggctacatgaactaggtgatgaattcaagtcacttccactttggagacaggcagaaccaagatttctatggaatggctacttgttggaacgtcttattgagaacaaactgcaccagtacttgttaccagttatacaaggaagttttcaaagcatccatgcagaagttcggtcagaaaaggtaaatgtgactcttattgcacgaaggtgcacacggaggataggtactcggatgtggaggcgaggagcagatccagagggttatgctgcaaattttgtagaatcagagcaaatcgtgcaatcaaaaggatttacagcatcctatgtgcaggttcgaggttcgatgccttttctttgggagcaaattgttgacctgacatataaaccaggttttgatgttgtaagagtagaagaggcggctcgtgtacttgagcggcactttcatgatttacaaaagaaacatggggctgttgtagctgttgatctggtcaatacacatggtggtgaaggtcgactctatgaaagatatgcaaaatctattgaacctatacttagtgaagatataagatttgtgcattttgatttccataaaatatgtggtcatattcactttgagcgtctttctcagctctacgatcaaattgaggattatctcaagaagcacaagtacttcctcttgagtgataaaggcgagaaaactgagcagcaaactggcactgtcagaacaaattgtgtcgattgtttagaccgtactaatgtaactcagagtatgattgggagaaaacttctggaaagtcagctccaacgaataggtgtttttggtgctaatgatacagtcagtaactttctagattttgatgcaaattataaagttttgtgggccaatcatggagatgcaataagcactcagtattctgggactcctgctctgaaaggagacttcgttcggtacgggaaacgaactactcagggaattttaaatgatctatggaatgcacttgctagatactacctaaacaattttgtagatggtactaagcaggatgccatggatcttcttcaaggacattacatctcctctgttagtcgggacatggcacctacaagtaaagcaggacttctggagaattatgcgtcattccgtcttgctttcgcattggttttggtagctgtttcgttcatgattatatcactaagacaagcacggaatgatgctcgccacttggtgttgtcacttatgtgggccggtctttgcattggcatatcacgatatgtaagaaccaatggccgtatgttctgcaatcgaccccgtttctaccagtcacgccattgatcggtgcagagggatcgttccacgtcaagtgagcttgccaacttgtcacgacacaaattttctgaagattctattcatttcattctttttgtaaagaacctggcctccccaattttgtttcaacccttaacattcttttacacattgctgcacaatttgctttcgtacacatagtactatacctactaatatatctggctcaacctctcatgatggttgttcttaccatactttcctcacggaaggaaagaattgatgcatataattcataaaaagcatcaccgacattcttaccgtagcaaatatagtatcttgactcgaactagctagcttatgttttacggcctttattttattgtggcgaaccagttaaaactaatgacttctggaaggaacaactcattgtggtgttgtaatgttgcagcgaaaactgtttggtggtgttgatttgtaggagagaacgtctggaaattctgattgcaccgtcgatgcacaaaactgaagaccatgtgtgatctgtgtaaaggcgctatctggtatacatctgcaaccacgagaccagtggcaaaacactacctaacatttacttaatgcagagcaccaagactcctgcggcttatattgtcagatgcccatttgtttttaaaatctgttcttgtaggcaacctggaaattcacatgggatgaattttccccctgttgtatagaactttttcaggtggcaatgtagtttttagtatcttatggattgacactctttgtaattaatggataagcaacatcctttctttactatggaaacattccgttctttaacacttgtggaatgcaatagacaataagtacaaaacatttgaatgtcataagtttatataagtacttagataggttattgattctgaaatgtgcacgtgacagatttctgaggaatttaagtacgggtggtctaggtggcaagtatcgtttgtgtacgtaaaaagcacacatactaaatcatatatgccctacaaaacatcattacaaagcatattaaaatgcacaaaactaagggatgggactagatggcaaaactgatgaggtcaggtggca

SEQ ID NO: 10182 - DNA, 3612 bp, Setaria italica
cgcttccgacggaagcaaaaaaggggaagccatccgaaagggggagccgccccacgagtgagccgacccaaccggaaaggggggaaaagccctagaagaaacccgcgtaaagcgaccggatccaatggcgggtgcctcgtgctgctagatctcgcaccctgccggcaatggcgacgcggccggcgtcgcggcagcggaaggcggggtccgcatcggcggcggcggcggcgaagggctcgcatcagcagcagcagcagccgcagccgggctcgccgacgtcgacaaccacaacgaccacgtcatcgtcgcgtctcacaccggagctctcgctcgacgggcccgcgtccccgctgttcgccgggttggacgaggacccggcgcccaaggagaatgtcaccgtaactgtccgcttccgcccgctcagcccgcgggagattcggcagggggaggaggtcgcgtggtatgcggatggtgacacggtcgtgcggagcgagcagaaccccaacgtcgcctatgcttatgatcgagtttttgcaccaactactacaacccgtcatgtatatgatgttgccgctcaacatgttgttagtggttccatggagggagtaaatggtacaatatttgcatatggtgttacaagcagtgggaagacccacacgatgcatggagaccaaagatccccagggattatacctttggctgtcaaagatgcatttagcattatacaagagacactgaatcgtgagtttctcctacgtgtgtcgtacttggaaatttataatgaggttgtccatgatctactaaatcctgctggtcagaatttgcgaattagagaggatcctcagggaacgtttgttgagggtatcaaggaagaagttgtattgtctcctgcacatgcactgtcccttattgcagctggagaagagcatagacatgttggatccaccaacttcaatctactaagtagcagaagtcatactattttcacactgacaatagagagcagcccttgtggtgagtctaatgaaggggaagctgtcaccttctcacagctgaacctcatcgatctggcaggttcggagagctcaagggcggaaacaactggagtacggcggaaggaaggatcttatatcaacaaaagcttgctaactcttggaacggtgatatcaaagctgactgatggaaaggctacacatattccgtatcgagattcaaaattaacacgactacttcagtcgtccctcagtggtcaagggcgtgtttctctaatttgcacagtgacaccagcatcaagtaattctgaagagacccataatacactaaaatttgcccaccgtgcgaaacgtattgagatccaagcatcacagaacaaaattatagatgagaaatctttaataaagaagtatcaaactgagattcgcagattaaaggaagagctagagcagctgaaaatgggtattattactggcacaccctcaaaagatactggggaagataatatcatcctttggaaacaaaagttagaagatggtaacgtcaagctgcagtctaggctggaacaagaggaggaagctaaagctgctttacttgcaaggatacagcgtttaacaaaacttatactggtttctactaaagcgacccagacttctagattttctccacatcctggaccaagacgaagacattcttttggtgaagaggagctggcgtatcttccatacagaagacgagatataatgatggataatgaaagcaatgaattgcttcttcctgttgaagggtttggtgtatcacttgaagattcttcaaaggaggaaaaaaagaataggaaaggacttctaaactggttcaaactccggaaacgtgatggagcttctattctgacaagttcagaaggtgataagtccagtttgactaaatcaaccgctccttcaacacctattggggaaagtgtcaattttcgtgcagaaccaagaatttcaaattctttggctggtgagaatgtatcagctgatctgtttatcattggccatggggaatttccttctggaagcattcatggtgaagaaattgctttgaccagtggaaaaacgatggaccatgttgatttactgagagagcagttgaagattttgtcaggggaggtagcacttcagactagtgttcttaagcgccttacagaggaagccggaagaagcccactgagtgagaacattcagatggaaatgaagaagatcagtgatgaaattaaggggaagaagcggcaaatagcatctttggaaagggaaatagctcatgcaacattgggaagtcaaggaaaggctgacaagttagaactttcaccgtcttatcctgaattacttgagcagctcaatgagaaatctttcgaacttgaggtgaaggctgcagataatagagtaatacaagatcagctaaatgagaagataaatgaatgcatgggattacaagctgaagttactcatctcaaagaacagctgtcccaagctcttgaagctaaggatttgctgtcaaatagcatggtacagaataatagagtagttaaccatgaagttgaacgccatgctgatcaagacagtgctgttccaagagaggtttcttccgaactgctacaaaaacagcagcagtcaattgagattgatgaactgaagcaaaaggtgtctgaactcattgaaatcaaagctcaacttgaggatcgcaatcaaaagctactggaggaaagtacttatgcaaaaggcttggcttcagctgcaggcgtcgaattgaaagcattgtcagaagaagtgaccaagctgatgaaccaaaatgagaagcttgcgactgagttggcatcactgagaagtccaactccacgcagagttaccaatggaccaagaggtggtaggagggaaagcatgagcagacgacacgagccagctagcagaagagacaccaatgcaagccatgaaagagaaaaagctctagagaatatgcttatggagaaggaacaaaaagaagcagagctccaaaggaaagttgaggagtcaaagcagaaggaagccttcctggaaagtgagctcgccaacatgtgggttctagtagcgaaactgaagaagtctcagggttatgaacacgaggattcggaagccaaacatgatgtctcgtgaccttgtaagttaatcatgaaaagtctgcctggcttgggtgtgggttttctgtatgtatgtaagttgctagtatcggtttttctgtttgttagtgtgaattagcctctcattctgtatattctccgcgtgatcaaatatgccagtagtgccttgcctgactcgtgtgcctagagatttctattgatgctacagcggcattttgggttcttcaggcacataacccggcattgcaggaacattgaacagatgtctggaaatctgacgagtttctgatgcccattcaaaatatctaacctgtattagttctactcatcctgctcttaatattgaaaggatatcaaatgtgaatatatccttaaagagtgaattccattgtattaccacacttgttctgacaacatcttcaataatatacattgcatggttgcctgcccttagttttgacaaa

SEQ ID NO: 10183 - DNA, 3572 bp, Sorghum bicolor
tcgcttccgacggaagcaaaaaaggggaagcgacagccaccccacgagcgtgtgacccaaccggaaagggggagaaaagccctaggagaaacccgcgtaaagcgaccggatccaatggcgggtgcctcgtgctgctagatctcgcgccgtgcgggcaatggcgacgcgcccggcgtcgcggcagcggaaggcggggcacgcatcggcggtggcggcggggccgaagggtctgcatcagcagcagcccccgcagtcgggctcgccgacgtcgactaccaccaccaccacgtcctcgtcgcggctcacgccggagctctcgctcgacgggcccgtgtcgccgctgttcgccgggttggacgaggacccggcgcccaaggagaatgtcaccgtcactgtccgcttccgcccgctcagcccgcgggagattcggcagggggaggaggtcgcctggtatgcggatggtgacacggtcgtacggagcgagcagaaccccagcgtcgcctatgcttacgatcgggtttttgcaccaactactacgacccgtcatgtttatgatgttgcagctcaacatgttgttagcggtgccatggagggagtaaatggtacaatatttgcatatggtgttacaagcagtgggaagacacacacaatgcatggagaccaaagatccccagggattatacctttggctgtcaaagatgcatttagcattatacaagagacaccaaatcgcgagtttctccttcgtgtgtcatacttggaaatttataatgaggttgtcaatgatctactaaatcctgctggtcagaatttgcgaattagagaggatcctcagggaacatttgttgaaggtatcaaggaggaagtagtattatctcctgcacatgccctgtcccttattgcagctggagaagagcataggcatgttggatccaccaacttcaatctactgagtagcagaagtcatactattttcacattgactatagagagcagcccttgtggtgaggctaatgaaggggaagctgtcactttctcacagctgaacctcatcgatctggcaggttcagagagctcaagggcggaaacaactggagtacggcggaaagaaggatcttatatcaacaaaagcttgctaactcttggaacggtgatatcaaaactgactgatggaaaggctacacatattccatttcgagattcaaaattaacacgactacttcagtcatccctcagtggtcaaggacgtgtttcactgatttgcacagtgacaccagcatcaagtaattctgaagaaacccataatacactaaaatttgcccaccgtgcaaagcgcattgagatccaagcatctcaaaacaaaattatagatgagaaatctttaataaagaagtaccaaactgagattcggagattgaaggaagagctagagcagctgaaaatgggtattattaccggcacaccgtcgaaagatactgaggaagataatatcatcctttggaagcaaaagctagaagatggtaacgtcaagctgcagtctcgactggaacaagaggaggaagctaaagctgctttgcttgcaaggatccagcgtttaacaaaactaatactggtttctactaaggcgactccgacttccagattttctccacatcctggaccaagacgaagacattcttttggggaagaggagctggcataccttccgtacagaagacgagatataatgatggacaatgaaagcaatgaattacttcttcctgtcgaagggtttggtgtatcacttgaagattcttcgaaggaagaaaaaaagaataggaaaggacttcttaactggttcaaactccggaaacgtgatggagcttctattctgacaagttcagaaggtgataagtccagtttgactaaatcaacagctccttcaacacctattggggaaagcatcaattttcctgctgaaccaagaatatcaaattcattagctggtgagaatgtatcagctgatctgtttagcattggtcatggagaatttccttctggcagcattcatggcgaagaaactcctttggccagtggaaaaacgatggaccatgttgatttgttgagagagcagttgaaaattttgtcaggggaggttgcatttaatacaagtgctcttaagcgcctcacagaggaagctggaagaagcccaaagaatgagaagattcagatggaaatgaagaagaagaccgatgaaattaaggggaagcagcagcagatagcatctttggagagagagatagctcatgcaacattaggaactcaaggaaaggttgacaagctagagctttcaccgtcttatcatgaactacttgaacagctcaatgagaaatctttcgaactcgaggtgaaggctgcagataatagagtgatacaagatcagctgaatgagaagataagtgaatgcatggaattgcaagctgaagttactcatctcaaagaacagctgtcccaagctcttgaagctaaggatttgctgtcgaatagcatgatacagaataatagagttaaccaggaagttgaacaccatgctggtcaaaatgtgccaagagagatctcttctgaaccacagcaaaaacagcagcagtcagttgaaatcaatgagctgaagcaaaaggtgtctgaactcattgaaatcaaagctcaacttgaggatcgcaatcaaaagctactggaggaaagtacatatgcaaaaggcttggcttcagctgctggtgttgaattgaaagcgttgtcagaagaagtgaccaaactgatgaaccaaaatgagaagcttgcgaccgacttgtcatcactgagaagtccaactccagctccacgcagagttagcaatggaccaagaggtactaggagggaaagcatgagcaggcgacacgagccagctagcagaagggacacgaatgcaaaccatgaaagggaaaaagctctagagaccatgcttatggagaaggagcaaaaagaagcagagctccaaaggaaagtggaggagtcaaagcagaaggaagccttcctggaaagtgagcttgccaacatgtgggttctagtagcaaaactgaagaagtcccagggttatgaccatgaggatccggaggccaaaaatgatggctcgtgacctcatcagttaagataaatctgcttggtttgggtgtggccgtgtgggttttctgtatgtaagttcttcgtattgggttttcggtttcttagcatgaattagtgtctcattctgtatattctccgcgtgatcaatatgccagtagtgccttgcctaactgtgcctagagctttctattgatgctagagcggcattttgggttcttcaggcacataatctgggtttgaagaaacaatggacaagtgtttggaaatctgacgggtttctgatgctctcactcaactatctaacatgtattagtctgctcatcctggtcttggatattgaaaggataacaaatgtgaatatgccctgaagtgtgagttctattgtatcagaacactatcgtttcaacatcatcaatagtatatgcttgtttttg

SEQ ID NO: 10184 - DNA, 3620 bp, Brachypodium distachyon
caaaaaggggccgagaggactgcgaaagccatccgaaagcacaccccacgagtgacccgaacggaaaggggggaaaaaccctagaaaaaacccgcataaagcgagggaggcgggagctagcctggcctggtggatccgatggcgggtgccacgtgctgctagatctcgcgcttgtggcggcaatggcgacgcggccggcttcgcggcaacggaaggcgtccccggcggcggcggcggcgaagagttcgcagcagcagcagcagcagccgcagtcgggctcgccgacgtcgtccgcgaccacctcgtcgtcgcggctcacgccggagatgtcggttgacgggcccgcgtccccgctgttcgctgggctggacgaggacccggggacgaaggagaatgtcaccgtcaccgtccgcttccggccgctcagcccgcgggagattcggcagggcgaggaggtcgcgtggtatgccgacggcgacacggtcgtgcggagcgagcagaaccccaacgtcggatatgcttacgatcgtgtttttgcaccgactactacaacccggcaagtatatgatgttgcagctcagcatgttgtcagtggtgccatggagggaatatatggaacaatatttgcatatggtgttacaagcagtggaaagacacatacgatgcatggagatcaaaggtccccaggaataatacctttggctgtcaaagatgcatttagcattatacaagagacgccaaatcgcgagtttcttcttcgtgtgtcatacttggaaatttataacgaggttgtcaatgatctactcaatcctgcagggcagagcttacgaattagagaggatccccagggaacgtttgttgagggtatcaaagaagaagtagtattgtctcctgctcatgctctgtcccttattgcagctggagaagagcatagacatgttgggtccactaacttcaatctactaagtagcagaagtcatacaatttttacactgacaatagagagcagctcttatggcgagtctaatgaaggggaagcagtcaccttctcacagctgaacctcatcgacctggcaggttcagagagctcaagggctgaaacaactggagtacgccgaaaggaaggatcttatatcaataaaagcttgctaactcttggaacggtgatatcaaaactgactgatggaaaagctacacatattccatttcgagattcgaaactaacacgtctgcttcagtcatccttgagtggacaagggcgtgtttcactaatttgcacagtgaccccagcatcgagtaactcggaagagacccacaatactctaaaatttgcccaccgcgcaaagcgcattgaggtccaagcatcacaaaacaaaattattgatgaaaagtctttaataaagaaataccagaacgagattcgcagattaaaggaggagctagaacagctcaaaatgggtattattactggaactccgttaaaagatgctgaagaagataatatcatcctttggaaacaaaagctagaagatggtaacgtcaagctgcaatcaagactggaacaagaggaggaagctaaatctgctttgcttgcaaggatacagcgtctcacaaaacttatcctggtctccactaaggcaacccagacttctagattctctccacatcctggaccaagaagaagacactcttttggagaagaggagctggcttacctcccgtacagaaggcgagatatcattttggataacgaaagtactgaattactcacttctggtgaaggatttggtgtgacacttgaagactcctcgaaggaggaaaaaaagaatcgaaaaggacttcttaactggttcaaacttcggaaacgtgatgctggtggagcttctactctgacaagttcagaatgtgacaagtccagtttgactaaatcaaccgctccttcaacacctattggggagagtctgaattttcatgcagaaccaagaatatctaattccttcgttgctgatagtgtatcggctgatatgttgagcattggcaatggggaatttccttctgacggtcttcatggagaagaaacccctctggtcagcacaagaacaatagaccacgttgacttactaagggagcaattgaagatattgtcaggggaggtggcgtttcatacaagtgttctaaagcgccttacggacgaagctggaaaaaacccaaatagcgagaaaattcagatgaaaatgaagaagaccagtgacgaaattaagggaaagcagcatcagatagcatcattagaaaaacagatacctcattccatgtcaaatagtcaagtgaaggatgaaaaatcagaactttcaccgtcttatgctgaactacttgagcaactcaatgagaaatcctttgaacttgaggtgaaggtagcagataacagagtaatacaagaccagctgcaggaaaagacaagtgaatgcttagaattacaagatgccgtttctcgcctgaaagaacatctttctcaagctcttcaggctaatgattcactgtcaaatagcattatgacacagcagagtgcaggagtaaaccatgaagatcaacatcatgttgaccaaggaaaatctgttcccaaagagatctctgctgaaccactgcaaaaagagcagcagtcagttgagattggtgagctaaagcaaaggttgtgtgaactcaccgaagtcaaagctcaacttgaggttcgtaatcagaagctactagaggaaagtacatacgcgaaaggcttggcttcagctgcaggagtggaattgaaagcgctgtcagaagaagtcaccaaacttatgaatcaaaacgagaagcttgcttctgagttggcatcgctgagaagcccaacccctcgcagggtaagcaacggacccagaggtactactaggagggatagcatgagtagacgacatgaaccagctagcagaagagatggcaatgcaagccacgagagggagagagttttagaaactatccttgcggagaaggagcaaaaggaagcagaacttcaacgaaaggttgaggaatcaaagcaaaaagaagccttcctggaaagtgagcttgcgaacatgtgggttctagtggcaaaattgaagaagtctcatggggatgaccaagaagatttggaggccaaatataatggctcctaagtaccttaacaaaggttaatcaatcatcaaaggtctgtttttgcttgggtacgggttttctgtatgtatgtgagtgatttatgttggttttctttttctcattgtggattagtatgtcctgtatattcttggctgaccaaagttgtgggtagtgcctagtatagagtggtgtgctaacaactgctgagagctgcctatcattgctgtattgagattttggatcccccttccacgtggtggctgcaaccaagaagttttcaggtggctgtaccagatatctaacatagtgtgacctgtattacgtatgctaatcctgcagtttgaagaacatcgaactggaatgtgtatattatgggtgaattcccttcgtgttatgataagatcacaactcttggttttgtaaaatgccacgttgatttttattgtacgtcaattctggag

SEQ ID NO: 10185 - DNA, 3860 bp, Zea mays
acggcgctacccagttggcaaacggaaagcaggcgagttggtttcagctttccttttcttccacaacatcttgcagcggcggcaacccccgcgcagcgcatcgcttccgacggaagcaaaaaaggggaagcgacagcccccctcccccgagcgtgtgacccaaccgaaaggggggagaaaagccctaggacaaacccgcgtaaagcggccggatccaatggcgggtgcctcgtgctgctagatctcgctccgtacgggcaatggcgtcgcggccaacgtcgcggcagcggaaggcgggacacgcatcggcggcggcggggccgaagggtctgcaccaccaccagcagctgccgccgcagtcgggctcgccgacgtcgaccgcgaccacgtcctcgtcgcgtctcacgccggagctctcgctcgacgggcccgcgtccccgctgttcgccgggttggacgaggacccggcgcccaaggagaatgtaaccgtcactgtccgcttccgcccgctcagcccgcgggagattcggcagggggaggaggtcgcgtggtatgcggatggtgacacggtcgttcggagtgagcagaaccccagcgtcgcctatgcttacgatcgagtttttgcaccaactactacgacccgacatgtatatgatgttgcagctcaacatgttgttagtggtgccatggagggagtaaatggtacaatatttgcatatggtgttacaagcagtgggaagacacacacgatgcatggagaccaaagatccccagggattatacctttgtctgtcaaagatgcatttagcattatacaagagacaccaaatcgcgagtttctccttcgcgtatcatacttggaaatttataatgaggttgtcaatgatctactaaatcctgctggtcagaatttgcgaattagagaggatcctcagggaacatttgttgaaggtatcaaggaggaagtagtattatctcctgcacatgccctgtctctcattgcagctggcgaagagcataggcatgttgggtctaccaacttcaatctattgagtagcagaagtcataccattttcacattgactatagagagcagcccttgtggtgagtctaatgaaggggaagctgtcactttctcacagctgaacctcatcgatctggcaggttcagagagctcaagggcggaaacaactggagtacggcggaaagaaggatcttatatcaacaaaagcttgcttactcttggaacggtgatatcaaagctgactgatggaaaggctacacatattccatatcgagattcaaaattaacacgactacttcagtcatccctcagtggtcaaggacgtgtttcactgatttgcacattgacaccagcgtcaagtaattctgaagagacccataatacactaaaatttgcccaccgtgcgaagtgcattgagatccaagcatctcaaaacaaaattatagatgagaaatctctaataaagaagtatcaaactgagattcggagattaaaggaagagctagaacagctgaaaatgggtattattactggcacacccttgaaagataccgaggaagataatattatcctttggaagcaaaagctagaggatggtaacgtcaagctgcagtctcggctggaacaagaggaggaagctaaagctgctttgcttgcaaggatccagcgtttaacaaaacttatactggtttctactaaggcgaccccggcttctagattttctccacatcctggaccaagacgaagacattcttttggggaagaggagctggcataccttccgtatagaagacgagatataatgatagacaatgaaagcaatgaattacttcttcctgtcgaagggtttggtgtatcacttgaagattcttcaaaggaagaaaaaaagaataggaagggacttcttaactggttcaaacttcggaaacgtgatggagcttctattctgacaagttcagaaggtgataagtccagtttgactaaatcaaccgctccttcaacacctattggggaaagcgtcaactttcctgctgaaccaagaatatcaaattcattagctggtgagaatgtatcatctgatctgtttagcattggtcatggggaatttccttctggcagcattcacggcgaagaaactctttcggccagtggaaaaacgatggaccatgttgatttgttgagagaacagttgaaaattttgtcaggggaggttgcgtttaatacaagtgctcttaagcgcctcacagaggaagctggaagaagcccaaagaacgagaagattcagatggaaatgaagaagaagaccgatgaaattaaggggaagcagcaacagatagcatctttggagagagagatagctcatgcaacattaggaactcaaggaaaggtcgatacgttagagcattcaccgtcttatcatgaactacttgagcagctcaatgagaaatctttagaacttgaggtgaaggctgcagataatagagtgatacaagatcagctgaatgagaagataactgaatgcatggaattgcatgctgaagttactcatctcaaagaacagctgtcccaagctcttgaagctaaggatttggtgtcaaatagcatgatacataataatagagttaaccatgaagttgaacaccttgttgatcaagatgttccaagagagatctcttctgaaccacagcaaaaacagcagtccgttgaaatcaatgagctgaagcaaaaggtgtctgaactcatggaaatcaaagctcaacttgaggatcgcaatcaaaagctactggaggaaagtacatatgcaaaaggattggcttcagctgctggtgtcgaattgaaggcattgtcagaagaagtgaccaaactgatgaaccaaaatgagaagcttgcgaccgagttgtcatcgctgagaagtccaactccagctccacgcagattcaacaatggaccaagaggtactaggagggaaagcatgagtaggcgagaaccagctagcagacgagacacgaatgcaagccatgaaagggaaaaggctctagaggcattgcttatggagaaggagcaaaaggaagcagagctccaaaggaaagtcgaggagtcaaagcagaaggaagccttcctggaaagtgagcttgccaacatgtgggttctagtagcaaaactgaagaagtcccagggttatgaccatgaggatctggaggccaaacatgatggctcgtgacctcttcagtttagatatctatcggcttggcttgcgtgtgggttttctgtatgtaaggttttggtattcgttttttctcttagcatgaattagtgtctcattctgtatattctccgcgtgttaaatatgccagtagtgccttgcctgactgtgcctagagctttcgatggatgctagagcggcattttgggttcttcaggcacataatctggatttgaagaaacagtgagcaagtgtttggaaatctgacgggtttctgatgcccactcaaatatctaacatgtattagcctgcccatcctgctcaggataacaaatgtgaatatgccctgaagtgtgagctacattgtattagaacactttcgttttcaacatcttcaatactgcttattgtatgcctccctgcctgcccgccgttacttttatgcatcttcttatgtgaccatgcaatgccattgataacaaaagcgaatgaagtacccccgtttgtttcggttttttgcagcttctggcaccaaaagctgccacggactctcaaatgctcaatttttaaccagcttttataaaatttgtttgggtaaaaatcattcaaaatcaacataaacacataataggt

SEQ ID NO: 10186 - DNA, 3248 bp, Triticum aestivum
cggggctggacgccgccgacgccgacgacgaccaggccgccaccaaggagaacgtcaccgtcaccgtccgcttccgcccgctcagcccgcgggagattcggcagggggaggaggtcgcgtggtacgccgacggcgacacggtcgtgcggagcgagcagaaccccaacgtcggctacgcttacgatcgggtttttgcaccgactactacaacccgccaagtatatgatgttgcagctcaacatgttgtcagtggtgccatggagggcatatatggaacaatatttgcgtatggcgttacaagcagtggaaagacacatacaatgcatggagatcaaagatccccaggaataatacctttggctgtcaaagatgcatttagcattatacaggagaccccaaatcgcgagtttctcctgcgtgtgtcatacttggaaatttataacgaggttgtcaatgatctactcaatcctgcaggacagagcttacgaattagagaggatcctcagggaacgtttgtcgagggtatgaaagaagaagtggtattatctcctgcacatgctctgtccctaattgcagctggagaagagcatagacatgttggatccactaacttcaatctactaagtagtagaagtcatacaatttttacactgacaatagagagcagctcttacggtgactctaatgaaggggaagcagtcaccttctcacagctgaacctcattgatctggcaggttcagagagctcaagggcagaaacaactggagtacgccggaaggaaggatcttacatcaataaaagcttgctaactcttggaacggtgatatcaaaactgactgatggaaaagctacacatattccatttcgtgattcaaaactaacacggctacttcagtcatccttgagtggacaagggcgcgtttcgctaatttgcacagtgaccccggcatcaagcaactccgaagagacccacaacacactaaaatttgcccaccgtgcaaagcgcattgaggtccaagcatcacaaaacaagataattgatgaaaaatctttgataaagaaataccagaatgagattcgcagattaaaggaagagctagaacagctgaaaatgggtattattactggaactccgttaaaagatgccgaagacgataatatgatcctttggaagcagaagctagaagatggtaacgtcaagttgcaatcaagacttgaacaagaagaggaagctaaatcagctttgcttgcaaggatacagcggctcacaaaacttatccttgtttccacaaaggcaactccgacttctagattttctccacatcctgggccaagaaggagacactcttttggggaagaggagctggcttacctcccgtacagaaggcgagatatcatgttggataatgaaagcaatgaattactcactcctggcgaaggatttggtgtgacacctgaagactcttcgaaggaggagaaaaagaacaggaaaggacttcttaactggttcaaaattcggaaacgcgacggtggagcttctactctaacaagttcagaatgcgataagtccagtttgactaaatcaactgctccttcaacacctattggggagagtctgaattttcctgcagaaccaagaatatcaacttcgttggttaatgagagtgaatcagctgatatgctgagcattggccatggggattttccttctgatggtcttactggagaagaagcatctctggcgagcacaaaaacaatcgaccatgttgacttactaagagagcaattaaagattttatcaggggaggttgcacttcatacaagtgttctaaagcgcctcaccgaggaagctggaagaaacccgaatagtgagaaaattcagatgaaaatgaagaagatcagtgacgaaattaaggcaaagcagcagcagatatcatctttagaaaaacagatgcctcattccttgtcaaatagtcaagtgaaggttgacaagttagatctttcaccgtcttacggggaactacttgagcaacttaatgagaaatctttcgaacttgaggtgaaggtagcagataacagagtaatacaagagcagctacaggaaaagacaactgagtgcatggaattacaagaggcagttgcttgccttaaagaacatctttcccaagctcttcaagctaaggattcactgtcaaatagcattatgatgcagaatagttcaggagtaaaccatgaagaacaacacagtgatcaagaaaaaccagtttccagggatatctctgctgaacaactgcaaaaggaacagcagtcacttgagcttggtgagctaaagcagagggtacatgaactcaccgaagtcaaagctcaactcgaggctcgcaatcagaagctattagaggaaagtacatatgcaaaaggcttggcttcggctgcaggagtggaattgaaagcgttgtcagaagaagtgaccaaactcatgaaccaaaatgagaagcttgcttccgagttagcatcgcagagaagtccaacccctcgcagagtaagcaatggaccaagaggtactgctaggcgagagagcatgagtagacgaaatgaaccagctagcagaagagatggcaatgcaagagaagagagggagagagcgttagaaaccatccttgcagagaaggaacaaaaagaagcagaactccaaaggaaagtcgaggaatcaaagcaaaaggaggccttcttggagagtgagctggcaaacatgtgggttctagtggcaaaattgaagaagtctcgtggggatgatgaccatgaggatttggaggccaaatataatggctcctgagtcctaatcaaacgcttgttttggcttgggtatgggcttttctgtatgtatgcaagattggtggtttgggtcggttttctttgtgaattagtgtcgtcccctgtatattcttgggctaatcaaagttgtgagtagtagtggagagtggtgtgctaacaactgctgagagcttcctaccattgctgtaatgagattttggaattcctagaacatggtcgtgataatgaagagaaacgtctctggtgcctgtaccagatgtgagatgtctaacgtagtaacttgtttttcatctgttcgtcctgcaattggattggaagaatatcaaactggaatgtgtatattataggagaatgccatgttggttttgttgaaggatagttgtatgatcaaagcataacctcctgttttcggaaa

SEQ ID NO: 10187 - DNA, 3438 bp, Zea mays
tagtagaggagactagaaactccattaggcctagcccagagtcagctagggatgccgcccgatccactacgtactgaaagcgatcccggcccatgaacgctagtgggttgtaattcggcttacccaagtacccagccgttcctccacacctctgcactacccgaaacccacgcccaacggccgtttcccgcaccccctatccgggaaggaagaaagccagaactcacccctgcttcgtctggcggcgccgtttcccgcacgcgatgccgtcgacggcggaggatttcccggcgataaggaagctggggaagctcttccggcttaccgaagtgtacctctgggacgattcgtatggcgctggacctcacgatggacagaagaacgggcgctcggcggaggctgctctcgtggactctcatacagataaaacatgcaatgaagcatccaatagcactgacaaaggccatttctttgttgaagatttggaattggtcaatctcatgggttctttggggcttcctgtttcattcagcacaagtaaagtgaacaagaacacatgcaacaagggaaagaaaaaaggaagacaagcaccgctcaaagcagcaaacactcaaatcaatgatgctgtgaggatatgtatcaatactgaagatagagaaaattctgttgaatcattggatgctatggagcaaacgcactcatgcaatttatttgtgacaccactgggtcaaaatgaaccctcccgtgatgacactgacaagaggcttagggaagacagctcttgtgttgaagaacaagaagagtctggctgtagcaccatctactctgctggcaaagcccctggctgtgatgctaaaaatcatctcactgaacttggggcttttgagctttctgataacttggccaactcagcaaaagaagaatactcaattcaagaaaatcaagcttatgaaagtgtgttgctagattctgaagagatgtcaaggaatgactgtgttgatgatgaatctacacattcctgtgttggcatttatcaggatgaaagagtgtccacaaggggagatcaaacatctgaagaaactctatcagtaccccatgattacaatgatgttggcagagaagctagtctaagtttggcagagccatcatctattgatgagcatgcacaaagctctgccaacaacttttactatgactatggtgaatggagggttatctgggatccattctataatcggtattatttttacaacatccagacacaagagtccacatggtgtcctcctgaaggactggaggattttgcatcatattgtagcccagataccactaaagagctagctgaactgggatctcagtgttcaagcatggcaccacaagagaacaatctggctactcatgtcaatcatttagaagcacaggagcaagatcactgcattcatgatttatctgacattcctgttgaaaagccaatatatcaaagtatgataactacctctgacaaagcacagcacactgaaaataagtacagcgattcaacaactactgtgttagagatgaaccaggaagttgctagcaccaaaacgaaaaagagaatcattcatgccaagacatggcagggaacgtctctaatgacatcatcaagtactgggctcagcggtattcacttttctcactttttgatagtggtataaagatggatgaagtagggtggttttcagttacgccagagccaattgcaaagcatcatgcatctcgtgtgggtgcgggagtaatgattgattgtttcacaggagttggtggaaatgccatccaatttgccaaaaagtgcaagcatgtaattgcagttgatattgatccacaaaagattgattgcgcgcatcataatgcatccatttatggagtaaatgatcacatagatttcattgtaggtgattttatacatatagctcctcatctgaagggagaaactgctttcatgtcgcctccttggggtggccctgactatgccaaagttgatgtttatgatatgaaaagcatgcttattccttgtgatgggtactctctttttaaactcggaaccatgatagcttcaagagtagtgatgtttcttcctcgcaacattgacctaaaccaattggcggacatgtccttgtctgtggatcccccgtgggcagttgaggtcgagaagaacttcctcaacggaaagctgaaagccataacagcttactttgaagaacaggatcgttgaaccaagcatcggcgctggtgatacaaatcatcttgttagctatgactcacgacaaatttttgtggtgaccctaaacagaacctttgtgttcggagacagaaagaagcggtttatcatcttcaccgagcatagataatttatttgcagagatgagtcattggtatcatacaaaagcagctcagcttatctcaattcacagcaagtgaaactgtcgaaggaaaactacaaggctgacagtcgaacgcgtgggagttagcttaattttgccttatgataagcaagcatgcttcctggtttatttcatacagctactagtagtttcagctgcaacagttgtgcgttggtgtgcgtgtgattctcacatatctggtcctgcggatgtgagtgatgcaaatgtatgtgtcatcatcccatgtaagggtttgtttgtttgctctcaatctatgtagattgagtgggattaagtgagtttaaatctcagacaagtcaaaaaaaaatgttttcaatctcatccaatccacatatgatagtaatacccgagtaaggcttagatgtaatagttggaataagaaaaacaagtcagccattttgaagttttgtccttggagttctattaaaaggcattactgataaatctccaacagatttgcagttgaagcaacatgtgaaacatatttatcatgttaaaacaatttgccttagtattcgattatgccatgaaatctgacatttccttacacatcccagtttatcattgtcaactgtctttaggaatgtattgtatctgctgtttttacttgtatatgtatgttattttttgtcgttgtatgtatatgttttattataaacatggccactaaggttgttctattcgttaaaataacacagatctataaacgactaaacaagcttcttgggataaagaatcatatggaggctggattttcgaggagtctggtgcactgttttgctaatgatcagccccccccccccccccctctaaaaataaagaaaatactggatttcctgttcatttattacattcatatgtaaatgcttctgtccttttctatatctgggctggactttttgtgtgctcgtcactcaagttggttagtgtggttaattttattatgctccgtgctctttcctaccgaacttggtctttgttagtatcattatcagtc

SEQ ID NO: 10188 - DNA, 2801 bp, Echinacea purpurea
atttcaactccactgtctcccaaaacttgatcgtcttcaatcaccatggatcccttcggcggcgcatacttcaccgacgagaaagcagccagagttgagaacatcttcctggagttcctcaagagctatccgaatgcaagagcaccgttctacgaatcggaaattgaagcaatgaaaccgaacgagtcgaacacgatgttcatcgatttccgtcatgttatggagtttaatgatgtcctgcagaaagcggttgctgatgagtatttgaggtttgagccgtatctgaagaacgcgtgtaagcgatttgtgatgggacagaaacctacattcatcactgatgacaaccctaataaggatataaatatagctttttacaacctgcctatcataaaaagattgagagaattgggcacatctgaaataggtaggttagtatcggtaacaggagtggttactcgaacaagcgaggttaggcctgaacttattcaggggactttcaagtgcctggagtgtggaaccattgtaaaaaatgttgagcaacagtataaatataccgagcccatgatatgcatgaatgctacatgttcaaagaaagggagatggacacttcttagacaagagagcaaatttgcagattggcagagggttaggatgcaggaaacatcaaaagaaatacctgcaggatccttgccgagatcattagacgtcattcttcgccatgacattgttgagcaggctagggctggtgacacggtaatctttacgggcactgtggttgtgatacctgatcttttggcattagcagctccaggagaaagagccgaagttcgtagagaaggtggtcaaggtcaacgttctggcaatggcactgttcaagaaggtgttaaaggtcttcgtgcattgggagttagagatctttcttataagcttgcatttattgccaactcagtgcagatttgtgatggtagaagggatactgacatacgcaataggaaaagagatgctgaggatgatgacatgcaacagttcacgccagaggagttggatgaggttagacaaatgaaaaatacccctgactttttcaacaagcttgttgcaagcatggcccctactgtttatggtcatcatgatatcaagcgagctatcctgcttatgcttttgggcggtgtccacaaatttactcatgaaggaatcaatcttcgtggagacatcaatgtttgtattgttggggatcctagttgtgccaagtctcagtttctcaagtacacaacaactttagttccaagatctgtttacacgtctggaaaatcttcatcagctgctggattgacagctactgttgcaaaagagccagaaactggagagttttgtatagaggctggtgcactaatgcttgctgacaatggtgtttgttgcattgatgagtttgacaagatggatgtaagagatcaggttgccatacatgaagctatggaacaacaaacaattagtattacaaaagcaggaatacaagcaacattgaatgcaaggacgtcaattttagctgctgccaatcccactggaggccgctatgataagactaaaccgttgaagtacaatgttgctcttcctccagccatcctttcaaggtttgacctggtatatgtcatgattgatgaccctgatgatacaacagattatcatattgcatctcacatagtgaaggtgcatcaaaagcgtaatgaagctgtttctccagatttcaccactgcacaattgaagcgttttattgcagtcgctaagtctaaaaagccaaagctaaatgcagaagccagaaaacttttggtggattcttacgttgatctccgtaggggtgatacagctccaggaagtaaagttgcatatcgcatgacagtcagacagttggaggcactaatcagactgtcagaggcaattgccagatgtcacctggatgatgaggttcttccacgccatgttactttagcaactaaactcttaaaaacttcagtaatcagtgtggagtcgagtgaaattgatttgactgagtttcaagaagagaatagagaagatggtgatattggagaagatggtgatattggagaaaatggtgacgcaggagaaaatggtgaagctcagccaggtggtgcagatgctgacgcaaacaataatcatccagaaaatgcaaaagactctggagcaaagaagcttgttataacagatgaatactttcagagggtgactcaagctcttgtgatgcgtcttagacagcatgaggaaacagttacgcgagaagggagtgggttagctggaatgaggcaaagggatttgatacagtggtatgtgaaacagcaaaatgaaaatgaggcctacgagaatgaggaagaggcaaaggctgagatcaccaagattaaagctataatagagagtttggtaagaagggaagggcatttaattgtagtgaacgaaggggatgatgacggaaatgccagaccgccttccaggaacgacaggattcttgcggtggcacctaactatgttattgattaagctgatgaattttaaggatttgtgatactaattgtttggcagtttcagtaactagacatccattttcattgtaaagcctgtgatgctgcgacaactatatttatgagtctaggtatgtgctgtatgcatttctgtttcatccctttttccgacaaaaagttttctacttattattttagtattaaaactagatcatggtgttttagtctgtatttttacatcattttcagtagaaaagattttatttcataacg

SEQ ID NO: 10189 - DNA, 2679 bp, Chrysanthemum coronarium
caaacaagaaacaatcagcaagaatggattcattcggcggcgcctatttcaccgacgaaaaagccgcaaaagtcgaaaacatcttcttagacttcctcaaaacctttagattagatcccaattcacgcgaaccctactacgaatccgaaatcgaagcaatgagacctaacgaatccaacactatgtttatcgatttcgcacatgttatgcgcttcaacgatgtccttcagaaagctatctctgatgaatacctaaggttcgagtcgtatttgaagaacgcgtgtaagcgatttgtgatgggccagaaacctacttttattactgatgataatcctaataaggatatcaatattgctttttttaatctccctattatcaaaagattgagggaactgagtacttctgagataggtagactagtatcggtaacgggtgtggtgactcgtacaagtgaggttaggccggagttacttcagggtacttttaagtgcttggactgctcggcgattgttaaaaatgttgagcaacagtataagtacactgagcctatgatatgtatgaatcctatgtgtgcgaagaaagggtggtggacacttcttcgacaagagagtaagtttgctgattggcagagggttaggatgcaggagacgtcaaaggaaatacctgcgggatcgattccgaggtcgttagatgtcattcttagacatgatattgttgaacaggctagggctggtgacacggtggtttttaccggcactgtggttgtgatacccgacattttggcattggcagctcctggagagagagccgagtgccgtagagaaggtggtcagcgcagtaacagtggcagtgtccaagaaggtgtaaaaggtcttagggcgttgggagttagagacctttcttataagcttgcctttatcgccaattcagtgcagatatgtgatggcagaagagatgcagatatacgaaataggaagagagatgctgaagatggcgacactccagagttcacgtccgaggagttagctgaggttagacaaatgagaaatactcccgacttcttcaacaagcttgttgacagtgttgctcctactgtgtttggtcatcaagacattaagcgagcaatcctgcttatgcttttgggtggggtccacaagtttactcatgaaggaattaaccttcggggagacatcaatgtttgtatcgttggggatcccagttgtgctaagtctcagtttctcaagtacacaactactttggtttcaagatctgtgtacacatctgggaagtcttcatctgccgctggattgactgcgactgttgcaaaagaaccagaaactggagagttctgtatcgaggctggtgcacttatgcttgctgacaatggtgtttgttgtattgacgaatttgacaaaatggatgtcagagatcaggtcgcaatacatgaggctatggaacaacaaacaatcagtattacaaaagcaggaatacaagcaacattaaatgctagaacatcaattttggctgctgcaaatcccacaggaggccgttacgacaagtctaaaccattgaagtacaacgttgctcttcctcctgccatcctttcaaggtttgacctggtatatgtcatgattgatgaccctgatgatacgacagatttccatattgcctctcacatcgtgagggtgcatcaaaagcgtgaagaagcagtttctcctacatttacgactgcccaattgaaacgttacatagcagttgccaagtctaagaagccaaagctaaatgcagatgctagacaaattttggtggattcttatgttgctttacgtaaaggtgatacagctccaggaagtagagttgcataccgcatgacggtcaggcaattggaggctcttatcagactctcagaggcgattgccagatgtcacctggatgatgaggtccacccaaggcatgttcgtctagcaacaagactcctaaaaacatcagtaatcagtgtggaatcaactgagattgatttgaccgagttccaagatgatattcaagaagagaatcaaggagatggtgatattggtggcaatggtgaagctcaaccaagtggtgcagacgctgatatgaccaatgagcacccagaaaacgcagaggtgcctggagctaagaagcttgttataacagatgagtactttcagcgggtgactcaagctcttgtgatgcatcttagacagcatgaggaaactgtggcacgagagggtactggactagccggaatgagacaaagggatctgatacagtggtatgtgggtcagcagaatgaaaagaacaactacaactccatggaggaggcaaaggctgaagtcaccaagatcaaagctatcatagagagtttggtgaggagggaggggcatttaatcgtggtagacgaagaggaggccacagcacaaggggatgatgatggaaatggcaggcggacttctcgaaacaacaggattcttgctgtggcacctaactatgttattgattaaaatggtaatttgttcaatttcaaggatttgtaatactagttgctatttagtttcagacacaagtcatccattttatttattgtaaagtcaagagtgctgctacagctctatggataatttaacttgtgtgcaatatgcaattttcctatttcttgcc

SEQ ID NO: 10190 - DNA, 2744 bp, Chrysanthemum coronarium
ttggctgtatccccattcattctccctccacacacacactaaaaacacaaagaaattaattgagtggaagcaatggattcattcggcggagcctatttcaccgacgaaaaagcagcaaaagtcgaaaacatcttcttagacttcctcaaaacgttcaaactagatcccaactcacgcgaaccctactacgaatccgaaatcgaagccatgagacctaacgaatccaacactatgttcatcgatttcgcacacgttatgcgcttcaacgatgtccttcagaaagccatctctgatgagtacctcaggtttgagtcgtatttgaagaacgcgtgcaagcgatttgtgatggggcagaagcctacttttattactgatgataatcctaataaggatatcaatattgctttttttaatctccctgttatcaaaagattgagggaattgagtacttctgagataggtagattagtctcggtgaccggagtggtgactcgtaccagtgaggttaggcccgagttacttcagggcacttttaagtgtttggactgctcaaccattgttaaaaatgttgagcaacaatataagtacaccgagcctatgatatgtatgaatcctatgtgtgccaagaaaggatggtggacacttcttcgtcaagagagtaagtttgccgattggcagagggttaggatgcaggagacttctaaggaaatacccgcaggatccattccgaggtcgttggatgtcattctaagacatgatattgttgaacaggctagggctggtgacacagtggtttttaccggtactgtggttgtgatacccgacattttggcgttggcagctcctggagagagagctgagtgccgtagagaaggtggccagcgcaataacagtggcggtgtgcaagaaggtgttaaaggtcttcgggcgttgggagttagagacctttcttataagcttgcctttatcgccaattcagtgcagatatgtgatggcagaagagatgcagatatacgaaataggaagagagatgctgaagatggcgacactccagagttcacgtccgaggagttagctgaggttagacaaatgagaaatactcccgactttttcaacaagctcgtagacagtgttgctcctactgtgtttggtcatcaagatattaagcgagcaatcctgcttatgcttttgggtggggtccacaagtttactcatgaaggaatcaaccttcgaggagatatcaatgtttgtattgttggggatcccagttgtgccaagtctcagtttctcaagtacactactaccttggtttcaaggtcggtttacacttctgggaaatcttcatctgctgctggattgactgcgactgttgccaaagaaccagaaactggagagttctgtattgaggctggtgcacttatgcttgctgacaatggtgtttgttgtattgatgaatttgacaaaatggatgtcagagatcaggtcgcaattcatgaggctatggaacaacaaacaatcagtatcacaaaagcaggaatacaagcaacattaaatgctagaacatcaattttggctgctgcaaatcccacaggaggccgctatgacaagtctaaaccattgaagtacaacgttgctctcccccctgccatcctttcaaggtttgacctggtatatgttatgattgatgaccctgatgatacaacagatttccatattgcatctcacatcgtgagggtgcatcaaaagcgtgaagaagcagttgctcctacattcacgactgcacaattgaaacgttacattgcagttgccaagtctaagaagccaaagctaaatgcggaggctagacaaattttggtggattcttatgttactttacgtaaaggtgatacagctccaggaagtagagttgcatatcgtatgacagtcaggcaattggaggcactgataagactctcagaggcgattgccagatgccacctggatgacgaggttcacccaaggcatgttcgtcttgcaacaagactcctcaaaacatcagtaatcagtgtggaatcaaccgagattgatttgaccgagttccaagatgatattcaagaagagaatcaagaagatggtgatattggtggcaatggtgcagctcagccaagtgatgcagacgctgatatgaccaatgaaaatccagaaaatgcagaggcgcctggagctaagaaacttgttataacagatgagtactttcagcgggtgactcaagctcttgtgatgcgtcttagacagcatgaggaaactgttgcacgagaagggacaggactagccggaatgaggcaaagggatctgatacagtggtatgtggggcagcagaacgaaaagaacaactacaactccatggaagaggcaaaggctgaagtcaccaagctcaaagctatcatagagagtttggtaagaagggaggggcatctaatcgtggtagacgaagaagaggccccagcacaaggggatgatgatggaattggcaagcggacttctcgaaacaacaggattcttgctgtggcgcctaactatgttattgattaggaggtgatttgtttaatttcttatggatttgtttaattttcaaggatttgtaatactagttggttagtttcagtcatccaacattttatttattgtaaagtttatgagtgctgctacagctctattctatggttggagtttaaacttatgcaatttttcctatttgatgctgc

SEQ ID NO: 10191 - DNA, 2790 bp, Lactuca sativa
atcgggtcaaggcggcccatcccgcgagatgtggcgggaaccctaacacgctctgcttattttcccgccaaaaagtgcatacacagtttcattcatctacttccgttcccaatcaacgaattcactcacagttgagcaaaaaaagaaaaaaaaacttagaggaaggcagccaacaatatggattctttcggcggcgcatatttcaccgacgagaaagcagcgaaggtcgagaatatcttcttggagtttcttaagagttttaggttagatgcgaattcgagggaacctttctatgaatcggaaatcgaagcaatgagaccaaacgagtccaacacaatgttcatcgatttctctcatgttatgcggttcaacgatgttctgcagaaagcaatttctgatgaatatttgaggtttgagtcgtacctgaagaacgcatgtaagaggttcgtaatgggtcagaaacccaccttcataaccgacgacaacccaaataaggatatcaatattgcattttataatttacctgtcataaaaagattgagggaactgagcacatctgagataggcagactagtatcagttacaggagtggtgactcgtactagcgaggttagaccagaactcctccagggaactttcaaatgcttggattgtggaaccatcatcaaaaacgttgagcaacagtataaatacactgagcccatgatatgcattaatgctatgtgctcaaagaaaggaaaatgggcacttcttcgacaagaaagtaaatttgcagattggcagagggtcaggatgcaggaaacatcaaaagaaatacccgcaggatcccttccgagatcattagatgtcattcttcgccatgacattgttgaacaagctagggctggtgacacggtgatctttactggcactgtggttgtgatacctgacattttcgcattagcagctcctggagaaagagccgaagttcgtagagatggtggtagtaaacgcgacaccactggcactgttcaagaaggtgttaaaggcctccgggctttgggagttagagatctttcttatcgccttgcctttattgccaattcagtgcagatttgtgatgggagaagagatgctgatatacgaaataggaagagggatgctgaggatgaagacaatctacaattcacgccggaggaggtggctgaggttaaacaaatgagaaatacgcctgattttttcaacaaacttgttgatagtatggcacctactgtttttggacatcaagatatcaagcgagcaattctgcttatgcttttgggtggagttcataagttcacccatgaagggatcaatctcaggggggatatcaatgtttgtattgttggagatcctagttgtgctaaatctcagtttctcaaatacacaacaaccttagtttcaagatctgtgtacacatccgggaaatcttcatctgctgctggattgacagccactgttgcaaaagaaccagaaaccggagagttttgtattgaggctggtgcactgatgcttgctgacaatggtgtctgttgcattgacgaatttgacaaaatggatataagagatcaggttgcgatacatgaagctatggaacaacaaacaattagtatcacaaaagcaggaatacaagcaacattgaacgcaagaacatcaattttggctgctgcgaatcccacaggaggccgctatgataaatctaaacccttgaagtataatgttgcgcttcctccagccattctttcaaggtttgacctggtgtatgtcatgatcgatgatcctgatgacacaacagatttccatatcgcctctcacattgttagggttcatcaaaagcgtgaaaatgctgttgctcctgccttcaccactgcacaactcaagcgttacattcaagttgccaagtctaaaaagccaaagctaagtgtagaagcaagaaaaattttggttgattcttatgttgctcttcggagaggtgatacagctccaggaagtagagttgcatatcgaatgacagttagacagttggaggctctaatcagactttcagaggcaattgccaggtgtcacctcgatgatgaggttcatcctcgccatgttaaattagcaacaaggcttctaaaaacttcagtaatcagtgtggagtcaactgagattgatttgaccgagttccaagaagatggtgatgtcgatggcgatgttgatggaaatggtgaacctgagacagcagatgcagcagccaataacgagcaaccagaaaatggagaagggcagggagggaagaaacttgtgataacagatgaatactttcagagggtgactcaagcccttgtcatgcgtcttagacaacatgaggaaactgttatgcaagatgggagtgggctagctggaatgaggcaaagggatctgatacagtggtatgtgggtcaacagaatgagaagaacaactacagctcaatggaagaggcaaaggctgaagtcaccaagattaaagctatcatagagagtttggtgagaagggaggggcatctgatagtggtagatgaggaggcacaaggggatgatggagtacgttcttctcgaaacaacaggattcttgcagtcgcacctaactatgttattgattaaaatgcatttaatatgctttgctttcaaatgttgttgattgattgattaaaagtcttgatttctatggttcaatgagatattaggttgtatttctatcctcaaaatggttgttttagtagaaatgaaactttttaactctttaattta

SEQ ID NO: 10192 - DNA, 2733 bp, Cichorium intybus
atacacacattactacactgcacaatcccccatttcacctccagatttctgcaaaaaactagaggaagacatacgatagccaacgatatggattcattcggcggcgcatacttcaccgatgagaaagcagcgaaggtcgagaatatcttcttggagttccttaagagttttaaattagatgcgaattcaagagaaccgttctacgaatcggaaatcgaagcaatgagaccaaacgagtcaaacaccatgtttatcgatttctctcatgttatgcggttcaacgatgttctacagaaagccatatctgatgaatatttgaggtttgagtcgtacctgaagaacgcatgtaagcggtttgtaatgggacagaaaccaaccttcattaccgacgataaccctaataaggacatcaacatcgcattttacaggggttgagggaactgagcacatccgagataggcagactagtatcagtaactggagtggtgactcgtacaagcgaggttagaccagaacttcttcagggcactttcaagtgcttggagtgtggaaccatcgtcaaaaatgtcgagcaacagtataaatacaccgagcccatgatatgcatcaatgcaatgtgtgcaaagaaaggaagatggacacttcttcgtcaagaaagtaaatttgcagattggcagagagttagaatgcaagaaacatcaaaggaaattcccgcaggatcccttcctagatcattagatgtcattcttcgccatgacattgttgaacaagctagagctggtgacacggtgatctttacaggcactgtggttgttatacccgacatttttgcattagctgcacctggtgaaagagctgaagttcgtagagaaggtggcagtaaacgtgatacagctggcactgttcaagaaggtgtcaaaggccttcgtgcattaggtgttagagacctttcttatcgacttgcctttattgccaattcagtacagatttgtgatggaagaagagatgctgatataagaaatagaaagagggatgctgaagatgatgacaatctacagttcacggctgaagagttagacgaagttaaacaaatgagaaacacacccgactttttcaacaagcttgttgacagtattgcccctactgttttcggtcaccaagacatcaaaagagcaattctactcatgcttttaggcggtgttcacaaattcacacatgaaggaatcaatcttcgtggggacattaacgtctgtattgttggggatcctagttgtgcaaaatcccaatttctcaagtacacaacaactttagtttcaagatccgtttacacatctggaaaatcatcatctgctgctggtttaactgccactgttgcaaaagaacccgaaactggagagttttgtattgaggctggtgcactaatgcttgctgacaacggtgtttgttgcattgatgaatttgacaaaatggatataagagatcaggttgcaatacacgaagcaatggaacaacaaacaatcagtatcacaaaagcaggaatacaagcaacattaaacgcaagaacatcaatcttggctgcagcaaatcccacaggaggccgttacgacaagtcaaaacctttgaagtacaacgtcgcccttcctccagccattctttcaagatttgaccttgtgtatgtcatgattgatgaccctgatgacacaacagattaccatattgcctctcacattgtaagagtccatcaaaaacgtgaaaacgccgtttctcccgctttcacaaccgctcaattgaagcggtacattcaagtcgccaagtctaaaaagccaaagctaaatgtagaggctagaaagattttagtggattcttatgttgctcttcgaagaggcgatacagctccaggaagtagagttgcataccgcatgactgtcagacagttagaggcgcttattagactctcggaggccattgccaggtgtcacctggacgatgaagttcacccgcgacatgttcgtttagcaacaagacttttaaaaacttcagtaatcagcgtggagtcaaccgagattgatttgaccgagtttcaagaagaaaatcaagaagaagtcgatgttggtgtggataatggagatgctgagacaactaataatgagcatccagaaaatggagaagggcaggaagggaagaaacttgtgataacagatgaatactttcaacgggtgactcaagcgcttgtgatgcgtcttagacaacacgaggagactgttatgcgagaagggactggattagcgggaatgaggcaaagggatttgattcagtggtatgtgggccagcagaatgagaagaacaactacagctcaatggaagaagcaaaggctgaagtgaccaagattaaagctatcatagagagtttggtgagaagggaggggtatttgatagtagtggatgaagaggcacaaggagatgatggaaccgcggtacggtcttcacgaaacaaccggattcttgcggtggcgcctaattatgttattgattaaattggtaatttggaatgttgagtgaaatattgatttgtatacggttaaatgagagtagggtgttcttctgttgtgtatcctacaattggttgttttggtaggaatgagactttggaattattttctaatttagtgtttttgactacaagattatcaacacaacatgtcctttacagcaatgtagttacaacacttttct

SEQ ID NO: 10193 - DNA, 2756 bp, Cichorium intybus
atacacacattactacactgcacaatcccccattttacctccagatttctgcaaaaaactagaggaagacatacgatagccaacgatatggattctttcggcggcgcatacttcaccgatgagaaagcagcgaaggtcgagaatatcttcttggagtttcttaagagttttaaattagatgcgaattcaagagaacctttctacgaatcggaaatcgaagcaatgagaccaaatgagtccaacaccatgtttatcgatttctctcatgttatgcggttcaacgatgttctacagaaagccatatctgatgaatatttgaggtttgagtcgtacctgaagaacgcatgtaagcggtttgtaatgggacagaaaccaaccttcattaccgacgataaccctaataaggacatcaacatcggggggggttgagggaactgagcacatccgagataggcagactagtatcagtaactggagtggtgactcgtacaagcgaggttagaccagaacttcttcagggcactttcaagtgcttggagtgtggaaccatcgtcaaaaatgtcgagcaacagtataaatacaccgagcccatgatttgcatcaatgctatgtgtgcaaagaaaggaagatggacacttcttcgacaagaaagtaaatttgcagattggcagagagttagaatgcaagaaacatcaaaggaaattcccgcaggatcccttcctagatcattagatgtcattcttcgccatgacattgttgaacaagctagagctggtgacacggtgatctttacaggcactgtggttgttatacccgacatttttgcattagctgcacctggtgaaagagctgaagttcgtagagaaggtggcagtaaacgtgatacagctggcactgttcaagaaggtgtcaaaggccttcgtgcattaggtgttagagacctttcttatcgacttgcctttattgccaattcagtacagatttgtgatggaagaagagatgctgatataaggaatagaaagagggatgctgaagatgatgacaatttacagttcacggctgaagagttagacgaagttaaacaaatgagaaacacacccgactttttcaacaagcttgttgacagtattgcccctactgttttcggtcaccaagacatcaaaagagcaattctactcatgcttttaggcggtgttcacaaattcacacatgaaggaatcaatcttcgtggggacattaacgtctgtattgttggggatcctagttgtgcaaaatcccaatttctcaagtacacaacaactttagtttcaagatccgtttacacatctggaaaatcatcatctgctgctggtttaactgccactgttgcaaaagaacccgaaactggagagttttgtattgaggctggtgcactaatgcttgctgacaacggtgtttgttgcattgatgaatttgacaaaatggatataagagatcaggttgcaatacacgaagcaatggaacaacaaacaatcagtatcacaaaagcaggaatacaagcaacattaaacgcaagaacatcaatcttggctgcagcaaatcccacaggaggccgttacgacaagtcaaaacctttgaagtacaacgtcgcccttcctccagccattctttcaagatttgaccttgtgtatgtcatgattgatgaccctgatgacacaacagattaccatattgcctctcacattgtaagagtccatcaaaaacgtgaaaacgccgtttctcccgctttcacaaccgctcaattgaagcggtacattcaagtcgccaagtctaaaaagccaaagctaaatgtagaggctagaaagattttagtggattcttatgttgctcttcgaagaggcgatacagctccaggaagtagagttgcataccgcatgactgtcagacagttagaggcgcttattagactctcggaggccattgccaggtgtcacctggacgatgaagttcacccgcgacatgttcgtttagcaacaagacttttaaaaacttcagtaatcagcgtggagtcaaccgagattgatttgaccgagtttcaagaagaaaatcaagaagaagtcgatgttggtgtggataatggagatgctgagacaactaataatgagcatccagaaaatggagaagggcaggaagggaagaaacttgtgataacagatgaatactttcaacgggtgactcaagcgcttgtgatgcgtcttagacaacacgaggagactgttatgcgagaagggactggattagcgggaatgaggcaaagggatttgattcagtggtatgtgggccagcagaatgagaagaacaactacagctcaatggaagaagcaaaggctgaagtgaccaagattaaagctatcatagagagtttggtgagaagggaggggtatttgatagtagtggatgaagaggcacaaggagatgaggtacggtcttcacgaaacaaccggattcttgcggttgcacctaactatgttattgattaaattggtaatttggtgaatttggaatgttgagtgaaatgttaatttgtatacggttaaatgagagtagggtgttcttctgttgtgtattctacaattggttgttttggtaggaatgagactttggaattattttcttaatttagtgtttttggctacaaaagattatcaacacaacatatcatttacagcaatgtagtaacaacactttttcaaaagtggtcgtacatcaataacaac

SEQ ID NO: 10194 - DNA, 2477 bp, Artemisia annua
acgagtgcgtccatgttatgcgcttcaacgatgtccttcagaaagctatctctgatgaatacctcaggttcgagtcgtatttgaagaacgcgtgtaagcgatttgtgatgggacagaaacctacttttattactgatgataatcctaataaggatatcaatattgctttttttaatctccccattatcaaaagattgagggaactgagtacttctgagataggtagactagtttcggttacgggtgtggtgactcgtacaagtgaggttaggccggagttacttcagggtacttttaagtgtttggactgctcggcgattgtcaaaaatgttgagcaacagtataagtacactgagcctatgatatgtatgaatcccatgtgtgcgaagaaagggtggtggacacttcttcgacaagagagtaagtttgctgattggcagagggttaggatgcaggagacgtcaaaggaaatacctgcaggatccattccgaggtcgttagatgtcattcttagacatgatattgttgaacaggctagagctggtgacacggtgatttttaccggcactgtggttgtgatacccgacattttggcattggcagctcctggagagagagccgagtgccgtagagaaggtggtcagcgcagcaacagtggcagtgtccaagaaggtgttaaaggtcttagggcgttgggagttagagatctttcttataagcttgcctttatcgctaattcagtgcagatatgtgatggcagaagagatgcagatatacgaaataggaagagagatgctgaagatggcgacactccagagttcacgtcagaggagttagctgaggttagacaaatgagaaatactccggacttcttcaacaagcttgttgacagtgttgctcctactgtgtttggtcatcaagacattaagcgagcaatcctgcttatgcttttgggtggggtccacaagtttactcatgaaggaattaaccttcgcggagacatcaatgtttgtattgttggggatcccagttgtgctaagtctcagtttctcaagtacacaactactttggtttcaagatctgtatacacatctgggaaatcttcatctgccgctggattgactgctactgttgcaaaagaaccagaaactggagagttctgtatcgaggctggtgcacttatgcttgctgacaacggtgtttgttgtattgatgaatttgacaaaatggatgttagagatcaggtcgcaatacatgaggctatggaacaacaaacaatcagtattacaaaagcaggaatacaagcaacattaaatgctagaacatcaattttggctgctgcaaatcccacaggaggccgttacgacaagtctaaaccattgaagtacaacgttgctcttcctcctgccatcctttcaaggtttgacctggtatatgtcatgattgatgaccctgatgatacgacagatttccatattgcctctcacatcgtgagggtgcatcaaaagcgtgaagaagcagtttctcctacatttacaactgcccaattgaaacgttacattgcagttgccaagtctaagaagccaaagctaaatgcagaggctagacaaattttggtggattcttatgttgctttacgtaaaggtgatacagctccaggaagtagagttgcataccgcatgacagtcaggcaattggaggctcttatcagactctcagaggcgattgccagatgtcacctggatgatgaggtccacccaaggcatgttcgtctagcaacaagactcctaaaaacatcagtaatcagtgtggaatcaactgagattgatttgaccgagttccaagatgatattcaagaagagaatcaagaagatggtgatattggtggcaatggtgcagctcaaccaagtggtgcagatgctgatatgaccaatgagcacccagaaaacgcagaggtgcctggagctaagaagcttgttataacagatgagtactttcagcgggtgactcaagctcttgtgatgcgtcttagacagcatgaggaaactgtggcacgagagggtactggactagccggaatgaggcaaagggatctgatacagtggtatgtgggtcagcagaacgaaaagaacaactacaactccatggaggaggcaaaggctgaagtcaccaagatcaaagctatcatagagagtttggtgaggagggagggccatttaatcgtggtagacgaagaggaggccgcagcacaaggggatgatgatggaaatggcaggcggacttctcgtaacaacaggattcttgctgtggcacctaactatgttatcgattaaaatggtaatttgttcaatttcaaggatttgtaatactagttggtatttagtttcagacacaagtctaccattttatttattgtaaagttatgagtgctgctacagctctatggataatttaacttgtgtgcaatatgcaatttt

SEQ ID NO: 10195 - DNA, 2870 bp, Panax ginseng
ctctctcctcccattagaagaaacagaggaagaagaagagagcgtaaaaatggattcatttggaggcggatactatgtggatgagaaagctgttagagtggagaacatctttctcgagtttctgaagagctttcgattgaatccgaattctcgagagccgtattacgaatcagagatagaggcgatgaagccaaacgaatcaaacaccatgttcattgatttctctcacgttatgcgtttcaatgatgtcctccaaaaagccatttcagatgaatttttgagatttgagtcttatttgaagaacgcgtgcaagcgattcgtgatggaacagaaacctacatttataactgatgacaaccctaacaaggatatcaatgttgctttttttaatcttccattgttaaagagattgagggaattgagtacagctgaaatcgggaaactagtatcagtgactggggtggtgacccggaccagtgaggtcaggccagagcttctacaaggcaccttcaattgcttggaatgtggaaccattgtcaagaatgttgagcagcaatacaagtacactgagcctgtcatatgcatgaatccaacgtgctcaaagaccaagagctgggcgttgcttcgacaagatagtaaatttgcagattggcaaagggttagaatgcaggaaacctctaaagaaataccagctggctcccttcccagatcattagatgtcattctgcgccatgatattgttgaacaggccagggctggtgatacggtcatatttactggcactgtggttgtgataccggacataatggcattggcctctcctggggaaagagctgagactaggcgagaggcttcccagcataagaaccccaccgggcaaggtgtcaagggccttcgtgccttgggtgtcagagacctctcttaccgccttgcttttattgccaattcagtacagatttgtgatggcagaagggattctgacgtcagaaataggaggagggatgctgaagatgatgacaatcaggagttcacggcggaagagctagatgaagtccaacaaatgagaaacacccccgacttcttcaataagcttgttgatagcattgccccaactatttttggtcatcaagatattaagagagcaattctgcttatgcttttgggtggtgtccacaagtttactcatgaaggcattaacttgaggggagatattaatgtttgcattgttggggatccgagctgcgcaaagtctcagttcctcaagtatactgcaggtctagttccaagatctgtgtatacatctggaaaatcctcgtctgctgctggcttgactgcaacagttgctaaagaacctgaaactggggagttttgcatcgaggctggagcactaatgcttgctgacaatggggtctgttgcattgatgaatttgataaaatggaagtcagggatcaggttgcaattcatgaagcaatggaacagcagacgataagcataacaaaagcaggaatacaagcaacattaaatgcacgaacatccattttggctgcagccaatccagctggaggtcgctatgataagtctaaaccattaaagtacaatgtggctcttcctcctgctatcctttctaggtttgatttggtgtatgtcatgattgatgacccagatgatcaaacggattaccacattgcacaccacattgttagggttcatcaaaagcatgaagatgctatttctcctgcattctctactgcacaactgaaacgttacatttcttatgcaaagactctgaaaccaaagcttagtgcagaagcaagacaattgttggtggaatcctatgttactttacgcagaggtgatactgctcctggaagtagagttgcatatcgcatgacagtcagacagctggaggcattgattaggctttcggaggctatagctcgaagtcatttggaagttcaagtggctacacgccatgtacgtcttgcagtgagactactgaaaacatcaattatcagtgtggagtcaagtgagattgatctatctgaatttcaagacgagaatcgtgataacgttgatcatggagatggtggtcccggagaaggcgaacctcaaccaagtggtgctgaacctgaatcaacttctaggaatgcagaaaatggagatgaagctacaacccagaaaggaaagaaacttgtgataactgatgaatattttcagcgggttacccatgcccttgtcatgcgtcttagacagcatgaggaaactgtaatgcatgaagggactggacttgctggaatgaggcagagggatctgatacagtggtacgtgggtcagcagaatgagaaaaacaactacagttccatggaggaggcagcagctgaagtttctaaaatcaaagccattattgagagtttggtacgaagggaaggccatttgatagttgtggacgatggtaggcaagcagcggaagagggtgaaaatgctaggcagtcttcatctagaaacgacagaattttagcggtggctcctaattatgtcatagattgatctgataatgcatttaatatggaagattacaagactaggcttcatcttgagctttacatcacgaggctaagagctctactacaactgaactgaggaggggagtttgaagagaaatgtatcatcattatctaactataaatttgttttaacttttcatgccgactaaatacaatatctgattggtggcttaaacaaggcatggttgtattactctaccttgccatttcaaattccaaagaatagataatttgtttttgctggtttcattgtttacaagcacttgcttttctggtttaaagcctgcagtgttgttacattgtca

SEQ ID NO: 10196 - DNA, 2802 bp, Capsicum annuum
accattcaatttgtttgttgatccttctccctcctctttgagctatcaaaaaaaagtaaaatggacagctatggcggcggtggatactacgtcgatgagaaagccgttcgtgtcgaaaacatcttcttggaattcctcaaaagttttcgagtggatgcgaactcgcgtgagccgttttacgagacggagatcgaagcaatgagacctaatgagtccaacactatgtttattgatttctcccacgttatgcgcttcaatgatgttcttcagaaagccatctccgatgagtttctcaggtttgaatcctatttgaaaaatgcttgcaagagattcgtgatggagctgaagccgactttcataactgatgataaccccaacaaggacatcaacgtcgccttttacaatcttcccctgattaagagattgagagaattgactaccgcagagatagggaaattggtgtcagtaactggagtggtaactcgtaccagtgaggtccgaccagagcttctgcagggaacctttaaatgcttggactgtggaactgtgatcaagaatattgaacagcaattcaaatataccgagcctataatttgcatgaatgcaacatgtcaaaacaaagcaaggtgggcattacttagacaggagagcaaatttgcagactggcaaagggttcgaatgcaggagacatccaaggagataccagcagggtcccttccaagatcacttgatgtcattctacgccatgacattgtggaacaagccagggcaggtgacatggtcatatttactggtagcgttgtggtgatacctgacatactttcacttgcctcacctggagagagagctgaatgtcgccgagatgcatctcagcgaaagaatgcctctggcggtcaagaaggtgtgaagggtcttcgggcattgggtgtcagggacctctcatatcggttagcctttattgccaactcagttcagatatgtgatggccgaagggacaatgacatcagaaataggaggagagatgttgaagaagatgagaatccccagttcacggccgaagagctagaagatatccaacgaatgaggaaaattccggattttttcaataagcttgttgagagtattgctccaaccgtttttggtcactcagatatcaagagggcaatactgctcatgcttttgggtggtgttcacaagtttactcatgaaggcattaatttaagaggggacatcaatgtttgcattgttggggatcctagctgtgcaaagtctcagttcctcaaatacacagcaggtctggttcctcgatctgtctatacgtcagggaaatcctcgtctgctgctggattgactgcaacagtggccaaagaacctgaaactggagaattctgtattgaggctggagcactgatgcttgcagacaatggtatctgttgtattgatgaatttgacaagatggatgttagagatcaggttgccattcatgaagcaatggaacagcagacaataagcataactaaagctggtatacaagcaacattgaatgcccggacttcaattttagctgcagccaaccccactggtgggcgatatgataagaccaaacctcttaagtataatgtagcactgcctcctgccatcctttcaaggtttgatctggtatatgttatgattgatgatcctgatgatcaaacagactataatattgctcatcacatagtgagggttcaccaaaagagggaaaatccagttgaccctccttttagcactgcgcaagtgaagcgatacataatgtatgcgaaaacactgaaacctaagctatctacagaagctagagagttgttggttgattcatatgttgctttacgtcgagatgacactgctccggggagtagagttgcctatcgcatgactgtaagacagctggaagcgttgatcagactttcggaggctattgctcgaagtcatttagatattcaggtgcaaccacgtcatgtacaaattgcaaggagattgttgaagacgtcgataattagtgtggagtcaagtgaaattgatctatctgagttccaagatgggaatcgtgaagacgatgttggtgatactgaaaatggtactggtcaaggggaaaatcaaccaactgaagctccggctgagtcggtatctgggaatgcagaaaatgccactggaaccacaagcaagcaaggaaagaagctagtcatcactgatgaatatttccagagagttacccgtgctctcattctgcgactgagacagcatgaagagactgtaacgcaagacgggactgggttagctggaatgaggcagaaagatcttatacaatggtacattagtcagcagaatgataagaatagctacagctccatggaagaggcagcagctgaagttgcgaaagtgaaagctattatagagagcttgatacgaagagaaggccatttgatagtcgtggatgacggtagacaagcaggcgaggatggtggaaggcaaccatccagaaatgataggattttggcagtggctcccaattatgttgtagattgatttggaattcttgtgaaaaagagggaaaattggaccgtctgagctcaattacgcgggccttaaaagtcactcaagtcacttgatgtactactataggaggctaactggtttatgttaaattaatcgttgtacttgagtttgagaatgtgaagttatcaagcctatctgtactagtattattatttgtgtttgtctatgcttctttactaagtatcaattgaggaagtattcagtattcat

SEQ ID NO: 10197 - DNA, 2936 bp, Solanum lycopersicum
atctttttcccgccaaacccctaatcgtctccaaatctattttgtctttctcagaaactcacttgttttttgatccctctttgagaaatttgaagatcaagaaatggacagctatggcggtggcgggtacttcgtcgacgagaaagccgttagggtcgaaaacatcttcttggagttcctcaagagttttcgagtggatgcgaactcacgtgagccattttacgagtcggagatcgaagccatgagacctaatgagtccaacacaatgttcattgatttctctcacgttatgcgcttcaacgatattcttcagaaggccatttccgatgagtttctcaggtttgaatcctatctgaaaaatgcttgcaagagatttgtgatggaattgaagccaactttcatcactgatgataatcctaacaaggacatcaacgtcgcattttacaatcttccgctgattaatagattgagagagttgactacctcagagatagggaaattggtgtcggtgactggagtggtaactcgtaccagtgaggtccgaccagagcttctacagggaaccttcaaatgcttggactgtggaactgtgatcaagaatgttgaacagcaattcaaatacaccgagcctataatttgtatgaatgcgacatgccaaaacaaagcaagatgggcattactcaggcaagagagcaaatttgcagactggcagagggtccgaatgcaggagacctccaaggagataccagcagggtcccttccaagatcacttgatgtcattctacgccatgacattgtggaacaagccagagcaggtgacacggtcatatttactggtaccgttgtggtgatacctgacatacttgcacttgcctctcctggggagagagctgaatgtcgccgtgatgcatctcagcggaagaatggtactggtgcgcaagaaggtgtgaagggtcttcgagccttgggcgttagggatctctcgtatcgattagcatttatagctaactcggttcagatatgtgatggtcgaagggacaatgacatcagaaatagaaggagagatgttgatgaagaagagagtccccagttcatgactgaagagctagaagacatccaacgaatgaggaaagttccggattttttcaataagcttgttgagagtgttgctccaacagtttttggtcactcagatatcaagagggcaatactgctcatgcttttgggtggtgttcacaagtttactcatgaaggcattaatttaagaggggacatcaatgtttgcattgttggagatcctagctgtgcaaaatctcagttcctcaaatacacagcaggtctggttcctcgatctgtctatacatcagggaaatcctcgtctgctgctgggttgacagcaactgtggccaaagaaccagaaactggagaattctgtattgaggctggtgcactgatgcttgcagacaatggtatctgttgtattgatgaatttgacaaaatggatgttagagatcaggttgccattcatgaagcaatggaacagcagacaataagcataactaaagccggtatacaagcaacactgaatgcccggacttcaattttagctgcagccaaccccacgggtgggcgatatgataagaccaaacctctgaagtataatgttgcactacctcctgccattctttcaaggtttgatctggtatatgttatgattgatgaccctgatgatcaaacagactataatattgctcatcacatagtgagagttcaccaaaggcggcagaatccagttgaccctccttttagcactgcacaagtgaagcgatacataatgtatgctaaaacactgaaacctaagctatctgcagaagctagagagttgttggttgattcatatgttgctttacgtcaagatgacactgctccagggagtagagttgcctaccgcatgactgttagacagctggaggcgttgatcagactttcggaggctattgctcgatgtcacttggatattcaggtgcaaccacgtcatgtacaaattgcaaagaaattgttgaagacatcgataatcagtgtggagtccagtgaaattgatctatctgagttccaaaatgagaatcccgaggatggtgttggtgatactcaaaatggtactggtcaaggggaaactgaaccaactgaagctccggctgagtcagtatctgggaatgcagaaaatggtgctggaactacaaacaagcaaggaaagaaactagtcattactgatgaatatttccagagagtcacccgtgctcttattctgcgattgaggcagcatgaagagactgtaatgcaagacgggactggattagctggaatgaggcagaaagatcttatacagtggtacgtgagtcagcagaatgataagaatagctacagctccatggaagaggcagcagccgaagtcacgaaagtgaaagctattatagagagcttgattcgaagagaaggccatttgatagttgtagatgatggtacgcaagcaggcgaggaaagtggaaggcaatcagcatccagaaacgaccggattttagcagtggctcccaattatgttgtagattgatttggaattcttgtgaacaggacagaaaatctggggctgtttgagcgcaatggcagcgcggcctaaagttgtaggactggggaactgtgtttttctactgtcatagctgagaaatcttacaccctttgtgggaatgttctactatacgagactaacttgttttaagttaaactaattgttgtacttgagtttgagaatgtgaagttatcaagcctacctgtactagtattagttttgagtttgcttatgttcaatgtagtatcaactggtattagtcttctggattcattaatggtacatttttaattagagatgtttcataatctaa

SEQ ID NO: 10198 - DNA, 2453 bp, Solanum phureja
tccaaacttggtagttgaaacattaattagattcgttactcctctcatgcaaggtctattttgtgccatttcttcagtgaaagtggatacactataaaccctgtttggaccatctaagctgctgtttgttataaagtttgagttgagtttttatttttggattgtgtaagagaagtattggagaaaatgagcaagtttggtttgaaggttgaggaaggaaaagaagggaaaaatggagagccatctattggtcctgtttatagaaatccaatagctaaaaatggttttccatcagctgatcctgatttgtctacagcttggcaactcttcagatcagctgttgaaaaatatccaggaaacagaatgctgggatggcgtgattttaaggatggaaagtggggttcttataattggaaaacctacaaagaagcttatgaagagactttgcagacaggttctgcattacgggctcacggaattgaacctggtgctcgaattggaatttatggagccaattgtcctcagtggatagtagcaatggaggcttgcagtgcccacagcttgatatgtgttcctctctatgataccctcggatccggcgctgtagattttattattgaacatgctgagatcgatatcgtttttgttcaagataagaaagtgaaagaacttctaaatgaagagtgcacacacgctaaacgcctgaaattgatcgtgtgtttcacttcgctacagcaggaagagaaggataaggcagtttctatggatatcaagccatactcttggaatgaatttctcaacatgggtaaagagaatccatcagagccttctccgccgcagccattagacatatgtacaatcatgtatactagtggaactagcggagaacctaaaggtgtaatattgactcatgaaaatatgacagcatctgtaacaggagttgatcattttatggaagaatttgaagacaagatgacagtggatgatgtgtacatatctttcctaccacttgctcatatacttgatcggatgattgaagaattcttctttcataggggtgcttctgttggctacttccatgggaatatcaatgagatacaagaagacatgatggagttgaagccaacctttttggctggagtacctcgagtttatgaaaaagtgcatgaaggtgtactgaaagcacttgaagaactcaatcccttcaggaggcacatgttccatgtgctatataacctcaagcttaaatggatgaatcttgggtacaaacagaagtatgcttcacggctggctgatctactagcttttagaaaggttaagaataggctaggtggcaggattcgcctcatagtctctggtggtgctcctttaagcagtgaggtggaagagttcttacgggttacctcctgtggatttgtcctacaaggttacggtttgacagagacttgtggtttggccaccattgggcatccagatgaaatgtgcatgcttggaactgttggtccaccatttgtcttcacagaagttcgtctcgaggaagttcctgaaatgggatatgatcccctagcagaccctccccggggagagatatgcgtgagagggaggaccacttttgctggatactacaaaaatccagagttgacaaaagaggctatcaaagatggatggtttcatacaggtgacatcggagaaatgatgcctaatggagttgtaaaagtcattgatcgaaagaaaaatgttataaagctatcacaaggagaatatgttgcattggaatatctggaaaaggtttatggtattgcgcccatcgttgaagatatatgggtatatggggacagcttcaagtccatgctggtagcagtcgtggcgccacatgaagggaacacgaaaaaatgggctgataaaaatggacacaagggttcaattactgaactttgttccctccaagacctaaaccaatatgttctccttgagctgaaatctgctgcagaaaggaacaagctaagaggtttcgagaacatcaaaggagtgattctggaacctcaaccttttgagtttgacaaggagttggtaacagcaacaatgaaaaagagaagggagagattgcttaagcgttacaaggtggagattgatgacctttacaaaaggcttaatgcagcagctaaacgctaatacgtttttgaatactgaagcaatgcaactcttgatcaatcaactgagtgatgatcatctatggagctatgtgttataacgtttgaactatacaaatattgttttaatgtctgatatgacagtgatttgtacgaataatcatcagtattgttgtcttacatttctaaattaagcacccttccagagagattagtagtattggttttatgaatgggctaataatttttaagcactaaatattatgtagccttaaacggtataaagattatactattaagtat

SEQ ID NO: 10199 - DNA, 2288 bp, Capsicum annuum
atttcttctggcacttctttgctggaagtaacagtggcaactctatgagtcctgtttggaccacttaggctggtgtttgttatataattgagttgagttttttgggttgtcatcaaagaagaattggaaaaaatgagcatgaccatgtttggtgtgaaagtggaggaaggaaaagaaggcaaaaatgggcaaccatctattggtcctgtttatcgaaatccaatatctaaaaatggttttccttcagctgatcctgatttgtctacagcttggcaactctttagatcagctgttgataaatatccagggaatagaatgctgggatggcgagattttaaggatggaaagtgggggccttataactggaaaacctacaaagaagcttatgaagagattttgcagactggttctgcattacgggctcatggtatcgaacctggtgctcgaattggaatttatggagccaattgtcctcagtggatagtagcaatggaggcttgcagtgcccacaatttgatatgtgtccctctctatgataccttgggacctggagctgtaaattttattattgaacatgctgagattgatatcgttttttatcaagataagaaagtgaaagaacttctaaattcggagtgcacacatgctaaacgcctgaagttgatcgtgtctttcacttcgctacagcaggaggagaaggataaggcagtttctatgaatattaaaccatactcttggaatgaatttctcaacatgggtaaagagaatccatcagagccttcaccgccacagccattagacatatgtacaatcatgtacactagtggaactagcggagaacctaaaggtgtaatattgactcatgaaaatatgacagcatctataactggggttgatcattttatggaagaattcgaagacaagatgacagtggatgatgtgtacatatctttcctaccacttgctcatatacttgatcggatgattgaagaattcttctttcataggggtgcttctgttggctacttccatgggaatatcaatgagatacaagaagacatgatggcattgaagccaacctttttggctggagtacctcgagtttacgaaagggtgcatgaaggtgtactgaaagcacttgacgaactcaatcccttcaggaggcgcatgttccacttgctatataacctcaagcttaaatggatgaatcttgggtacaaacataagtatgcttcgcgactggctgatctactagcttttagaaaggtaaaggctaggctaggcgggcggattcgcctcatagtctctggtggcgctcctttaagcagtgaggtggaagaattcttgcgggttacctcctgtggattcgtcctacaaggctacgggttgacagagacttgcggtttggctaccatcgggcatccagatgaaatgtgcatgcttggaactgttggtccaccatttgtcttcacagaacttcgtctcgaggaagtacctgaaatggggtatgatccactaggagaccctccccggggagagatatgcgtgagagggaggaccacttttgctggatactacaaaaaaccagagttgacaagagaggccatcaaagatggatggtttcatacaggtgacatcggagaaatgatgcctaatggagtagttaaaatcattgatcgaaagaagaatgtcataaagctgtcccaaggagaatatgttgcactggaatatctggagaaggtttatggtattgcacccattgttgaagatatatgggtatatggggacagcttcaagtccatgctggtggcggttgtcgtgccacatgaagggaacataaagaaatgggctgatcaaaatgggcacaagggttcaattcctgaactttgttccctccaagagctaaaccaatatgttctccttgagctgaaatctgctgcagaaaggaacaagctaagaggttttgagaacatcaaaggcgtgattctagaacctcaacccttcgagtttgaccaggacgtggtaacagcaacaatgaaaaagagaagggagagattgcttaagcgttacaaggtggatattgttgacctttaccaaaggctcaatgcagcacctagacgctaatatgttcttgaacactgaggcagtgtaactcttgatctactgagtgatcagtggagctgtgttgtaaacgtttgtactatacaaatattgatttaatatcttgatataatagcaatttgtacgaacaatcatcagtattgttgtcttatatttctgaatttagc

SEQ ID NO: 10200 - DNA, 1313 bp, Vigna unguiculata
ggatgaagagaagaaaaacaagttacgtggtttctctcttcagatctgtctcactctttcactctcattttttcacgcgtttgaaaagtcctacaaactttcgttacttctcaaacattgtcgtgctgaattactgcatcttttcttactttccttctttgcagcttcattttctgcaagatggatccgtcgtcattgctgtttagtcacctcaagggtgcagacccgttcttcctgctagcgggacctaatgtgattgaatcagaggatcacattctgcggatggctaagcacgtcaagagcattgcaactgaggttggaatacctttggttttcaagtcaagctttgacaaagctaaccgaacatcatcaaaatcatttcgtggcccggggatggttgagggattaaagatactcgagaaggttaaaatagcttatgacatccctatagtgacggatgtgcatgagaccatccagtgtgaagcagttggcagagttgcagatatcattcagattcccgcattcctgtgtcgccaaaccgatcttctagttgcagcagccaaaactgggaaaattatcaacattaagaagggccagttctgtgctccttctgtcatggcaaattcagctgaaaaagttcggttagctggaaatcctaatgtgatggtttgtgagagaggaacaatgtttggatacaatgatttgattgttgatccacgtaacttggagtggatgagagaagccaattgtcccattgtagctgatataacacattcgctacaacagcctgctggaaagaagttggatgggggaggtgttgcaagtggaggtcttcgagaactaataccttgcattgcaaggaccgcagttgccgttggagtggatgggatcttcatggaggtgcatgatgatccactgaatgctcctgttgatggaccaacacagtggcctttgcgccatttgaaggagctacttgaggagcttgtagctattgctaaggtaagcaaagggaagaaacagttcaaaattgacctcacgccatttcgtgaataatggtgatggttttcggtcatgctgaatatgattctgagttttgatcttttaagatctctcaaggttgaatacaaggagatctagttgatctcaaaaatattatttgataatctatgcttgttactctgaagtggtaacaccaccaactaatgttgctcaaatatcatgtgtagccttaatcatatcagttgttaaagttgagacaattaattgaacactgtttattaactaagtttattatcaggaaatgaatttatttt

SEQ ID NO: 10201 - DNA, 1312 bp, Cajanus cajan
aacagagaggccggagtgcatttttttccactctggctcgatctgagtaactgaaactggggagttatttagctactgacttgactgtgttttggagagcatttctgattcattgtaccatcatcatcaaggagaagaagcttcattttctgcaaaatggatccgtcgccattgttgtttagccacctcaagggtgcagaaccgttcttcctgctcgcgggtcccaatgtgattgaatcagaggagcacattatgaggatggctaagaacataaagagtattgcatctgaagttggaataccgttggttttcaagtcaagctttgacaaagctaaccgaacatcatcaaaatcatttcgtggcccagggatggccgagggattgaagatactagagaaggttaaaatagcctatgacatccctatagtgacagatgttcatgagaccatccagtgtgaagcagttggcagagttgcagatatcattcagattccagcattcttgtgtcgccaaacagatcttctagttgcagcagccaaaactgggaaaattatcaacattaagaagggccagttctgcgctccttctgtcatgtcgaattcagctgaaaaggttcgattagctggaaatcctaatgtaatggtttgtgagaggggaacaatgtttggatacaatgatttgattgttgatccacgtaacttggagtggatgagagaagccaattgtcccattgtagcggatataacacactcactacaacaacctgctggaaagaagttggatgggggtggtgttgcaagtggaggtcttcgagaactaataccttgcattgcaaggacagcagttgccgttggagtggatggtatcttcatggaggtgcatgatgatccgctgaatgcacctgtggatggtccgacacagtggcctctgcgccacttgaaggagctacttgaagagcttgtagcaattgctagggtaagcaaagggaagcaacggttcaacattgatctcacgccatttcgtgaataaaaagaaatggtgatgattttcagttattctgaatataatgcagtgagcattggtcttttacgattgttcaaggttgaatgctaaactgtctcctctcacaagaaccttataagtagaatttatcattaaatattatttgatgatccttgcttgttactctgaattggtaatttaccaactaatgtttgtcacataacctgtctagccttaatcatgtcagttattaaagttggcaattaattgaatatcaaaatataggtatcactaggtaaattaatttatt

SEQ ID NO: 10202 - DNA, 1132 bp, Glycine max
attctgattctaccgtcatcaactaggagaagaagcttcattttctgcaaaatggatccctctgcggcattgctatttaaccacctcaagggtgcagacccgttcttcctgctagcgggtcctaatgtgattgaatcggaggagcacattctgcggatggctaagaacatcaagagtgttgcatctgaagttggaataccattggttttcaagtcaagctttgacaaagctaaccgaacatcatcaaaatcatttcgtggcccggggatggctgagggattgaagatactcgagaaggtaaaaatagcttatgacattcctatagtgacagatgtgcatgagaccatccagtgtgaagcagttggcagagttgcagatatcattcagattccagcattcttgtgtcgccaaacagatcttctagttgcagcagccaaaactgggaaaattatcaacattaagaagggccagttctgtgctccttctgtgatgacaaattcagctgaaaaggttcggttagctggaaatcctaatgtgatggtttgtgagagaggaacaatgtttggatacaatgatttgattgttgatccacgtaacttggagtggatgagagaagccaattgtcccattgtagctgatataactcactcactacaacagcctgctggaaagatgttggatgggggaggtgttgctagtggaggtcttcgagaactaataccttgcattgcaaggacagcagttgccgttggagtggatgggatcttcatggaggtgcatgatgatccactgaatgcacctgttgatggcccaacacagtggcctttgcgccactttaaggagctacttgaagagcttgtagccattgctagggtaagcaaagggaagcaacggttcaacattgatctcacaccatttcgtgaataaaaaaaatggtgatggttttcagttattctgaatgtaatttctttaccattggtcttttaagattgttcaagggtgaatgcaaaactgtctcctctcacaagttccttataaggagagtttatcttaaaaatattatttgatgatcaatgcatgttactctgaagtggtaacactataccaactcaagtttgtcacatatcctgtg

SEQ ID NO: 10203 - DNA, 1511 bp, Glycine max
ggaatttggagtgcaataattctgattctaccgtcatcaactaggagaagaagcttcattttctgcaaaatggatccctctgcggcattgctatttaaccacctcaagggtgcagacccgttcttcctgctagcgggtcctaatgtgattgaatcggaggagcacattctgcggatggctaagaacatcaagagtgttgcatctgaagttggaataccattggttttcaagtcaagctttgacaaagctaaccgaacatcatcaaaatcatttcgtggcccggggatggctgagggattgaagatactcgagaaggtaaaaatagcttatgacattcctatagtgacagatgtgcatgagaccatccagtgtgaagcagttggcagagttgcagatatcattcagattccagcattcttgtgtcgccaaacagatcttctagttgcagcagccaaaactgggaaaattatcaacattaagaagggccagttctgtgctccttctgtgatgacaaattcagctgaaaaggttcggttagctggaaatcctaatgtgatggtttgtgagagaggaacaatgtttggatacaatgatttgattgttgatccacgtaacttggagtggatgagagaagccaattgtcccattgtagctgatataactcactcactacaacagcctgctggaaagatgttggatgggggaggtgttgctagtggaggtcttcgagaactaataccttgcattgcaaggacagcagttgccgttggagtggatgggatcttcatggaggtgcatgatgatccactgaatgcacctgttgatggcccaacacagtggcctttgcgccactttaaggagctacttgaagagcttgtagccattgctagggtaagcaaagggaagcaacggttcaacattgatctcacaccatttcgtgaataaaaaaaatggtgatggttttcagttattctgaatgtaatttctttaccattggtcttttaagattgttcaagggtgaatgcaaaactgtctcctctcacaagttccttataaggagagtttatcttaaaaatattatttgatgatcaatgcatgttactctgaagtggtaacactataccaactcaagtttgtcacatatcctgtgtagccttaatcatgtcagttactaaagttgaggcaattaattgaatattaagatataggtagattaattattaaatttattattaggtaaattaatttattatttttgtcatttctcccaagtactttctacaaggttttcaagccatttctaaaatatctcaaaattttggctgtggcttagggatattgtttacgatttaggagaaatatcagaaaatgatgtataaggatatatggtttaatgcatgatctacttggtaaattgtattggtgcctcattatttaaaaacactatcagtggttatgcactaattgttggtggttccaatgacgcaatgatatttgaactgataatagat

SEQ ID NO: 10204 - DNA, 1044 bp, Glycine max
taattccttcgttctaccgtcatcaactagaagaagaagcttcaatttctgcaaaatggatccgtctgcggcattgctgtttaaccacctcaaaggtgcagacccgttcttcctgctagcgggtcctaatgtgattgaatcagaggagcacattctgcggatggctaagaacatcaagactattgcatctgaagttggaataccgttggttttcaagtcaagctttgacaaagctaaccgaacatcatcaaaatcatttcgtggcccggggatggttgagggattgaagatactcgagaaggttaaaatagcttatgacattcctatagtgacagatgtgcatgagtctatccagtgtgaagcagttggcagagtagcagatatcattcagattccagcattcttgtgtcgccaaacagatcttctagttgcagcagccaaaactgggaaaattatcaacattaagaagggccagttctgcgctccttctgtgatgacaaattcagctgaaaaggtccggttagctggaaatcctaatgtgatggtttgtgagagaggaacaatgtttggatacaatgatttgattgttgatccacgtaacttggagtggatgagagaagccaattgtcccattgtagctgatataactcactcactacaacagcctgctggaaagaagttggatggaggaggtgtggcaagtggaggtcttcgagaactgataccttgcattgcaaggacagcagttgccgttggagtggatgggatcttcatggaggtgcatgatgatccactgaaagcacctgttgatggcccaacacagtggccgttgcgccactttaaggagctacttgaagagcttgtagccattgctaggataagcaaagggaagcaacggttcaacattgatctcacaccatttcgtgaataaagaaagggtgatggttttcagatattctgaatataattccgtgaccattggtttttaaagattgttcaagggtgatgaatgcaaaactgtctcctatcgcaagttccttataa

SEQ ID NO: 10205 - DNA, 1242 bp, Glycine max
caccgacataactgtgttttggaatttagagtgcaataattccttcgttctaccgtcatcaactagaagaagaagcttcaatttctgcaaaatggatccgtctgcggcattgctgtttaaccacctcaaaggtgcagacccgttcttcctgctagcgggtcctaatgtgattgaatcagaggagcacattctgcggatggctaagaacatcaagactattgcatctgaagttggaataccgttggttttcaagtcaagctttgacaaagctaaccgaacatcatcaaaatcatttcgtggcccggggatggttgagggattgaagatactcgagaaggttaaaatagcttatgacattcctatagtgacagatgtgcatgagtctatccagtgtgaagcagttggcagagtagcagatatcattcagattccagcattcttgtgtcgccaaacagatcttctagttgcagcagccaaaactgggaaaattatcaacattaagaagggccagttctgcgctccttctgtgatgacaaattcagctgaaaaggtccggttagctggaaatcctaatgtgatggtttgtgagagaggaacaatgtttggatacaatgatttgattgttgatccacgtaacttggagtggatgagagaagccaattgtcccattgtagctgatataactcactcactacaacagcctgctggaaagaagttggatggaggaggtgtggcaagtggaggtcttcgagaactgataccttgcattgcaaggacagcagttgccgttggagtggatgggatcttcatggaggtgcatgatgatccactgaaagcacctgttgatggcccaacacagtggccgttgcgccactttaaggagctacttgaagagcttgtagccattgctaggataagcaaagggaagcaacggttcaacattgatctcacaccatttcgtgaataaagaaagggtgatggttttcagatattctgaatataattccgtgaccattggtttttaaagattgttcaagggtgatgaatgcaaaactgtctcctatcgcaagttccttataaggagagtttatattaaaaaatgttatttgatgatccatgcttgttactctgaagtggtaacactataccaactaatgtttgtcacatatcccttaatcatgtcagttactgaagttgaggcaattaattgaatatcaaaatataggtagattatttattaaa

SEQ ID NO: 10206 - DNA, 1380 bp, Lupinus angustifolius
gtttttttcagcactaattaaattatcctttaatccattctcttcccttttgcaaaaatccaacaattacaactaattctctttcattgaagctctgattcttacttagttatcaaatctctttcctttttccctatacagcttcattcttctgcaaatggatccagcaacattgtttagcaccctcaagggtgcagaaccgttcttcctgttagcgggtccaaatgtgattgaatctgaggaacacattatgcgcatggctaagcacattaagactattgcatctaaagttggaataccattggttttcaagtcaagctttgataaagctaaccgaacatcatcaaaatcattccgtggcccggggatggccgagggattgaagatacttgagaaggttaaaatagcttacgacatccctatagtgaccgatgtgcacgagagcatccagtgtgaacccgtcggcaaggttgcagatattattcagattccagcattcttgtgtcgccaaacagatcttctagttgcagcagccaaaactgggaaaattatcaacatcaagaaaggccagttctgtgctccttctgtcatggcaaattcagcagaaaaggttcggttggctggaaatcctaatgtcatggtctgtgaaagaggaactatgtttggatacaatgacttgattgtcgatccacgtaacctggagtggttgagagaagcgaattgtcctgttgtagctgatataacacactcgctacaacagccagctggaaagaagttggatggcggcggtgttgcaagtggaggtcttcgagaactaataccttgtattgcaaggacagcagtagccgttggggtagacgggatcttcatggaggtgcacgacgatccactgaatgcgccggtcgatggtccaacacagtggcctctgcgccatttcgaggagctacttgaagagcttgtagctatttctagggtaagcaaagggaagcaacaattcaacattgatctcacaccatttcgcgaatagtaagatcggtgatgaatttgagctatgttgcatgtaattccaagcattggtttcataggatatgaaggcaaaacattcttaaattctgtactgctttattagtaggatttatactgaaaaccattattctatgatccatgttttggtgactgattttggtcatagattcttgtaccatttaatcatgtcagatactaaagtcatgccatgtggatttaggaactgttcaatgcatatttccctagttttaggatatgcttaccgcacagacttgcgtgaagacgaaaccatatagaaacaactaataagatcttgacaacatattaatattttaattttaattaaacttaatc

SEQ ID NO: 10207 - DNA, 1369 bp, Lotus japonicus
ttcctttcttacacgaagaccattgttgttgttactgttgctgctgagtagtagctgaaactagcgactctctcgaccactatcaccaaggtacgaggtacgttcccttcactcattctcttcatcaacagatctctctcgacccgtgtttctccttccaagcagcttcattctcaatggatccatcggcattgctctatagccagctcaaggctgctgagccgttcttcctgctagcgggtcctaatgtgattgaatctgaagagcacattatgcgtatggctaagcacataaagagtattgcaactaaagtgggaattccactggttttcaagtcaagctttgacaaagctaaccgaacatcgtcaaaatcatttcgtggcccagggatggttgagggattgaagatactggggaaggttaaaatagcctacgatatccctatagtgacagatgtgcatgaggcctctcagtgtgaagcagttggcagagttgcagatatcattcagattccagcattcttgtgtcgccaaacagaccttctagttgcagcagccaaaaccggaaaaattatcaacatcaagaagggccagttttgtgctccttctgtcatggaaaattcagctgaaaaggttcggttagctggaaatcctaatgtgatggtttgtgagagaggaaccatgtttggctacaatgatttgattgttgatccacgcaatctggagtggatgagagaagccaattgtcctgttgtagctgatataacacactcgctacaacagcctgctggaaagaagttggatgggggaggtgttgcaagtggaggtcttcgcgaactaataccttgcattgcaaggacagcagttgctgttggagtggatgggatcttcatggaggtgcatgatgatccattaagtgcacctgttgatggtccaacccagtggcctctgcgccacctggagcagctactagaagagcttgtagctatttctagggtcagcaaagggaagcaacaattcaacattgatctcacaccatttcgtgaataaaaggaatggtatggttttcagttattctaaatatgaggaaaaccctgaggttgagcattggtctttgaagattgttcaaggttaagaacaacactgtctttcttgtaaaagctcaagtgccttatattgatgatccatgctttgtttgtccatcgtagtgacactaccaacttatgttttcacagatcctgtgtagccttgctcatgtcagtcactattaaacattcattataagtaggttactgattaattattgtacgaactagattgtaaagcttctaaggcaactttgttcatttatcccactttggttcgtagaa

SEQ ID NO: 10208 - DNA, 1370 bp, Arachis hypogaea
ccgtcgcccagaggctgtcgttgccgctggcattgccacagaaccctcaagtcgccgctggattagcctcaccctagcctcccacttctcccgttgacgtcgctcaccttcacagaacccacgctcacgctcgttctcttatcgccggcgcgcctcagctccgctgcggtcctctttccggcgtcgctcacgttcgttctatcctcggcgtctctctctgttcaagctctctctttctctctctctctgcgatctcactctctcaccgttgaacgattccattcttcatcaatcaaggtgctcactcttacgctaaacacagatctcactctatcttctctcttctcttcatctgcgtttagattcggaattaataaaaaaagcttcggaagaaacaaaagatggatccaccgtcaatgctgtatagccagctcaaggctgcagaaccgttcttcctgttagcgggtcctaatgtgattgaatcagaggaacacattatgaagatggctaagcacataaagactattacatctaaagttggcatcccattggttttcaaatcaagctttgataaggctaacagaacatcatcaaaatcttttcgtggcccagggatggttgagggattgaagatacttgagaaggttaaagtagcatatgacctccctatagtaacagatgtgcatgagtccatccagtgtgaagcagtcggcagagttgcagatatcattcaaattccagcattcttatgccgtcaaacagatcttctagttgctgcagccaaaactgggaaaattgtccacatcaagaagggccagttttgtgctccttccgtcatggcaaattcagcagagaaggttcggttggctggaaatcctaatgttatggtttgtgagagaggaactatgtttggatacaatgatttgattgttgatccacgtaacctggagtggatgagagaagccaattgccctattgtagctgatataacacactcactgcaacagcctgctggaaagaagttggatggcggtggtgttgcaagtggaggtcttcgagaactaataccttgcattgcaagaactgcagttgctgtaggagtggatgggattttcatggaggtacatgatgatccactgaatgcacctgttgatggtccaacacagtggcctttacgccacttggaggagttacttgaagagcttgtagctattgctagggtaagcaaagggaagaaaaaattcaacattgatctcacaccatttcgtgaatagcaagaatggtgatgatttcctgttattaaaaatataattccctgaggattggcctttataagatcagattgttttaaggttgaatgtacgattatc

SEQ ID NO: 10209 - DNA, 1217 bp, Trifolium pratense
atatttcttttcttctcctaagtctcctgtttctgttatatcgctatcatcttcttcactatcaagcaagctacaagattcactttctcaaaatatggatccctcattgctgtataatcagctcaaggctgcagacccgtttttcctgctagctggtcccaacgtgattgaatcagaggagcacattatgcggatggctaagcatatcaagattatttcatctaaatttggaattccattggttttcaaatcaagctttgacaaagctaaccggacatcatcaaaatcatttcgtggcccggggatggttgagggattgaagatacttgagaaggttaaaatagcttacgacctccctatagtgacagatgtgcatgaggccatccagtgtgaaccagttggcaaagttgcagatatcattcagattccagcattcttatgtcgccaaacagatcttctagttgcagcagccaaaactgggaagattatcaatatcaagaagggccagttctgtgctccttcggttatggcaaattcagcggaaaaggttcgattagctggaaatcctaatgtgatggtgtgtgagagagggacaatgtttggctacaatgatttgattgttgatccacgtaacctggagtggatgagagaagccaattgtcctattgtagctgatataacccactcactacaacaacctgctggaaagaagttggatggaggaggcgttgcaagtggaggtcttcgagaactaataccttgcattgcaaggacatcagttgccgttggagtggatgggattttcatggaggtgcatgacgatccgctgaatgcaccagtagatggtccaacacagtggcctttgcgccacttggaggaactacttgaagagcttattgctatatctagggtaagcaaagggaagaagccgtttaagattgatctcacgccatttcgtgaataagaagaacggtgatgattgagctattctgaatatagttatgtcggcattgtgcttttaagaatgttcatgcttgaatgcaaaactgtcttcattttgtggcaaaagttcaagctcctcatcataagaaagactgtttatcctaaaaactttgttttatgattcatacttgtttcttcatgtagtgacactaccaactgatgtttgtttgtcactgataatgtgtaggcttaaccttgttagttactaaagttga

SEQ ID NO: 10210 - DNA, 1486 bp, Cicer arietinum
aaaatctcactagacacattatttgcttaggccccaaaagaaatagttcatggcatcttcttcttcacaagtcacaacgcagcccatggttttgctgcctgagtagctgaatcactctccaacaacacaaacatctttctctttttcttcgtcttctcattcttattctatcttccccataaagcaacttacgagtttcattttctcgaaagaaaaaaaatggatccatcggcgttgctgtataaacagctcaagggtgcaaacccgtttttcttgctagcaggtcccaatgtgattgaatcagaagagcatattatgcggatggctaaacacatcaagactatttcctctaaattcggaattccattggttttcaaatcaagctttgacaaagctaaccgaacatcatcaaaatcatttcgtggcccggggatggttgagggattgaagatactagagaaggttaaaatagcatacgacattcctatagtgacagatgtccacgaggccgcccagtgtgaaccagttggcaaagttgcagatatcattcagattccagcattcttgtgccgccaaacagatcttctagttgcagcagccaaaactgggaagattataaacatcaagaagggccagttctgtgctccttctgtcatggcaaattcagctgaaaaagttcggttagccggaaatcctaatgtgatggtttgtgagagaggaacaatgtttggctacaatgatttgattgttgatccacgtaacctggagtggatgagagaagccaattgtcccgttgtagctgatataacgcactcgctacaacaacctgctggaaagaagttggatggaggaggtgttgcaagtggaggtcttcgagaactaataccttgcatcgcaaggacatcagttgccgttggggtcgatggtatcttcatggaggtgcatgatgatccgctgaatgcacccgtcgatggtccaacgcagtggcctttgcgccacttggaggagctacttgaagagcttatagctatttctagggtaagcaaagggaagaagcagtttaacattgatctcacgccgtttcatgaataagaagaatggtgatagttgagtaatgctggatataattttctgagcattgttctttaaagattgttcaagattgaatacaaaattatcttcatttcctagcacaagttcaagtgcctcataagaaagatggtttttaacctaaaaactgtttgatgatccatgcttgtatctccatgtagtgagactaccaactgttgtttgtcactgatcctgtgtaggccttgatcatgtcagttactaaacatgaggcaaataagtataaaatataggtagagtattgattatgtctcttgttacttaaattaattcagtactttgattatttaatatacaaattattatgaactcaattgaaaagcttcttttgacagccaacttttctgcgtaatttctc

SEQ ID NO: 10211 - DNA, 951 bp, Castanea mollissima
ctcaacgcatttttccagtcagatctttcgtttggttgctgagaaaatatttgaaattgtcatctgggtccagatggaatcatcagcacagctctttaaccagctcaaggcagcggacccatttttcttgttggctggtcccaatgtgattgaatccgaggagcatatttttcgaatggctaagcacattaagactattgcatcaaaagttgggttgccattggttttcaagtcaagctttgacaaagctaacagaacatcttcaaaatcatttcggggtcctggaatggttgaaggcttaaagatccttgagaaggttaaattggcgtatgacatccctatagtgactgatgtgcatgaaacaatccagtgtgaagcagttggaagagtagcagatattattcagattccagcatttttatgtcgtcagacagatcttctagttgcggcagccaagacggggaaaattgtcaatatcaagaaaggccagttctgtgctccttctgtcatggtaaattctgcagagaaaattagattggctggaaatccaaatgtgatggtttgtgagagaggaactatgtttggctataatgatttgattgttgatccacgcaattttgaatggatgagagaagccaattctcctgttgtagctgatgtcacacatgcgttacaacagcctgctgggaaaaagttggatggtggaggtgttgctagtggtggtcttcgcgaattaatcccatgcattgcgaggacagcagttgctgttggagttgatggaattttcatggaggtgcatgatgatcctttgaatgcacctgttgatggtcccacccaatggcctctgcgcaatttggaagaactgctggaggagcttgtggcaattgctagagtaagcaaggggaagcaacatttgaacattgatctcacgccattccgtgattaggaaga

SEQ ID NO: 10212 - DNA, 1319 bp, Pisum sativum
ccaatatttttactgcatgagtagctgaatgaaccagtcaccgacaatcatttagcaacaaatatattccttttcgacttctgattgcatcgttatcatcaccatcaatcaaccaaactcccagtttcgttttcacgaaaaatggatccttcggttttgctgtataaccagctcaaggctgcagacccgttcttcctgttagcaggtcccaatgtgattgaatcagaggagcacattatgcggatggctaaacatatcaagactatttcatctaaatttggaattccgttgattttcaaatcaagctttgacaaagctaaccggacttcttcaaaatcatttcgtggccccgggatagttgagggattgaagatacttgagaaggttaaaatagcttacgacatccctatagtgacagacgtgcacgaggccagccagtgtgaaccagttggcagagttgcagatatcattcaaattccagcattcttatgccgccaaacagatcttctagttgcagcagccaaaaccgggaagattatcaatatcaagaagggccaattctgcgctccttctgtcatggcaaattcagcggaaaaggttcggttagctggaaatcctaatgtgatggtttgtgagagaggaacaatgtttggctacaatgatttgattgttgatccacgtaatctggagtggatgagagaagccaattgtcctgttgtagctgatataacacactcgctacaacaacctgccggaaagaagttggacggaggaggtgttgcaagtggaggtcttcgagaactaataccttgcattgcaaggacatcagttgccgttggagtggacgggattttcatggaggtgcatgatgatccattgaatgcacctgtagatggtccaacacagtggcctttgcgccacttggaggagctacttgaagaactcatagctatttctagggtaagcaaagggaagaagccatttaacattgatctcacaccatttcgtgaataagaagaatggtgatggttgagttgttctgaatataattccctgtgtgcattgttcaagattgaatgcaaaactgtctccatttcatgcacaagttcaagtgtctcataagagggtttatacctaaaaaaaaaagtttgatgattcatgcttgtttctccatgtagtgactctaccaacttacgtttgcgactgattatgtgtagccttaattatgtccgtacaacatatttaggtagattgttgtttatttgctaggtatattatttatttttagcaaatgggtgcataaagatctacactaccct

SEQ ID NO: 10213 - DNA, 1159 bp, Trigonella foenum-graecum
agattcattttctgtcaaaatggatcaatcggcattactgtataaccagctcaaggctgcagacccgttttttctgcttgctggtcccaatgtgattgaatcagaagagcatattatgcgtatggctaagcacatcaagactatttcatctaaatttgggattccatggttttcaaatcaagctttgacaaagctaaccggacatcatcaaaatcatttcgtggtccagggatggttgaggggttgaagatacttgagaaggttaaaatagcttacgacatccctatagtgacagatgtgcacgaggccatccagtgtgaagcagttggcagagttgcagatatcattcaaattccagccttcttatgtcgccaaacagatcttctagttgcagcagcccaaactgggaagattatcaacatcaagaagggccagttctgtgctccttctgtgatggcaaattcagctgaaaaggttcggttagctggaaatcctaatgtgatggtttgtgagagaggaacaatgtttggctacaatgatttgattgttgatccacgtaacctggaatggctgagagaagccaattgtcctgttgtagctgatataacgcactcgctacaacaacctgccggaaagaagttggatggaggaggtgttgcaagtgggggtcttcgagaactaataccttgcattgcaaggacatcagttgccgtaggagtggacgggatcttcatggaggtgcatgatgatccactgagcgcacctgtagatggtccaacacagtggcctttgcggcacttggaggagctacttgaagagcttatagctatttctagggtaagcaaagggaagaagccgtttaacattgatctcacgccatttcgtgaataagaagaatggtgatggctgagttattcaaaatataatttccctgaacattgttcttttaagatcttttcaagattgaattcaaaactgtctccatttcgtggcacaagtttaagcacctcataagaaagagggtttatcctaaaaactttgtttgatgatccaagcttgtttcttcatgtagtaacacttaccaactgatgtttgtcactgatcaaactaattttgtactttgattaattaatatacgaactaaaatgaaaagcttctt

SEQ ID NO: 10214 - DNA, 1896 bp, Quercus alba
ccacgctgcctgagagaggagagactgacagttaaagagtgtgtcaaaggagagtggtttgggttggagagagagagagagcagagactcgagatgagagagaggtcagagaaatttggagaaatgtgtaacgtgataaacagacagtgttagggaccaaattggtcaattttgaaatattttggatctagttggtattagccgaaactttgggggtataagatttatcgtcttttcagtttttgtgtcggtactctgaaagcatttacagcattcgcaatataaacacttccactcagtcactcaacgcatttttccagtcagatctttcgtttggttgctgagaaaatatttgaaattgtcatctgggtccagatggaatcatcagcactgctctttaaccagctcaaggcagctgacccgtttttcttgttagctggtcccaatgtgattgaatccgaggagcatatttttcgaatggctaagcacattaagactattgcagcaaaagttgggttgccattggttttcaagtcaagctttgacaaagctaacagaacatcttcaaaatcatttcggggtcctggaatggttgaaggcttaaagatgcttgagaaggttaaattggcgtatgacatccctatagtgactgatgtgcacgaaacaatccagtgtgaagcagttggaagagtagcagatattattcagattccagcatttttatgtcgtcagacagatcttctagttgcggcagccaagacggggaaaattgtcaatatcaagaaaggccagttctgtgctccttctgtcatggtaaattctgcagagaaaattagattggctggaaatccaaatgtgatggtttgtgagagaggcactatgtttggctataatgatttgattgttgatccacgcaatttcgaatggatgagagaagccaattctcctgttgtagctgatgtcacacatgcgttacaacagcctgctgggaaaaagttggatggtggaggtgttgctagtggtggtcttcgtgaattaatcccatgcattgcaaggacagcagttgctgttggagttgatggaattttcatggaggtgcatgatgatcctttgaatgcacctgttgatggtcccacccaatggcctctgcgcaatttggaagaactgctggaggagcttgtggcaattgctagagtaagcaaggggaagcaacatttgaacattgatctcacgccattccgtgattaggaagattggcttctctcaaggatctctcttctagatttggaatttagaaccagaacaagcatgaactagaaaatatggagtatggagtttcttggccgcttcttgtgagaaatcatctctatatatgtggccgaccctaactagtatgttgagaatccataactaaccccaaaattttgggactaaagcttggttgttgttgcttttggttttggtttttactgccaaagtcaatatgagaagtaattaaattatgcttgtcgtcccttctaagaaaaatcttcttgatatgaaatacaaattttgattatgctcacaattatctacaatatgtactttgcagtagatttatcaaaatgcagaattaatgttggctaataataggcatcattgatttgtttgatgttggctctgcaaattataggcatcgttgatgccttgttataaaccttagatattgattgtctcttataatatttaaatgccaatttttcttacggtagattgaaattttcatttacaagtttcatgctatacagttgattgccatatacaaagcatttgaattttaaattacctctaggttgtgaatgctatttttaaagcatttgagtttaaaattcctctagatgtattagagaagattaa

SEQ ID NO: 10215 - DNA, 1256 bp, Euonymus alatus
tctatcacctctagagaattcagatccctcctcggctcctcctctctttctcatgtatattcagagccatcgccggagactaattggcaacttcctttgtagtttctgagttgtggatatggaatcatcagcactactgtttcagcatctcaagacagcggaaccatttttcctattagcgggccctaatgtgattgaatccgaggagcacattctaaggatggcaaagcacatgaagcatgtggcagccaaagttggcttgcccctagttttcaaatctagctttgacaaagctaacagaacatcctcaaaatcttttcgtggtccgggcatggctgaaggcttgaagatcttagagaaagttaaaatagcatatgacatccccattgtcactgatgtgcatgaaagtattcagtgtgaagcagttggccgagttgcagatatcatacaaattccggcatttttatgtcgccagacagatctgctggtcgcagcggccaagactggaaaaattatcaatatcaagaagggacagttttgtgctccttcagttatggtgaattctgctgagaaagtcagattggctggaaattcgaatgtcatggtttgtgagagaggaacaatgttcggctacaatgatttgattgttgatcctcgcaatttagagtggatgagagaagctaattgtccagttgtggctgacatcacacattcattgcaacagccagcagggaagaagttggatggtggaggtgttgcaagtggaggtctccgtgaattgatcccttgcatagcgaggacagcagttgctgtgggggtagatggaatctttatggaggtgcacgatgatcctctgaatgccccagtggatggtccaacacaatggcctctacgcaatttggaggaactgctgcaagaactcgtggcaatagcacgagtaagcaaggggaagaaacgcatgaacattgatctcacaccattccatgattaggaagagtttgaaagctttgagcttgttgaaggtgatttgttttcttacaaaaattgacggagccgcgattgctgtacgtgcactgttcaatcggtgtcagattaaccattgttgtattcgtgcctgcatttttctactgtgttctcaactaaaatcaactctggtcctctatagttttacttatattctctcttattaattccttagtaactcgtcccattcgataaagactgttgggtttgtgcaatgaaaattcctatccaaa

SEQ ID NO: 10216 - DNA, 1292 bp, Citrus clementina
atggaacagatgctttgtcaaaataataaatgtaaaatctttgcacgctctcattcagtcactcatttctctctctcaaagcaaaacgaagggatggatccatcaactgctttgtttaaccaactcaaggcagctgagccgtttttcttgttggcgggtccaaatgtgattgaatcagaggaacacataatgcgcatggccaagcacatcaagagtatctctaccaaagttgggttgccgcttgttttcaagtcaagctttgacaaagctaatagaacatcttccaagtcatttcgtggtcccggcatggttgaaggcttgaagatcctagagaaggttaaaatagcttatgacattcccattgtgactgatgtgcatgaaactgttcagtgtgaagaagttggcaaagttgcggatatcatccagattccagcatttttatgccgtcagacagatcttctagttgcagcagccaagactggaaaaattattaatattaaaaaaggacagttctgtgcttcctcagtaatggtaaattctgcagagaaggttagattggctggaaatccaaatgtgatggtatgcgagagaggaaccatgtttggctataatgatttgattgttgatccacggaatttggagtggatgagagaagctaattgtcctgttgtagctgatgtcacgcattcattacaacagcctgctggcaagaagttggatggaggaggtgttgccagtggtggtcttcgtgaattgataccttgcattgcaaggacggcaattgctgttggcgtagatggagtttttatggaggtacatgatgatcctcttaatgcaccagttgatggccctacccaatggcctctccgcaatttggaggaactgctagaggagcttgtggccatagctaaagtaagcaaggggaaacaacgcatgaacattgatctcacaccatttcgtgattaagaagaatttcaaggcttctatttatggattcaagaagatatcaagctgaaatgggcatcagtgcaccctttctgcctaatatgttttgcatgtagactagaattacaaaaatcctgcagagatgaaccaaaacaatcctagttgtgatggggataagccattgccatgctttctaagttgttgacttgaactaattatcgatattttgtattttatattcggattagtatacattattaacgctgtaacacttgtgttttagcaatatttacgatgagattatcaagataccaatacatattatcagtctcattattgatagaatc

SEQ ID NO: 10217 - DNA, 1092 bp, Euonymus alatus
ggaggcttgggcgttgagtaggcccaatatctggatcctctccaggcccaatccaacacagcgtctttctttcactccactctcgacaattcagattcctcctcgccttccactctttctcacatatcctgtgatcgttatcagccatcgccggtgactgattagccgcttccattgtagtttctgagttgaagatatggattcatcagcacttctgtttgagcagctcaagaaagcggaaccatttttcctattagcgggccctaatgtgattgaatccgaggagcacattctaaagatggcaaagcacataaagcatgttgcagccaaagttggtttgcctctagttttcaaatctagctttgacaaagctaacagaacgtcctcaaaatcttttcgtggtccaggcatgactgaaggattgaagatcttagagaaagttaaaatagcatatgacatccccattgtcactgatgtgcatgaaagtattcagtgtgaagcagttggccaagttgctgatatcatacaaattccagcttttttatgtcgccagacagatctgctggttgcagcagccaagactggaaaaattgtcaatatcaagaagggccagttttgtgcttcttcagttatggcgaattctgctgagaaagtcagattggctggaaatccaaatgtaatggtttgtgagagaggaacaatgttcggctataatgatttgattgttgatccacgcaatttagagtggatgagagaagctaattgtccagttgtggctgatatcacacattcattgcaacagccagcagggaagaagttggacggtggaggcgttgcaagtggaggtctccgtgaattgatcccttgcatagcaaggacagcagttgctgttggggtggatggtattttcatggaggtgcatgatgatcctctgaatgccccagttgatggtccaacacaatggccgctacgcaatttggaggaactgctgcaagaacttgtggcaatagcaagagtaagcaaggggaagaaacagatgaacattgatctgacgccattccatgattaggaagagcttgtaagaggtgattt

SEQ ID NO: 10218 - DNA, 1292 bp, Citrus sinensis
atggaacagatgctttgtcaaaataataaatgtaaaatctttgcacgctctcattcagtcactcatttctctctctcaaagcaaaacgaagggatggatccatcaactgctttgtttaaccaactcaaggcagctgagccgtttttcttgttggcgggtccaaatgtgattgaatcagaggaacacataatgcgcatggccaagcacatcaagagtatctctaccaaagttgggttgccgcttgttttcaagtcaagctttgacaaagctaatagaacatcttccaagtcatttcgtggtcccggcatggttgaaggcttgaagatcctagagaaggttaaaatagcttatgacattcccattgtgactgatgtgcatgaaactgttcagtgtgaagaagttggcaaagttgcggatatcatccagattccagcatttttatgccgtcagacagatcttctagttgcagcagccaagactggaaaaattattaatattaaaaaaggacagttctgtgcttcctcagtaatggtaaattctgcagagaaggttagattggctggaaatccaaatgtgatggtatgcgagagaggaaccatgtttggctataatgatttgattgttgatccacggaatttggagtggatgagagaagctaattgtcctgttgtagctgatgtcacgcattcattacaacagcctgctggcaagaagttggatggaggaggtgttgccagtggtggtcttcgtgaattgataccttgcattgcaaggacggcaattgctgttggcgtagatggagtttttatggaggtacatgatgatcctctgaatgcaccagttgatggccctacccaatggcctctccgcaatttggaggaactgctagaggagcttgtggccatagctaaagtaagcaaggggaaacaacgcatgaacattgatctcacaccatttcgtgattaagaagaatttcaaggcttctatttatggattcaagaagatatcaagctgaaatgggcatcagtgcaccctttctgcctaatatgttttgcatgtagactagaattacaaaaatcctgcagagatgaaccaaaacaatcctagttgtgatggggataagccattgccatgctttctaagttgttgacttgaactaattatcgatattttgtattttatattcggattagtatacattattaacgctgtaacacttgtgttttagcaatatttacgatgagattatcaagataccaatacatattatcagtctcattattgatagaatc

SEQ ID NO: 10219 - DNA, 1366 bp, Theobroma cacao
caaactgcggctcaactactccgccgggagttcccgccaaaacccagttttctcattgccttttgctgccgtccgttcattttccttctttccatctccttatctaccgaatattatttggcctttgggatcttccaactcaaggcgatggatacctcgtctgtgctttttaaccagctcaagggtgctgagccatttttcttattagccggtcccaatgttattgaatccgaagatcatattctaaggatggctaaacacatcaagactattgctaccaagcttgggttgcctctggttttcaagtcaagctttgacaaagctaaccgaacgtcctccaaatcatttcgtggtccaggaatggctgaaggcttgaagattcttgagaaagttaaagtagcatatgacattcctattgtaactgatatccatgaaactattcagtgtgaaccggttggaagagttgctgatattattcagattcctgcatttttatgtcgtcagacagatcttctagttgctgcagccaagactggaagaatcatcaatatcaagaaaggccagttctgcgctccttctgtcatggtaaattctgcagagaagattagattggctgggaatccaaatgtgatggtttgtgagagaggcaccatgtttggctataatgatttgattgttgatccacgtaatttggagtggatgagggaagcaaattgccctgtggtagcagatatcacacattcattgcaacagccagctggaagaaagttggacggtggaggtgtagccagtggaggccttcgtgaacttataccatgcattgcaaggactgcagttgctgttggagtggatggaattttcatggaggtgcatgataatcctctgaatgcaccagtcgatggtccaactcaatggcctctacgccatttggaggaacttctggaagagctaatggcaatagctagggtaagcaaagggaagcaacgcttcaacattgatctcacaccatatcatgattaggaaggtttccagagttctctaagtgggtaagcaggtgattgttttccatttcaagctcgtttcggtacaagaacatgacaatcgtccatagacataagcgttgttgtgtacatttcagccaggattgattcttgaatgttgccactgtgagttgttagtactacatgattgctctataaatgcatttgtagattaggatgaaattatgaacatattaggctaaatggttgtaattgtatctaggacttcgctcacagatggtgtatgcacattcaatcgaagtctacgtagacaattatttgttattagtcatcgtttgaaaaaacttgatttgaatgatgatttt

SEQ ID NO: 10220 - DNA, 1290 bp, Medicago truncatula
ccgacaattatttagcaacaaatttatttcctacagtaacatcattctatcgttttcttcttcactatcaaccaagctacaagattcattttctcaccaaatggatccatctgcattgctgtataatcagctcaaggctgcacacccgtttttcctgctagctggtcccaatgtgattgaatcagaggagcatataatgaagatggctaagcacatcaaggctatttcatctaaatttggaattccattggttttcaaatcaagctttgacaaagctaaccggacatcatcaaaatcattccgtggcccagggatggttgagggattgaagatactcgagaaggttaaagtagcttatgacattcctatagtgacagatgtgcacgaggccagccagtgtgaagcagttggcagagttgcagatatcattcaaattccagccttcttatgtcgccaaacagatcttctagttgctgcagcccaaactgggaagattatcaacatcaagaagggccagttctgtgctccttctgttatggcaaattcggctgaaaaggttcggctagctggaaatcctaatgtgatggtttgtgagagaggaacaatgtttggctacaatgatttgattgttgatccacgtaacctggagtggctgagagaagccaattgtcctgttgtagctgatataacgcactcactacaacaacctgctggaaagaagttggatggaggaggtgttgcaagtggaggtcttcgagagctgataccttgcattgcaaggacatcagttgctgtaggagtggacgggatcttcatggaggtgcacgatgatccactgagcgcacctgtagatggtccaacacagtggcctttgcgccacttggaggagctacttgaagagcttatagctatttctagggtaagcaaagggaagaagccgtttaacattgatctcacaccatttcgtgaataagaagactggtgatcattgggttattctaaatataatttcctgaacattgtaattttaagatctcttcaagattgaatgcaaaactgtctccatttcctggcacaagttcaagtgcctcataggaaaaagggttcatcctaaaaactttgtttgatgatccaatttgatgatccaagcttgtttcttcatgtagtaacactaccaattgatgtttgtcattgatcatgtgtatcctttaatcatgtcagttactattcttgaggcaaataaatataaaatataggtagagattgttgattatgtctcttgttcgctaa

SEQ ID NO: 10221 - DNA, 1457 bp, Panax ginseng
actcaaaaactaatgaaactcaaagaggtgctttgagtttgggatcgaggtaaggtttatagagagagatggtatatagattatagatagattaaacggtcactctcacagtctcgctagtgtctgcagctgcagatcaatctcagatctcggattcaccaagaaagctttacctaggtagagaaaaaataaaccttggatggattcatcaacagtattattcaaccagctcaagtcagcagaaccatttttcttattagctggtcctaatgtgatcgaatcagaggagcacattttacgtatggccaagcacattaaggctatcacatcaaaacttgggctgccattggttttcaagtccagctttgacaaagctaatagaacatcctctaagtcgttccgcggtcctgggttagctgaaggcttgaagattcttgaaaaggtgaaagtagcatatgacctaccaattgtgactgatgtacatgaagctaaccagtgtgatgcagttggtcaggtagcagatataatccagattccagcttttttgtgccggcagacagatctcctagttgcagctgcgcagactggaaagattataaacatcaagaaaggccaattttgtgctccttctgtgatgacaaattctgctgaaaaggttaggctatctggaaatcaaaatgttatggtttgtgagcgaggaactatgttcggctataatgatttaatcgttgatccacgaaacttggaatggatgagggaagctaattgtccaatcgtagctgatatcacacattcattacaacaacctgctgggaaaaagttagaaggtggtggtgttgccagtggaggtcttcgtgaattaataccttgcattgcgaggacagcagttgccgttggagtggatggaatctttatggaggttcacgatgatcctctaaatgctccagttgatggtccaacacagtggcctctacgccatttggaggaactgctagaagagcttgtagcaattgctagggttaccaagggaaaacaacagttcaagattgatctcactccattccgtgattagacagaatttgaggctattctcaatggtgaactctaccaatggctgtctacagacaagatcctgcctccacctcgaatgtgtggcacctagaaaatcgcctcggtatccgaatttgacattaatatattatgttcatcatttttactcttttttttttcagtttaatcgagtggtatttcagtttatttgtagttttggtatgtttactccatccttagccttgtgaacatcatcaagtttctgttgattcaaaaagtaatgggattgtctcagttgggcaaataggcctcaaatacttgcttgtttgatgtttttaccttcatttcctgagctattggtcatggaaaatgctggttttcagaggcagattcaattttaatttttc

SEQ ID NO: 10222 - DNA, 1195 bp, Brassica napus
ctcgccgtactccgttctctaatgccgtcgtcatatgctcaaaggggagatcaagttacaacaagattttgatcgaagatcttctcgatcgtgcagcttttgtattccaagttgttagctttgacgaaaaagaatggcggcaacatcaccactctacaatcagctcaaggatgctgaaccgttcttcttgttggctggtccaaatgtgatcgaatccgaggagcatatccttcgaatggcaaagcacatcaaacacattgccacaaaagttgggttgcctctggttttcaagtcaagttttgataaggctaacagaacttcttctaagtccttccgaggtcctggcatggctgagggtctcaagattcttgagaaggtgaaagtagcatatgacctgccaatagtgactgatgttcatgaatcgatccagtgtgaagaagttggcaaggttgcagatataattcagataccagcattcttatgtcgccagacagatcttctggttgcggcagctcaaccggaaaaattatcaatatcaagaaaggacagttctgtgctccttctgtaatgaataattcggcagagaagatcagacttgctgggaatccaaatgtgatggtttgtgaaagaggaaccatgtttggatacaatgatttgatagtagatccacgaaactttgaatggatgagggaagctaattgtcctgttgttgctgatataacccatgcactacaacaacctgcaggcaaaaagttggagggtggaggtgttgctagtggaggactacgtgagttgataccctgcattgcaagaactgctgtagcagttggtgttgatggaattttcatggaggttcatgatgatcctctaagtgctccagttgatggtccaactcaatggcctttgcgtcatttagaagaactcctagaagagctcatcgccattgctagggtcacaaaagggaagcagcagttccagatcgatctcacaccgttccgcgattagaattgaagatgcaagtaaatgggcatgtacgatatatatgatatgcctctgctcaccatgaaactgttaataatctttagagaccatgataatgcatcatctgtttcttagacataacatctacttgagcaaagagcattatttgtttttgattttaagagaaactgttataaacatataataactatga

SEQ ID NO: 10223 - DNA, 1224 bp, Euonymus alatus
ctagagaattcagatccctcctcggctcgtcctctctttctcatgtatattcagattcatcgccggagactaattggcaacttcctttgtagtttctgagttgtggatatggaatcatcagcactactgtttcagcatctcaagacagcggaaccatttttcctattagcgggtcctaatgtgattgaatccgaggagcacattctaaggatggcaaagcacatgaagcatgtggcagccaaagttggtttgcccctaattttcaaatctagctttgacaaagctaacagaacgtcctcaaaatcttttcgtggtccaggcatgactgaaggattgaagatcttagagaaagttaaaatagcatatgacatccccattgtcactgatgtgcatgaaagtattcagtgtgaagcagttggacgagttgcagatatcatacaaattccggcatttttatgtcgccagacagatctgctggtcgcagcagccgagactggaaaaattatcaatatcaagaagggacagttttgtgctccttcagttatggtgaattctgctgagaaagtcagattggctggaaattcgaatgtcatggtttgtggaagaggaacaatgttcggctacaatgatttgattgttgatcctcgcaatttagagtggatgagagaagctaattgtccagttgtggctgacatcacacattcattgcaacagccagcagggaagaagttggatggtggaggtgttgcaagtggaggtctccgtgaattgatcccttgcatagcaaggacagcagttgctgtgggggtagatggaatctttatggaggtgcacgatgatcctctgaatgccccagtggatggtccaacacaatggcctctacgcaatttggaggaactgctgcaagaactcgtggcaatagcacgagtaagcaaggggaagaaacgcatgaacattgatctcagaccattccatgattaggaagagtttgaaagctttgagcttgttaaaggtgatttgttttcttacaaaaattgacggagcggcgattgccgtatgtgcactgttcaatcagtgtcagattaaccattgttgtattcgtgcctgcatttttctactgtgttctcaactaaaatcaactctagtcctctatagttttgcttatattctctcttattaattccttagtaactcctcccatttgataaagactgttgaggttgt

SEQ ID NO: 10224 - DNA, 1292 bp, Brassica rapa
gcgtccaaacaggctaaaaggtgagaggaggagatctcatctcacttcccttcacttcactctgcaacttcgagatcaagttacaacaagattttgatcgaagatcttctcgatcgtgcagcttttgtattccaagttgttagctttgacgaaaaagaatggcggcaacatcaccactctacaatcagctcaaggatgctgaaccgttcttcttgttggctggtccaaatgtgatcgaatccgaggagcatatccttcgaatggcaaagcacatcaaacacattgccacaaaagttgggttgcctctggttttcaagtcaagttttgataaggctaacagaacttcttctaagtccttccgaggtcctggcatggctgagggtctcaagattcttgagaaggtgaaagtagcatatgacctgccaatagtgactgatgttcatgaatcgatccagtgtgaagaagttggcaaggttgcagatataattcagataccagcattcttatgtcgccagacagatcttctggttgcggcagctcaaaccggaaaaattatcaatatcaagaaaggacagttctgtgctccttctgtaatgaataattcggcagagaagatcagacttgctgggaatccaaatgtgatggtttgtgaaagaggaaccatgtttggatacaatgatttgatagtagatccacgaaactttgaatggatgagggaagctaattgtcctgttgttgctgatataacccatgcactacaacaacctgcaggcaaaaagttggagggtggaggtgttgctagtggaggactacgtgagttgataccctgcattgcaagaactgctgtagcagttggtgttgatggaattttcatggaggttcatgatgatcctctaagtgctccagttgatggtccaactcaatggcctttgcgtcatttagaagaactcctagaagagctcatcgccattgctagggtcacaaaagggaagcagcagttccagatcgatctcacaccgttccgcgattagaattgaagatgcaagtaaatgggcatgtacgatatatatgatatgcctctgctcaccatgaaactgttaataatctttagagaccatgataatgcatcatctgtttcttagacataacatctacttgagcaaagagcattatttgtttttgattttaagagaaactgttataaacatataataactatgatggattctgtttacattcgatgtaaaagctcgtgggtttccctacccatttctgaaaacataagtcaacca

SEQ ID NO: 10225 - DNA, 1403 bp, Fagopyrum esculentum
tacgggggactccccacagtaactgacttcgactgtggatctctgccgtcgcctgccaccacggccgaatcttatttctccgatcacctcctcatctctcttccgctctttctcatcccttgccccaaaatcgtgtccgcaggtttaaatcgaagcaggagaactccttaagaaactccgtgttcaacttctccaaatcccgagttttgtaaaccgatctcggttcctccgccattgagctcatctccgaccgccgcccacatctgtaagcaaccaggtgacaagttaaggcaatggaggcttccacaactcttctgtttaaccagctcaaggctgcagaccccttttcttgcttgctggtccaaatgttattgaatctgaagatcacgttatgcggatggcaaaacacattaagggcatagcaggaaaagttgggcttcctctcgtgttcaaatcaagctttgataaggccaataggacgtcctccaaatcattcaggggccctggtatggctgaaggcttgaagatccttgagaaggttaaattagcatatgatatccccatagttactgatgtgcacgagtccagtcagtgcgaagcagttggaaaagttgctgatattattcagattccagctttcttatgtcgtcagacagatctccttgttgcagctgccaaaacaggaaaaatcatcaacattaaaaaaggccaattttgtgctcattcggttatggtaaattctgctgaaaagtacggctggctggaaatccgaatgttatggtttgtgaaagagggactatgtttggctataatgacttgatcgttgatccaagaaacttggagtggatgagggaagctaattgccctgttgtagctgatataacacattcattacagcagcctgctggtagaaagctggaaggtggtggtgtagccagtggaggctaccgcgagttaattccttgcattgcgaggactgcagttgcagttggagttgatggaattttcatggaggtccatgatgatcccttaaatgcacccgttgatggtccaacacaatggcctctgcggaacctggaggaactgctagaagagctcgttgctattgctagggttagcaaggggaagaaacaattgaacattgatcttacaccctaccgtgaataggaagagcgtggccgagcagcaggcgcacaaggtccatggtgtattcgtatgcttgtaactgttgcagtattatgaggacagtttatttgtttgtttgttttatatttacctttccttcttgattgctgtattgccgcgcattcctttcactgggttgttgggtatttctggctagctattgaaatggataaatttctagctaggtgaaagattcaggatgaataataaatttgtat

SEQ ID NO: 10226 - DNA, 1177 bp, Cucurbita pepo
ccgtctcgcccagctctcttacactccatctcctcctcctccactgcctgatcgccattacaccatcttcaaagctcaagacatcctgaattaattgtctgtaagtcttgaattgcatcgaagtaaacgccatggaatcttcgctgcttttcaaccagctccaggctgctgaaccctttttcctattggctggtccaaatgtgatcgaatcagaggagcatatatttaggatggctaagcacatcaagaatatatcgtcgaagtttggtttgccactggttttcaagtcgagcttcgataaagctaaccgaacatctgcaaaatcctttcgtggtccaggcatggtcgaaggcctgaagatacttgaaaaggttaaattagcatatgatatacccatagtgactgatgtgcatgaaaccatacagtgcgaagccgttggcaaagttgcagatattattcagattcccgcgtttttgtgtcgacagactgatcttctagttgcagcagccaagactgggagaattataaatattaagaaaggccagttttgtgctccttctgtaatgaaaaattctgctgaaaagatcagaatggctgggaattcaaatgtgatggtttgtgagagaggaactatgtttggatataatgacttaatcgttgatcctcggaacctggagtggatgagagaggcaaactgccctgttgttgctgacattacccattcattgcaacaacctgctgggagacagttgggtgatggaggtgttgctagtggtggcctacgtgaattaataccgtgcattgcgaggacagcagtggctgttggagtagatgggatattcatggaggtgcatgatgaccctatgaacgctccagttgatggtccaacgcagtggcctttgcgtcatttggaggaattgctggaagagcttgtggcaattgcacgagcgagcaagggtaagcagcattttaatatcgacttgacgccatttcgtgagtagaggcacgacgcaccatgaaagttcgaactgaggtacgagagctatgatttgaatacaccaattcttgctcattattgacattatcgctaccaagttagtttgattttgtgtagatactgatctatcttcaaatgaactgaacatgttgctttagttttgtcttacaccaatcatga

SEQ ID NO: 10227 - DNA, 877 bp, Eutrema halophilum
atggcggcaacatcacctctgtacaatcagcttaaggctgctgaaccattcttcttgttggctggcccaaatgtgatcgaatccgaggaacatattcttcgaatggcaaagcacataaaagacattgccacaaaaattgggttacccctggttttcaagtcaagttttgataaagctaacagaacctcttcaaagtcgttccgaggccctggcatggctgagggtctgaagattcttgagaaagtgaaagtagcatatgacctacccatagtaaccgatgttcacgaatcgatccagtgcgaagcagttggcaaggttgcagatataattcagataccagcattcttatgtcgccagacagatcttctcgtcgcggcagcccaaaccggaaaaattatcaatattaaaaaaggacaattctgtgctccttctgtcatggaaaattcggccgagaaggttaaactggctggaaatccaaatgtgatggtttgtgaaagaggaaccatgtttggatacaatgatttgatagtagatccacgaaactttgaatggatgagggaagctaattgccctgttgtcgctgatataacccatgcactacaacaacctgcaggcaagaagttggagggtggtggtgttgctagtggaggccttcgtgagttaataccatgcattgcaagaacagctgtagcagttggcgttgatggaatattcatggaggttcatgatgatcctctaagtgctccagttgatggtccaactcaatggcctttgcgtcatctagaagaactcctagaggagctcatcgcgatcgctagggtcacaaaagggaagcagcgtttccagatcgatctcacaccgtaccgcgaataggaac

SEQ ID NO: 10228 - DNA, 1757 bp, Eucalyptus grandis
aaccaatcgatggatggagagaaaagcgacggcgtcagatcttcgcagcagcaagctcactactggctggcaaacagggagtaacaccgacgctcgtcaaaaagctctctgcaacttgcccaaagccgcaggtgtggacgcccagaatctccatcctcccgtcgcatccgagtccctgaagctcatctccctgatctctctctatctctcgccgttccaccgtcgcgtctccggccgccatttcctcggccggactcctcggagaatccgccggaagaagagtgtccgttccgtttatagccggattcgacggagatggaatcgtcggcgctcctgttcaaccagctcaaggcggcggatccattctttctgttagctggaccgaatgtgattgaatcggaggagcatgttttgtacatggcgaagcacataaagagcgtcgctgcaaaagttggcttgccgcttgtattcaagtcaagctttgacaaagccaaccgaacgtcgtcgaaatcgttccgtggtcccggcatggctgaaggcctcaagatccttgagaaagttaaggcaacttatgacattcctattgtgactgatgtgcatgaaacaattcagtgtgaagcagtaggaagagttgcagatattattcaaattccagcatttttatgccgtcagacagatctcctggttgcagcagctaagacagggaagattattaacattaagaaaggccaattttgtgcttcctctgtcatggcaaactctgctgaaaagattagactggctgggaatccacacgtcatggtttgtgaaagaggaactatgtttggttataatgatttaattgtggatccacgcaatctcgagtggatgagagaggccaactgtcctgttgtagctgatgtcacacatgcactccaacaacctgctgggagaaagttggaaggtggaggtgttgccagcggaggtcttcgggaacttataccatgcattgcaaggacagcagttgcagttggagtggatgggctttttatggaggtgcacaatgatcctttaaattcgccagtagatggtccaactcaatggcccttacgccatcttgaggagcttctggaagagcttgtggcaatagctagggcaagcaaagggaagcaacagcttaaaattgatcttacaccatatcacctctaggaggaccttgaggcttctcagagggaaatagacttgggctctatgtagattttccttagtggcttagatacctcgaagtgatcaagcaagttcaggtgatcaggcagaatgcctgtaatggtggctggaataaataatatcatgcaacgtaatgctattctttcctactgtcttctggcatcatctctgcccggttaatcaccaatgttttgcatctccgtgttattcctagatattattttattgattgtaattgtttttttgttgatgagagaaaccaaagttgctttgagtaagtagagttttgttgctgtagcatggtctttccaagtgaacttgtccacagtgcaaaattgactgacgaagttgaaaaggaaatctccaggttgagacactgatctttacctgtgcgtgttttctctgtgattttcatcgacagatgaggttctgtactttgctactggctagggaaaaacacagttgagacttaagcatggccttggtgaaagttcggacttcggtgtgtttggcagagtctaggataatacaaggaagagctaggaagctgg

SEQ ID NO: 10229 - DNA, 1007 bp, Allium cepa
agtaaaagatggatagttcaacggatctttacaacatgctgaagggagctgagccctttttcttgcttgccgggcccaatgtgattgaatctgaggagcatgttcttaagatggcgaaacatataaaagatgtaacgtccaagctaggagtgccgctagtatttaagtctagctttgacaaggctaaccgcacatcatcaaaatcattcagaggccctgggttggaagagggtttgaagatcttggagaaagtcaaagttgcgtatgatcttcccatagtgacagatgtgcatgagagtagccagtgcgaagctgttggccgagttgcagatataattcaaattccagctttcctgtgtagacagactgatctcttagttgcagctgctaagactggaaagataattaatataaaaaagggccagttttgtgctccttctgtgatggtcaattctgctgaaaaggtcagacttgctgggaacccaaatgtcatggtttgcgagcgaggcacaatgtttggttacaatgatttaattgttgatcctcgaaactttgagtggatgagagaagcaaattgccctattgtggcagatgttactcattctctacagcaacctgcaggtaaaaagctggatggtgggggagttgcaagtggaggtctgcgtgaactaataccatgtattgcacgtacttcagttgtagttggagttgatggaattttcatggaggttcacgatgatccactgaatgcacctgtagatggtccaacacaatggcctttgcgtcatttggaagagctgttagaagagttgatagcaatagctagggtcactaagggtaaaaggccgtttaaaattgatctcacgccgtatgaagattgagtcaagctacttctataaagcagaggagttatccgtggagtaataccaacgtgttacactcttatgtttatatgaatgcgactattttacttgtcagattcgtactcaatatttaattgaatacca

SEQ ID NO: 10230 - DNA, 1139 bp, Citrullus lanatus
tatctcagttccagaccttttccgttgaattggttagaagtaattgtctgaagtcttcaatttcacataagtaagcgccatggaatcttcgctgcttttcaaccagctccgggctgctgagccctttttcctattggctggtccaaatgtgattgaatcggaggagcatatatttaggatggccaagcacatcaagaatatatcatcgaagtttggtttgccactggtttttaagtctagctttgataaagctaaccgtacatctgcaaaatcctttcgtggtccaggcatggttgaaggcttgaagatacttgaaaaggttaaattagcatatgatatacccatagtgactgatgtgcacgaaaccatacagtgtgaaccagttggcaaagttgcagatattattcagattcctgcatttttatgtcggcagactgatcttctagttgcagcagccaagactgggagaattataaatattaagaaaggccagttttgtgctccttctgtaatgaaaaattctgctgaaaagatcagaatggctggaaattcaaatgtgatggtctgtgagagaggaactatgtttggatataatgatttaattgttgatcctcggaacctggaatggatgagagaggcaaactgccctgttgttgccgacattacacattcattgcaacaacctgccgggagacagttgggcgatggaggtgttgctagtggtggcctacgtgaattaataccatgcattgccaggacagcagtggctgttggagtagatgggatattcatggaggtgcatgatgaccctctgaatgctccagtagatggtccaacacagtggcctttgcgtcatttggaggaattgctggaagagcttgtggcaattgcacgggcgagcaagggtaaacagcgttttaatatcgacttgacgccgtttcatgaataaaggcacgatgcaccatgaaagtttgggtatgggagctatgatttcaatactccattttttactcattattcacattgtccctaccaaatagtttgattttgtgtagagatacttctgatgtatcttcaaaggaatatgttgagttagtttttggtgcaacaccaatcatgaattgtttctcctaaacaat

SEQ ID NO: 10231 - DNA, 1353 bp, Brassica napus
ggtcagcgtatccaaacatttttcacgcgttaaaaggcaagaagagatctcacttcccttcacactctcactctgcaacttcgcgatcaagttaatagttagttacagcttttcagctttccgaaaagaatggcggcaacatcaccactctacaatcagcttaaggatgctgaaccattcttcttgttggctggtcctaatgtgatcgaatccgaggaccatatccttcgaatggcgaagcacatcaaacacattgccacaaaagttgggttgccactggttttcaagtcaagttttgataaggctaaccgaacttcttctaagtcctttcgaggtcctggcatggctgagggtctcaagattcttgagaaggtgaaagtagcatatgacttaccaattgtaactgatgttcatgaggcgtatcagtgtgaacaagttggcaaggttgctgatataattcagataccagcattcttatgtcgccagacagatcttctggttgcggcagctcaaaccggaaaaattatcaatattaagaaagggcagttctgtgctccttctgtcatggaaaattcggctgagaagatcaggctggctgggaatccgaatgtcatggtttgtgaaagaggaaccatgtttggatacaatgatttgatagtagatccacgaaactttgaatggatgagggaagctaattgtcctgttgttgctgatataacacatgcactacaacaacctgctggcaaaagttggaaggtggtggcgttgctagtggaggccttcgggagttaataccctgcattgccagaacagctgtagcagttggcgtcgatggaattttcatggaggttcatgatgatcctctaagtgctccagttgatggtccaactcaatggcctttgcgtcatttagaagaactcctagaggagctcatcgcgattgctagggtcacaaaaggaaagcagcggttccaaatcgatctcacaccttaccgcgactaggattgaaggtctcatatgggtccacggcaaatcctggagacctcattgcggttgcaacctctccgtaaaggatatctgtcatctacttgagcaaagagtgtttatttgtttttgattgctccaaactttgaacatataatatgttttcattcaaaatttgctcaatttagagtgtgataacatacaataactataatgaattctgtttacattcgatagacaaagttgtacaagctcatgggttacagaggtttgcttccctaagtcaaccacatctacatatgcctgcacattgtatgtatattatcattaatgcaagagtgtatatatacatatacatctgagtgtgatc

SEQ ID NO: 10232 - DNA, 1442 bp, Fagopyrum esculentum
gactccccacagtaactgacttcgactgtggatctctgccgtcgccggtcacgaaggccgaatcttatttctctgatcacctcctcatctctcttcctctctttctcatcccttgccttaaaatcgaagtaggagaattcttgtagaaactccgtgttcaacttctccaaatcccgagttttgtaaaccgatctcggttcctccgccattgagctcatctccgaccgccgcccacatctgcaactacaatagtaagcaaccaggtgacaagttaaggcaatggaggcttccacaactctctttttaaccagctcaaggctgcagacccctttttcttgcttgctggtccaaatgttattgaatccgaagatcacgttatgcggatggcaaaacacattaagggcatagcaggaaaagttgggctgcctctcgtgttcaaatcaagctttgataaggccaataggacgtcctccaaatcattcaggggccctggtatggctgaaggcttgaagatccttgagaaggttaaattagcatatgatattcccatagttactgatgtgcatgagtccagtcagtgcgaagcagttggaaaagttgctgatattattcagattccagctttcttatgtcgtcagacagatctccttgttgcggctgccaaaacaggaaaaatcatcaacattaaaaaaggccaattttgtgctcattcggttatggtaaattctgctgaaaaaatacggctggctggaaatcagaatgttatggtttgtgaaagagggactatgtttggctataatgacttgatcgttgatccaagaaacttggagtggatgagggaagctaattgccctgttgtggctgatataacacattcattacagcagcctgctggtagaaagctggaaggtggtggtgtagccagtggaggctaccgtgagttaattccttgcattgcgaggactgcagttgcagttggagtcgatggaattttcatggaggtccatgatgatcccttaaatgcacccgttgatggtccaacacaatggcctctgcggaacctggaggaactgctagaagagctcgttgctattgctagggttagcaaggggaagaacaattgaacattgatctcacaccctaccgtgattaggaagagcatggccgagcagcaggcgcacaaggtccatggtgtattcgtatgcttgtaacttttgcagtattatgatgacagtttgtttgttttatatttacctttcattcttgattgctgtattttgcgcattcctttcattcggttattgggtatttctggctagcttttgaaaatggataaatttctagctaggtgaaagattcaggatgaataacaagtttgtatcgagttggccgggtagcaggtgctcgtctatggtgtattcgctctttcaataaatctaaac

SEQ ID NO: 10233 - DNA, 1095 bp, Brassica juncea
ttccgaaaagaatggcggcaacatcaccactctacaatcagcttaaggatgctgaaccattcttcttgttggctggtccaaatgtgatcgaatccgaggaccatatccttcgaatggccaagcacatcaaacacattgccacaaaagttgggttgcctctggttttcaagtcaagttttgataaggctaacagaacttcttctaagtccttccgaggtcctggcatggctgagggtctcaagattcttgagaaggtgaaagtagcatatgacttaccaattgtaactgatgttcatgaggcgtatcagtgtgaagaagttggcaaggttgctgatataattcagataccagcattcttatgtcgccagacagatcttctggttgcggcagcccaaaccggaaaaattatcaatattaagaaaggacagttctgtgctccttctgtcatggaaaattcggctgagaagatcaggctggctgggaatccgaatgtgatggtttgtgaaagaggaaccatgtttggatacaatgatttgatagtagatccacgaaactttgaatggatgagggaagctaattgtcctgttgttgctgatataacacatgcactacaacaacctgcaggcaaaaagttggaaggtggtggtgttgctagtggaggccttcgggagttaataccctgcattgccagaacagctgtagcagttggcgtcgatggaattttcatggaggttcatgatgatcctctaagtgctccagttgatggtccaactcaatggcctttgcgtcatttagaagaacttctagaggagctcatcgcaattgctagggtcacaaaaggaaagcagcggttccaaatcgatctcacaccttaccgcgactaggctgaatgtgtagtagtctcgaggccttctcctcggatatatgggtccacggcaaatcctggagacctcattgcggttgcagcctctccgtaaaggatatctatcatctacttgagcaaagagtgttatttgtttttgattgcaccaaactttgaacacatatatataagcttttattcaaaatttcttcaatataagtgttaaacaggca

SEQ ID NO: 10234 - DNA, 1045 bp, Brassica oleracea
ttttgtattccaagttgttagctttgacgaaaaagaatggcggcaacatcaccactctacaatcagctcaaggatgctgaaccgttcttcttgttggctggtccaaatgtgatcgaatccgaggagcatatccttcgaatggcaaagcacatcaaacacattgccacaaaagttgggttgcctctggttttcaagtcaagttttgataaggctaacagaacttcttctaagtccttccgaggtcctggcatggctgagggtctcaagattcttgagaaggtgaaagtagcatatgacctaccaatagtgactgatgttcatgaatcgatccagtgtgaagaagttggcaaggttgctgatataattcagataccagcattcttatgtcgccagacagatcttctggttgcggcagcccaaaccggaaaaattatcaatatcaagaaaggacagttctgtgctccttctgtaatgaataattcggcagagaagatcagacttgctgggaatccaaatgtgatggtttgtgaaagaggaaccatgtttggatacaatgatttgatagtagatccacgaaactttgaatggatgagggaagctaattgtcctgttgttgctgatataacccatgcactacaacaacctgcaggcaaaaagttggagggtggaggtgttgctagtggaggactacgtgagttgataccctgcattgcaagaactgctgtagcagttggtgttgatggaattttcatggaggttcatgatgatcctctaagtgctccagttgatggtccaactcaatggcctttgcgtcatttagaagaactcctagaagagctcatcgccattgctagggtcacaaaagggaagcagcgattccaaatagatctcacaccgtaccgcgattaggattgaagatgcaagtaatctccgaggtgagagaagcaaatgggcatatatgatatgcctcatcatgaaactgttaataatctttagagaccatgataatgcatcatctgtttcttagacataacatctacttgag

SEQ ID NO: 10235 - DNA, 1868 bp, Brassica rapa
aattaatctgtcagcgtatccaaacatttttcacgcgttaaaaggcaagaagagatctcacttcccttcacactctcactctgcaacttcgagatcaagctaatagttagttacagcttttcagctttccgaaaagaatggcggcaacatcaccactctacaatcagcttaaggatgctgaaccattcttcttgttggctggtcctaatgtgatcgaatccgaggaccatatccttcgaatggccaagcacatcaaacacattgccacaaaagttgggttgcctctggttttcaagtcaagttttgataaggctaaccgaacttcttctaagtccttccgaggtcctggcatggctgagggtctcaagattcttgagaaggtgaaagtagcatatgacttaccaattgtaactgatgttcatgaggcgtatcagtgtgaagaagttggcaaggttgctgatataattcagataccagcattcttatgtcgccagacagatcttctggttgcggcagcccaaaccggaaaaattatcaatattaagaaaggacagttctgtgctccttctgtcatggaaaattcggctgagaagatcaggctggctgggaatccgaatgtgatggtttgtgaaagaggaaccatgttcggatacaatgatttgatagtagatccacgaaactttgaatggatgagggaagctaattgtcctgttgttgctgatataacacatgcactacaacaacctgcaggcaaaaagttggagggtggtggtgttgctagtggaggccttcgggagttaataccctgcattgccagaacagctgtagcagttggcgtcgatggaattttcatggaggttcatgatgatcctctaagtgctccagttgatggtccaactcaatggcctttgcgtcatttagaagaactcctagaggagctcatcgcgattgctagggtcacaaaaggaaagcagcggttccaaatcgatctcacaccttaccgcgactaggattgaaggtctcctcctcggacatatgggtccacggcaaatcctggagacctcattgcggttgcaacctctccgtaaaggatatctgtcatctacttgagcaaagagtgtttatttgtttttgattgctccaaactttgaacatataatatgttcttattcaaaaaaattctcaatttagagtgtgatacatacaataaatacaatgaattctgtttacattcgataggcaaagttgtacaagctcatggggttacacaggtttgctttcctaagtcaaccacatctacatatgcctgcacattgtatgtatattatcattaatgcaagagtgtatatatacatatacatctgagtgtgatcacatcaacggctctatgaacatataacaaaacggtcttgcataacgatttggtcttgttgcttgtctagtgtcctttgcacagcttgatagaactcaatccaagaagacgagtacgaagagccaaacatgaatgttggattaggactagcagggcaagcagtgaccaaatccaaaacagaagtggcaggtttgagctggtgagggaagttgaaagccaagttatcaactttatgctcatagattttgccattacggtccagtttatagcgagaagttccctgaaactctcctttggcctcccatggaactctaggtatacctttgagattccacctgatgagaatcatgttctctgatggttgccaaaccctgaagatctcaagtgagatatctctgaagagaatcttgccatgaaacctgagtgcccagaagatcagtttgtagttctcaatcccagagaaagtgttcgctggatccaccagtgttatatcatc

SEQ ID NO: 10236 - DNA, 1444 bp, Brassica napus
agcttttgtattccaagttgttagctttgacgaaaaagaatggcggcaacatcaccactctacaataagctcaaggatgctgaaccgttcttcttgttggctggtccaaatgtgatcgaatccgaggagcatatccttcgaatggcaaagcacatcaaacacattgccacaaaagttgggctgcctctggttttcaagtcaagttttgataaggctaacagaacttcttctaagtccttccgaggtcctggcatggctgagggtctcaagattcttgagaaggtgaaagtagcatatgacctaccaatagtgactgacgttcatgaatcgatccagtgtgaagaagttggcaaggttgcagatataattcagataccagcattcttatgtcgccagacagaccttctggttgcggcagcccaaaccggaaaaattatcaatatcaagaaaggacagttctgtgctccttctgtaatgaataattcggcagagaagatcagacttgctgggaatccaaatgtgatggtttgtgaaagaggaaccatgtttggatacaatgatttgatagtagatccacgaaactttgaatggatgagggaagctaattgtcctgttgttgctgatataacccatgcactacaacaacctgcaggcaaaaagttggagggtggaggtgttgctagtggaggactacgtgagttgataccctgcattgcaagaactgctgtagcagttggtgttgatggaattttcatggaggttcatgatgatcctctaagtgctcccgttgatggtccaactcaatggcctttgcgtcatttagaagaactcctagaggagctcatcgccattgctagggtcacaaaagggaagcagcgattccaaatagatctcacaccgtaccgcgattaggattgaagatgcaagtaatctccgaggtgagagaagcaaatgggctgctcatcatgaaactgttaataatctttagagaccatgataatgcatcatctgtttcttagacgtaaaatctacttaagcaaagatcattatttgtttttgattttaagagaaactgttataagcatataataataactatgatcgtcactcgatgtaaaagctcgtgggtttccctaccaatttctgaaaacacaagtcaaccaaatctgcacattatcttcagtgcaacaaaatagatatatatacacccgagtctgagaatggcccaatcactggcactatgaacatatgacaaaacggtcttgcccaaggatttgctcttgttgcaggtttgagctgctgagtgaagtttaaaatccaagttatcgaaccttcgctttgttttatcttttgacctccaaattatcctttatttattgtgttcttcattaaaatttccaattaaggtgtactaattacttctcctaccttaaacttagtatta

SEQ ID NO: 10237 - DNA, 1626 bp, Arabidopsis thaliana
ctcacttgccttcttcactcactctgcagcaacttcgagatcaagttaaagaatggcggcaacatcactattgtacaatcagctcaaggctgctgaaccattcttcttgttggctggtccaaatgtgattgaatccgaggaacatattcttcgaatggcaaagcacattaaagacatttccacaaaagttgggctgcccctggttttcaagtcaagttttgataaagctaacagaacttcttcaaagtcatttcgtggtcctggcatggccgagggtctgaagattcttgagaaggtgaaggtagcatatgatctaccaatagtaactgatgttcatgaatcaagccagtgtgaagcagttggcaaggttgcagatataattcagattccagcattcttatgtcgccagacagatcttctggttgcagcagcacaaaccggaaaaattatcaatattaagaaaggacaattctgtgctccttctgtcatggagaattcagctgagaagatcagactggctgggaatccaaatgttatggtttgtgaaagaggaaccatgttcggatacaatgatttgatagtagatccacgaaacttcgagtggatgagagaagctaattgtcctgttgtcgctgatataacccattcactacaacaacctgcaggcaagaagttggatggtggtggtgttgcaagtggaggccttcgcgagttaataccatgcattgcaagaacagctgtagcagttggcgtcgatggaattttcatggaggttcatgatgatcctctaagtgctccagttgatggtccaactcaatggcctttgcgccatctagaagaactcctggaagagctcattgcgattgcgagggttacaaaagggaagcagcggcttcaaatcgaccttacaccctaccgtgattaaaatcaaaggctcagtgatcgcgagctttcacaagtttgcaagtacaattcctctttctcggttctcgctctctagaaagcgaaacagagcggaaaaggcagatgtgaggaagaagatgagcttcgagaaggcacaaaacccagctttgggctttaacttagaaacatggaatttctatcaactggctaattcaagggagcgtagccaaaatgattaactttttctttgcatccctccgtacaaaaggtttaaggaaggaatcacctaaaggagaaagaggaaaacacacctgtaaatgtcgtaattgagatctttggtgaagaggagaggcaaatcttcgcgaagggaggaggagcctggacgctaaagagagaaagtggagagagactatcttcttcaaactcgtagctattggacgatgatgatgatgatgataaagcttggttggaaatgggtttctctttgagtgattttccggtcggaagaaggaaagaaggagagagattggggagaagaaacgccatagctgctggattttagagcttctcttgttcttttgttgttgttttgtcttaatttttcaaggcgacttaagagaatcagagggagaggatgacgagttgagaagagcgaagatgcacgaagaagctttgttggaagataaacagctgctcgttttttgagtggtaatcaaaccttcg

SEQ ID NO: 10238 - DNA, 1605 bp, Arabidopsis thaliana
tgccttcttcactcactctgcagcaacttcgagatcaagttaaaggtcagattccttaattctccatttcttatttgcttcgttgcagagaagaattaggttttcccgatcttcggattctgattctgattttcttttgcgattattggcttggcgataagaatggcggcaacatcactattgtacaatcagctcaaggctgctgaaccattcttcttgttggctggtccaaatgtgattgaatccgaggaacatattcttcgaatggcaaagcacattaaagacatttccacaaaagttgggctgcccctggttttcaagtcaagttttgataaagctaacagaacttcttcaaagtcatttcgtggtcctggcatggccgagggtctgaagattcttgagaaggtgaaggtagcatatgatctaccaatagtaactgatgttcatgaatcaagccagtgtgaagcagttggcaaggttgcagatataattcagattccagcattcttatgtcgccagacagatcttctggttgcagcagcacaaaccggaaaaattatcaatattaagaaaggacaattctgtgctccttctgtcatggagaattcagctgagaagatcagactggctgggaatccaaatgttatggtttgtgaaagaggaaccatgttcggatacaatgatttgatagtagatccacgaaacttcgagtggatgagagaagctaattgtcctgttgtcgctgatataacccattcactacaacaacctgcaggcaagaagttggatggtggtggtgttgcaagtggaggccttcgcgagttaataccatgcattgcaagaacagctgtagcagttggcgtcgatggaattttcatggaggttcatgatgatcctctaagtgctccagttgatggtccaactcaatggcctttgcgccatctagaagaactcctggaagagctcattgcgattgcgagggttacaaaagggaagcagcggcttcaaatcgaccttacaccctaccgtgattaaaatcaaaggctcagtgatcgcgaggttggtgacccaaacgggcatatatgatacgactttctcatcatttaaataatccccacaaaaaaactgtttataatcttctcactttcagtagagactagttgcaaaaagggtgaacgttttaaagaagcaccatgttaatgcatcatctgtcatcactgttcttgtttacaagaagttaagagatcagagattgcttctgaagaactgaaaatgttgggcttctcttatattggcccggcaatattcttattcatttgtctgaaacttttaggtctactcgcggacatttgggtccccatcaaaatcccagagattaaagatgatctagtcagtgatgagcctttgtttctgtttcctccaccaacattcgcttcaaaataattcgaattaagaaagtattgagctctatactatagtcatactcagaaatacggttgtatatgtgtggtttctctctgattttgtacttgggataatatatctgttgaaccctgtaatttctcgtgaacgggatgatagtcgtgcttgatttgcgttggatac

SEQ ID NO: 10239 - DNA, 1400 bp, Triphysaria pusilla
gagtgtatttacaagttaaatttcccgacccgtacaacttgtagcgctggcaactttaccgactaataccatctccgttttccatcagatctgataccaaataatttcttttctattttctcactgttttaaacattttatctcatttatttttggcattttatttatcacctgcatcctgggttgaagatatggattcgtcggcgctgctttacaatcagctcaaggcagcggagccatttttcgtgctagcaggtcccaatgtgattgaatcggaggaacatgttctctacatggccaagcatatcaaagcaatcacttctaaacttggattgccgttggtgttcaagtctagcttcgataaagctaatcggacatcttctaagtcgtttcgtggtcctggtttggaagaaggtttaaagatacttgagaaggtgaaaacgacatatgacattccaatagttactgatgtgcatgagtcaagccagtgtgaagctgttggcagggttgctgatataattcagatccctgcttttttgtgccggcagacagatctacttgtggcagctgccaagactgggaaaattataaatatcaagaaaggccaattttgtgctccttctgtaatggcaaattctgctgaaaagatcagaatggctggaaatgaaaatgttatggtttgtgagagaggcacaatgtttggatacaatgacttgattgttgatccgcgcaacttggagtggatgagggaggccaactgccctattgtggctgatataacacattcgttgcaacaacctgcggggagaaagttggaaggtggaggtgttgccagtggtggtcttcgtgaactgataccatgcattgcccggacagcagttgctgttggggtggatgggatctttatggaggtgcacgatgaccctttaagcgctccagttgatggtccaacacagtggcctcttcgtcacttcgaggagcttctagaagaactcatcgcaattgctagggttagcaagggaaagcaacaatttcaaatcaatctcactccattccgtccataagagctggagcttctcgcacagctggttcttgttatagtgagcatgggccagagggaacaccgaagaggaaccctggggaatggaaatttaccatgcaacataattcattaatcgtatcaataagtcaacttgtatacacttgtcactcgaatactttgtttgttctatttttggcgatgcttggcaagtgttgactgaaaccagagatcctatgtgtaatgtattcatcgccaccggtatttttaggtgtgtgcgctttaacaatgagaaacttgtattactcattcatcggtactatacaatcaggctacaagggcaaatgggaaaaacccgaat

SEQ ID NO: 10240 - DNA, 1238 bp, Triphysaria pusilla
gatatggattcgtcggcgatgctttacaatcagctcaaggcagcggagccatttttcgtactagcaggtcccaatgtgattgaatcagaggaacacgttctctatatggccaagcatatcaaagcaatcacttctaaacttggattgccgctggtgttcaagtctagcttcgacaaagctaatcggacatcttctaagtcgtttcgtggtcctggtttggaagaaggcttaaagatacttgagaaggtgaaaacgacatatgatattccaatagttactgatgtgcatgagtcaagccagtgtgaagctgttggcagggttgctgatataattcagattcctgcttttttgtgccggcagacggatctacttgtggcagctgccaagactgggaaaattataaatatcaaaaaaggccagttttgtgctccttctgtcatggcaaattctgctgaaaagatcaggatggctggaaatgaaaatgttatggtttgtgagagaggcacaatgtttggatacaatgacttgattgttgatccgcgcaacttggagtggatgagggaggccaactgccctattgtggctgatataacacattcgttacaacaacctgcgggtagaaagttggaaggtggaggtgttgccagtggtggtcttcgagagctgataccctgcattgcccggacagcagttgctgttggggtggatgggatcttcatggaggtgcacgatgaccctttaagcgctccagttgatggtccaacacagtggcctcttcgtcacttcgaggagcttctagaagaactcatcgcaattgctagggttagcaaggggaagcaacaatttcaaatcgatctcactccattccgtccataagagctggagcttctcgcacagctggttcttgttatagtgagcatgggccagagggaacaccgaagaggaaccctggggaatggaaatttaccatgcaacataattcattaattgtatcgataagtcaacttgtatacacttgtcactcgaatactttgtttgttctatttttggcgatgcttggcaagtgtcgactgaaaccagagatcctatgtataatgtattcatcgtcaccggtatttttagtgtgtgtgcgctttaacaataagaaacttgtattactcattcatcggtactatacaatcaggctacaagggcaaatgggaaaaacccgaataaaaaacaagaaatctaaatgcttg

SEQ ID NO: 10241 - DNA, 1213 bp, Papaver somniferum
tcaaagatcagaaaaaacaaacgaaaacatgatttcctcagcagatctattcaatcaactcaagtctgcagaacccttttttgtattagctggaccaaatgtgattgaatctgaagaacatatttttaaaatggctaaacatatcaaacacatcaccaacaaggttggtgtgccccttgtgttaaatcgagcttcgataaagctaatcgtacatcgtctaagtcgtttcgtggtcctggtttagaagaaggcttgaagatccttgaaaaagttaaacttgcatatgatttacctattgttactgatgtgcatgagagctggcagtgtgaagctgttggaaaagttgctgatattatccagattcctgctttcttatgccgtcagacagaccttctagttgcagctgcgaagactggaaaaattatcaacattaaaaaaggccaaatgtgttcttcttctgttatggcaaattctgcagagaaggttaggttagctggtaacccgaatgtgatggtctgtgagcgaggcaccatgtttggttataatgatttaattgttgatccccgcaacttggagtggatgcgagaagctaattgtcccattgtagcagatattacacattcattgcagcaacctgcagggaaaaagctggagggtggaggagttgccagtggaggtcttcgcgaattaataccatgtatagcaaggacatcagttgctgtcggggtggacggtatctttatggaggtacatgacgatcccctaagtgcacctgttgatggtccaacgcagtggccgttacgtaacttggaggagctattacaggagctcgtggctattgccagggttagcaagggaaaacaacaattcaaaatagatctcacaccatttcgtgaagatcaatcttgaattcataggaaaaggtttagcgagaaatgacgtagcgaccattttggtgattatgttgaagccaggtgtgattactggaaggcagaccttcagaaaatcaagatcttatattgaagccaacttggatctccacctgcctcaccaccagaaccaggagcgccaccctcttaaacaaattagcttaagtttgtggttcatgtcattgagatttgagatcatatttgtaaccgtgttcttgttagtgttacccattaatggatgaatgaaaaaaccccagctatcaattagatcgaaattttacaaa

SEQ ID NO: 10242 - DNA, 1009 bp, Cucumis sativus
agatctagaccacctgcttccgttgaattggttagcagtaattgtctgaagtctttaattggacataagtaaacgccatggaatcttcgctgctcttcaaccagctccgggctgctgagcccttttttctattggctggtccaaacgtgattgaatcagaggagcatatatttaggatggccaagcacatcaagaatatatcatcgaaatttggtttgccactggttttcaagtccagctttgataaagctaaccgtacatctgcaaaatcctttcgtggtccaggcatggttgaaggcttgaagatacttgaaaaggttaaattagcatatgatatacccatagtgaccgatgtgcatgaatccatacagtgtgaagcagttggcaaagttgcagatattattcagattcctgcgtttttgtgtcgacagactgatcttctagttgcagcagccaagactgggagaattataaatattaagaaaggccagttttgtgctccttctgtaatgacaaattctgctgaaaagatcagaatggctggaaattcaaatgtgatggtttgtgagagaggaactatgtttggttataatgatttaattgttgatcctcggaaccttgagtggatgagagagacaaactgccctgttgttgctgacattacgcattcattgcaacaacctgccgggagacagttgggtgatggaggtgtcgctagtggtggcctacgtgaattaataccatgtatagcgaggacagcagtggctgttggagtagatgggatattcatggaggtacacgatgaccctctgaacgctccagttgatggtccaacacagtggcctttgcgtcatttggaggcactgctggaagagcttgtggcaattgcacgggtgagcaagggtaaacagcgttttaatatcgacttgacgccgtttcgtgattaaaggcacaatggaccataaaaagttcaaggtatgagagctatgatttcaatactccatttttt

SEQ ID NO: 10243 - DNA, 1236 bp, Cucumis melo
ctttctcactcccagctcttccactgccaatcgcacaatcgtccaagatctagaccacctttttccattgaattggttagaagtaattgtctgaagtctttaactgcatataagtaaacgccatggaatcttcgctgcttttcaaccagctccgggcggctgagcccttttttctattggctggtccaaacgtgattgaatcagaggagcatatatttaggatggccaagcacatcaagaatatatcatcgaagtttggtttgccactggttttcaagtccagctttgataaagctaaccgtacatctgcaaaatcctttcgtggtccaggcatggttgaaggcttgaagatacttgagaaggttaaactagcatatgatatacccatagtgactgatgtgcatgaatccatacagtgtgaagcagttggcaaagttgcagatattattcagattcctgcgtttctgtgtcgacagactgatcttctagttgcagcagccaagactgggagaattataaatattaagaaaggccagttttgtgctccttctgtaatgacaaattctgctgaaaagatcagaatggctggaaattcaaatgtgatggtttgtgagaggggaactatgtttggttataatgatttaattgttgatcctcggaaccttgagtggatgagagaggcaaactgccctgttgttgccgacattacgcattcattgcaacaacctgccgggagacagttgggtgatggaggtgtcgctagtggtggcctacgtgaactaataccatgtatagcgaggacagcagtggctgttggagtagatgggatattcatggaggtacacgacgaccctctgaacgctccagttgatggtccaactcagtggcctttgcgcaatttggaggcattgctggaagagcttgtggcaattgcacgggtgagcaagggtaaacagcgttttaatatcgacttgacgccgtttcgtgattaaaggcacaacggaccacgaaagttcgaggtatgagaggcaatgatttcagtactccattttttaaactgattgttcacattgtccctaccaaattagtttggttttgtgtagatacttctgatgtatcttctaaggaatatgttgagtttgtttttcttttacaccagtcatgaatcatgaatcatgaatcatgaatcatttaagccagtttatgatttattattattactatggtctttagatt

SEQ ID NO: 10244 - DNA, 1515 bp, Arabidopsis lyrata
gagaggagatctcagttcccttcttcactcactctgcaacttcgagatcacggcaaagaatggcggcaacatcaccattgtacaatcagctcaaggctgctgaaccattcttcttgttggctggtccaaatgtgatcgaatccgaggaacatattcttcgaatggcaaagcacattaaagacatttccacaaaagttgggctgcctctgattttcaagtcaagttttgataaagctaacagaacttcttcaaagtcatttcgaggtcctggcatggccgagggtctgaagattcttgagaaggtgaaagtagcatatgatcttccaatagttactgatgttcacgaatcaagccagtgtgaagcagttggcaaggttgcagatataattcagattccagcattcttatgtcgccagacagatcttctggttgcagcagcacacaccggaaaaattatcaatattaagaaaggacaattctgtgctccttctgtcatggaaaattcagccgagaagatcagactggctgggaatccaaatgttatggtttgtgaaagaggaaccatgttcggatacaatgatttgatagtagatccacgaaactttgagtggatgagggaagctaattgtcctgttgtcgctgatataacccattcactacaacaacctgcaggcaagaagttggatggtggtggtgttgctagtggtggccttcgcgagttaataccatgcattgcaagaacagctgtagcagttggggtcgatggaatattcatggaggttcatgatgatcctctaagtgctccagttgatggtccaactcaatggcctttgcgccatttagaagaactcctggaagagctcattgcgattgcgagggtcacaaaagggaagcagcggcttcaaatcgaccttacaccctaccgtgattaaaatcaaaggctcagttcagtagtcccgaggttagtgacccaaacgggggatatatgatatgactttctcatcattgaaataattcccacaaaaaaaagaaaaatgtttataactttctcactttcagtggagactagttgcaaaaactgtgaatgtttacagaagaaccatgttaatgcatcagctgtcatcactgttcttgtttacaagaagtaacagaacagagattgcttctgaaaagctgagcttctcttatattggtttggcaattttcttattcatttatttgaaacatttaggtctactcgtcagacatttgggtccccagcaaatcctggagattagaggatccgagtcagtagtgatgagcctttgtttctgtttgctccagacttttgcaatattcacttcaaaaagtaattcgaactaagataatattgagctatataatatatacacagaaatacggttgtatatgcgtggtttctctctgatttgtgtacttggataatatatctgttgaacattgtaataaatttctcgtgaacgggaagcctagtcgtgcttgatttgcgctggatac

SEQ ID NO: 10245 - DNA, 1066 bp, Brassica oleracea
ttgcagcttttcagctttccgaaaagaatggcggcaacatcaccactctacaaccagcttaaggatgctgaaccattcttcttgttggctggtccaaatgtgatcgaatccgaggagcatattcttcgaatggcgaagcacatcaaacacattgccacaaaagttgggttgccactggtcttcaagtcaagttttgataaggctaacagaacttcttctaagtccttccgaggtcctggcatggctgagggtctcaagattcttgagaaggtgaaagtagcatatgacttaccaattgtaactgatgttcatgaggcgtatcagtgtgaagaagttggcaaggttgctgatataattcagataccagcattcttatgtcgccagacagatcttctggttgcggcagctcaaaccggaaaaattatcaatattaagaaaggacagttttgtgctccttctgtcatggaaaattcggctgagaagatcaggctggctgggaatccgaatgtgatggtttgtgaaagaggaaccatgtttggatacaatgatttgatagtagatccacgaaactttgaatggatgagggaagctaattgtcctgttgttgctgatataacccatgcactacaacaacctgcaggcaaaaagttggaaggtggtggtgttgctagtggaggcctacgcgagttaataccctgcattgctagaacagcggtagcagttggtgtcgatggaattttcatggaggttcatgatgatcctctaagtgctccagttgatggtccaactcaatggcctttgcgtcatttagaagaactcctagaggagctcatcgcgattgctagggtcacaaaaggaaagcagcggttccaaatcgatctcacaccttaccgcgactaggattgaaggtctcctcctcggacatatgggtccacggcaaatcctggagacctcattgcggttgcaacctctccgtaaaggatatctgtcatctacttgagcaaagagtgtttatttgtttttgattgctccaaactttgaacatataatatgtttttattcaaaa

SEQ ID NO: 10246 - DNA, 1957 bp, Brassica napus
cagctttttagctttccgaaaagaatggcggcaacatcaccactctacaaccagcttaaggatgctgaaccattcttcttgttggctggtccaaatgtgatcgaatccgaggagcatattcttcgaatggcgaagcacatcaaacacattgccacaaaagttgggttgccactggtcttcaagtcaagttttgataaggctaacagaacttcttcaaagtccttccgaggtcctggcatggctgagggtctcaagattcttgagaaggtgaaagtagcatatgacttaccaattgtaactgatgttcatgaggcgtatcagtgtgaagaagttggcaaggttgctgatataattcagataccagcattcttatgtcgccagacagatcttctggttgcggcagctcaaaccggaaaaattatcaatattaagaaaggacagttctgtgctccttctgtcatggaaaattcggctgagaagatcaggctggctgggaatccgaatgtgatggtttgtgaaagaggaaccatgtttggatacaatgatttgatagtagatccacgaaactttgaatggatgagggaagctaattgtcctgttgttgctgatataacccatgcactacaacaacctgcaggcaaaaagttggaaggtggtggtgttgctagtggaggccttcgcgagttaataccctgcattgctagaacagcggtagcagttggtgtcgatggaattttcatggaggttcatgatgatcctctaagtgctccagttgatggtccaactcaatggcctttgcgtcatttagaagaactcctagaggagctcatcgcgattgctagggtcacaaaaggaaagcagcggttccaaatcgatctcacaccttaccgcgactaggattgtaaggtctcctcctcggacatatgggtccacggcaaatcctggagacctcattacggttgctacctctccctaaaggatatctatcatctacatgagcaaagaatgttgttccctttttgattgctccaaactttgaacatatatttatgtttttattcaaaagttgttcagattaagagtgttattataacatataataactataatgaattctgtttacattcgataggcaaagttgtacaagctcatgggttacacaggtttgcttccctaagtcaaccacatctacatatgcctgcacattgtatgtatattatcattaatgcaagagtgtatatatcatatacatctgagcgtgatcccatgaggctctatgaacatataacaaaacggtcttgcataaggatttggtcttgttgcttgtctagtgtcctttgcacagcttgatagaactcaatccaagaagacgagtacgaagagccaaacatgaatgttggattaggactagcagggcaagcagtgaccaaatccaaaacagaagtggcaggcttgagctggtgagggaagttgaaagccaagttatcaactttatgctcatagattttgccattacggtccagtttatagcgagaagttccctgaaactctcctttggcctcccatggaactctaggcacacctttgagattccaccttatgaggatcatgttctctgatggttgccaaaccctgtagatctcaagagagatatctctgaagagaatcttgccatgaaacctgagtgcccagaagatcagtttgtagttctcaatcccagagaaagtgttcgctggatccaccagtgttatatcatccctgtaaatgtcgtaattgagatctttggagaagagcagaggtaaatcttcacgaagggtgcgtatagctaaaccgagattgatgtagaactcatctttgccatgctgctggtgcttatcttgctcactcggcatggtcttaacctgcgcgcctggagcaggaggagcctggacaggaagagatagaagagagagactac

SEQ ID NO: 10247 - DNA, 1132 bp, Ocimum basilicum
taacaactgagacgacagactgtgtttcatacataccatcaaatctcagatccaacattgcctagatttatcagatccagcgaatttcggtttgattccggatcgagcgcagaaatggactcgtcagctcttctttttaatcagctcaaggcggcggagccgtttttcctgctggcaggccccaatgtgattgagtccgaggagcacattctctacatggccaaaaacattaagtccatcgcttctaaacttggactgccgctggtttttaagtctagcttcgacaaagctaatagaacatcttctaagtcgtttcgcggccctggtttggctgaaggcttgaagatccttgagaaggtcaaaacaacttacgacattccaatagttactgatgtgcacgagtcggctcagtgtgaagctgttggcaaggttgcggatataattcagatacctgcttttttgtgccgacagacagatctgcttgtagcagctgccaaaactgggaaaattatcaacatcaagaaaggccaattttgtgctccttcagtaatggtaaattctgcagaaaagattagaatggctggaaatgaaaatgttatggtttgcgagagaggcacaatgtttggttacaatgacttgattgttgatccacgcaatttggagtggttgagggaggccaattgtccagttgtggctgatataacacattcattacaacaacctgctgggaaaaagcttgaaggtggcggtgttgccagtggtggtcttcgtgaactgataccctgcattgcccggacagcagtagctgttggggtcgatggtatctttatggaggtgcatgatgacccgctgaaggctccagttgatggtccaacacagtggcctctacgtcatctggaggaacttctagaagagctcattgcaatttctcgcgtaaccaaaggaaagaaacagttcaatatcgacctcactccatttcaaccatgagatccagagcgtttcgagtctctacttccatgggcaggcgataaccttggctgtgttttgaccctatcagtattcttccatgatttgcatcagcacccttgattgtatttgtattcataatgtaaaaactatatatttcttccgg

SEQ ID NO: 10248 - DNA, 1293 bp, Daucus carota
tgcgaatcgagattgtgatgatatataaacacacccgcgtttcactcacactctcatccctgtcttgcaactcaaatcttgatcttctccagaaatagttgttgacggtgagaagcgtaagctttacagatggattcagcatcagaattatataaccacctcaagtcggtggagccgtttttcgtattagcgggtcctaatgtgattgagtcggaggagcatatatttcgtatggccgagcacatcaaggctatcacttcaaagcttgggctgccactgatctttaaatccagttttgacaaagctaatagaacatcatctaagtcttttcgtggtcctggcttagccgaaggcttgaagattttggaaaaggtgaaactagcatatgacctccctatagtgactgatgtacatgaagctagccagtgtgatgcagttggccaagttgccgatattattcagattccagcattcctttgcagacagacagatctcttagttgcagctgcgcaaaccggaaagattatcaacattaagaaaggccaattttgtgcaccttctgttatgacaaattctgctgaaaaagttaggctggctggaaatcaaaatgtcatggtttgtgagcgaggaactatgtttggctatagtgatctgattgttgatccacggaacttggaatggatgcgggaagctaattgtccaatcgtagctgatattacacattcattacaacaacctgctgggaaaaagctagaaggtgggggtgttgcaagcggggggcttcgtgagctaataccttgcatagcgaggacagcagttgctgttggagtggatggaatttttatggaggttcatgatgatcccctaagtgctcccgtagatggtcctacacagtggcctctgcggcatttggaggaattgctagaggagcttgtggcaattgcaagggttacgaaaggaaaacaacagttcaagattgatctcactccgttccgtgattaggctccggacctgagacatttctctctggtaattggtccatgtcaggtgatgatttgtctacatagaagttctgtggacttgaagtagcaccttttgagacacgctatcatcagaaattggaatttacgtatctttcttctaaatttttcactccagtttttatgttcagtgtaatctagttatgaaataccgaatcaaattaatagggaatgtgtggtatgatttctgtaatgccgaccgaattgtgttgacataattgggttcaaaatttcaaataaattaatattcccg

SEQ ID NO: 10249 - DNA, 1240 bp, Daucus carota
cgcgactccaatttgattgatcaattcggatcttcatttgaaggaggatctaggctgagaattttaagcttgaaaaatggattcatcggcattgctatataataagctcaagtcagcggaaccattttttgtacttgcgggtccaaatgtgattgaatcagaggagcatgtattaagcatggctagtcacataaagactatcacttcaaaacttggcctgccactggttttcaagtccagttttgacaaagctaatagaacatcatctaagtcttttcgtggtcctggcttagccgaaggcttgaagattttggaaaaggtgaaactagcatatgacctccctatagtgactgatgtacatgaagctagccagtgtgatgcagttggccaagttgccgatattattcagattccagcattcctttgcagacagacagatctcttagttgcagctgcgcaaaccggaaagattattaatattaagaaaggtcaattttgtgcgccttctgtcatgacaaattctgctgagaaagttaggctagcaggaaatcagaatgtcatggtttgtgaaagaggaaccatgtttggctatagtgatttgattgttgatcctcgaaacttggaatggatgagggaagctgattgtccaatcgtagctgatattacacattcattacagcaacctgctgggaagaagctagaaggtgggggtgttgcaagcggggggcttcgtgagctaataccttgcatagcgaggacagcagttgctgttggagtggatggaatttttatggaggttcatgatgatcccctaagtgctcccgtagatggtcctacacagtggcctctgcggcatttggaggaattgctagaggagcttgtggcaattgcaagggttacgaaaggaaaacaacagttcaagattgatctcactccgttccgtgattaggctccggacctgagacatttctctctggtaattggtccatgtcaggtgatgatttgtctacatagaagttctgtggacttgtagtagcaccttttgagacacgctatcatcagaaattggaatttacgtatctttcttctaaatttttcactccagtttttatgttcagtgtaatctagttatgaaataccgaatcaaattaatagggaatgtgtggtatgatttctgtaatgccgaccgaattgtgttgacataattgggttcaaaatttcaaataaattaatattcccg

SEQ ID NO: 10250 - DNA, 1204 bp, Gossypium hirsutum
gtcgggactgataactgcaattgctgaagtttagtatggattcctcggcttcgctgttaaacaagctcatgggtgcggatccatttttcttgttagcgggtcccaatgtgattgaatctgaagatcacattctaaggatggctggctacatcaagactatcactaccaaacttgggttgcctttggttttcaaatcaagctttgataaagctaaccgaacatcatcaaaatcatttcggggtcctggaatggctgaaggcttgcagatccttgagaaagttaaagtagcatatgacattccaattgtaactgatgtccatgaaactattcagtgtgaagcagttggaagagtcgctgatgttattcagattccagcattcttatgtcgtcagacggatcttctagttgaggcggccaagactggaagaattatcaatattaaaaaaggccagttctgtgctccttctgttatggtaaattctgctgagaagattagattggctgggaatccgaatgtgatggtttgtgaaagaggcaccatgtttggctataatgatcttattgttgatccacgtaacttggagtggatgagggaagcgaattgtcctgttgttgctgatatcacacattcactgcaacagccagctggaagaaagttggatggtggaggtgtagccagtggaggtttccgtgaactcataccatgcattgcaagaactgcagttgctgttggagtggacggaattttcatggaggtgcatgataatccattaaatgcaccggttgatggtccgactcaatggccactgcgccatttggaggaacttctggaagagctaattgcaatagctggagtaagcaaagggaagaaacgcttcaacattgatctcacaccctattcaggttaggaagattccaagagttgttcgagtggataagcaggtgattgtttaccgttaaagcacgtttaagtagaaatagcggttgattcttgaatttttcattgttagtaggctgtgtatggtatccaggattttagccccatttgtgatggaaactttcctactctatttatctatggaggagcagtcatgtgttgttaccgcaagtttttcttttctttgtttatttttatattgggatggggaatgaggctacttggaattgaacacaactttccatacctacaaaataatacttcgtc

SEQ ID NO: 10251 - DNA, 1987 bp, Petroselinum crispum
gtctgctctttgcaactcggatcttcattctactaggttgcatttctttctctttactttctgtgtttctatatctcatatatctgtatctatacttggattctatatgtcactaaatagagtgccttttgttaatttctgattctgtgttcattttgttttcttatatttgtattatcatgtttctagtttcaatctacaattaggatttctagtacctagattatgtgtataaagctatgttcatttatattccattcaattattaattgactttccccccgtttaatgctttaagatttagttcatattcttctcatttaaaacagttacattatttttctgttcaaatttgtttaacattgtgtatattctggatcataagaatatttgcatttgtaatcggtcttttttgttgtacggcttacaagttatcaatactccctctggtcctgtattatatgtgttatttgacttttgtacacaaattaaacaaaactttgggacagagggagcattttaaataaaaagaagatgttttttgttctgctagtacgattttaagatttcattcttagatggtgctatgaattttgtgttttagattttctaaacttgcggtttcactgtgggcagaaagagttgttgacgtaagcttgaaaaatggattcagcatcagagttatataaccagcttaagtcagcggagccattttttatattggcgggtcctaatgtgattgagtcggaggaacatatttttcgtatggcaaagcacatcaaggctatcacttcaaagcatgggctgccactgatcttcaagtccagttttgacaaagctaatagaacatcatctaagtctttccgtggtcctggcttagcagaaggcttgaagatacttgaaaaggtgaaactggcatatgacctgcccatagtgactgatgtacatgaagttagccagtgtgatgccgttggtcaagttgccgatataattcagattccagcattcctgtgcagacagacagatctcttagttgcagctgcacaaacgggaaagattatcaacatcaagaaaggtcaattttgtgcaccttctgttatgacaaattctgctgaaaaagttaggctagctggaaatcaaaatgttatggtttgtgagcgaggaactatgtttggctatagtgatttgattgttgatccgcggaacttggaatggatgcgggaagctaattgtccaatcgtagctgatattacacattcattacaacaacctgctggaaagaagctagaaggtgggggtgttgcaagcggagggcttcgtgaactaataccttgcatagcgaggacagcagttgctgttggagtggatggaatctttatggaggttcatgatgatcctctaaatgctcctgtcgatggtcccacacaatggcctctgcgccatttggaggaactgctagtggagctggtagaaatagctagggttacaaagggaaaacaacagttcaagattgatctcactccattccgtgattaggcgcaggactagaggcgtttctctatggtgatgataagttcttctgcatactcaattgtggacttgtggtagcacctatggaaacacgctatcataagaaattggcatccacgtatctttcatttaaatgttatactcccgctttatttgtctagtatatcagcaacaaattattgactgtcttctagcttctccttgtatctgtatgggggaatgcttgtacccaatgttccatgtaatttagatgtgaatgacattgaattaaatgtcaatcacattctacgagggaatgtgtggtatgatttctgtaaaaccgaagactggaaaattgtcaaacattactgaacttgaataaataaatctttctacaaaatccttctctatatatttaatttgaatgaaacaaatctatatataggccatggtagttatactttttaatgcttatcgg

SEQ ID NO: 10252 - DNA, 1467 bp, Aristolochia fimbriata
ggttaagatgtaacttgtattaatgaaatccaatccttaaaaaacttgatattcgggggaaaaaatatgcacttctcctcttctgataattttgcctattaagtctgtcagcctgccaggcagaaaatgagagagagagagagagaaaataaaattactaaagtacgctcgatctatttattttcttattttttacttttacatgaaatccatacgactccacagggttccacgattgaatcgcagaggcgcgatggttgaactctgaagcctttacaggctgctcactctactcggtatcactctcttgaagtcttccggaggttgagcaactcattaaagtacattgccgtcgattttcacaaagcatatcgaagtgctgaagctatggagccatcgttgctgttcaatcagctgaaggccgcagaaccatttttcttgctagcaggccccaatgttattgaatcagaggaacatattttacgaatggccaaacacataaagggtattacctccaaacttggtttaccgctggttttcaaatccagctttgacaaagctaatcgtacatcctcgaaatcatttcgtggccctggtatggaggaaggcttgaagatccttgaaaaggttaaggtggcctatgatcttcccatagtgactgatgtgcatgagacgagccagtgtgaacctgttggaagaattgcagatatcatccagattccagctttcctttgtcgtcagactgaccttctagttgccgctgccaagacagggaaaattgtcaatatcaagaaaggccaattttgtgctccttctgtcatggtaaactctgcagagaaaattagattggcggggaatggaaatgtgatggtttgtgagcgaggaaccatgtttggttataacgacctgattgttgatccacgtaacttggagtggatgagggaagcaaattgtcctgttgttgcagatgttacgcattcgctgcagcaacctgctgggaaaaagctggatggaggtggcgttgctagtggaggccttcgggagttaattccatgcattgcaaggacagctgttgctgttggagtcgatggactctttatggaggtgcacgatgatcccacaaatgctcctgtagatggcccaacacagtggcctctgcgtcatctggaggagctgttggaggagctcatggctatagcaagggtctctaagggaaagaaacaaatgaagattgatttgactccattccgagctcccgaggaaagctaagaagcgccgtgagcgagaatgcgtcaatggatttttctgtaatgcactcttctctactctgtatgttaaaaatagtttatctttttcttttttggttgtaagtttatgataatatttctatgagaaatatatgaattcttctagcaattctataactctcttttatgctgagagggaattatgagtttatgatattta

SEQ ID NO: 10253 - DNA, 1854 bp, Arachis hypogaea
ctcgagctagccgttcctctcaacgccggcgagctcagtccctccctttcgcgctgccacggtcccgccggcgctagatctgtttcaccgcagccactgtcccgttcgaagcccattcgaaggtgctccttctctcggtgtctcccctttcgtgctctgttcaaggcttctagcttcgaaggtgctctctttcgccgccgtcgcgctcacatagaggagaatcatcgcaagcgccgccgtttcctcctcctctcggtcaagccgtcatccacttctctgctgcgccgctgtctacttctcaatcgtcctactcgccgcggtctttgtcatccgcgacactcagtcacgccacatcttccatcttagggacaaactctagcgatggctcaaggcaggagaaatatggaatgactaacaaaccccgaggagagcctgaggatgcgcaacgatcgaacaaaggtgaaagaggtgtcttccgaagtatcaaagtatatccactggaatcaaatgacaagagacttaattatgaaccacctacagatttacttagcaagctgtccctggtttctaaagtgaaaaaacctgcaaaactgccatctaagtgaacgattccattcttcatcaatcaaagtgctcactcttacgttagaccgatctcactctatcttttctcttctcctcatctacgtttagattcggaattaattaaaaaagcttcggaagaaaaaaaaagatgaattcacagtcaatgctgtatagccagctcaaggctgcagaaccattcttcctgttagcaggtcctaatgtgattgaatcagaggaacacattatgaagatggctaagcacataaaaactattacatctaaagttggcgtcccattggttttcaaatcaagttttgacaaggctaatagaacatcatcaaaatcttttcgtggcccagggatggttgaggggttgaagatacttgagaaggttaaagtagcatatgacctccctatagtgacagatgtgcatgagtccgtccagtgtgaagtagtcggcagagttgcagatatcattcaaattccagcattcttatgccgtcaaacagatcttctagttgctgcagccaaaactgggaaaattgtccacatcaagaagggccagttttgtgctccttccgtcatggcaaattcagcagagaaggttcggttggctggaaaatacctaaaatagttaataggtttagtgagagaggaactatgtttggatacaatgatttgattgtcgatccacgtaatctggagtggatgagagaagtcaattgccctattgtagctgatataacacactcactgcaacagcctgctggaaagaagttggatggcggaggtgttgcaagtggaggtcttcgagaactaataccttgcattgcaagaactgcagttgctgtaggagtggaaggaattttcatggaggtacatgatgatccattgactgctcctgttgatggtccaacacagtggcctttacgccacttgaggagttacttgaagagcttgtagctattgctagggtaagcaaagggaagaaaaaattcaacattgatctcacaccatttcgtgaatagtaaaaatggtgatgatttcctgttattaagaatataattctctgaggattggcctttataagatcagattgttttaaggttgaatgtttcgattatctttgcaccccatcacaagttcaagcccttataaaggagagcttatcttgaaagagaaattatttgaagtagtaacatattcaattatcatttgtcacagattctatgtaacctttcaaataattgctgtttctagaagaaatgt

SEQ ID NO: 10254 - DNA, 1256 bp, Amsonia hubrichtii
gttgtaatcttcgatccggaagagatggatgcaccaacggccctttataaccagctcaagactgcgaatccctttttcataatggctggtcccaatgtgattgaatcagaggaacatattttctacatggccaagcacatcaaggccatcactgataaacttgggttgccattggtattcaagtcaagcttcgacaaagctaaccggacttcctctaaatcatttcgcggtcctggcttgacacaaggattgaagatacttgaaaaagttaaagctgcatatgacattccaatagtcacagatgttcacgagacaattcagtgtgaggcagttggtcaggttgctgatataattcagattcctgctttcctatgccgacagacagatctgcttgttgcagccgcccagactgggaaaattatcaatattaagaaaggccaattctgtgcttcttctgtaatgctaaactctgctgaaaaggttaggttggctgggaatcaaaatgttatggtctgtgagaggggaacaatgtttggctataatgatttgattgttgatccacgcaacttggagtggatgagagaggctaattgtccagtggtggctgatgtaacacattcattgcaacaacctgcaggaaagaagcttgaaggtggtggcgtggccagtggaggtcttcgtgaattaataccttgcattgctaggacagcagttgctgttggggtggatggcatttttatggaggtgcataatgatcctctaaatgctccggttgatggtccaacacaatggccccttcgccacctgaaggaactcttagaagagcttatatcaattgctaaggctagcaaggggaaacaacagtttaagattgatctcactccattcctcgattaaaagggttttgaggtttctcctttaacagatggctactatgcctacggatgaaacccagaaacctagatgttggtgcataattgatgaacctccaacgtcgaataatttatggtcttgctgtgtctttagctggattttattgtaaccattacgagctttggatgagagactaggttaacaccattcaacgttaatagctttgctaatctcaagggagggagggttcatgttaggggattgttgtcgttcaaaaggtttatgtttcttaaagaacccaccaaagcccaaagcaatgtaatcagattgatgaatatgattacaagatgttgaggattactatagaatatgaaaatacattc

SEQ ID NO: 10255 - DNA, 1316 bp, Catharanthus roseus
catactctccgctgctaattgcaatagacagtagactgctaatcttcgatctgcaagagatggatgcatcgacggcacttttcaaccagcttaagaatgcggatccctttttcctaatggctggtccaaatgtgattgaatcggaggaacatgttttctacatggccaagcacattaaggcaattgctgctaaacttgggttaccgttggtgttcaagtctagcttcgacaaagctaaccgaacttcctctaaatctttccgtggtcctggcttgtctcaaggcttgaagatacttgaaaaagttaaagttgcatatgacattccgataatcacagatgttcacgagacaattcagtgcgaggcagttggtcaggttgctgatataattcagattcctgctttcctttgccgacagacagatctgcttgttgcagctgcacagactgggaaaattatcaatataaagaaaggccaattctgtgctccttctgttatgctaaactctgctgaaaaagttagattggccgggaatcaaaacattatggtctgtgagagaggaacaatgtttggctataatgatttgattgttgatccacgcaatttggagtggatgagagaggccaattgtccagtggtggctgatgtaacacattcattgcaacaacctgcagggaaaaagcttgagggtggtggtgtagccagtggaggtctccgtgaattgataccttgcattgctaggacagcagtggctgttggagtggatggcattttcatggaggtgcataatgaccctctaaatgctccagttgatggtccaacacaatggccccttcgccacttggaggaacttttagaagagcttatatcaattgctaatgctagcaaggggaagcaacaattcaagattgatctcactccattccttgattgaaaggttttgagatttctcctatcagatgccacgcctatggatggaaccccagaaacgcagatgagagttgcttggtgatggacctctactcgataataatttatgaagtgggtgtctttgtctggatttattgtaagcatgactagctttggaagagctactaaactaaaccattcgatgatagttatgttatatctgcattttgataggctagctaatgttaagagggagagtttggagagacttgttaaaatgacaaggtttttgcctctcagaagaacaccaaaaagttgcaatctgcctaactgcttatcttcatttgctgtgactgagatgttggatggtgagaatatataaaatggccttcttggaaatggaacttaa

SEQ ID NO: 10256 - DNA, 1004 bp, Flaveria ramosissima
accaatcaacaccactcagtgttcgtctcagcgatctgtgttcttaaatcaaggtatcgagattcagttgtccacacttcaagtatggactcatctactgccctattcaaccagcttaaggaagcacagcctttctttgtgttggctggtcccaatgtgattgaatctgaggaacatattttacatatggcgaaacaaattaaggccgtcacttcaaaacttggattgcctttagtttttaagtctagctttgacaaagctaacagaacttcatcaaaatcctttcgaggacctggtttagctgagggattgaagatccttgaaaaggtgaaaacaacgtatgacttgcccatagtgactgatgtacatgaatccgaccagtgtgaagcagtcggcagggttgcagatataattcaaatcccagcttttttgtgccgacaaactgatcttctagttgcagctgccaagactggaaaaattgtaaatataaagaaaggccagttctgcgctccttctgtcatgaccaactctgcagaaaaagttagactggctggaaatcagaacgttatggtttgtgagagagggaccatgtttggatacaatgatttaattgttgatccacgcaacttcgaatggatgcgagaagctaattgtcctgttgtagcagatgttacacatgcattacagcaacctgctgggaaaaagctggaaggtggtggtgttgccagcggaggtcttcgggaattaataccttgcattgcaaggacagcagttgctgttggggttgacggacttttcatggaggtccatgatgatccacttaacgctcctgttgacggtccaacacaatggcctctgcgccattttgaggagctgctagaagagcttatggcaattgctagggttaccaaggggaagcagcaatataaaatcgatctcactccatttcgtgagtaaaactcctgcaggctggttttccatgtgatcaaacagaaggcaagaat

SEQ ID NO: 10257 - DNA, 1432 bp, Gossypium raimondii
tattaaaaaaaattactattatccggagaggagagttttcttagttaatgacttcccgtcgttctcagcatatttgattcgactgtgagtttctcttctttctgtcctctcaccctttttttttctgtcgggactgataactgcaattgctgaagtttagtatggattcctcggcttcgctgttaaacaagctcatgggtgcggatccatttttcttgttagcgggtcccaatgtgattgaatctgaagatcacattctaaggatggctggctacatcaagactatcactaccaaacttgggttgcctttggttttcaaatcaagctttgataaagctaaccgaacatcatcaaaatcatttcggggtcctggaatggctgaaggcttgcagatccttgagaaagttaaagtagcatatgacattccaattgtaactgatgtccatgaaactattcagtgtgaagcagttggaagagtcgctgatgttattcagattccggcattcttatgtcgtcagacggatcttctagttgaggcagccaagactggaagaattatcaatattaaaaaaggccaattctgtgctccttctgttatgataaattctgctgagaagattagattggctgggaatctgaatgtgatggtttgtgaaagaggcaccatgtttggctataatgatcttattgttgatccacgtaacttggagtggatgagggaagcgaattgtcctgttgttgctgatatcacacattcactgcaacagccagctggaagaaagttggatggtggaggtgtagccagtggaggtttccgtgaactcataccatgcattgcaagaactgcagttgctgttggagtggacggaattttcatggaggtgcatgataatcctttaaatgcaccggttgatggtccgactcaatggccactgcgccatttggaggaacttctggaagagctaattgcaatagctagagtaagcaaagggaagaaacgcttcaacattgatctcacaccctattcaggttaggaagattccaagagttgttcgagtggataagcaggtgattgtttaccgttaaagcacgtttaagtagaaacagcggttgattcttgaatttttcattgttagtaggctgtgtatggtatccaggattttagccccatttgtgatggaaactttcctactctattttatctatggaggagcagtcatgtgagttgttaccgcaagttttttcttttctttgaatgactttttatttttatattgggatggggaatgacgctacttgggattgaacacaagttcccatacctacaacataatactttgtcattaggtttctttctttgtatgacttaaataacgctgttgtaatttattttctaaaacattatgattagtaattaaaccctattttgcaa

SEQ ID NO: 10258 - DNA, 1214 bp, Raphanus sativus
gatctcacttgccttcactcgcactcactctgcaacttcgagatcaaaagctaaaaccttacagcttttcttgctttcccgcgaagaatggcggcaacatcaccactctacaatcagcttaaggatgctgaaccattcttcttgttggctggtccaaatgtgatcgaatccgaggagcatattcttcgaatggcaaaacacatcaaacacattgccacaaaagttgggttgccactggttttcaagtcgagttttgataaagctaacagaacttcttctaagtccttccgaggtcctggcatggctgagggtctcaagattcttgagaaggtgaaagtagcatatgacttaccaattgtaactgatgttcatgaggcgtatcagtgtgaagaagttggcaaggttgctgatataattcagataccagcattcttatgtcgccagacagatcttctggttgcggcagcccaaactggaaaaattatcaatattaagaaaggacagttttgtgctccttctgtcatggaaaattcagctgagaagatcaggctggctgggaatccgaatgtgatggtttgtgaaagaggaaccatgtttggatacaatgatttgatagtagatccacgaaactttgaatggatgagggaagctaattgtcctgttgttgctgatataacccatgcactccaacaacctgcaggcaaaaagttggaaggtggtggtgttgctagtggaggccttcgggagttaataccctgcattgccagaacagctgtagccgttggcgtcgatggaattttcatggaggttcatgatgatcctctaagtgctccagttgatggtccaactcaatggcctttgcgtcatctagaagaactcctagaggagctcatcacgattgctagggtcacaaaaggaaagcagcggttccagatcgatctcacaccttaccgcgactagggttgaaggtgtagtaatctcgaggtggtctccctcctcggacatatgggtccacgccaaatcctggagaccttcattgcggttgcaaccactccgtaaaggatatctatcatctacttgagcaaagaatgttatttatttttgatttctccaaactttgaacatatatataagcttttattcaaaatttcttcaatttaagagtgttcaaacatatgataactataatgaagtctgtttacattcgataggca

SEQ ID NO: 10259 - DNA, 1202 bp, Raphanus sativus
ggcacgcgttaaaaaggtgagaagagatctcacttcccttcactcgcactcactctgcaacttcgagatcaaagctaaaaccttatacagcttttcttgctttcccgagaagaatggcggcaacatcaccactctacaatcagcttaaggatgctgaaccattcttcttgttggctggtccaaatgtgatcgaatccgaggaacatattcttcgaatggcaaaacacatcaaacacattgccacaaaagttgggttaccactggttttcaagtcaagttttgataaggctaacagaacttcttctaagtccttccgaggtcctggcatggctgagggtctcaagattcttgagaaggtgaaagtagcatatgacttaccaattgtaactgatgttcatgaggcgtatcagtgtgaagaagttggcaaggttgctgatataattcagataccagcattcttatgtcgccagacagatcttctggttgcggcagcccaaactggaaaaattatcaatattaagaaaggacagttctgtgctccttctgtcatggaaaattcagctgagaagatcaggctagctgggaatccgaatgtgatggtttgtgaaaggggaaccatgtttggatacaatgacttgatagtagatccacgaaactttgaatggatgagggaagctaattgtcctgttgttgctgatataacccatgcgctccaacaacctgccggcaaaaagttggaaggtggtggtgtcgctagtggaggccttcgggagttaataccctgcattgccagaacagctgtagcagttggtgtcgatggaattttcatggaggttcatgatgatcctctaagtgctccagttgatggtccaactcaatggcctttgcgtcatctagaagaactcttagaggagctcatcacgattgctagggtcacaaaaggaaagcagcggttccagatcgatctcacaccttaccgcgactaggattggtctcctcctcggacatatgggtccacggcaaatcctggaaaggttgcaacctctccgtaaaggatacctatcatctactttgagcaaagaatgttatttatttttgatttctccaaactttgaacatatatataagtttttattcaaaatttcctcaatttaagagtgttcaaacatataataactataatgaagtctgtttacattcga

SEQ ID NO: 10260 - DNA, 1328 bp, Fragaria vesca
tctactcgatcagtcactcaaccggtatcactgtgtctctgggttccaattcagctcagtggcagacatggaatcaccagctttgttatacaaccagctcaagacagcagaaccatttttcttattagcaggtccaaatgtgattgaatcagaggagcacattttccgaatggccaagcacataaagactattgcaacaaaagttggattgccactggtgttcaagtcaagctttgacaaagctaaccgtacatcctcaaaatcattccggggccctggcatggctgaagggttaaagatccttgagaaggttaaactagcctatgacctccctatagttacagatgtacatgaatctatacagtgtgaagaagttggcaaagttgcagatatcattcagattcctgcatttttatgccgtcagacagatcttctagttgccgcagccaagactggaaagattgtcaatattaagaagggtcaattctgtgctccctctgtcatggtaaattctgcagagaaggttagactggcaggaaatccaaatgtgatggtttgtgagaggggaactatgtttggttataatgatttaattgttgatccgcgtaatttggagtggatcagagaagctaactgtcctgttgttgctgatgttacacatgcattgcaacagcctgctgggagaaagttggatgacggaggtgttgccagtggtggtcttcgtgaactgataccatgtattgcaaggacagcagttgctgttggagtggatggaattttcatggaggtgcatgatgatccctctaatgcgccagttgatggtccaacccaatggccattgcgccatttggaggaactactggtagagcttattgcaatagctagggtaagcaagggaaagcaacgcttcaacattgatctctcaccctatcgtgattagaagactgatgctacttagatggtgcttatatgtgttcaagtgctctacgttgaggatatgactagctttgtgagggaaattacattctgctagcactttgaagcacacagacagggattatataaatgcaagttggttaccaagactgggcttctgacccatctatttatcattctatgtatattcttgaatatcactagaatggttttggtctcaaactcaaaccttgatccggagaaattgtttctaatggtatactatccgtttttgcattttgtcattgtatactctggtaactctattaagatcaagaccgtgggctgctgcctttgtagatcatggaatatgatgattttctgttttcttcaatccgtttgtttcgcttctg

SEQ ID NO: 10261 - DNA, 1159 bp, Sarracenia psittacina
tggaacgtctcccgacgtccgtccgtctcgtcacttagctcagttgtagatggagtcggcgacaatgctgttcaaccagctcaagtcatcagaccctttttcttattggcgggacccaatgtgattgaatcggaggaacacattctatggatggctaatcacattaaagctatcacttcaaaacttgggttacgactggttttcaagtcaagctttgacaaagccaatcggacgtcttccaaatcatttcgtggtcctgggctttctgaaggcttgaagatccttgagaaagtaaagatagcatatgacatccccatagtgactgacgtacatgaaactatccagtgtgaagcagttggcagagttgctgatattattcagatcccagcgttcttatgccgacagactgatctcctagttgcagcggccaagactggaaaaattgtcaatattaagaaaggccaattctgtgctccttctgtcgtggtaaattctgctgaaaaagttagattggctggaaatgaaaatgtaatggtttgtgagagagggactatgtttggctataatgatttgattgtcgatccacgaaacttcgagtggatgagggaagctaattgtcctattgtggctgatgtcactcattctttgcaacagcctgctggaagaaggctggagggaggtgttatcgccagtggaggtctacgtgaactgataccatgcattgcaaggacagcaagttgctgttggagttgatggcgtattcatggaggtgcatgatgatcctctaaaagctccagttgacggtccaacccaatggcctttgcgccatttggaggaattgctagaagagcttatcacaattgctagggttagcaaggggaagcaacagttcaaaattgatttgactcccttcagtgtttagaaggtaagtctttcgcggcttttctcaagggaaaaaagggcttgctggggttgacgaacaaaatgtttctcatgtcgggtgatcagtttatgactcggatgtgccaacgatccagttcattctatttttttttttttggaatgctacttatttcatcaatgaaggatttgatgtgcgactcctttcacctcccattttgaaggaagtgttccttcttcaaatcaaaggaactgttcc

SEQ ID NO: 10262 - DNA, 1222 bp, Papaver somniferum
aaaactaacgaaaacatggtttcctcagcagatctatacaaccaactaaagtccgcagaaccctttttgtattagctggaccaaatgtgattgaatctgaagaacatattttcagaatggctaaacatatcaaacacatcaccgacaaagttggtgtgccgcttgtgtttaaatcgagtttcgataaagctaatcgaacatcgtctaaatcattccgtggtcctggtttagaggaaggcttgaagatccttgaaaaagttaaacttgcatatgacttaccaattgttactgatgtgcatgagagttggcagtgtgaagctgttggaaaggttgctgatattatccaaattcctgcttttctatgccgtcagacagaccttctagtcgcagctgcaaagactggaaaaattgtcaacattaagaagggacaaatgtgttcttcttctgttatggcaaattctgcagagaaggttaggttggctggtaatccgaatgtgatggtttgtgagcgaggcaccatgtttggttataatgatttaattgttgatccccgcaacttggagtggatgcgagaagcaaattgtcccatcgtggccgatattacacattcattgcaacaacctgcagggaaaaagctggagggtggaggagttgcaagtggaggtcttcgagaattaataccatgtatagcaaggacgtcagttgctgtcggggtggatggcatctttatggaggtacatgacgatcccctaagtgcacctgttgatggtccaacgcagtggccattgtgtaacttggaggagctattacaggagctggtggcgattgctagggttagcaaaggaaaacagcagttcaaaatagatcttacaccatttcgtgaagattagtcttgaattcatcggaaaagatttagccagaaaagcgttgtagccaccattttagtgataatgtttttccacagtttaaacttatctctgcaccgagaaaaggaaatattgaggaatgtaatttctgtctatcctagcagtttcgtcccccatataagcaattcatttacatgaacttcccagttttgggtttgttaaagaccttgtaaaattgtaatgtcattctgttttttctattgtaatgtcactcagtctttaatgtttggccttgtaatgcaagatcaatttttgtttgtatcccaatacttcataatggattttgccaggatcaa

SEQ ID NO: 10263 - DNA, 1350 bp, Amorphophallus konjac
ttcagataccggttcggttttgataacattgccaggttcacctccattagtaaacgccgggagacgaggcacaagagcaacgtgttgcggacgaagagacgcagtcagagcctgcgcgaaagagagagaccagggtttagctgcagcgtcaactttgggtgcgggactctgacagcgatggacgcctccacagcgctatttaatcagctgaaggttgctgaaccattcttcctattagcaggccctaatgtaattgagtctgaagagcatgttctgaagatggccaaacatataaagagtatcgcatcaaagcttggcttgccactggtcttcaagtcaagctttgacaaggctaatcgcacttcatcgaaatcatttcgtggccctggtttggttgaaggtctgaagatccttgagaaggttaaaatagcttatgacatccccattataacagatgtacatgaggctagccagtgtgaacctgttggaagagttgctgatattatacaaattccagctttcctctgccgccagacggaccttttagttgcagctgccaagacagggagaattatcaacatcaagaaaggacaattttgttctccttctgttatggtaaattctgcggagaaagttagactagcaggcaaccagaatgtgatggtttgcgagcgagggacgatgtttggctacaatgacttgatagttgatccacgtaacttggagtggatgagggaggccaactgccctgtggtagcggatgtcacacattcattacaacaacctgctgggaaaaaactcgaaggtggcggtgttgcaagtggaggtcttcgtgaattaataccctgcattgcaaggacatgcattgcagttggggtagatggaatcttcatggaggtgcatgatgatcccttgagtgcacctgtggatggccccactcaatggcctttgaggcacttggaggagctgcttggggagctcatctctatagcaaaagccagcaaaggaaaacaacctttcaaaattgatctcactcccttcggcaaatcagtctgaagccagcaccatcttgtcagtccattaggatcacgaatttgctgattattgtgcactgttctcattgttggtttctcagttgatacctcacgcaatgttctatttggcaaatattgctaagttgttcccgcatacttcatattcatgtgccataaattagaaacaagcagttcgttgttgagaatcatgggaagcagtggatctgattcaagatggcccgacgggataacagccagttgtatggaaagaatctgagtgaagattgaataaatattgaagagggagcagttttac

SEQ ID NO: 10264 - DNA, 1028 bp, Cichorium intybus
gatttgtaggatatggactcatcaactgcgttatacaaccaacttaagggagcacaaccattcttcgtgttagctggtcccaatgtgattgaatcagaagaacatattttacatatggcaaaacaaatcaaggctgtcacttcaaaacttgggttaccattagtgttcaagtcaagctttgacaaagctaacagaacttcatcaaaatcttttcgtgggcctggattagctgagggattaaagatccttgaaaaggtgaaagccacatatgacttacccatagtgaccgatgtacatgaatctagccagtgtgaagcagtcggcagggttgcagatataattcaaattcctgcatttttatgccgacagactgatctcctagttgcagctgcgaagacgggtaaaattgtaaatataaagaaaggccagttctgtgcctcctctgtgatgaccaattcagcagaaaaagttagattggctggaaatcaaaatgttatggtttgtgaaagagggaccatgtttggttacaatgatttaattgttgatccacgcaactttgagtggatgcgtgaagctaattgccctgttgtagcagatgtgacacatgcgttacagcaaccagctggaaaaaagcttgaaggtggtggtgttgcgagtggaggtttacgggaattaatcccgtgtgttgcaaggacagctgtcgctgtgggagtggatggactttttatggaggtacacgatgatccgcttaatgctccggttgatggtccaacacaatggcctttgcgacatttggaggagcttctagaagagcttgtggcaattgctagggttagcaaaggaaagaagaaattcaaaattgatcttactccattccgtgggtagaaagtttgcgatgataaacacctttctgttgattttgtttacactttgatattgaatgttggatatgtatttgtaatttagaatctgagaaccaaataaaatcaattacaataagctgagaaccaaaatcaattacatgaacc

SEQ ID NO: 10265 - DNA, 1394 bp, Vitis vinifera
cttatccttcagcgtgagaaagatgtcattctattgaaattccccatatcttatatccaaatcacaactctaagttcgacttagattcttggaattcacttcagttgagcaaagctcttgaatttctcagagaaaactttgaattttctgagttttttttttttcttttaggttttcttcttcagttgattctgaattttgtgtgtaaaaaaccatggattcttcaacaatgctgtacaaccagctcaagtcatcagaaccctttttcttgttggctggtcccaatgtgattgaatctgaggagcacattatgtatatggccaaagccatcaagagtctcacatcaaaatttgggttgaagctggttttcaagtcgagctttgataaagccaatcgaacctcctcaaaatcatttcggggtcctggcatgattgaaggcctgaagatccttgagaaggtcaaagtagcatatgacatccccatagtgactgatgtacatgaaattgaacagtgtgaaccagttggcagagttgcagacatcattcagattccagctttcctctgtcgtcagacagatctcctagttgctgctgccaagactggaaaaattatcaatattaagaaaggccaattttgtgctccctctgtcatggtaaattctgctgaaaagatcagattggctgggaatgaaaatgtgatggtttgtgagaggggaactatgtttggctataatgatctgattgttgatccacgcaacttggagtggatgagggaagctaattgtcctattgtggcagatgtcacacattcactacaacagcctgcggggagaaaactggaaggcggaggtgttgccagtggaggtcttcgtgaattgataccatgcattgcgaggacagcagttgctgttggagtggatggaattttcatggaggtgcacaatgatcctctaaatgctccagtcgacggtccaacacaatggcctctacgccatttggaggaactgctggaagagcttgtggcaatagctagggtaagcaaggggaagcaacgcttcaacattgatctcacaccagtccatgattaagaagctctttgaggcttttctcaagggtgatcgtttggatattcactcaacatggtaggaggtgaaggcaccttctgagtaggcgactgcttgcaggttggcgttgtctatctgctttaaaccatgcagactgcaatgccctttttcgggtactagaccagctttatatgtatgtgaaccaaacccagatcttgttgtggatcaaatttgttcatgttgagtgacaagaatttacgatgatcgggaaatatgtgaatctaaatcctataataataaattttttatttatattctcattttaaaaaaa

SEQ ID NO: 10266 - DNA, 1355 bp, Tropaeolum majus
accttacggacaccactgttttcatcttcatcgtcgtagataagtcgcaccgccattgcatccgcttctcttctcagttccgtaacctagctttccgacattcgagctatcgttgtttcccaagctttgtgctaggtggaagagatggattcttcgacactattgtataaccagcttaaggcagctgaaccatttttcctattggctggacccaatgtgattgaatccgaggaacacgtgctacagatggctaagcagataaagaacatcacaacaaagcttggtgtgcctctggttttcaagtcgagttttgataaagctaatcgaacatcctcaaaatcattccgtggtccaggcatgatggagggcttgaagattcttgagaaggtaaaaacggtatacgatataccaattgtaacagacgtacacgaaacaatacagtgtgaagcagttggaagggttgcagatattattcagataccagctttcttatgtcgtcagacagatcttctagttgctgcagctaagactggaaaaattataaacattaagaaaggccagttctgtgctccttctgtcatggtaaattctgctgagaaggtcaaattggctggaaattcaaatgttatggtctgtgaaagaggcactatgtttggctacaatgatttgattgttgatccacgcaatttggagtggttaagggaagcccattgtcctgttgttgctgatatcacacattcattacaacaaccagctggaaaacagttggatggtgggggtgttgccagtggaggtcttcgagagctaataccatgcattgctaggacagcagtagctgttggagttgatgggcttttcatggaggtgcacaatgatcctttaaatgcaccagttgatggtccaactcaatggcctctccgccatttagaagaattgctggaggaactcatagcattagctagggttagcaaggggaagcaacctttcaacatcgatctcacaccatccgatatataggaaatgcagtgtgatgctttcactcgaagggtaagtaagattagtagcatatcaggcttcagcatatttgtctattaactgccgatatttcgttatgatacgcaagctactcgttctgcagaccctgcaactttgtatgtgttatcttttttgatttgaagctagaagtcatgtttcgattaaaatattattgagatcatacattctaacatcctaatacttcatcctaactataagggttgcggtatgaaccattgttgatggtcccctaagacctccaataccaataacatttagcttaccgatgtgttagaagtcttgcgttgtgtaatattata

SEQ ID NO: 10267 - DNA, 1264 bp, Elaeis guineensis
cctctttctccttctcgtctttccagaaaatccaagtctttttgttctctcggaagattgaaagggccggggattgaagagatagcgcgattcgtctctcagggaagtctttgagatctccgagctcgtagacgacctctgaatcgagtaaggtctcttgcatcacatcaagacatggagtcttctgtggcactttacaaccaactcaaggctgcagagccatttttcttattagcgggccctaatgtaattgaatctgaggagcatatactctacatggccaaacatataaaagatgtcacatctaagcttggtgtaccgctggttttcaagtccagctttgacaaagctaatcgcacttcttcaaaatcatttcgtggcccagggttggaagaaggcttgaagatccttgagaaggtgaaactaacatatgatctcccaattgtaactgatgtgcatgagagtagccagtgtgaagctgttggaagagttgctgatattatccaaatacctgctttcctttgccgccagacagaccttctagttgcagctgccaagactgggaaaataatcaacattaagaaaggccaattttgtgctccttctgttatgttaaattctgcagagaaggttagacttgctggaaaccaaaatgttatggtttgtgaacgaggcaccatgtttggctacaatgatttaattgttgatccacgcaatctggagtggatgagggaagcaaattgccctgttgttgcagatattacacattcactacaacaacctgctgggaaaaagctggaaggtggaggtgtcgcaagtgggggtctgcgtgaactgataccatgtattgcaaggacagcagttgcagttggagtggatggaatattcatggaggtgcatgacaatcccctaaaagcgcccgtcgatggcccaacacaatggcctttgcgccacctggaagagctactagaagagctcatagcaatagcgagcgtcagcaaggggaaaaagccattcaagatcgatctcacaccctatcaagattaatctgaatctaccaggatgaaagcactgcaagttgtattgcagtttatccactattcatgcattagagatgtatctctagaatccaataaattttcatcttccctttttttccctttgcggtatgacaggatgatactatgatattacatgtcaggccatatgcatttgttgtcaaatttatgttgttcaagctggtacttgcagctcactttggcat

SEQ ID NO: 10268 - DNA, 2267 bp, Prunus mume
aattaggttcattgcattggaaataggacggggagaaaaaacagaggttttgcctcctatgggatcaaatcatcaatgcagtgatacctgctgcgatcccctccctcccccactgaagccatcttctcttgctccctgggattaatagattcattcttgcttcttcacctttggtgcctttgcaaacagaagaagaactatcggagctcgcatcaaccaacctaaattctctctctctctctctctctctcccattgcaacccacctccacatcccctttttccccagttctccttctccccttttgactcttttttttaattcaatcgggaaagcttcaaacagaggcttcagcaaaggtgttctcccaggaacgccgcacatcctcttcgatcttgacaagctagtgatttgggtttgtttggttgcagaaattaggtaaccccatgaggaatcggagcagatagaaagggctctatgggtcaactgattgagtgttcaattgggtattgttgttggtgtcgatacggttggtggtggtgacagtgaggttgggcgatgacagtgcgaagatttagttctgcgatggtttagctcggactcgcgaattcaatatagcgtgggtattatattgcgagccgcttttcgagctcgctaaattagaggagcgagtgagggggattattcatcgctaatgagaagctcttatcagcaaacaatgagtgagcccacttttcagaagctcgttgtaatggggttactagcccaaattacaagttaaaaaggctgagaattttctgagttgggcctccaacgttttttggaccttcacattacacacagtcgagcgcgcacgcacactctcatacagcacagcttcagtgacagtgacagagagtcggtgacagagatatttcataacactatctgggtaactcgtctctgcttctataccattactcactgaagctctccctgtttttgtgattaaagtgagcgaagtggcaaagatggatgcatcaacagtgttatataaccagctcaaggcagcagaaccatttttcttattagcgggtcccaatgtgattgaatccgaagagcacattttccggatggccaagcacataaagcatgttgcaacaaaagttggattgccactggttttcaagtcaagctttgacaaagccaaccgtacatcctcaaaatcattccggggtcctggcctcactgaaggcttaaagatccttgaaaaggttaaagtagcatatgacatccctataattacagatgtgcacgaagctagccagtgtgaagaagttggtaaagttgcagacattattcagattcctgcatttttgtgccgccagacagatcttctagttgcagcagccaagactggaaaaattatcaacattaagaaaggccaattctgtgcaccttctgtcatggtaaattctgctgagaaggttagactggctggaaatccaaacgtgatggtctgtgaaaggggaactatgtttggctataatgatttaattgttgatccgcgcaatttggagtggatcagagaagctaattgtcctgttgttgctgatgtaacacatgcattgcaacagcctgctgggagaaagttggatgatggaggtgtagccagtggtggtcttcgtgaattgattccgtgcattgcaaggacagcagttgctgttggagtggatggaattttcatggaggtacacgatgatccttctaacgcgccggttgatggtccaactcaatggcccttgcgccatttggaggaactgctggtagagcttgtagcaattgctagggtaagcaaggggaagcaacgcttcaacattgatctcacaccctatcgtgattagaagacttgaagctacactattggtatacgcctgtgttcaagtaatacatgttaaagtgatagctagctctgtagggggtgacattttgccacatccccactggatgagctggtgataatgtttgtgcagaccaggatcaaatatgagataagatgctgtccttcgccgggctatgccatcatttatttatcattgtattcatgaattcatagcagtttgaagggtttatgaaatgattatttttgttttcttcaatcatttggtttacttccctttaatctgtgatgtttatgcatattaagagaataattaattttgtgttcctacacttcttcagggttttggaaagcgtaggaatgaaatcatatttttttgtcataataa

SEQ ID NO: 10269 - DNA, 1170 bp, Tragopogon dubius
ggggttaccgacagtaatcaaagagcattactgagcaaggcgtactactcagtagcttcaccactcaccgatcgtcggagcgatctctgttcttccaatccagaaaggtgtaaagatttagttttccacaatatggactcatcaactctgttgtataaccagcttaaggaagcacaaccgttctttgtgttagcgggtcccaatgtgattgaatctgaagaacatattttacatatggcaaaacaaatcaaaaccatcacttcaaaacttgggttgccattagtttttaagtcaagttttgacaaagctaacagaacttcatcaaaatcttttcgagggccaggattagctgaaggattgaagattcttgaaaaggtgaaaatgacatatgatttgcctatagtaactgatgtacatgaatctagccagtgtgaagcagtaggcagggttgcagacataattcaaattccagcattcttgtgtcgacagactgatcttctagttgcagctgctaagacgggcaaaatcgtaaatataaagaaaggccagttctgtgcaccatccgtcatgagcaattcagcagaaaaagttagattggctggaaatcaaaacgttatggtttgtgaaagaggcaccatgtttggatacaatgatttaatcgttgatccacgcaattttgagtggttgcgagaagctaattgccctgttgtagcagatgtgacacatgcgttacggcaacctgctgggaaaaagctggaaggtggtggtgttgccagtggaggcctccgggaactaataccttgtgttgcaaggacagctgttgctgtgggagtcgatggacttttcatggaggtgcatgacgatccacttaatgctccggttgatggtcctacacaatggcctttacgtcatttggaggagctgctagaagagcttgtggcaattgctcgggttaccaaggggaagcaaacatacaaaattgatctcactccatttcgcgagtaaaaagttgtggaggctgatagaaccatatattttgagaaacaagtcttattgaattcatggtgtgtattaatatctaaatattagtgtcgtgtaatttataccttaaggcttaaacttgtgatactttaaacataattactttgaattgatttgtgtgtttagagt

SEQ ID NO: 10270 - DNA, 1244 bp, Amborella trichopoda
cttttttttctctctattatctcttctttctttctttacttttatttctctaacttttaacacagcacagcgacatcaccagatcaagagaaggaaacgctccatcctttttccttgagagatggattcaactgctctcttcaaccaattgaaggcggcagaaccatttttccttttagctggtcccaatgttatagaatctgaggcgcatgttctgaagatggctggacatattaaggacatcacctcaaagcttggggtgcagttggttttcaaatccagctttgacaaagctaatcgtacatcgtcaaaatcattccgtggtccaggcctagaagaaggcttgaagatccttcaaaaggtcaagatgacttttgatcttcctattgtgacagatgtgcacgaggcaagccagtgtgaacctgttgggagggttgctgatatcattcagattccagcttttctatgtcgccagacagaccttctagttgcagctgcaaagactgggaaaatagtcaatattaagaaaggccaattttgtgctccttctgtcatggtaaattctgcagaaaaggttcgattggcagggaatcaaaatgtaatggtttgtgagcggggcaccatgtttggctataatgatttgattgttgatccccgcaacttggagtggatgagagaagcaaattgtcctgttgttgcagatattactcattccttacagcagcctgcaggcaaaaagctagatggtggtggtgttgcaagtggcggtcttcgtgaactcataccctgtattgcaaggacatcagttgcagttggggttgatggtatcttcatggaggtacatgatgatccgctgaatgctccagttgatggtccaacacagtggcctctgtgccatttggaggagctacttgaagagctcattgcaatttcaagggtcagcaaaggaaaacaaccattcaagattgacctcactccatttcgtggctaaggtatgacttgtaatagattttcacacaatgatctctgttgagttacatgtaggaaatgccgtttgatttattcatctgaaaagaaaaaacaaaaggttatatttatgatgtctatgcttgaatgaaacaatttagaacatatgaacttgaagccaattctgtaatgaacctcttttgaatgagtggttgaataaaatagatttccgttagcttacattcaaccaagaaaggagaaaatatacttttaactct

SEQ ID NO: 10271 - DNA, 1238 bp, Plantago ovata
cacaaatcagagatccaaaacgacgcagtgtagttacagacatggatcctgcaatgctcttcaatcaactcaagaccgcagagccgttcttcgtgctagctggtccgaatgtgatcgaatcagaggaacacattctccacatggccaagcagattaaggccatcacctctaagctaggattgtctttggttttcaagtcgagctttgataaagctaatcgaacatcctctaagtcgttccgtggtcctggactggaagaaggactcaagatccttgagaaggttaaaatgacctatgaccttcctattgtaactgacgtgcacgagtcaattcagtgtgaagcagttggaagggttgcggatataattcagatccctgctttcttgtgccggcagacagatctgcttgtggcagctgctaagactgggaaaattatcaacataaagaaaggccaattttgtgcaccttctgtcatggcaaattcagctgaaaaggttagaatggctgggaatgataacgtcatggtttgtgaaagaggcacaatgtttggctacaatgatttgattgtcgatccacgcaacttggaatggatgagggaagcaaactgtccagttgttgctgatatcacacattcactacaacaaccagcagggaaaaagctggaaggtggtggtgttgctagtggaggtctgcgtgaattgataccatgcattgccaggacagcagtagctgttggggtggatggaatctttatggaggtacatgataacccattagcagctccagtagatggtccaacacagtggcctcttcgccatttcgaagaactacttgaagagttggtggcaatcgctggagttagtaagggaaagaagaagtttgaaattgatctcactccttacagtttatagagtcggagcagcactgttgtctgcatttccttgcacatagcctacaatgcaggtattctcacaaattctgatattggtgcttggagtaagagacaggcacatgttaaactaaactttgcatgatatgcaaaaatctataaacagtttttattcaaagctccaggaatcttgacatgttatgtattgttgtttgaatgtcaatagtgtgaactgaacgcgattgtatcaacatattaagagaatatttttgtgctagattactagcacgctctcagtttatgtaatttaagaagtgattaagtgggactgggaatctgaacttctgta

SEQ ID NO: 10272 - DNA, 901 bp, Eutrema halophilum
gagctctacgagaaataatggcggattcatcttcattactgtacaatcaactcaaggttgctgagccctttttcttgttggctggtccaaatgtgatcgaatctgaggaacatgttcttcgaatggctaaaagcataaaagatatttccacaaagcttgggctgcctctggtttttaagtcaagttttgataaagctaacagaacttcatcaaagtccttccggggtcctggcatggctgagggcctcaagattcttgagaaggtgaaagtagcatatgatctaccaatcgtaaccgacgttcatgaatcgagccagtgtgaagcggttggcaaggttgcagatataattcagataccagcattcttatgtcgccagacagatctgctggtcgcggcagcccaaactgggaaaattatcaatatcaagaaaggacagttttgtgctccttctgttatgggaaactcggctgagaagatcagactcgcagggaatcctaatgtgatggtttgtgaaagaggaaccatgtttggatacaatgatttaatagtagatccacgaaatctggaatggatgcgagaagctaattgtcctgttgtcgctgatataactcattcattacaacaacctgcaggcaagaagttggatggtgggggtgttgcaagtggaggccttcgcgaattaataccatgcatagcaagaactgccgtagctgttggtgtcgatggaattttcatggaggtgcatgatgatccgttaagtgcaccagtcgatggtccaacacaatggcctctgcgtcatctagaagaactgctagaagagctcatagcaatcgcgcgtgtcacaaagggaaaacagcggttccaaatcgatttgacgccttatcatgattagaatcaaag

SEQ ID NO: 10273 - DNA, 1346 bp, Malus domestica
agtttcgcctctgcttcttcctgcaccctcactcactgaagcgctctctccctgttttcgcgattgaagtgagttgtttgtttgtattgtttcagctaagtgggaagatatggattcatcagttctgctatataaccagctcaaggcgaccgaaccgtttttcttgttagctggtcccaatgtgattgaatccgaggagcacattttccggatggccgagcacattaagagtgttgcaacaaaggttggattgccactggttttcaagtcgagctttgacaaggccaaccgtacgtcctcaaaatcattccggggtcctggcttggaagaaggcttaaagatccttgagaaggttaaaacagcatatgacctccctataattacagatgtacatgaagctagccagtgtgaagcagttggtaaagttgcagatattattcagattcctgcatttttatgccgccagacagatcttctagttgcagcagccaagactggaaaaattatcaatattaagaagggccagttctgtgctccttctgtcatggtaaattctgccgagaaggttagactggctggaaatccaaacgtgatggtttgtgagaggggaactatgtttggctataatgatttaattgttgatcctcgcaatttggagtggatcagagaagctaattgtcctgtggttgctgacgtcacacatgctttgcaacagcctgctgggagaaagttggacgatggaggtgttgccagtggtggtcttcgtgaattgataccgtgcattgcgaggacagcagtcgctgttggggtggatggaattttcatggaggtacatgatgatccttctaacgctccagttgatggtccaactcaatggcccttgcgccacttggaggaactgctggtagagctcatagcaattgctagggtaagcaaggggaagcaacctttcaacattgatctcacaccctatcgtgattagaagacttgaagctactctattggtatttatctgtgttgggggaaggggagtgacattgtaccgcagcctcccccgttcgatgagccgcaatgtttacacttgaaggcatgcagaccaggatcaaatgtgagataagatgctgtccttcttggatttgccagcacttgtttatcgttgtaacttgtattcatgaattcattagtactgcgctcggactaattgtttctcttgacccgaagatattgtttgtcatgatattcgtgtttgtgttcctcgttaaatgtccgtacattttattcaagaacttggagttccgactatgtaccttgtcgcttaagaaatgaagaattatgtttttcttcaa

SEQ ID NO: 10274 - DNA, 1245 bp, Arnica chamissonis
caaatacaaaagcgtcaaatccatcccggcccgaatcgaccgacagaaaggagtcctatcgagtccagtttcaccgatccccaccactcagtggtcgtcgcagcgacctcaattctccaatccagaaaggtgtggagatttagttgttcacacttcaaatatggactcatcaactgcgctatacaaccagcttaaggaagcacagccgttctttgtgctggctggtcccaatgtgattgaatctgaggaacatattttacatatggcgaaacaaattaaggctgttacgtcaaaactcggactgccattagtttttaagtctagctttgacaaagctaacagaacttcatcaaaatcctttcgagggcctggattagccgagggattgaagatccttgaaaaggtaaaaacaacatacgacttgccaattgtcactgatgtgcatgaatctaaccagtgtgaagcagtcggcagggttgcagatataattcaaattccagcttttctgtgtcgacagactgatcttctagttgcagctgccaagactggaaaaattgtaaatataaaaaaaggccagttctgtgctccctctgtcatgaccaactctgcagaaaaagttagattggctggaaatcaaaacgtcatggtttgtgagagagggaccatgtttggatacaatgatttaattgttgatccacgcaacttcgaatggatgcgagaagctaattgtcctgttgtagcagatatcacacatgcattacagcagcctgctgggaaaaagctggaagggggtggtgtcgctagtggaggtcttcgtgaactaataccttgcattgcaaggacagcagttgctgttggagtggacggacttttcatggaggtgcatgatgatccacttaatgctccagttgatggtccaacacaatggcctctgcgccattttgaggagttgctagaagagctaatggcaattgctagggttaccaagggaaagcagcaatacaatattaatctcactccatttcgtgagtaaaacctcaacggaaggcaaggttctgcgctgaggtcagatgtgcctgaacgtatgaaagattacaacatcataatctattagttgatgtcttagcatctatgatttgagaaatacactgttgttatacttgtgttgtgtataatctacatattagtttatggttcgggcacatggttgttcctttcattgtaggggtcattatcttgtagccg

SEQ ID NO: 10275 - DNA, 1363 bp, Artemisia annua
cactcactcaatcactgatcactgcttcgatctctcttcttcaatccatattatttttacgatttaataattcttcaaagatatggactcatcaactctgctatacaaccagcttaaggaagctaagcctttttttgtgttggctggtcccaatgtgatcgaatccgaggaacatattatgtatatggccaaacaaattaaggctgttactacaaagcttgggttgccgttggtttttaagtcgagttttgacaaagctaacaggacttcgtcaaaatctttccgagggcctggattagccgaaggattgaagatcctcgaaaaggtgaaaatgacatatgacttgcccatagttactgatgtacatgaagccagccagtgtgaagcagtcggcagagttgcagatataattcaaattccggcctttttgtgccgacagactgatcttctagttgcagccgccaagactggaaaaatagttaacataaagaaaggccagttctgtgcttcctctgtcatgaccaactctgctgaaaaagttagattggctggtaatcaaaacgttatggtttgtgagagaggaaccatgtttggatacaatgatttaattgttgatccacgtaacttcgagtggatgagagaagctaattgtcctgtcgtagcagatatcacacatgcgttacagcaacctgctggtaaaaagctggaaggtggtggtgttgcgagtggaggtcttcgggaactaataccgtgcgttgcaaggacagcagttgctgttggagtggatgggcttttcatggaggtgcatgatgatccacttagtgctccagttgatggtccaacacaatggcctctacgccatttcgaggagctgctagaagagcttgtggcaattgctagggttaccaaggggaagcagcaattcaaaattgatcttactcctttccgcgagtaaagtgttctggagaccggttttcccaatgtgcctgaatatgtgaaagatctcaacattataatctattcatacttaatttacatttttgtcagattcatggtctgtatcagtatctagtttttacactgtgttcttgagttttttcagtaaagaaaagtaaagtaataagaagtaaacattttcagcccacttttgggatgcaacactttactttcaaaatcaaccaaattacactacttttcactctttttccttttcttttccttcttaagtgaaactcaagaacacaactttttctatttcttttcattttcttttttaatggagacttgagaacacaggtgttgtgtaattcagaataaacaaacagatgtaaagcctcggcatttatgatttatttcattgtgg

SEQ ID NO: 10276 - DNA, 1272 bp, Chrysanthemum coronarium
ccgagccgacccaacccaaccgacaacgatgagaatgacaccagccagccagcgtgcgactcatgtgtgaccatgagcaataagattagctaccactcagactcactcactcactgatcatctatctgcttcgatctctattcttcaatccatattattttcacgatttaaatcaaagatatggactcatcaactctgctatacaaccaccttaaggaagcacagccgtttttcgtcttggctggtcccaatgtgatcgaatccgaggaacatattatgtatatggccaaacaaattaaggctgttactaccaagcttgggttgccattagtctttaagtcaagttttgacaaagctaacaggacttcatcaaaatcgttccgagggcctggattagccgagggattgaagatcctcgaaaaggtgaaagtgacgtatgacttgcccatagttactgatgtacatgaatccagccagtgtgaagcagtcggcagagttgcagatattattcaaatcccagcctttttgtgccgacagactgatcttctagttgcagccgctaagactggaaaaatagtaaacataaagaaaggccagttctgtgcttcctctgtcatgaccaactctgctgaaaaagttagattggctggaaatcaaaatgttatggtttgtgagagaggaaccatgtttggatacaatgatttaattgttgatccacgcaacttcgagtggatgcgggaagctaattgccctgttgtagcagatatcacacatgcattacagcaacctgctggtaaaaagctggaaggtggtggtgttgcgagtggaggtctccgggaattgataccttgtattgcaaggacagcagtcgctgttggtgttgatggacttttcatggaggtgcatgatgatccactcagtgctccagttgatggtccaactcaatggcctttacgccatttcgaggagctgctagaagagcttgtggcaattgctagggttaccaaggggaagcagcaatacaaaattgatctcactccataccgcgagtaagaagtgaaggctgttcttcctgaaagaaaggtgcatgatttgagaacaaattactgaaacataattttgcacagttaatgagtatattatgatattcacatgaatcaaatgcctactgatttcaggcaagatcctgctctgacatcagatgtgctgaacgtgtgaaagattacagcattgtattctattcattgacaatttggaatctattgttcgaga

SEQ ID NO: 10277 - DNA, 1167 bp, Chrysanthemum coronarium
atcatctgcttcgatctctcttcttcaatccatattatttttacgctttaattcttcaaagctatggactcatcaactctcctatacaaccagcttaaggaagctaagcctttttttgtgttggctggtccgaatgtgatcgaatccgaggaacatattatgtatatggctaaacaaattaaggctgttactacaaagcttgggttgccgttagtttttaagtcgagttttgacaaagctaacaggacttcatcaaaatctttccgagggcctggattagccgaaggattgaagatcctcgaaaaggtgatagtgacatatgacttgcccatagttactgatgtacatgaatccagccagtgtgaagcggtcggcagagttgcagatataattcaaattccggcctttttgtgccgacagactgatcttctagttgcagccgccaagactggaaaaatagtaaacataaagaaaggccagttctgtgctccctctgtcatgaccaactctgctgaaaaagttagattggctggaaatcaaaacgttatggtttgtgagagaggaaccatgtttggatacaatgatttaattgttgatccacgtaacttcgagtggatgagagaagctaattgtcctgtcgtagcagatatcacacatgcgttacagcaacctgctggtaaaaagctggaaggtggtggtgttgcgagtggaggtcttcgggaactaataccgtgcattgcaaggacagcagttgctgttggagtggatgggcttttcatggaggtgcatgatgatccacttagtgctccagttgatggtccaacacaatggcctctacgccattttgaggagctgctagaagagcttgtggcaattgctagggttaccaaggggaagcagcaattcaaaattgatcttactcctttccgcaagtaaagtgttctggagaccggttttcccaatgtgcctgaatatgtgaaagatctcgacattatatataatctattcatagtgtcttaatttacatttttgtcagattcatggtctgtatcacactacaacaaaatagtggcatattcacacttattagagcatgttgctacattttaaagtgtgaagaataaaaaagttcacactagtatgcgtgtgaaccaattgggtgtagca

SEQ ID NO: 10278 - DNA, 1298 bp, Cichorium intybus
gccgcaagccggcaattcaaaggtcgagtgctcaaaaatctgaaattgacttcacgtcttcacctttggagacttccggcgttgcgctccaacatcctaccgagtactaaattgagtattgcttcgtcttcatcaagcatccaaggttcaaaacatccgacctaataatcgataatcgcttcttccttgcgtgatttttcgctgcttccgttcgtgctgccagtaatcgatttgtaggatatggactcatcaactgcgttatacaaccaacttaagggagcacaaccattcttcgtgttagctggtcccaatgtgattgaatcagaagaacatattttacatatggcaaaacaaatcaaggctgtcacttcaaaacttgggttaccattagtgttcaagtcaagctttgacaaagctaacagaacttcatcaaaatcttttcgtgggcctggattagctgagggattaaagatccttgaaaaggtgaaagccacatatgacttgcccatagtgaccgatgtacatgaatctagccagtgtgaagcagtcggcagggttgcagatataattcaaattcctgcatttttatgccgacagactgatctcctagttgcagccgcgaagacgggcaaaattgtaaatataaagaaaggccagttctgtgccccttctgtgatgaccaattcagcagaaaaagttagattggctggaaatcaaaatgtaatggtttgtgaaagagggaccatgtttggttacaatgatttaattgttgatccacgcaactttgagtggatgcgtgaagctaattgccctgttgtagcagatgtgacacatgcattacagcaaccagctgggaaaaagctggaaggtggtggtgttgcgagtggaggtctacgagaattaatcccctgtgttgcaaggacagctgtcgctgtgggagtggatggactttttatggaggtgcatgatgatccgcttaatgctccggttgatggtccaacacaatggcctttgagacatttggaggagcttctagaagagcttgtggcaattgctagggttaccaaagggaagaagaaatacgaaattgatcttactccattccgtgagtaaaaagttctggaggctggtttgccacgtgtgtaattgatgataaacacctaaaatttcttttaggggccttgttttattgattttgtttgcactttgatattgaatattggatatgtatttgtaatttagaatcgatattgatagccactgcttgtaaaatatcattatctctcaccttttagact

SEQ ID NO: 10279 - DNA, 1265 bp, Cocos nucifera
catgtacctacaatagcaaatttccaaaatgcccccataaaatccccttatttatatgagcgcccgtaactagtggccactgcaacgactcctctttacctctcctgtgtctccgagacctctggagagaatctctcctatcacatccaccatggagtcttctgtggcactctacaaccagctcaaggctgcagagccatttttcttattagctggcccgaatgtaattgaatcagaggaacatattctcaagatggccaaacatataaaaaatgtcgcatcgaagtttggcttaccactggttttcaagtccagttttgacaaagctaaccgaacttcttcaaaatcatttcggggtcctgggttggaagaaggcttgaagatccttgagaaggtgaaactgacatatgatcttccaatcgtaactgatgtgcatgagagtagccagtgtgaagctgttggaagagttgctgatattatccaaatacctgctttcctctgccgccagacagatcttctagttgcagctgcaaagactgggaagataatcaacattaagaaaggccaattttgtgctccctctgttatgttaaattccgcagagaaagttagacttgctgggaaccaaaacgtgatggtttgtgagcgaggcaccatgtttggctacaatgatttaattgtcgatccacgcaatttggagtggatgagggaagcaaattgccctgttgttgcagatgttacacattcactgcaacaacctgctggaaaaaagctggaaggtggaggtgttgcaagtgggggtctgcgtgaactaataccatgtattgcaaggacatcagttgcagttggtgttgatggaatattcatggaggtgcatgacaatcccctaaaagcacctgttgatggcccaacacaatggcctttgcgccacttggaagagctactagaagagctcatagcaatcgcaagggtcagcaaggggaaaaagccattcaagattgacctcacaccccatgaagattaactcgaagcaaccaggataataacggtgcaagttgcattacagtttatccaaaactcctatgcattagccacgtatctcgagtctgatggttttctttatccttgttgctctctttttcctttggagtttgattgtatgatagcataaaagtacattgtcaggccatatcaatttgttgtcaaatttatatttgcggtacttaagctgttacttgtggctctcttttgcagcatagtttttt

SEQ ID NO: 10280 - DNA, 1120 bp, Cocos nucifera
tagaaaaatcgtaaatcagccattgatttataaaggaataacttttcctttctcaatttgctaaattctcatcattctatgatattcttttccgtgcattgatatgtttatgtaatgttacagatctctcctatcacatccaccatggagtcttctgtggcactctacaaccagctcaaggctgcagagccatttttcttattagctggcccgaatgtaattgaatcagaggaacatattctcaagatggccaaacatataaaaaatgtcgcgtctaagtttggcttaccactggttttcaagtccagttttgacaaagctaaccgaacttcttcaaaatcatttcggggtcctgggttggaagaaggcttgaagatccttgagaaggtgaaactgacatatgatcttccaatcgtaactgatgtgcatgagagtagccagtgtgaagctgttggaagagttgctgatattatccaaatacctgctttcctttgccgccagactgaccttctagttgcagctgccaagactgggaaaataatcaacattaagaaaggccaattttgtgcttcttctgttatgtcaaattctgcagagaaggttagacttgctggaaaccaaaatgttatggtttgtgaacgaggcaccatgtttggctacaatgatttaattgttgatccacgcaatctggagtggatgagggaagcaaattgccctattgttgcagatattacacattcactacaacaacctgctgggaaaaagctggaaggtggaggtgttgcaagcgggggtctgcgtgaactgataccatgtattgcaaggacagcagttgcagttggagtggatggaatatttatggaggtgcatgacaatcccctaaaagcacccgtcgatggcccaacacaatggcctttgcgccacctggaggagatactagaagagctcatagcaatagcaagggtcagcaatgggaaaaagccattcaagatcgatctcacaccctatcaagattaatctgaatctaccaggacgaaagcactgcaagttgtattgcagtttatccactactcatgcattagcgatgtatctctagaatcgaataatttttcatcatccc

SEQ ID NO: 10281 - DNA, 1195 bp, Flaveria ramosissima
ctactctcttaagtttcaccaacactcctcactgttcgtctcagcgatctctgttcttcaatcaaggtatcgagattcagttgttcacacttcaaatatggactcatctactgccctattcaaccagcttaaggaagcacagcctttctttgtgttggctggtcccaatgtgattgaatctgaggaacatattttacatatggcgaaacaaattaaggccgtcactacaaaacttggattgcctttagtttttaagtctagctttgacaaagctaacagaacttcatcaaaatcctttcgaggacctggtttagctgagggattgaagatccttgaaaaggtgaaaacaacatatgacttgcccatagtgactgatgtacatgaatccaaccagtgtgaagcagtcggcagggttgcagatataattcaaatcccagcttttttgtgccgacagactgatcttctagttgcagctgccaagactggaaaaattgtaaatataaagaaaggccagttctgtgcttcttctgtcatgaccaactctgcagaaaaagttagactggctggaaatcagaatgttatggtttgtgagagagggaccatgtttggatacaatgatttaattgttgatccacgcaacttcgaatggatgcgagaagctaattgtcctgttgtagcagatgtcacacatgcattacagcaacctgctgggaaaaagctggaaggtggtggtgtcgccagcggaggtcttcgggaattaataccttgcattgcaaggacagcagttgctgttggggttgacggacttttcatggaggtccatgatgatccgcttaatgctccagttgacggcccaacacaatggcctctgcgccatttcgaggagctgctagaagagcttatggcaattgctagggttaccaaggggaagcagcaatataaaatcgatctcactccatttcgtgagtaaaaactcctgcaggctggttttccatgtgatcaaacggaaggccagaatctgcgctgaactcagatgtgcctgaacgtgtgaaagattacgtcataatttatcagtcgatgtattagaatatatggtttgagagatacattgttgctagattcatggtgtgcatcaatatctaaatattagattatgatttgtaacattgtggactaaactaagctgttcaaattc

SEQ ID NO: 10282 - DNA, 901 bp, Prunus persica
gcaaagatggatgcatcaacagtgttatataaccagctcaaggcagcagaaccatttttcttattagcgggtcccaatgtgattgaatccgaagagcacattttccggatggccaagcacataaagcatgttgcaacaaaagttggattgccactggttttcaagtcaagctttgacaaagccaaccgtacatcctcaaaatcattccggggtcctggcctcactgaaggcttaaagatccttgaaaaggttaaagtagcatatgacatccctataattacagatgtgcacgaagctagccagtgtgaagaagttggtaaagttgcagacattattcagattcctgcatttttgtgccgccagacagatcttctagttgcagcagccaagactggaaaaattatcaacattaagaaaggccaattctgtgcaccttctgtcatggtaaattcagctgagaaggttagactggctggaaatccaaacgtgatggtctgtgaaaggggaactatgtttggctataatgatttaattgttgatccgcgcaatttggagtggatcagagaagctaattgtccagttgttgctgatgtaacacatgcattgcaacagcccgctgggagaaagttggatgatggaggtgtagccagtggtggtcttcgtgaattgattccgtgcattgcaaggacagcagttgctgttggagtggatggaattttcatggaggtacacgatgatccttctaacgcgccggttgatggtccaactcaatggcccttgcgccatttggaggaactgctggtagagcttgtagcaattgctagggtaagcaaggggaagcaacacttcaacattgatctcacaccctattgtgattagaagacttgaagctacacttttg

SEQ ID NO: 10283 - DNA, 1161 bp, Chenopodium quinoa
ctctcctccattgaaccaccttccgagtttggaatcaatttgaaggaaatagctgagaatatggattcttcggcagctctgtatacccaacttaagggagcaaagccattcttcttgatcgcgggacctaatgtgattgaatcagaagagcacataatgaagatggctaagcacattaaggccataacaaccaaacttggggtgcctctgatcttcaagtccagcttcgacaaagcaaacaggacatcttctaaatcatttaggggtcctggtatggctgaagggcttaaaattcttgagaaagtaaaagtagcatttgaccttcctatagtaactgatgtgcatgaaagtgaacagtgtgaagctgtaggtaaagttgctgatattatccagatcccggctttcttatgccgtcagacggatctccttgttgcagctggcaaaacagggaaaatcatcaatattaaaaagggtcaattttgtgctcctactgttatggtgaactctgctgaaaaagtccgaggtactggcaatcaaaatgtgatggtttgtgagagagggactatgtttgggtacaatgacttgattgtggatccccggaacttggaatggatgagagaagctaattgccccgttgtagctgatatcactcattcactacaacaacctgctggtaagaagttggatggtggaggtgttgctagtggaggttttcgggagctgattccgtgcattgctaggacagcagttgcagttggagttgatggaatcttcatggaggtccatgatgatccattaagtgcaccatgtgatggacccacacaatggcctcttcggcatttagaggagttgctggaagagctgatcgctattgctaaagtaagcaaagggaagcaacaatttgcgattgatctcacaccattccgtgattaggaacatcttccatcaatggtttgtaacctcagctcattctttcatttcctaagtggatttgagattatcaaatgctgcttgtttacaaactttgcagtatcaactaggttagtcatttattgagagccttactctctttaaagagcctgaaactgatttattgttacctgctaataaccttgtatttctataatgtatcaatgtgtgccatttatgaagttttcaatt

SEQ ID NO: 10284 - DNA, 1432 bp, Sesamum indicum
gagaaatcttcatcatgatgcccctttccgtgaacagtgatagtaaatattttcttattagatctcggatccacctctcggcattttgaaagcgtttatctcgtttctgttaatatttgcttgtaagtgcaatttggagtgaagatatggattcgtctacattgctttacaataggctcaagactgcggagccatttttcttgctggcaggcccaaatgtgattgaatcggaggagcatattctccacatggctaagcaaattaaagccatcagttctaaacttggattgcccttggtttttaagtcaagcttcgacaaagctaaccgaacatcttctaagtccttccgcggccctggcttggctgaaggtttgaagatccttgagagggtgaaaacaacatatgaccttccagtaattactgatgtgcatgagacagtacagtgtgaagctgttggtagggtggcggatataattcagattcctgctttcttgtgccgacagacagatctgcttgtggcagctgcaaagactggaagaattatcaacatcaagaaaggccaattttgtgctccttcggtcatggtaaattctgctgaaaagattaggatggctggaaatgaaaatgtcatggtttgtgagagaggcacaatgtttggctataatgatttgattgttgatccacgaaacttggagtggctgagggaggccaattgtcctgttgttgctgatataacacactcacttcaacaacctgcagggagaaagctggaaggaggtggtgttgccagtggaggtctccgcgaactgataccttgcattgcccggacagcagttgctgttggtgtggatggaatctttatggaggtgcatgatgatccactaaatgctccagtcgatggtccaacacaatggcctctacgtcatttggaggaattgctggaagagctcatggcaattgctcgggttagcaaggggaagaagcagttccaaattgatctcactccattccgtccatgagaaaagaacatcaattgtagatctggccactccttacaatggccggagagcaccaggttccactgcatgtttctgctttcacggccaggaccaggcacaatcagtaaacaattatgccgaatattattgatttcatgatttgtatcagcaacgctgcttgtaaactagtcaatttagaaactctgttctcctttctctaggtttgatacactaccattatctaagcaagtctcaattgaagttatgacttctaatctcccatgttagtggaaatactgctgttattttgaacatttaagaattatgactagtttatgtgtccggctatctagggtacaaaaggattgttgttgcactgagaaaacgcttctcacacctttaacttcctatagcaacgcaacagcgattttcgt

SEQ ID NO: 10285 - DNA, 1305 bp, Cirsium arvense
attgcaatcggatccataatccatatcaaatcccaccgaattcgacgcacagactacatacactcactagtctaaagactcgtagatttagctgttttacacttaagatatggatccagcagcgctttacaaccagcttaaggaagcacagccattcttcgtgttggctggtcccaatgtgattgaatctgaggaacatatcttttatatggccaaacacattaaggccgtcactacaaaactcgggttaccgttagtttttaagtcaagctttgataaagctaacagaacttcgtcaaaatcttttcgaggacctggattggctgaaggattgaagattcttgaaaaggtgaaagtggcatatgatttgcccatagtgaccgatgtacatgaatctagccagtgtgaagcagttggcaaggttgcagatataattcaaattccagcctttttgtgccgacagactgatctcctagttgcggctgccaagactggaaaaatcataaatataaagaaaggccagttctgtgcttcctctgtgatggccaactctgcagaaaaagtcagattggctggaaatcaaaatgttatggtttgtgagagagggaccatgtttggatacaatgatttaattgttgatccacgcaacttcgagtggttgagagaagctaattgtcccattgtagcagatgttacacatgcattacagcaacctgctgggaaaaagctggaaggtggtggtgttgccagtggaggtctccgagaattaataccttgcgttgcaaggacagcagttgctgtcggagtggatggacttttcatggaggtgcataatgatccacttaatgctccagttgatggtccgacacaatggcctctacgccatttggaggagctgctagaagagcttgtgggtattgctagggtcaccaaggggaagcaacaatacaaaattgatcttactccatttcgcgagtaacaacttctgtatgctggtttttcacgcgtaatgaagaaaggcaagatccttcccggaccacagatgtggctgaacgtgtgaaagatgtcaacatcataatctatagtttgagaaatacatttcagagtatctaaacattattgttgttcctttcatttaggggtcttgtttgtctttatgtagttagtataggcaactcttgtgatcattgggtgctataagcattagacatggcggcaaggccagatctcaaaccttagaagcctcgacgaggttatggcatgatttatgccgacaaatatataatattacatatctaaacaaaa

SEQ ID NO: 10286 - DNA, 1110 bp, Echinochloa colona
gctccactcgctcgctcctccgcctctccgctccgagctcgcatctcagtccttccgatctctcttctctcgaggagcaagaaatctggaatggaggctccgcccgtcgcgctcttcgacagcctcaaggctgccaagccattcttcttgctagccgggcccaatgttattgaatcggaagagcatgtcctgaagatggccaaacacattaaaggcatcacagccaagcttgggatcccacttgtgttcaagtccagctttgataaagcaaatcgtacgtcatcaaaatctttccgtggtcctggtctggaagaaggcctaaagatccttgaaaaggtgaaagcaacatatgatcttccaatagtcactgatgtgcatgaaagccaccagtgtgaagctgttggaagagttgctgacattatacagattccagctttcctctgtcgccagactgatcttctagtagctgctgctaagactggaaaaatcatcaacatcaagaaaggacaattctgtgcgccttctgttatggccaactctgcagagaaaataagactggctggaaatccaaatgtgatggtctgtgagcgtggtaccatgtttggttacaatgatctaattgttgacccaaggaaccttgagtggctgagggaagctaactgcccagttgtagctgatataacacatgctctacaacaaccagctggaagaaagcttgatggtggaggtgttgctagcgggggcttccgagaactaataccatgcatcgcaaggacttctgttgctgttggtgtcgatggtattttcatggaggtacatgatgatcccttgaatgcaccatgtgacggcccaactcaatggccattgcgcaatttggaggagctattggaggaattgatagcgatcgctcgagttaccaagggaaagacgccgttcaagattgatctcactccgttccaggaatgatctggtttggtctatagaaagcacaatgccactgtctagtttcaacggggtggttttcttgttgctgtacttgttacggtttcaaggatagctgccatcgatgactgttatcactgaactactgagttgaaacagtcgtcgtgt

SEQ ID NO: 10287 - DNA, 1205 bp, Pennisetum glaucum
actccagtccactcccgcgtctctccgcgctcccaactcgcgtctcgatccctccgatctctcctctctccggttgcccccgcgcagggatcgaggaaaaggagcatggagggtccgcccgtcgcgctgttcgacagcctcaaggctgccaaaccattcttcctgctggccgggcccaacgtgattgaatcggaggagcatgtcctgaagatggccaaacacattaaaggcatcacaaccaagcttgggatcccacttgtcttcaagtccagctttgataaagcaaatcgtacatcatcaaaatctttccgtggtcctggtctggaagaaggcctaaagatccttgaaaaggtgaaagcaacatatgaccttccagttgtcactgatgtgcatgaaagccaccagtgtgaagctgttggaagagttgctgacattatacaaattccagctttcctctgccgccagactgatcttcttgtggctgctgctaagactggaaaaattatcaatatcaagaaagggcaattctgtgcaccctctgttatggccaactctgcagagaaaataagacttgctggaaatccgaatgtaatggtctgtgagcgtggtaccatgtttggctacaatgatctaattgttgacccaaggaatcttgagtggctgagggaagctaactgcccagtcgtagctgatataacacatgctctacaacaaccagctggaaaaaagcttgatggtggaggtgttgcaagcgggggcttacgagaactaataccgtgcatcgcaagaacttgtgttgctgttggtgttgatggtattttcatggaggtacatgatgatcccttgaatgcgccgtgtgacggcccaacccaatggccattgcgcaatttggaggagctattggaggaattgttggcaatcgctcgagttaccaagggaaagaagccgttcgagattgacctcactccattccaggaatgatccagtttggtagcaacagcgcacaatgcaactgtccactggttccaactttcaacagggtgtatttcgagtctagatgactgtgtgagttactgagttgaagcttgtgtggttggtttggttcgtgctatttcttcagttgtaccataagtacatgttattggaggaacaaaacaatatcatcgcaaaaataaatgtgattgctggttggttaccagctttct

SEQ ID NO: 10288 - DNA, 1128 bp, Sorghum bicolor
ctcctgtctcctctcccctgctgtgtcgctccgctctgctccggtgagctgtccggcactcgcatctcgatccctcgatctgtcgttttctctcggggacgaagaaacgtgacaatggaggctccacccgtggcgctgttcgactccctcaaggctgccaaaccgttcttcttgctggccggtcccaacgtgattgagtcggaggagcatgtcctgaagatggccaaacacattaaaggaattacaacaaagcttggaattcctcttgtgttcaagtccagctttgataaagcaaaccgtacatcgtcaaaatcgttccgtggtcctggtcttgaagaaggcctaaagatccttgaaaaggtgaaagcaacatatgaccttccggtagtcactgatgttcatgaaagccaccagtgtgaagctgttggaagagttgctgacattatacagattccagcattcctctgtcgccagactgatcttctagtggccgctgctaagactggaaagattatcaacatcaagaaaggacaattctgtgcgccttctgttatgatgaactctgcagagaaagtaaggcttgctggaaacccaaatgtgatggtctgtgagcgtggtaccatgtttggctacaatgatctaattgttgacccaaggaactttgagtggctgagggaagccaactgcccagttgtagctgatgtcacacatgctctacaacaaccggctggaagaaagcttgatggtggaggtgttgcaagtggggggctacgagaactaataccatgcattgcaaggacttctgttgctgttggtgttgatggtattttcatggaggtacatgatgatcccttgaatgcaccatgcgacggcccaactcaatggccattgcgcaatttggaagagctattggaggaattgattgcaatcgctcgagttaccaagggaaagaagccattcaagatcgatctcactccgttccaggaataatctgccttggttcatagaaagcacaatgccagcatccatgggattcaacagggtggatttaatatgaatgctgtaaattttactgtttcgagcaaaactgcagtaaatgactgtaatcgccgaacgaactattgaatt

SEQ ID NO: 10289 - DNA, 1025 bp, Eutrema parvulum
gtatccaaacatctgccacgcggtaaaaggtgagaggagatctcacttcccttcactcactctccaacttcgagatcaagttaaaggtcagtttccggttattggcttgacgaaaagaatggcggcaacatcaccactgtacaatcagcttaaggctgctgaaccattcttcttgttggctggtccaaatgtgatcgaatccgaggaacatattcttcgaatggcaaagcacatcaaagacattgccacaaaagttgggttgcccctggttttcaagtcaagttttgataaagctaacagaacttcttcaaagtcgtttcgaggtcctggcatggctgagggtctgaagattcttgagaaggtgaaagtagcatatgacctaccaatagtaactgatgttcatgaatcgatccagtgtgaagaagttggcaaggttgcagatataattcagataccagcattcttatatcttctggttgccgcagcccaaaccggaaaaattatcaatattaagaaaggacaattttgtgctccttctgtcatggaaaattcggccgagaagatcagactggctgggaatccaaatgtgatggtttgtgaaagaggaaccatgtttggatacaatgatttgatagtagatccacgaaactttgaatggatgcgggaagctaattgtcctgttgttgctgatataacccatgcactacaacaacctgcaggaaaaaagttggacggtggtggtgttgctagtggaggccttcgcgagttaataccctgcattgcgagaacagctgtagcggttggcgtcgatggaattttcatggaggttcatgatgatcctctaagtgctccagttgatggtccaactcaatggcctttgcgtcatttagaagaactcctagaggagcttattgcgatttctagggtcacaaaagggaagcaacgattccaaattgatctcacaccttaccgcgattagtaatctcgaggtgagtgacgctaaatgggcatatgtgatatgactc

SEQ ID NO: 10290 - DNA, 1026 bp, Chrysanthemum coronarium
tttaattcttcaaagatatggactcatcaactctgctgtacaaccagcttaaggaagctaagcctttttttgtattggctggtccgaatgtgatcgaatccgaggaacatattatgtatatggccaaacaaattaaggctgttactacaaagcttgggttgccgttagtttttaagtcgagttttgacaaagctaacaggacttcgtcaaaatctttccgagggcctggattagccgaaggattgaagatcctcgaaaaggtgatagtgacatatgacttgcccatagttactgatgtacatgaatccagccagtgtgaagcagtcggcagagttgcagatataattcaaattccggcctttttgtgccgacagactgatcttctagttgcagccgccaagactggaaaaatagtaaacataaagaaaggccagttctgtgctccctctgtcatgaccaactctgctgaaaaagttagattggctggaaatcaaaacgttatggtttgtgagagaggaaccatgtttggatacaatgatttaattgttgatccacgtaacttcgagtggatgagagaagctaattgtcctgtcgtagcagatatcacacatgcgttacagcaacctgctggtaaaaagttggaaggtggtggtgttgcaagtggaggtcttcgggaactaataccgtgcattgcaaggacagcagttgctgttggagtggatgggcttttcatggaggtgcatgatgatccacttagtgctccagttgatggtccaacacaatggccactacgccattttgaggagctgctagaagagcttgtggcaattgctagggttaccaaggggaagcagcaattcaaaattcatcttactcctttccgcaagtaaagtgttctggagaccggttttcccaatgtgcctgaatatgtgaaagatctcgacattatatataatctattcatagtgtcttaatttacatttttgtcagattcatggtctgtatcacactacaacaaaatagtgg

SEQ ID NO: 10291 - DNA, 1069 bp, Chrysanthemum coronarium
tctgcttcgatctctcttcttcaatccatattatttttacgatttaattcttcaaaagatatgaactcatcaactctgctatacaaccagcttaaggaagctaagcctttttttgtgttggctggtccgaatgtgatcgaatccgaggaacatattatgtatatggccaaacaaattaaggctgttactacaaagcttgggttgccgttagtttttaagtcgagttttgacaaagctaacaggacttcgtcaaaatctttccgagggcctggattagccgaaggattgaagatcctcgaaaaggtgaaagtgacatatgacttgcccatagttactgatgtacatgaatccagccagtgtgaagcagtcggcagagttgcagatataattcaaattccggcctttttgtgccgacagactgatcttctagttgcagccgccaagactggaaaaatagtaaacataaagaaaggccagttctgtgctccctctgtcatgaccaactctgctgaaaaagttagattggctggaaatcaaaacgttatggtttgtgagagaggaaccatgtttggatacaatgatttaattgttgatccacgtaacttcgagtggatgagagaagctaattgtcctgtcgtagcagatatcacacatgcgttacagcaacctgctggtaaaaagttggaaggtggtggtgttgcaagtggaggtcttcgggaactaataccgtgcattgcaaggacagcagttgctgttggagtggatgggcttttcatggaggtgcatgatgatccacttagtgctccagttgatggtccaacacaatggccactacgccattttgaggagctgctagaagagcttgtggcaattgctagggttaccaaggggaagcagcaattcaaaattcatcttactcctttccgcgagtaaagtgttctggagaccggttttcccaatgtgcctgaatatgtgaaagatctcgacattatatataatctattcatagtgtcttaatttacatttttgtcagattcatggtctgtatcacactacaacaaaatagtgg

SEQ ID NO: 10292 - DNA, 1329 bp, Cichorium intybus
aaaatggcacctgccgctgtgccgcaagccggcaattcaaaggtcgagtgctcaaaaatctgaaattgacttcacgtcttcacctttggagacttccggcgttgcgctccaacatcctaccgagtactaaattgagtattgcttcgtcttcatcaagcatccaaggttcaaaacatccgacctaataatcgataatcgcttcttccttgcgtgatttttcgctgcttccgttcgtgctgccagtaatcgatttgtaggatatggactcatcaactgcgttatacaaccaacttaagggagcacaaccattcttcgtgttagctggtcccaatgtgattgaatcagaagaacatattttacatatggcaaaacaaatcaaggctgtcacttcaaaacttgggttaccattagtgttcaagtcaagctttgacaaagctaacagaacttcatcaaaatcttttcgtgggcctggattagctgagggattaaagatccttgaaaaggtgaaagccacatatgacttacccatagtgaccgatgtacatgaatctagccagtgtgaagcagtcggcagggttgcagatataattcaaattcctgcatttttatgccgacagactgatctcctagttgcagctgcgaagacgggtaaaattgtaaatataaagaaaggccagttctgtgcctcctctgtgatgaccaattcagcagaaaaagttagattggctggaaatcaaaatgttatggtttgtgaaagagggaccatgtttggttacaatgatttaattgttgatccacgcaactttgagtggatgcgtgaagctaattgccctgttgtagcagatgtgacacatgcgttacagcaaccagctgggaaaaagctggaaggtggtggtgttgcgagtggaggtttacgggaattaatcccctgtgttgcaaggacagctgttgctgtgggagtggatggactttttatggaggtgcatgatgatccgcttaatgctccggttgatggtccaacacaatggcctttgcgacatttggaggagcttctagaagagcttgtggcaattgctagggttaccaaagggaagaagaaatacgaaattgatcttactccattccgtgagtaaaaagttctggagactggtttgccacgtgtgtaattgatgataaacacctttcattaaggggcctcattacattttctattacactttgatattaaatattggatatgtattttgtaatttagaatcgatattgatagccactgcctgtaaaatatcattatctcttaccttttagattgtttcttttgctataaag

SEQ ID NO: 10293 - DNA, 1406 bp, Cirsium arvense
tcacaccagagtcaatcttcctcaatctttttacttaattatataataattgtaaagtcccgtttcttggctatgaaatttgggtcatgtttagagatctacctccttcacgatcatcatgattcatgtggcatttattcgtcaaattttcagaaattttggaatgccgatgtcgatttgatttccttctttgatgccagatttatctatttacacataagatatggattcatcaacggcgctttacaaccagcttaagggagcacagccattctttgtgttagctggtcccaatgtgattgaatccgaggaacatattttttatatggccaaacacattaaggccgtcacttcaaaactcgggttgccattagtttttaagtcaagctttgacaaagctaatagaacttcatcaaaatcttttcgagggcctgggttagctgagggattgaagatccttgaaaaggtgaaagtggcatatgacttgcccatagtgaccgatgtacatgaagctagccagtgtgaagaagttggcaaggttgcagatataattcaaattccagcctttttgtgccgacagactgatcttctagttgcagctgccaagactggaagaatcataaatataaagaaaggccaattctgtgcctcctctgtcatgaccaactctgcagaaaaagtcagattggctggaaatcaaaacgttatggtttgcgagagagggaccatgtttggatacaatgatttaattgttgatccacgcaacttcgaatggatgagagaagctaattgtcctgttgtagcagatgttacacatgcattacaacaacctgcagggaaaaagctggaaggtggtggtgttgccagtggaggtctccgggaattaataccttgtgtggcaaggacagcagttgctgttggtgtggatggacttttcatggaggtgcataatgatccacttagtgctccagtcgatggtccaacacaatggcctctacgccatttggaagagctgcttgaagagcttgtggcaattgctagggttaccaaggggaagcagcaatacaagattgatcttactccattccgcgagtaacaagttctgtatgcaatgatcaaaggcaagatcctgctccaacctaagatgtgtgaaagatcacaacatcataatctatggtttgagaaaatacatttcattatctaaacattattgttgtgtaattcagaagagacaatcacacatacattctaccttgtgaaagctctttaatggaattttagctttagctggttgtgactaagaaattaccggtttagctggtgggctgagaatgcccgacttatcaatttatctgctaaaccactaggggcgcatgtagcccatgtcgagttagtcgtattttggg

SEQ ID NO: 10294 - DNA, 1270 bp, Cocos nucifera
gagcgcgctcggagtcactggccactgcaactgctcttcatttcctcttctccttctcgtctttccagagaatccaagtctttttgttctctcggaagattgagagggccggggattgaagagatcgcacgattcgtctctcagggaagtctttgagatctccgagctcgtagacgacctctgaagcgcgtaagttacacgtctccggtatcacatcaagacatggagtcttctgtggcactctacaaccaactcaaggctgcagagccatttttcttattagcaggccctaatgtgattgaatctgaggagcatatactctacatggccaaacatataaaaaatgtcacatctaagcttggcttaccactggttttcaagtccagctttgacaaagctaatcgcacttcttcaaaatcatttcgtggtccagggttggaagaaggcttgaagatccttgagaaggtgaaactaacatatgatcttccaatcgtaactgatgtgcatgagagtaaccagtgtgaagctgttggaagagttgctgatattatccaaatacctgctttcctttgccgccagactgaccttctagttgcagctgccaagactgggaaaataatcaacattaagaaaggccaattttgtgcttcttctgttatgtcaaattctgcagagaaggttagacttgctggaaaccaaaatgttatggtttgtgaacgaggcaccatgtttggctacaatgatttaattgttgatccacgcaatctggagtggatgagggaagcaaattgccctattgttgcagatattacacattcactacaacaacctgctgggaaaaagctggaaggtggaggtgttgcaagcgggggtctgcgtgaactgataccatgtattgcaaggacagcagttgcagttggagtggatggaatatttatggaggtgcatgacaatcccctaaaagcacccgtcgatggcccaacacaatggcctttgcgccacctggaggagatactagaagagctcatagcaatagcaagggtcagcaatgggaaaaagccattcaagatcgatctcacaccctatcaagattaatctgaatctaccaggacgaaagcactgcaagttgtattgcagtttatccactactcatgcattagcgatgtatctctagaatcgaataatttttcatcatccctttttccccccccccccccccccccccccccccccccccccccccccccccccccccccccccccccccccc

SEQ ID NO: 10295 - DNA, 1142 bp, Cocos nucifera
ttacacgtctccggtatcacatcaagacatggagtcttctgtggcactctacaaccaactcaaggctgcagagccatttttcttattagcaggccctaatgtgattgaatctgaggagcatatactctacatggccaaacatataaaaaatgtcacatctaagcttggcttaccactggttttcaagtccagctttgacaaagctaatcgcacttcttcaaaatcatttcgtggtccagggttggaagaaggcttgaagatccttgagaaggtgaaactaacatatgatcttccaatcgtaactgatgtgcatgagagtaaccagtgtgaagctgttggaagagttgctgatattatccaaatacctgctttcctctgccgccagacagatcttctagttgcagctgcaaagactgggaagataatcaacattaagaaaggccaattttgtgctccctctgttatgttaaattccgcagagaaagttagacttgctgggaaccaaaacgtgatggtttgtgagcgaggcaccatgtttggctacaatgatttaattgtcgatccacgcaatttggagtggatgagggaagcaaattgccctgttgttgcagatgttacacattcactgcaacaacctgctggaaaaaagctggaaggtggaggtgttgcaagtgggggtctgcgtgaactaataccatgtattgcaaggacatcagttgcagtgggtgttgatggaatattcatggaggtgcatgacaatcccctaaaagcacctgttgatggcccaacacaatggcctttgcgccacttggaagagctactagaagagctcatagcaatcgcaagggtcagcaaggggaaaaagccattcaagattgacctcacaccccatgaagattaacttgaagcaaccaggataataacggtgcaagttgcattacagtttatccacaactcctatgcattagccacgtatctcgagtctgatggttttctttatccttgttgctctctttttcctttggagtttgattgtatgatagcataaaagtacattgtcaggccatatcaatttgttgtcaaatttatatttgcggtacttaagctgttacttgtggctctcttttgcagcatagtttttt

SEQ ID NO: 10296 - DNA, 1455 bp, Echinacea purpurea
gacaggaaggagtactacttgcctgcagttcaccactcactagtcgtctcagcgatctctgttcttcaatccagaattcgacgtaatcatccaattacattgtgatttagtcgttcatacttcagatatggactcatcaactttgctattcaaccagcttaaggaagcacagccgttctttgtgttggctggtcccaatgtgattgaatccgaggaacatgtattgcatatggcaaaacaaattaaggctgtcacttcaaaactcggattgccattagtttttaagtctagctttgacaaagctaacagaacttcatcaaaatcctttcgagggcctggattagccgagggattaaagatccttgaaaaggtgaaaacaacatatgacttgcctatagtgaccgatgtacatgaatctgaccagtgtgaggcagtcggcagggttgcagatataattcaaattccagcttttctgtgccgacaaactgatcttctagttgcagctgccaagactggaaagattgtgaatataaagaagggccagttttgtgctccctctgtcatgaccaactctgccgaaaaagttaggttggctggaaatcaaaacgttatggtttgtgagagagggaccatgtttggatacaatgatttaattgttgatccacgcaactttgagtggttgcgagaagctaattgccctgttgtagcagatgtcacacatgcattacagcaacctgctgggaaaaagctggaaggaggtggtgttgcgagtggaggtcttcgggaattaataccttgcattgcaaggaccgcagttgctgttggagtagacggacttttcatggaggtgcatgatgatccacttaatgctccagttgatggtccaacacaatggcctctacgtcattttgaggagctgctagaagagctaatggaaattgctagggttaccaaggggaagaagcaatacaaaatcgatctcactccattccgtgagtgaaaacttcagtaggctggtgttccatgtgtgatcaaacagaaaggcaagattctgcggatgtgcctgaacgtggaaagatcacagcatcattatctatcagtcgaaatacattgatgttggattcatggtgtgtatcaatatcaaaatattagtttatgatttgtttcctccagtccattcaaattatatcacatggccgttcctttcttcttaggggtgatagtggtaatcttaaaagagtttattaacacatttatatattattatatgagctataagaatagtttcagatcttacatgagtttggtttatgttacaaagttgctttttatcttcgggtgttttgtcgtcctgcaatctctctaatgggttttattaatgtgtgacggatgcaaaagataagggatcttaactgtaaagtgtcaaaaatcaatatatagtaatttggttcatgt

SEQ ID NO: 10297 - DNA, 1016 bp, Flaveria ramosissima
tcagttgttcacacttcaaatatggactcatccactgccctattcaaccagcttaaggaagcgcaacctttctttgtgttggctggtcccaatgtgattgaatctgaggaacatattttacatatggcgaaacaaattaaggccgtcacttcaaaacttggattgcctttagtttttaagtctagctttgacaaagctaacagaacttcgtcaaaatcctttcgaggacctggtttagctgagggattgaagatccttgaaaaggtgaaaacaacatatgacttgcccatagtgactgatgtacatgaatccgaccagtgtgaagcagtcggcagggttgcagatataattcaaatcccagcttttttgtgccgacagactgatcttctagttgcagctgccaagactggaaaaattgtaaatataaagaaaggccagttctgtgctccttctgtcatgaccaactctgcagaaaaagttagactggctggaaaccagaacgttatggtttgtgagagagggaccatgtttggatacaatgatttaattgttgatccacgcaacttcgaatggttgcgagaagctaattgtcctgttgtagcagatgtcacacatgcattacagcaacctgctgggaaaaagctggaaggtggtggtgttgccagtggaggtcttcgggaattaataccttgcattgcaaggacagcagttgctgttggggttgacggacttttcatggaggtccatgatgatccacttaatgctccggttgacggtccaacacaatggcctctgcgccatttcgaggagctgctagtagagcttatggcaattgctagggttaccaagggtaagaagcaatataaaatcgatctcactccatttcgtgagtaaaaactcctgcaagcttgtttccatgtgatcaaacggaaggcaagaatctgcgctgaactctgatgtgcctgaacgtgtgaaagattacatcataatttattagtcgatatattagattatat

SEQ ID NO: 10298 - DNA, 1566 bp, Phalaenopsis aphrodite
ggctcccctgacatcactacgctctcctggaccttccctgttttcctgaaacccctaaaccctagcctatctctcttcaccacttccagtttcgtccagaaccatcgccatgttgatcgaaccatcgagatacagtagcaattagagctatcttagaaggcgacgacgggattgcggcttacggagactccatccttcttcaccttgggctccgctcttaccctaaaccattaaagacgagatttgttgcattatagcagaagatggatggctccgtggaattattcaaccacctcaaggctgcagatccatttttccttttagctggacccaatgtgattgaatccgaagagcatacattgaagttggcaaaacttataaagattattgcgtctaagttcgggctgccactggtttttaaatcaagcttcgacaaagcgaatcgtacttcctcgaaatcataccgtggacctgggctggaggaaggtttgaagattcttgagaaggttaaagtcacctatgaccttcctatagtaacagatgtgcatgagagcagtcagtgtgaagctgttgggagagtcgctgatatcattcaaattccagcttttctttgtcgtcagactgacctcttagttgctgctgcgaagacgggcaaaatcatcaacattaagaaaggacaattttgtgccccatctgttatggtgaattctgcagaaaaaattagacttgctggcaaccagaatgtgatggtttgtgaacggggcaccatgtttggctacaatgatttaatcgtcgatccacgcaatttggagtggttaagggaagctaattgtccggtggtcgctgatattactcattcgcttcaacagcctgcagggaagaagcttgaaggtggcggtgttgctagtggtggtttgcgcgaactaataccttgtattgcaaggacagctgttgcagtcggtgtcgatgggctattcatggaggtgcatgacgatccactgaatgctcctgttgatggcccaacacaatggcctttgcgccacttggaggaacttttagaagagctcatagcaatagctaggataactaaggggaagaagccatttgaaattgacctcgcaccttttcttgaatgagtcatgagaagctggctgcctcagtgaggtaattgacctcacagctttttttgggaaatttacatatgtagcccacacttcttatgtatttacaaaactcccacctaaactttcatatttatatatgtagcatcttggtgtgatattaaagcctcgagtgcgatgtgtgtaaatatgagtgtaggtgtgagttttgtaaatacataagaattgtgtgctatgtgtggtaaatgcccccccatttgtttttctattgaatttgagcacaaacaagagtgagggttgtagctaaatcgaatcgtgtatcttaatgttcgagtttatttattcgtctttttattgagtgcgagcagggtttatgtagacataaaattaagagtgattgaacagagtgtgtttttcaagttatttatttattttgtatgtaaaa

SEQ ID NO: 10299 - DNA, 1338 bp, Primula obconica
caaactttacactttctgaatctaagaccaaatcaggtcagatcagtgattcactgatttaaatcttgatttattactcctacttttgttcaatttccagctaaatctcactcatggattcatcgtcattgctgttcaataagctcaagacggcagagccgttttttgtgatggcgggtccaaatgtgatcgagtccgaagagcacattatgaggatggctaagcacatcaaggcaatcacttctaaacttgggttgcagtttggttttcaagtcaagctttgacaaagccaatcggacgtcctcaaaatcattccgaggtcccggcattgaagaaggcttgaagattcttgagaaagtaaaggtggcctatgatgtccccattgtgacagatgtacatgaaagcagccagtgtgaagcagtaggtaggattgctgacattattcagattccagcctttttatgccgacagacagatctcctagtagcagctgccaagaccggaaagattgtcaatattaagaaagggcaattctgtgcttcatcagtcatggcaaattctgctgaaaaggttagattggctggaaatgaaaatgttatggtttgtgagagggggaccatgtttggttacaatgatctgattgttgatcctcgcaacttcgagtggatgagagaagccaattgtcctgttgtagccgatgtcacacatgctctacaacagcctgccggaagaaagctggaaggtggtggtgtcgccagtggaggccttcgcgaattgataccatgcattgcaaggactgctgttgctgtcggagttgatggaatttttatggaggtgcatgatgatcctctcagtgctccagttgatggtccaacacaatggcctctacgccatttggaggaattgctggtagagcttatggcaattgctagggctagcaaagggaagcaacaatatcaaatcgatctcactccataccgtgattagtttcgaattgattttccaatattgaagcaaataaagatgtgagatttaatagtattgcgaaaaaaaatataatctatgttgcatttggaatgccatttcgacaagatagctagtgtccccgcttctttaattgttgtctgcaatattgaaatgtggttccggttgtagaattgcttcaaaaccatagcagtaaatcatgtaccttttcctccttatctatgatacaaaaaatttatttcggtacaccaaagcaggacggaaccagatgctgacgcgataaggctgtatctataaaatgcctcattaatttaagtaatttttgtgtaagtatttgagttatagcagattgac

SEQ ID NO: 10300 - DNA, 1178 bp, Oryza sativa
ctgtcgcctctgctcctcctcctcctgctccatctcctcctccatatcccactcgccaatctcgattccctcctccgctctacctcgccggagttcaccctgtgtgggactgggagcggcggcggcgtcggaggcaatggacgcttcgtcggtggcgctctacggccagctcaaggctgctcaaccattcttcttgttagctgggcctaatgtgattgaatcagaggagcatgtcctgaagatggcaaaacacatcaaaggcatcacaaccaagcttggtctgccacttgtgttcaagtccagctttgataaagcaaatcgtacatcatcaaaatccttccgtggtcctggtctggaggaaggcctgaagatacttgaaaaagtgaaagcaacatatgacattccagtggtcactgatgtgcatgaaagccaccagtgtgaagccgttggaagagtggccgacatcatacaaattccagctttcctctgtcgccagactgatcttctagtggctgctgccaagactggaaaaattatcaacatcaagaaaggacaattctgtgctccttctgttatggccaactctgcagagaaaatcagacttgctggaaatcaaaatgttatggtctgtgagcgtggcaccatgtttggctacaatgatctaattgttgatccaaggaattttgagtggctgagagaagctaattgtccagttgtagctgatgtaacgcatgctctacaacagcctgctggaaaaaagcttgatggtggaggtgttgcaagtgggggcttacgagaactaataccatgcatcgcaaggacttctgttgctgtcggagttgatggtattttcatggaggtacatgatgatcccttgaacgcaccttgtgatggcccaactcaatggccactgcgcaatttggaggagctattagaggagctgattgcaattgctcgagtcaccaagggaaagaagccactcaagatcgatctcacccccttcaaagaataatctggtccagttggtaggaaataatgggcacacttgcttggttgatagttttgaccagcatatatttacctgtttggatgaattgctcgttgtatgtcatacattcgtttatcggtgactgttgtctgtattgtactgcctatacaataaagatcattgttttacc

SEQ ID NO: 10301 - DNA, 1321 bp, Arabidopsis thaliana
acgatctatgaattgaattaaaaccggataatgattatccacgccagggacagtactgttggcgtatccgaacatcacctctcggccattggcaatttctattttggcatctcactgccttcactcacactacaacttccagttaaagattctgattttggaagttgaggttttgttatctgatcttaagctctactatagaaatggcgaattcagcgtcactactgtatgatcagctcaaggttgctgagccgtttttcttattggctggtccaaatgtgatcgaatccgaagagcatgttcttcgtatggctaaaagcatcaaagatatttcgacaaagcttgggttgcctctggttttcaagtcaagtttcgataaagctaacagaacttcatcaaagtccttccgaggtcctggcatggctgaggggctcaagattcttgagaaggtgaaagtagcatttgatctaccaatcgttactgacgttcatgagtcgagtcagtgtgaagcagttggcaaggttgcagatataattcagataccggcgttcttatgtcgacagacagatcttctggtcgcggcagcccaaagtgggaaaattatcaacataaagaaaggacaattttgtggtcactctgtcatgagaaactcggctgagaaggttagactcgcagggaatccaaatgtgatggtttgtgaaagaggaaccatgtttggatacaatgatttaatagtagatccacgaaatttggaatggatgagggaagctgattgtcccgttgttgctgatataactcattcattacaacaacctgcaggcaagaagttagatggtgggggtgttgctagtggtggccttcgcgaattaataccatgcatagcaagaaccgccgtagctgttggtgtcgatggaattttcatggaggtgcatgatgatcctttaaatgcaccggtcgatggtccaacacaatggcctctgcgtcatctagaagaactgctagaagagctcattgcaatcgcgagtgtcacaaaggggaaacaacagttccaaatcgatctcacgccttatcgtgattagaatcaaagggtccgtacgtcactttgggtgcaactacatcttcttgataatatttcaatcttgtcggagcaataagcattatttggcaaaacacatctctccacagtgactaatgtatattcaaagtagctgatgttgcctgatatgatatcaaatgtctaagtttgttttatttttgaagaaataaacaacaattagaagttaaattactttttatgtcaacataaagcactttttctata

SEQ ID NO: 10302 - DNA, 1222 bp, Raphanus sativus
ctctgcaacttcgagatcatcgagtaagcttaaagtttcaccttttgaggttatatagctttgacgaaaaaagaatggctacaacatcaccactatacgaccagcttaaggctgctgagccgttcttcttgttggctggtccaaacgttatcgaatctgaggaacatattcttcgtatggctaagcacatcaaagatattgccacaaaagttgggttgcccctggttttcaagtcaagttttgataaagctaacagaacttcctcaaagtcgttccgaggtcctggcatggctcagggtctcaagattcttgagaaggtgaaagtagcatatgacctgccaataataactgatgtgcatgaaccgttccagtgtgaagaagttggcaaggttgcagatatcattcaaataccagcattcttatgtcgccagacagatcttctggtagcggctgcccaaaccgggaaaattatcaatattaagaaaggacaattttgtgctccttctgtcatggaaaattcggccgagaagatcagacttgctgggaatccaaatgtgatggtttgtgaaagaggaaccatgtttggatacaatgatttgatagttgatccaagaaacttggaatggatgagggaagctaattgccctgttcttgctgatataacccattcactacaacaaccttgtggcagaaagttggacggtggtggtgttgctagtggaggccttcgggagttaataccttgcattgcgagaactgctgtagcagttggcgtcgatggaattttcatggaggttcatgatgatcctctaagtgctccagtcgatggtccaactcagtggcctttgcgtcatttagaagaactcttggaggagctcatcgcgattgctagggtcacaaaagagaagcaggggttccaaattgatttaacaccttaccgcgattaggattggaggtgttgtaatgcgagtggcatggcatctcctcttcatatgtactatccacacacggaacggggagaatacattctcttcataagagtgtttgtctttgttttttcaaaataaatagacaatacatctgattctcacttgggtttgtcttttctacttttccaaacttggacatttgttttctcggattggtttgcctttgttgtttttcctttgagtcaaaaaaaaaaagaattgagtcttggttacaatgataaatacttcattca

SEQ ID NO: 10303 - DNA, 1021 bp, Vaccinium corymbosum
ttgcttaaaaggatcatcaatcagatctcaggcctcactcactccagatctcaaaatcagacgaccagattagatcatatcatatcatatcacaagataaaagctcaattcttcaactgtagtactagaagatggattcttcgtcgacaatgcttttcaaccagctcaagacgtctgaaccattttctatgcggaccaatgtgatcgaatccgaggaacatgttatgcggatggccaatcacatcaaggctatcacttccaaacttgggctacagctggttttcaagtcaagctttgacaaagccaatcggacatcttccaaatcatttcgtggtcctggccttgctgaaggcttgaagatccttgagaaagtaaggtagcctatgacatcccaatagtgacagatgtgcatgaatccatccagtgtgaggcagttggtagagttgcagatattattcagatcccagccttcttatgtcgacagacagatctcctagttgcagctgctaagactggaaaaattgtcaacataaagaaaggccaattttgtgctccttctgtcatggcaaattctgctgaaaagattagattggctggaaatgaaaatgttatggtctgtgagagaggaactatgtttggctacaatgatttgattgtcgatccacgcaactttgagtggatgagggaggctaattgtcctattgtggctgatgtcacccattctttgcaacagcctgccgggaggaagctggagggtggtggtgtcgctagtggggggtcttcgcgaactgataccatgcatcgcaaggacagccgttgctgttggagttgatgggattttcatggaggtacatgatgatcctctaagggctccagttgatggtccaacccaatggcctctgcgacatttggaggaactgctagaagagcttattgcaatcgctagagttagcaaggggaagcagagcttcaaaattgatctcacaccattccgtgattaagttgactttgaggcttctct

SEQ ID NO: 10304 - DNA, 1074 bp, Valeriana officinalis
ctctaaaacctactcgatccagcaagccatcgaagatctcatcattgatattgaacaggttacgaattttctgagagatggattcttctggaatgctatttaaccagcttaagactgcagagccttttttcctgttagcaggtcccaatgtcatcgaatcagaagagcatgtgttacgtatggctggacgtattaaagccattgcagacaagttaggtgcagttggtttcaaatcgagttttgacaaagctaatcgaacgtcctctaaatctttcgcggtccaggcttagctgaaggcttgaagattcttgaaaaggtgaagttaacatatggcctgccgattgtgactgatgtacacgaagctagtcagtgtgaagcagttgccaaagtcgctgatataattcaaattccagcttttctatgccgccagacagatctacttgtagcagctgcaaaaacgggaaaaattataaatatcaagaaaggacaattttgtgctccttctgtcatggaaaattctgcagagaaagttagattggctggaaatcaaaatgttatggtttgcgagagaggaacaatgttcggatataatgatttgattgtcgatccacgtaactttgaatggatgagggaagctaaatgccccgttgtagctgatattacacacgctttgcaacaacccgctgggaaaaagttggaaggcggtggagttgccagtggaggtcttcgcgagttgataccttgtattgcgaggacagctgtcgccgtaggagtggatgggattttcatggaggtgcacgatgatcccctaaatgctccggttgacggcccgacacaatggcctctacgccacttggaggaacttctcgaagagcttgtggcaattgcgaggataagcaaggggaagaaacagttcaagatcgatctcactccacttcgcgattaggaacttttttctcgctgtctggttagtcaatgaaaaattaccgaattctaaaaacaatattctctttggtaaattaaaatattcgattatatgggacgcgattcatgtgtccatataaatcttaacca

SEQ ID NO: 10305 - DNA, 1283 bp, Spinacia oleracea
aaaagtgcaattgataagaaggactttgttttcgttttaacgctccgaagtccgaacagtgtacacgatctcatcagtgtaagctactactgtcatatgtgacgatctatctgcttctcccaagagtttgacatcatctctaaggaaatacgctgaaaatatggattcttccgtatctctatatacccaacttaaggcagcccaaccgttcttcgtgatggcgggtccaaatgtaattgagtcagaagagcacgttatgaagatggctaagcacataaaggctataacaaccaaagttggggtgcctctgatcttcaagtccagctttgacaaagctaacaggacgtcttctaaatcattcaggggtcctggtatggcagaaggcctgaaaatccttgagaaagtgaaagtagcatatgacctcccaatagtaactgatgtgcacgaaagcagtcagtgtgaagctgtgggtaaagttgctgatatcatccagatcccggctttcttatgccgccagacggacctccttgttgcagctgccaaaacagggaaaatcatcaatattaaaaaaggtcaattttgtggtgctaacgtgatggtgaactctgctgaaaaagtcagaggggctggcaatgaaaatgttatggtttgtgagagggggactatgtttgggtacaatgatttgattgtggatccccggaacttggaatggatgagagaagctaattgccccgttgtagctgatattactcattcactacaacaacctgctgggcaaaagttggatggtggaggtgttgctagtggagggtttcgggagctgattccgtgtatagcaaggacatcagttgcagtgggagttgatggaatcttcatggaagtccatgacgacccgttaagtgcaccctgtgatgggcccacacaatggcctcttcgccatttggaagagttgctcgaagagctggttgctattgctaaagtaagcaaggggaaacaacagtttgccattgatttgacaccattccgtgattaggaagacctttcgagtatgtgttagtaacctcagcttatcctttcacttccaaaattcagattatccaatgctgcatgtttacaaactcaatagtatcaattaagttcatcattactcatttgtcgcaagcgttacactcttcaaaaatagattgaagtagaattattggcttattgtattgctataatgtatcattgcataccattaatgaagttttcaattgttggtttctcatttcctcccccttccc

SEQ ID NO: 10306 - DNA, 1127 bp, Ambrosia trifida
cgacaagaagcgtagttacttgcattcaccactcagcaatctctgttgttcaatccacaagattcagttattcacacttcaaatatggactcatcaactgctctattcaaccagcttttggaagcgcagccgttctttgtgttggctggtcctaatgtgattgaatctgaggaacatgttttgcatatggcgaaacaaattaaggctgttactacaaaacttggattgcctttagtttttaagtctagctttgacaaagctaacagaacttcatcaaaatcctttcgagggcctggattagctgaaggattgaagatccttgaaaaggtgaaaacaacatatgacctgcccatagtgaccgatgtacatgaatctgaccagtgtgaagcagtcggcagggttgcagatataattcaaataccagcttttttgtgtcgacagactgatcttctggttgcagctgccaagactggaaagattgtgaatataaagaagggccagttttgtgctccctctgtcatgaccaactctgcagaaaaagttagattggctggaaatcaaaacgtcatggtttgtgagagagggaccatgtttggatacaatgatttaatcgttgatccacgcaactttgagtggatgcgggaagctaattgtcctgttgtagcagatgtcacacatgccttacagcaacctgctgggaaaaagctggaaggtggtggtgttgcgagtggaggtcttcgagagttgataccttgcattgcaaggacagcagttgctgttggagtggatggacttttcatggaggtgcatgatgatccacttaacgctccagttgatggtccaacacaatggcctctacgccattttgaggagctgctagaagagctaatggcaattgctagggttaccaaggggaagaagcaatacaaaatcgatctcactccatttcgtgagtaataactcctgtatgcgtgatcaaacagaaaggcaagattctgcggatgtgcctgaacgtgtgaaagataacatcatcataatttaccagtcaatacttagaatctctgttttccgaaatacattgttgttggctacatggtgtgtatcaatatttaactattagtttattg

SEQ ID NO: 10307 - DNA, 1532 bp, Chrysanthemum coronarium
agtccgaaccaatccgagccgacccaacccaaccgacaacgatgagaatgacaccagccagccagcgtgcgactcatgtgtgaccatgagcaataagattagctaccactcagactcactcactcactgatcatctatctgcttcgatcgctattcttcaatccatattaatttcacgatttaattcttcaaagatatggactcatcaactctgctatacaaccaccttaaggaagcacagccgtttttcgtcttggctggtcccaatgtgatcgaatccgaggaacatattatgtatatggccaaacaaattaaggctgttactaccaagcttgggttgccgttagtctttaagtcgagttttgacaaagctaacaggacttcatcaaaatctttccgagggcctggattagccgagggattgaagatcctcgaaaaggtgaaagtgacgtatgacttgcccatagttactgatgtacatgaatccagccagtgtgaagcagtcggcagagttgcagatattattcaaatcccagcctttttgtgccgacagactgatcttctagttgcagccgctaagactggaaaaatagtaaacataaagaaaggccagttctgtgcttcctctgtcatgaccaactctgctgaaaaagttagattggctggaaatcaaaatgttatggtttgtgagagaggaaccatgtttggatacaatgatttaattgttgatccacgcaacttcgagtggatgcgggaagctaattgccctgttgtagcagatatcacacatgcattacagcaacctgctggtaaaaagctggaaggtggtggtgttgcgagtggaggtctccgggaattgataccttgtattgcaaggacagcagtcgctgttggtattgatggacttttcatggaggtgcatgatgatccagtcagtgctccagttgatggtccaactcaatggcctttacgccatttcgaggagctgctagaagagcttgtggcaattgctagggttaccaaggggaagcagcaatacaaaattgatctcactccataccgcgagtaagaagtgaaggctgttcttcctgaaagaaaggtgcatgatttgagaacaaattactgaaacataattttgcacagttaatgagcatattatgatattcacatgaataaaatgccttctgatttcaggcaaaatcctgctctgacatcagatgtgcctgaacgtgtgaaagatcacagcattgtattctattcattgacaatttggaatctattgttcgagattatttcttgtcagatggtaacaccatctgtatcaatatctagatattagtattgtgtaattgataataaactggcgtacacgctaggatttagttctcttgtgggttaaccaagctgtctctcatgttgatcttctgtcacccaatttgtatcactctcatttgacttgaaatgctaatgaacataaataacccaactatcctgtaaggtaaacttcgtcattaaaagatggaaacatgttt

SEQ ID NO: 10308 - DNA, 1397 bp, Aquilegia formosa
caacatctgaacaatctttcattcatcattaaagttgtctcgagatgctctaatcagttttcactgcggatggaagaagatggtttaaatgtctgtggccgggtgtctatgatctggaacaagtgtacactacaattctctcttcattcttcttcatcactctcactctctctctcgaccgacacattttacaatctctctctctctctctctctctctctctctctctctctctctctctctgagtgaacaacgatgatgaattcgtcagcagtactgctttacgaccaaatcaagtcaacagaaccgtttttcgtattagctggtcccaatgtaattgaatctgaagaacatatcttccgaatggctaaacatatcaaagctatcacttccaaacttggattgcctttggtgtttaaatctagctttgataaagctaaccgtacttcgtcacaatcgtttcgtggtcctggtatggatcaaggcttgaagatccttgaaaaagttaaactagcatatgacatccccattgtcactgatgtgcatgaggctaaccagtgtgaggctgtgggcaaagtcgcagatattattcagattccagccttcctctgccgtcagacagatcttttgattgcggctgccaagactgggaaaatcattaatattaagaaaggccaattttgtgctccatctgttatggtaaactctgcagaaaaagttagacttgctgggaacccaaatgtgatggtttgtgagcgcggcaccatgtttggttataatgacttaattgttgatccacgcaacttggagtggatgagggaagctaattgtcctatagtagcagatattacgcattcattgcaacaacctgctggaaaaaagctggaaggtggaggtgttgcaagtggaggtcttcgggagttgatcccatgtattgcaagaacagctgttgctgtcggggtggatggaatctttatggaggtgcacgatgatcctctacaggctcctgttgatggtcccacacaatggcctctacgtcactttgaggagctactgaaagagcttatggaaattgctagggtaactaaggggaaacagcagttcaaaatagatctcacaccatatcgtgatcaagactcttgaaatagctcatgcaggaccaagtgatgctttattttgcaatgttgtacgaatttcatctagtttgtattatttttttgtatgtcaaacaactcattggtcagtgtgagtacaacattggtttatgttaattcctatttgcacattccttgtaaattgtgaacggtgggcatgctttatctgaagactagtgtcttgggctgtgcattgtgacattgcaagtttctgtttcacaaagagttggcttacttggtttg

SEQ ID NO: 10309 - DNA, 1032 bp, Humulus lupulus
attccgactccgtgtactagatcggttctcactccggagtagcaagagatggattcatcgtcatcagcactgctatacagccatctcaaggctgcagatccctttttcttaatggctggtccaaatgtgattgaatctgaaggccatgtcatgcgaatggctgctcgcataaaggctgtcgcctcaaaagttgggttgcccctggtgtttaagtcaagctttgacaaagctaaccgaacatcatcaaaatcatttcggggtccaggcttgactgaaggtttaaagatccttgagaaggttaaattagcgtatgacttacctataattaccgatgttcatgaagcttctcagtgtgaagcagttggcaaagttgcagatattattcaaattcccgcatttctgtgtcgtcagacagatctcctagttgcagcagccaagactgggaaaattatcaatgtcaagaagggccagttttgtgctccttctgtcatggaaaattctgttgagaagattagactggctggaaattcaaatgtgatggtctgtgagaggggaactatgtttggatacaatgatttaattgttgatccacgcaacttggagtggatgagagaagctaattgtcctgttgttgctgatgttacacattcactgcaacagcctgctgggagaaagttggctggtggaggtgttgcaagcggtggtcttcgtgaattgataccatgcattgcaaggacagctgttgctgttggtgttgatggagttttcatggaggtgcacgatgatcctttgaatgcgccggttgatggtccaactcaatggcccttgcgccatttggaggaacttcttgaagagcttgtggcaattgcaagggtgagcaaggggaagcaacccttcaatattgatcttacaccatatcgtgattgaagattaacgaggccactttctgtggtaagaaagtgaattaatgtcaaattattgttcatgccatgttttgcattttatgtattttataataaatatcacactaga

SEQ ID NO: 10310 - DNA, 1352 bp, Brachypodium distachyon
tcgtgccgtgctgctccccagtccccatgctctgccctaccaaagcagctccgagcccatccacaagtgtctccgatctctaaaatctcaatgcgcctctaaattctcacctacccgaccgccgctgcgccctacaagttccgccaatttcgccggaccgtgccaccgacgcccctctctctctctctctcacacacacaccccagccatctcccgcgcgccgccgccgccgcggttcccgttctaacttctcagacatggatgcttcgtccgtggcgctgttcaaccagctcaaggctgctcaaccattcttcttgctagctgggcccaatgttattgaatcagaggagcatgtcatgaagatggccaaacacatcaaagccatcacaaccaaagtcggggtgcctcttgtcttcaaatccagctttgacaaagcaaaccgtacatcatcaaaatcctttcggggtcctggattagaagaaggcctgaagatccttgaaaaggtgaaggcagcatatgaccttccagtggtcactgacgtgcatgaaagctaccagtgtgaagctgttggaagagttgctgacattatacagattccagcattcctctgtcgtcagactgaccttctagtggcagctgccaagactggaaaaattatcaatatcaagaaaggacaattctgtgctccttccgttatggccaactccgcagagaaaattagacttgctggaaatcaaaatgtgatggtctgtgagcgtggaaccatgtttggctacaatgatctaattgtggacccaaggaattttgagtggttgagggaagcaaattgcccggttgtagctgatgtaacacatgctctacaacaaccagctgggaaaaagcttgatggtggtggggttgcaagtgggggcctacgagaactaataccatgtattgcaaggacttcggttgcagttggtgttgatggtattttcatggaggtacatgatgacccagtgaattcaccttgcgacggcccaactcaatggccattgcgtaatttggaggagctattagaagaactgatcgagattgctcatgtcaccaagggaaagaagccgttcaagatcgatctaactccattccatgaatgatctggtggatagcaaaaggcacttgtccccatctatttgtttcgacagtgtttccctatgaggatgaaccgttctttgtatgccattactgctgctatctgtattggctttcctgtattattttttttaattttcaagcataaacatagcagccgtagaaatttgtttcacaactgaaccactgtacccagcgactcatttcgaaagaagttacagagt

SEQ ID NO: 10311 - DNA, 953 bp, Avena sativa
acatggacgcctcgtccgtggcgctcttcggccagctcaaggctgctcaacccttcttcttgttagccgggccaaatgtcattgaatcagaggagcatgtgatgaagatggccaagcacatcaaagccatcacaaccaaacttggggtgcctcttgtgttcaaatccagctttgataaagcaaaccgtacatcgtcgaaatccttccgtggtcctggtctggaagaaggcctaaagatccttgagaaggtgaagacggcgtatggcattccagtagtcaccgacgtgcatgaaagctggcagtgtgaagctgttggaagagttgcggatattatacagattccagctttcctctgtcgtcagactgaccttctagttgctgcggctaagactgggaaaattatcaatatcaagaaaggacaattctgtgctccttctgtcatggctaactctgcagagaaaattagactggctggaaaccaaaatgtgatggtctgtgagcgtggcaccatgtttggttacaatgatctaattgttgacccaaggaactttgagtggctgagggaagcaaattgcccagttgtagctgatgtaacacatgctctacaacaaccagctgggaaaaagcttgatggtggtggggttgcaagtgggggcttacgagaacttataccatgcatcgcaaggactgctgttgcagttggtgttgatggtatcttcatggaggtacatgatgatcccgtgaattcaccatgcgacgggccaactcaatggccattacgcaatttggaagagctactggaggaactgattgccattgcgcgagtcaccaagggaaagaagccgttcaatatcgatctaacaccattcaaggagtgacctggcacggtggatggcgaaagacaccttctcactgcccaatgtggctgtatcaggacagaatcactctttgtg

SEQ ID NO: 10312 - DNA, 1244 bp, Panicum virgatum
cccccgtcgctgtcgtcctccgctccggcgccactcgctcctgccccccgcgcctctctccgctcccaactcgcgtctcgatccctcctccgatctctcttctctcgggggagcagggaggaggaggatggaaggccctccagtcgcgcttttcgacagcctcaaggctgccaaaccattcttcttgctagctgggcccaatgtgattgaatcggaggagcatgtcctgaagatggccaaacacattaaaggcatcacaaccaagcttgggatcccacttgtgttcaaatctagcttcgataaagcaaatcgtacatcatcaaaatctttccgtggccctggtctggaagaaggcctgaagatccttgaaaaggtgaaagcaacatatgaccttccagttgtcactgatgtgcatgaaagccaccagtgtgaagctgttggaaaagttgctgacattatacaaattccagctttcctctgtcgccagactgatcttctcgtggctgctgctaagactggaaaaattatcaatatcaagaaaggacaattctgtgcaccctctgttatggtcaactctgcggagaaaataagacttgctggaaatcctaatgtgatggtctgtgagcgtggtaccatgtttggctacaatgatctaattgttgacccaaggaattttgagtggctgagggaagctaactgcccagttgtagctgatataacacatgctttacaacaaccagctggaagaaagcttgatggtggaggtgtggcaagcgggggcttccgagaactaataccgtgcatcgcaaggacttctgttgctgttggtgttgatggtattttcatggaggtacatgatgatcccttgaatgcgccatgtgatggcccaacccaatggccattgcgcaatttggaggagctattggaggaattgttagcaatcgctcgagttaccaagggaaagaagccgttcaagattgatctcacaccgttccaggaatgatctggtttggtagattgagagcacaatgacactgtccactggtttcaacagggcgtatttctcattgctgtacttgttattgttttgggcatagctgccgtagacgactgttatatctgaactactgaattgaatcctgtggttgctttgtgctgtttcattggttataccatgttattggacaaacaatatcacgcaaaataaatgtgattgcctgctgattaccagctttctgcttcgg

SEQ ID NO: 10313 - DNA, 1988 bp, Zostera marina
ggggatcggaaggaagctcaccaagttgtcgtaaaaccgatacttcgattgtgctctccagtcgacatattccgggaatcatggattcatctgcaacgtcgctcttcgaacaactcaagggtgccgcgccatttttcatattggctggtccgaatgtgatcgagtctgaggagcatgtgttgaagatggcaaagcatataaagggcatcacatccaagttgggacttcagcttgttttcaaatgcagttttgacaaagctaatcgtacttcatcaaaatctttccgtggtcctggcttggaagaaggtctcaggatccttgaaaaggtcaagcttatgtatgatcttccaatagtaactgatgtacatgaggtttcccagtgtgaagctgttggaaaggttgctgatattatccaaatcccagctttcctttgtcgccagactgatctattagtcgcagctgccaagactgggaaaattgttaatattaagaaagggcaattttgcgctccctctgttatggcaaattctgcagagaaagtaaggcttgcagggaacagcaatgttatggtttgtgaacgaggcaccatgtttggttacaatgatctgattgtcgatccacgcaatcttgagtggatgcgggaagcaaattgccctgttgtagcagacataacacattcactgcaacaacctgctgggaaaaagctagaaggtggtggagtggcaagtggaggtctccgtgaattaataccatgcattgcaaggactgctgttgctgttggggtggatggaatcttcatggaggttcacgataatcccttaagtgcaccagttgacggtcctacgcaatggcctctgcgacatttagaggaactgttggtggaactcatagctctggctaaggtgagcaagggaaaacattccttcaatattgatctcactccattccaggattaaacaaacattcttcgagtccctttcattgcaaccagaatacgatgatataataaatttgttatccatcgtagattcacattatcacactatcactcaatgcataaagatatttttatttgatatataagtttaagaccataccacaactgaaatatattgatgcaccaattgagttataacttcaaatttcctacgttctaacaatgttcgttctcttattcaaaaagaaacccatcattcatcgtccatcctatcatcacttaagatggtgttcaatcaaggatgccatttcaatagcagtcagagcagcctcggaacctttgtttccagcctttccaccagctctatttagtgcctgatccatgttatcacaagtaagaacaccaaagatgcatggaactcctgaacccaaactggcagatagtacaccagacgctgcagaattggcaacagcatcataatgggtagtgtctcctctgaccacagctccaatgcacaaaatagcattgtatttcccagatttgccaaggatttgagctgttattggaatttcaaaactcccaggaactgtgatgacatcaatgttctcttctgtgactgaatatcgcttaaatgtctctagagctccctccaacagtggttttgtcacaatctcgttgaatcgtgccacgaccacagcaaaacgtaatccttcggttttgttcagggatccaactaaatgtttaggccctgccattgccgaaattgagtaccttctcttcgtcccactccttagtggtccctggttaaggagggtggatcttgaagtgaggccgcgattgttcgtggaaagaggcgaaactatcccactgcgcatcgagttcttagaaaaagaagtgtgtttatttaatcgagaaccaacctgcattgtcatccccgtagcaaaagctgccgacatgttgccctaaaatgctctcgctcgtagatacgcggcggaggttgtcactttcccgccacaatccgacggggcgcacaaaaagatggaatagtctc

SEQ ID NO: 10314 - DNA, 1355 bp, Beta vulgaris
ctgattcctctcggctctcgcgaaatctctaattctccagcgtattcagtttgggaatttttttggcgagagaagctgaaaatatggaatcttcaactgcactgtatacccaacttaaggaagcacagccgttcttcgtgatggcgggtcctaatgtaatcgagtcggaagagcatattatgaagatggctaagcacataaaggcaataactacgaaactcggagtgcctctcatctttaagtccagcttcgacaaagcgaacaggacgtcttcaaaatcattcaggggtcctggaatggctgaaggtttaaaaatccttgaaaaagtgaaagtagcttatgatctccctatagtgactgatgtgcatgaaagcattcagtgtgaatctgtgggtaaagttgctgatgtgatccagatcccggctttcttatgccgtcagacagacctcttggtggcagcagccaaaacagggaaaatcattaatattaagaaaggccaaatgtgtgctactactgttatggtgaactctgctgagaaagtccgaggtgcagggaaccaaaatgtgatggtttgtgagagagggactatgtttgggtacaatgacttgattgtggatccccggaatttggaatggatgagagaagctaattgccctgttgtagctgatattacacattcactacaacagcctgctgggagaaagttggatggtggaggtgttgctagtggagggtttcgagagttaatcccgtgtattgcaaggacagctgttgcagtcggagttgatggaattttcatggaggtgcacgatgacccgttaagtgcaccagttgatgggcccacacaatggcctcttcgtcatttggaggagttgcttgaggagctgattgctattgctaaagtaagcaaggggaaacaacagtttgccatcgatctgactccatttcgcgattagggacaccttttgagtattggtatgtaaccttagctcatcctttcattttctatgtagaattgagattgtccaaatgctattctataaagtctggtaagtggtaaccaaattaagctatcatttgttgagagctttactcgcttcatggactttgaaattgatttgttgcttgaaatttattactagtactgggtaactgtttgagaggatagtctcttaggattatcggtgaaggccaaactatgtattactataatgtacttatcaatgaagtgttgtttatctagcacacacaagtgtaatgggcttattctcacccaataacatcttttaccaccccttccctacttcgacgaggacttgaacccggggcatgcccttggaagaagggagagccga

SEQ ID NO: 10315 - DNA, 1401 bp, Lactuca sativa
cggacacacatcagatccaactcgacccgaatcggccgacagtaagtagtactcagtattccgtagtttcaccagtgaccaggcagagatcatcggagcaatctctgttcttccaatccagaaaggtgtaaagatttagttgttcacaagtaagatatggattcatcaactgcgttatacaatcagcttaagggagcacaaccattctttgtgttagctggtcccaatgtgattgaatctgaagaacatattttacatatggccaaacaaatcaaggctatcacttcaaaacttggattgccattagtttttaagtcaagctttgacaaagctaacagaacctcatcaaaatcttttcgtgggcctggattagctgagggattaaagatccttgaaaaggtcaaagtcacatatgacttgcccatagtgactgatgtacatgaatctagccagtgtgaagccgttgccagggttgcagatataattcaaattccagcatttttatgtcgacagactgatctcctagttgcagctgccaagactggcaaaattgtaaatataaagaaaggccagttttgtgcttcctctgtgatgaccaactcagcagaaaaagtcagattggctggaaatcaaaacgttatggtttgtgagagaggaaccatgtttggttacaatgatttaatcgttgatccacgcaactttgaatggctgcgagaagctaattgtcctgtggtagcggatgtgacacatgcgttgcaacaacctgctgggaaaaagctggaaggtggtggtgttgctagtggaggtctccgggaactaataccttgtgttgcaaggacagctgtcgctgtgggagtggatgggctttttatggaggtgcatgatgacccacttaatgctccggttgatggtccaacacaatggcctctgcgacatttagaggagcttctagaagagcttgttgcaattgctagggttaccaaagggaagcacaagtacgatattgaccttactccatatcgtgagtaagaagttgtggaggctgtgtaattgataataaacacactcatgctcgaagatttatgatttatgataatgctgttatttatttctgctgtatttgtgcgtgtgccaagggttgtgtaaaatttgagcctctgtattgtaaacatgatctttccttacattattttagttacaaaagtgaaagcaacgcacaaaaatgaaagtactcatttgcttaacacaaatgagtattctccaccgcataacttgtattagatcacacttttgagtgtattgacacccgcatacattccagttacacaaaaagtattaacatgtatttatgtgatttgagtattattattgattaagtttggttataatctaatgagatat

SEQ ID NO: 10316 - DNA, 1241 bp, Carthamus tinctorius
cggggatgaatagagggtgggtgcggggggcgggctattttgggatcatcatcattgccaatcggatccataatcccaccgaattcgacgcacagactacacacactagtcaaagactcaaagattcagctgttttacacataagatatgaactcatcaacagcgctttacaaccagcttaaggaagcacagccattctctgtgttggctggtcccaatgtgattgaatctgaggaacatatcttttatatggccaaacacattaaggccatcacttcaaaactcgggttgccgttagtttttaagtcgagcttcgataaagctaacagaacttcttcaaaatcttttcgagggcctggattggctgagggattgaagattcttgaaaaggtgaaagtggcatatgacttgcccatagtgaccgatgtacatgaatctagccagtgtgaagcagttggcaaggttgcagatataattcaaattccagcctttttgtgccgacagaccgatctgctagttgcagctgccaagactggaaaaatcataaatataaagaaaggccagttctgtgcttcctctgtgatgaccaactccgcagaaaaagtcagattggctggaaatcaaaatgttatggtttgtgaaagagggaccatgtttggatacaatgatttaattgttgatccacgcaacttcgagtggttgagagaagctaattgtcctgttgtagcagatgttacacatgcattacagcaacctgctgggaaaaagctggaaggtggtggtgttgccagtggaggtctccgagaattaataccttgcgttgcaaggacagcagttgctgtcggagtggatggacttttcatggaggtgcatgatgatccacttaacgctccagttgatggtccgacacaatggcctctacgccatttggaagagctgctagaagagcttgtgggtatcgctagggttagcaaggggaagaaacaatacaaaattgatctgactccattccgcgactaacaacttctgtgcgctggtttttcacgcgtagagaacaaaggcaagatcctgcccggacttcagatgtggccgaacgtgtgaaagatggcaacatcataatctatagttcaagggatacatttcaattatctaaacattattgttgttccttttcatttaggggtcttgtttgtctttatgtagcataggcaactcttgtgatcattgggtgctataagcgt

SEQ ID NO: 10317 - DNA, 1179 bp, Tabernaemontana elegans
gagctctcagaaggtcgcaagtgcaccgacggtctcaacgctccgtccctgtggttgtagccggtgaagccggaaggggtttccaattcaatttgttactccactgctgtagactagtaatcttctatccaaaagagatggatgcatcaacggtcctctacaacgagctcaagactgccgatccctttttcgtaatggctggtcccaatgtgattcaatcagaggaacatatcttcttcatggctaagcacatcaaggctgtcactactaaacttgggttgccattggtgttcaagtcaagcttcgacaaggctaaccggacttcctctaagtcattccgtggtcctggcttgactcaaggcttgaagatacttgaaaaagttaaagctgcatatgacattccaataatcacagatgttcatgagacaattcagtgcaaggcagttggtcaggttgctgatataattcagattcctgctttcctttgccgacagacagatctgcttgttgcagccgctcagactgggaaaattatcaatattaagaaaggccaattctgtgcttcttctgtaatgctaaactctgctgaaaaggttaggttggctggaaatcaaaacgttatggtctgtgagagaggaacaatgtttggctataatgatttgattgttgatcctcgcaacttggagtggattagagaggccaattgtcctgtggtggctgatgtgacacattcattgcaacaacctgcaggaaaaaagcttgaaggaggtggggtggctagtggaggtcttcgtgaattaataccttgcattgccaggacagcagttgctgttggggtggatggcatttttatggaggtgcataatgaccctctaaatgctccagttgatggtccaacacaatggccccttcgccatttggaggaacttttagaagagcttatatcaattgctaaggctagcaagggcaagcaacagtttaagattgatctcactccattccttgattgaaagtttttcaggtttctcctattgctactacggctaaccgagatgtgggtgatgacgaagttggtgcgtgtttggaccggaatttagtgtaacctcgattagtgttttctgagagactacatttaaaccattgattattcaatgaatgatgtgtctattgttgaacatg

SEQ ID NO: 10318 - DNA, 1297 bp, Ambrosia trifida
aataagtgtactcacttacattcaccactcagcgatctctgttgttcaatccacaagattcagttattcgcacttcaaatatggcctcatcaactgctctattcaaccagcttaaggaagcgcagccgttctttgtgttggctggtcctaatgtgattgaatccgaggaacatgttttgcatatggcgaaacaaattaaggctgttactacaaaacttggattgccttagtttttaagtctagctttgacaaagctaacagaacttcatcaaaatcctttcgagggcctggattagccgaaggattgaagatccttgaaaaggtgaaaacaacatatgacctgcccatagtgaccgatgtacatgaatctgaccagtgtgaagcagtcggcagggttgcagatataattcaaataccagcttttttgtgtcgacaaactgatcttctggttgcagctgccaagactggaaagattgtgaatataaagaagggccagttttgtgctccctctgtcatgaccaactctgcagaaaaagttagattggctggaaatcaaaacgtcatggtttgtgagagagggaccatgtttggatacaatgatttaattgttgatccacgcaactttgagtggatgcgggaagctaattgtcctgttgtagcagatgtcacacatgccttacagcaacctgctgggaaaaagctggaaggtggtggtgttgcgagtggaggtcttcgagagttgataccttgcattgcaaggacagcagttgctgttggagtggacggacttttcatggaggtgcatgatgatccacttaacgctccagttgatggtccaacacaatggcctctacgccattttgaggagctgctagaagagctaatggcaattgctagggttaccaaggggaagaagcaatacaaaatcgatctcactccatttcgtgagtaataactcctgtatgcgtgatcaaacagaaaggcaagattctgcggatgtgcctgaacgtgtgaaagatcacatcatcataatttaccagtcaatacttagaatctctggtttgcgaaaatacattgttgttggctacatggtgtgtatcaatatttaactattagtttatgatttggttgctccatgcaattcattctagcacctggttgttcctttcattttaggggtggttatcttcatagatgttaaaagagtttgattattaacacatttctatattattgtataactatatgagtaatttcttatcttacatgggttaggtttttggctacaaaaaagaaa

SEQ ID NO: 10319 - DNA, 1224 bp, Silene vulgaris
gagtaaaattatggttcttaacttgttatcggagtaacgacgatctcaacaacactccctcattcactcactctgtctctctcagcttttgttacggcagctctttagagtagggaggtagcttgagaaaatggactcctctgcattatatggccagctgaaggcatctgaaccgtttttcgtgatggcgggtcccaatgtgatcgaatcagaagaacacataatgcggatggccaagcatataaaggccataacatcaaaggtggggttgcccctagttttcaagtctagtttcgataaagctaataggacatcctccaagtccttcagggtccaggtctgactgaagggttggccatcctagaaaaagtgaaactagcatatgacctccccatagtgacagatgtgcatgaaagtggtcagtgtgaagcagtgggtaaagtcgctgatatcattcaaatcccggctttcttatgccgtcaaacagacctccttgttgaagctgctaagacagggaaaatcatcaatattaaaaaagggcaattttgtgcgtcttctgtgatgaggaattcagctgaaaaggtcagattggccggaaatcaaaaggtcatggtgtgtgagagaggtaccatgtttgggtacaatgacttgattgtggatcctcggaatttagaatggatgagagaagctaattgcccagttgtcgccgatatcacacattccctgcaacaacctgccgggaaacagctggagggaggcggtgttgccagtggagggttgcgggagttaatcccatgtattgcgcggacagcagttgcagtcggagtggatgggatattcatggaggtgcatgatgatcctttaagtgcaccggttgacggtccaactcaatggcctcttcgccattacgaagagttgctggtagagctgattgctattgctaaagtaagcaaagggaagcgaagttttgcaattgatttgacaccattccgtgattaggaggtattgcattggcatattccctgagcctgttgtttcatttcttatttgaattttagatggtgtgatgtgtgatgttggtttcaataattcagtagtttataagtttatttgatttggtgcaccagcggtgaataatgtattcctgttaagatgtcggcgtctgaaataatgtttccactgctggaatgtgttgtttatctggagttgttggttaccttgttt

SEQ ID NO: 10320 - DNA, 1037 bp, Arabidopsis lyrata
atcactaaattcttgtttcttcgtgaattttgttaaaaaagttgaggttttgttttctgatcttaagctctactaaaaaatggcgaattcagcgtcactactgtacgatcagctcaaggttgcggagccgtttttcttgtttgctggtccaaatgtgattgaatccgaagaacatgttcttcgaatggcgaaaagcatcaaagagatttctacaacgcttggattgcccctggttttcaagtcaagtttcgataaagctaacagaacttcatcaaagtccttccgaggtcctggcatgcctgagggtctcaagattcttgagaaggtgaaagtagcatatgatctaccaatcgtaactgacgttcatgaatcgagccagtgtgaagcggtcggcaaggttgcagatgtaattcagataccagcgttcttatgtcgccagacagatcttctggtcgcggcagcccaaactgggaaaattatcaacataaagaaaggacaattttgtggtcactctgtcatgagaaactcggccgagaaggttagactcgcagggaatccaaatgtgatggtttgtgaaagaggaaccatgtttggatacaatgatttaatagtagatccacgaaatttggaatggatgagggaagctgattgtcccgttgttgctgatataactcattcattacaacaacctgcaggcaagaagttagatggtgggggtgttgctagtggaggccttcgcgaattaataccatgcgtagcaagaacagccgtagctgttggtgtcaatggaattttcatggaggtgcatgatgatcctttgaatgcaccagttgatggtccaacacaatggcctctgcgtcatctagaagaactgctagaagagctcattgcaatcgcgagtgtcacaaaggggaaacagcagttccaaatcgatctcacgccttatcgtgattagaatcaaagggtcacgtcactttgggtgcaactacaccttcttgataatacttcaatcttgtcggagcaataagcattatttg

SEQ ID NO: 10321 - DNA, 1571 bp, Hordeum vulgare
cacggacggatctaccggcagtcgtcatcctccagcagagagcaaacccccatctgctctctctcccccgctccgcttcatcccaccgcctggactggacgcctccgtctgctcctccgtgccccatccatccgcatccgcatccgcatccgccaccgtcctccacgccctccggtgcgcatgattcagtaggcaacgagctcctcctcctcctcctcctcagccccacacttcccggatcctcgtcgccccggccgagcagagaccggagccccgccgcagatccgcagggaagaatggacgccccgtcggtggcgctgtacagccagctaaaggctgctcaaccattcttcttgtttgctgggcccaatgtgattgaatcagaggaacatgtcatgaagatggccaaacacatcaaggccatcacaaccaaacttggggtacctcttgtgttcaaatcaagctttgataaagcaaaccgtacatcgtcgaaatccttccgtggtcctggtctggagcaaggcctaaagatccttgaaaaggtgaaggccgcatatgaccttccagtggtcaccgatgtgcatgaaagctcccagtgtgaagctgttggaagagttgctgatattatacagattccagctttcctctgtcgccagactgaccttctagtggctgcggctaagactgggaaaattatcaatatcaagaaaggacaattctgtgctccgtctgttatggtcaactctgcggagaaaattagacttgctggaaatcaaaatgtgatggtctgtgagcgaggcaccatgtttggctacaatgatctaattgttgatccaaggaactttgagtggctgagggaagcaaattgcccagttgtagctgatgtaacacatgcgctacaacaaccagctgggaaaaagcttgatggtggcggggttgcaagtgggggcttacgagaactcataccatgcattgcaaggactgctgttgcagttggtgttgatggtattttcatggaggtacatgatgatcccctgaattcaccatgtgatgggccaactcaatggccattgcgcaatttggaggagctgttggaagaattgattgcgatcgctcgagtcagcaaaggaaagaaaccgctcaagatcgacctaaccccattcaaggaatgatttggcagtggatagcagtaggaataacctcgtcgccgccatttggtttcaccaatatggccgtgtccaggcgagttgctctttgtatgcggtactttaatttactgtcggcttcaagctttgttggattgtctgcatgttttagtttctttccaaacgtagcatagcagccacatgttgctgttttgaatcactctgtctggagagttaatccgaaggaagtcgacttttgatttgtggtgtttcagttggagcacattttttgaaatcaaacagcagggtaaagaaacacacacggttgcatgagcatgatgatggcagcttcctctatggctctatttatccctggtgataaactgatacagttgcgaacaataataaatacataaattctccttg

SEQ ID NO: 10322 - DNA, 1222 bp, Setaria italica
cccgctcccaactcgcatctcgatccctccgatctctcttctccccggttgtccccgcgcagggagcgaggaaaaggaggatggagggcccgcccgtcgcgctattcgacagcctcaaggctgccaaaccattcttcctgctagccgggcccaatgtgattgaatcggaggagcatgtcctgaagatggccaaacacattaaaggcatcacaaccaagcttgggatcccacttgtcttcaagtccagctttgataaagcaaatcgtacatcatcgaaatctttccgtggtcctggtctggaagaaggcctaaggatccttgaaaaagtgaaagcaacatatgaccttccaattgtaactgatgtgcacgaaagccaccagtgtgaagctgttggaagagttgctgacattatacaaattccagctttcctctgtcgtcagactgatcttcttgtggctgctgctaagactggaaaaattatcaatatcaagaaaggccaattctgtgcatcctctgttatggtcagctctgcagagaaaataagacttgctggaaatccaaatgtgatggtctgcgagcgtggtaccatgtttggctacaatgatctaattgttgacccaaggaatcttgagtggcttagggaagctaactgcccagttgtagctgatataacacatgctctacaacaaccagctggaagaaagcttgatggtggaggtgttgcaagcgggggcttacgagaactaataccatgcatagcaagaacttctgttgctgttggtgttgatggtattttcatggaggtacatgatgatcccttgaacgcaccatgtgatggcccaacccaatggccattgcgcaatttggaggaactattggaggaattgttagcaattgctcgagttaccaagggaaagaagccgttcaagattgatctcactccattccaggaatgatctagtttggtagtaacagtgcacaatgccactgtccatttgtttcaactttcaacagggtgtatttcttgtagctgtacttgttactgtttcgtgcctagctgccgcagatgactgttatgtgtgaattactgagttgacgcctgtgtggttggttcgtgctatttcatcagttgtaccatgtgtccatgttattggacaaacaatgtcatcgcaaaataaatgtgattgctggctgattaccagctttctacttctgtttatcc

SEQ ID NO: 10323 - DNA, 1225 bp, Oryza sativa
atcgtcgtgctcgccgacacggccacacggggcgtcgccatcctgtcgcctctgctcctcctcctcctgctccatctcctcctccatatcccactcgccaatctcgattccctcctccgctctacctcgccggagttcaccctgtgtgggactgggagcggcggcggcgtcggaggcaatggacgcttcgtcggtggcgctctacggccagctcaaggctgctcaaccattcttcttgttagctgggcctaatgtgattgaatcagaggagcatgtcctgaagatggcaaaacacatcaaaggcatcacaaccaagcttggtctgccacttgtgttcaagtccagctttgataaagcaaatcgtacatcatcaaaatccttccgtggtcctggtctggaggaaggcctgaagatacttgaaaaagtgaaagcaacatatgaccttccagtggtcactgatgtgcatgaaagccaccagtgtgaagccgttggaagagtggccgacatcatacaaattccagctttcctctgtcgccagactgatcttctagtggctgctgccaagactggaaaaattatcaacatcaagaaaggacaattctgtgctccttctgttatggccaactctgcagagaaaatcagacttgctggaaatcaaaatgttatggtctgtgagcgtggcaccatgtttggctacaatgatctaattgttgatccaaggaattttgagtggctgagagaagctaattgtccagttgtagctgatgtaacgcatgctctacaacagcctgctggaaaaaagcttgatggtggaggtgttgcaagtgggggcttacgagaactaataccatgcatcgcaaggacttctgttgctgtcggaattgatggtattttcatggaggtacacgatgatcccttgaacgcaccttgtgatggcccaactcaatggccactgcgcaatttggaggagctattagaggagctgattgcaattgctcgagtcaccaagggaaagaagccactcaagatcgatctcacccccttcaaagaataatctggtccagttggtaggaaataatgggcacacttgcttggttgatagttttgaccagcatatatttacctgtttggatgaattgctcgttgtatgtcatacattcgtttatcggtgactgttgtctgtattgtactgcctatacaataaagatcattgttttacccaaaa

SEQ ID NO: 10324 - DNA, 1264 bp, Centaurea maculosa
ttttggtatcatcattgcaatcggatccataatccatatcaaatcccaaccgaattcgacgcacagaccacactagtcaaacactcaaagattcagctgtttataagatatgaattcatcaacagcgctttacaaccagcttaaggaagcacagccattctttgtgttagctggtcccaatgtgattgaatctgaggaacatatcttttatatggccaaacacattaaggccgttactacaaaactcgggttgccgttagtttttaagtcaagctttgataaagctaacagaacttcgtcaaaatcttttcgaggacctggattggctgagggattgaagattcttgaaaaggtgaaagttgcatatgacttgcccatagtgaccgatgtacatgaatctagccagtgtgaagaagttggcaaggttgcagatataattcaaattccagcctttttgtgccgacagaccgatctcctagttgcagctgccaagactggaaaaatcataaatataaagaaaggccagttctgtgcttcatctgtgatggccaactcggcagaaaaagtcagattggctggaaatcaaaatgttatggtttgtgagagagggaccatgtttggatacaatgatttaattgttgatccacgcaacttcgagtggttgagagaagctaattgtcctgttgtagcagatgttacgcatgcattacagcaacctgctgggaaaaagctggaaggtggtggtgttgctagtggaggtctccgagaattaataccttgcgttgcaaggacagcagttgctgttggtgtggatggacttttcatggaggtgcataatgatccacttaacgctccagttgatggtccgacacaatggcctctacgccatttggaggagctgctagaagagcttgtgggtattgctagggtcaccaaggggaagcaacaatacaaaattgatcttactccattccgcgagtaacaacttctgtatgctggtttttcacgcgtaatgaagaaagaactctcgctcgttttcaggcaagatcctgccgggacctcagatgtggctgagcgtgtgaaagatgtcaacatcataatctatagtttgaggaatacattttaaatatctctaaacattattgttgttcctttcatttagggatcttgtttgtcctgatgtagtataggcaactcttgttatcattgggtgctaattgctataagccttagacacgggaggaaggctagacctcaaacttta

SEQ ID NO: 10325 - DNA, 1090 bp, Lolium multiflorum
tcttccgatctccactgtcagtccgatctgcaatggcacatgccgcccgtccctctttcctcattcccatagcgccccgctccctcccagacgtacacaccgatcccactcccacccacagagcaattcctcctccgcgtgctccacgccgacgatctcgtctcaagggcggaaacggaatggacgcctcgtccgtggcgctgtacggccagctcaaggctgctcagccgttcttcctgttagccgggcccaatgtgattgaatcagaggagcatgtgatgaagatggccaaacacatcaaggccatcacaaccaaacttggggtgcctcttgtgttcaaatccagctttgataaagcaaaccgtacatcatcgaaatccttccgtggccctggtctggaagaaggcctgaagatccttgaaaaggtgaagatggcatatgacctcccagtggtcactgacgtgcatgaaagctggcagtgtgaagctgttggaagagttgctgatattatacagatcccagcttttctctgtcgccagacagaccttctagtggcggccgctaagactgggaaaattatcaatatcaagaaaggacaattctgtgctccttcggttatggcgaactctgccgagaaaattagactggctggaaatcaaaatgtgatggtctgtgagcgtggcaccatgtttggctacaatgatctaattgttgacccaaggaactttgagtggctgagggaagcaaattgcccggttgtagctgatgtaacacatgctctacaacaaccagctgggaaaaagcttgatggtggtggggttgcaagtgggggcttacgagaacttataccatgcatcgcaaggacttctgttgcagttggtgttgatggtattttcatggaggtacacgatgatcctgtgaattcaccatgcgacgggccaactcaatggccattgcgaaatctcgaggaactactggaggaactgattgcgattgctcgagtcaccaagggaaagaagccgttcaatatcgatctaactccattcaaggaatgatctggcacggtagatggcaaaaggctcaccttctc

SEQ ID NO: 10326 - DNA, 1321 bp, Zea mays
tcagcctcagctcagtctcttccactctcccttgacctgtctccttcacctgctgattgctgtgccgctccgctccgctccggtggcatctgcatctgcatctccatccctcgatctgtcttctctcagggtggaataagcgtgacaatggaggctccacccgtggcgctgttcgacaccctcaaggcagccaaaccgttcttcttgttggctggtcccaacgtgattgaatcggaggagcacgtcctgaagatggccaaacacatcaaagcaattacgaccaagcttggaattccgctcgtgttcaagtccagctttgataaagcaaaccgtacatcatcaaaatcattccgtggtcctggtcttgaagaaggtcttaagatccttcaaaaggtgaaagcaacatatgaccttccgatagtcactgatgtgcacgaaagccaccagtgtgaagctgttggaagagttgctgacatcatacagattccagccttcctctgtcgccagactgatcttctagtggctgctgctaagactggaaaaattatcaatatcaagaaaggacaattctgtgcgccttctgttatggtgaactctacagagaaagtaaggcttgctgggaatccaaatgtgatggtctgtgagcgtggtaccatgtttggctacaatgatctatttgttgacccaaggaaccttgagtggctgagggaaagcaactgcccagttgtagctgatgtaacacatgctctacagcaaccagctggaagaaagcttgatggtggaggtgttgcaagcggtgggctacgagaactaataccgtgcattgcaaggacttctgttgctgttggtgttgatggtattttcatggaggtacatgatgaccccttgaatgcaccatgcgatggcccaactcaatggccattgcgcaatctggaagagctgttggaggaattaattgcaattgctcgagttaccaagggaaagaagccattcaagatcgacctcactccgttccaggagtgatctgctttggttgatagaaagcacaatgccaccatccatggaattccacagggtggatttcaatatgaattgagtacttgctattgttgggagtatacctgcagtggatgacttagactatctctagcagattctttatctcattccgtattttatttcctttttcaaactccactccgcaaacagtgtcaaacagtgttgtcatctacagtttcgcattccctgttttaccctatctactcgagacagtcttatcaccgaacaaactattgtgttgaaacctgccggattggtttgt

SEQ ID NO: 10327 - DNA, 1505 bp, Triticum aestivum
cccatgtgctctctgccccgctccgcctgatcccactcccaccgcctcctcctgctcgtccgtaccccattcatccacatccgccaccgtcctccatgccctgcctccggtgtgcctgacgacccgattcctcgccaacgaactcctcctcagccccccacttcccggatcctcgtcgccccggccgagcagaaaccggagccccgccgcagatccgcagggaggaggaggggggagaatggacgccccgtcggtggcgctctacaaccagctcaaggctgctcaaccattcttcttgttagctgggcccaatgtgattgaatcagaggaacatgtcatgaagatggccaagcacatcaaagccatcacgaccaagcttggggtgcctcttgtgttcaaatcaagctttgataaagcaaaccgtacatcgtcgaaatccttccgcggtcctggtctggaacaaggcctaaagatccttgaaaaggtgaaggccgcatatgaccttccagtggtcaccgacgtgcatgaaagctgccagtgtgaagctgttggaagagttgctgatattatacagattccagctttcctctgtcgccagactgaccttctagtggctgcggctaagactgggaaaattatcaatatcaagaaaggacaattctgtgccccgtctgttatggccaactctacggagaaaattagacttgctggaaatcaaaatgtgatggtctgtgagcgaggcaccatgtttggctacaatgatctaattgttgatccaaggaactttgagtggctgagggaagcaaattgcccagttgtagctgatgtaacacatgctctacaacaaccagctgggaaaaagcttgatggtggtggggttgcaagtgggggcttacgggaactcataccatgcatcgcaaggactgctgttgcagttggtgttgatggtattttcatggaggtacatgatgatcccctgaattcaccatgtgacgggccaactcaatggccattgcgcaatttggaggagctgttggaagaattgattgcgatcgctcgagtcaccaaaggaaagaaaccgctcaagatcgacctaactccattcaaggaatgatttggcagtggatagcaataggaataaccttgtggctgccaattggtttcaccaatatggtcgtgtccaggcgagttggctctttgtatgcggtactttcatttaccgttggcttcaagctttgttggattgcctgcatgtattagtttctttccaagcgtagcatagcagccacagattgctgttttgaatcactctgtctcgagagtcaatccgaaagaagtcgacttttgatttgtggtgtttcagttggagcacatttttcgaaatcggacagcagggtaaagaaacactcgcggttgcatgagcatgatgatagcagcttcctctttttatccctggtgataaactgatacagttgcgaacaatgctaaatacataaattctcctt

SEQ ID NO: 10328 - DNA, 1065 bp, Amaranthus tuberculatus
ctcccattgtcatgcaagaagccctaacgaatatggaatcttcagctgcattatttacccaacttaaagctgcccaaccattcttcttgatggcggggcctaatgtaatcgaatctgaagaacacactatgcagatggcaaatcatataaaagccataacaaacaaactaggcgtacctttgattttcaagtccagctttgacaaagctaacaggacatcagccaaatcatttaggggccctggaatggatgaaggcttaaaaatccttgagaaagtgaaagtagcatatgatcttcctatagttactgatgtacatgaaaccattcagtgtgaagcagtcggtaaagttgctgatgtgattcagatcccagctttcttatgccgtcagacagacctccttgttgcagctgccaaaactgggaaaattatcaatatcaagaaagggcaattttgtgctcctactgttatggtgaactctgctgagaaagtccgaggtgctggcaatcagaatgtgatggtctgtgagagagggaccatgtttgggtacaatgacttgattgtagatccccgtaacttggaatggctaagagaagctaaatgccccgttgtggctgacatcacacattcactacaacaacctgcaggacggaagttggatggcggaggcgttgctagtggaggtttccgtgaattgatcccatgtattgcaaggactgcagttgccgtgggagttgatgggattttcatggaggtacacaatgacccattacgtgcacccgtcgatgggccaacacaatggcctcttcgtcatttggaggagttgcttgaagagctgatagcaattgcgaaagtaagcaaggggaagcaacaatatgaaattgatttgacaccattctgaaattcaagaggccttttgagtgttgttggtttgtatcctttagccatatttcattttatgtgtggattgagatcattaatttagttctattgcttgtatcaatcatcgtgaagcagcccaaactctaaaccacgtctcaccgtgaggcgacttcaattgggttaac

SEQ ID NO: 10329 - DNA, 937 bp, Vinca minor
gcagatccctttttcataatggctggtcctaatgtgattgaatcagaggaacatattttctacatggctaatcacatcaaggccatcactgctaaacttgagttgccattgatattcaagtccagcttcgacaaagctaaccgaacttcttctaagtcttttcgtggtcctggcttgactcaaggcttgaagatacttgaaaaagttaaagctgcatatgacattccaatagttacagacgtccacgagacgattcagtgtgaggctgtcggtcaggttgctgatataattcagattcctgctttcctgtgccgacagacggatctgcttgttgcagccgcccagactgggaagattatcaatatcaagaaaggacaattctgtgctccttctgtaatgctaaactctgccgaaaagattaggttggctgggaatcaaagtgttatggtctgtgagagaggaacaatgtttggctataatgatttgattgttgatccccgcaactttgaatggatgagggaagccaattgtccagtggtagctgatataacacattcattgcaacaacctgcagggaaaaagcttgaaggtggtggtgtggccagtggaggtcttcgtgaattaataccttgcattgccaggacagcagtggctgttggagtggatggcatttttatggaggtgcataatgacccccaaaatgctccagttgatggtccaacacaatggccccttcgccacttggaggaacttttagaagagcttatatcaattgctaaggctagcaaagggaagcaacagtttaagattgatctcactccattccgtgattaaaaggatttgaggtttctcctatgagctgttagggccatggatgaaacaccccggaaacccggatgtaatggacctctgtatgacggaagttggtggtcttcgg

SEQ ID NO: 10330 - DNA, 1028 bp, Thalictrum flavum
gtgatgatgatgaattcctcagcagtaatgctttacgaacaattcaagtcttcagaaccatttttcgtattagctggtcccaatgtcattgaatctgaagagcacatcttccgaatggccaaaaacatcaaagctatcacttccaaacttggcttgcctttggtttttaaatctagctttgacaaagctaaccgtacatcttcacaatcgtttcgtggtcccggaatggaacaaggcttgaagatccttgaaaaggttaaaatagcatttgacatccccattgtcactgatgtgcatgaggctagccagtgtgaggctgttggcaaagtcgcagatattattcagattccagctttcctttgtcgccagacagatcttttgattgcggctgccaagaccggcaaaatcattaatattaagaaaggccaattttgtgctccatctgttatggtaaactctgcagaaaaagttagacttgctgggaatccaaatgtgatggtttgtgagcgaggcaccatgtttggttacaatgacttaattgttgatccacgcaacttggagtggatgagggaagcaaattgtcctatagtagcagatattacacattcattgcaacaacctgctggcaaaaagctggaaggtggaggtgttgcaagtggaggtcttcgggagttgatcccatgtattgcaagaacagcagttgctgtcggggtggatggaatctttatggaggtgcacaatgatcctctacaggcacctgtcgatggtcccacacaatggcctctacgccactttgaggagctactggaagagcttatgcaaattgctagggtaaccaaggggaaacggcagttcaaaatagatctcacaccatatcgtgatcaagactcgtgaaatagctcatgcaggaccaattgatgctatattttgcaatgttgtacgaatttcattgaggtttattttcttgtatgtcaaacaactcattggtcaatgtaagaatgacttaattctgtagttctcttgtaata

SEQ ID NO: 10331 - DNA, 1439 bp, Secale cereale
ggacgcatctgccgacagtcgtcatcctcctccggcaatcccatgtgctctctgccccgctgtgcttgatcccagcgcctcgacgcctcctcctgctcgcccgtggtccattcatccacatccgccacagtcctccatgccctgcctctgctgtgcgtgacgacctgattcgataggcaacgaactcctcctcctcagccccccacttctcggatcctcgtcgcgccggccgggcagaaaccggagccccgctgcagatctgcagggaggaggagggggaagaatggacgcctcgtcggtggcgctctacaaccagctcaaggctgctcaaccattcttcttattagctgggcccaatgtgattgaatcagaggaacatgtcatgaagatggccaagcacatcaaagccatcacaaccaagcttggggtgcctcttgtgttcaaatcaagctttgataaagcaaaccgtacatcgtcgaaatccttccgtggtcctggtctggaacaaggcctaaagatccttgaaaaggtgaaggccgcatatgaccttccagtggtcaccgacgtgcatgaaagctgccagtgtgaagctgttggaagagttgctgatattatacagattccagctttcctctgtcgccagactgaccttctagtggctgcggctaagactgggaaaattatcaatatcaagaaaggacaattctgtgccccgtctgttatggccaactctgcggagaaaattagacttgctggaaatcaaaatgtgatggtctgtgagcgaggcaccatgtttggctacagtgatctaattgttgatccaaggaactttgagttgctgagggaagcaaattgcccagttgtagctgatgtaacacatgctctacaacaaccagctgggaaaaagcttgatggcggtggggttgcaagtgggggcttacgagaactcataccatgcatcgcaaggactgctgttgcagttggtgttgatggtattttcatggaggtacatgatgatcccctgaattcaccatgtgacgggccaactcaatggccattgcgcaatttggaggagctgttggaagaattgattgcgatcgctcgggtcaccaaagggaagaaaccgctcaagatcgacctaactccattcaaggaatgatttggcagtggatagcaataggaataaccttgtcgctgccaattggtttcaccaacatggtcgtgtcgaggcgagttgctctttgtatgcggtgctttcatttaccgttggcttgaagctttgttggattgcctgcatgtattagtttctttccaagcgtagcatagcagccacagattgctgttttgaatcactctgtctcgagagtcaatctgaaagaagtcgacttttgatttgtggtgtttcagttggagcacatttttcgaaatcggacagcagg

SEQ ID NO: 10332 - DNA, 1493 bp, Secale cereale
tcagcgactcacggacgcatctgccgacagtcgtcatcctcctccagcaatcccatgtgctctctgccccgctctgcttgatcccagcgcctcgacgcctcctcctgctcgcccgtggtccattcatccacatccgccacagtcctccatgccctgcctctgctgtgcgtgacgacctgattcgataggcaacgaactcctcctcctcagccccccacttctcggatcctcgtcgcgccggctgggcagaaaccggagccccgctgcagatctgcagggaggaggagggggaagaatggacgcctcgtcggtggcgctctacaaccagctaaaggctgctcaaccattcttcttgttagctgggcccaatgtgattgaatcagaggaacatgtcatgaagatggccaagcacatcaaagccatcacaaccaaacttggggtgcctcttgtgttcaaatcaagctttgataaagcgaaccgtacatcatcgaaatccttccgtggtcctggtctggaacaaggcctaaagatccttgaaaaggtgaaggccgcatatgaccttccagtggtcaccgatgtccatgaaagctgccagtgtgaagctgttggaagagttgctgatattatacagattccagctttcctctgtcgccagactgaccttctagtggctgcggctaagactgggaaaattatcaatatcaagaaaggacaattctgtgctccgtctgttatggccaactctacggagaaagttagacttgctggaaatcaaaatgtgatggtctgtgagcgaggcaccatgtttggctacaatgatctaattgttgatccaaggaactttgagttgctgagggaagcaaattgcccagttgtagctgatgtaacacatgctctacaacaaccagctgggaaaaagcttgatggtggtggggttgcaagtgggggcttacgagaactcataccatgcatcgcaaggactgctgttgcagttggtgttgatggtattttcatggaggtacatgatgatcccctgaattcaccatgtgacgggccaactcaatggccattgcgcaatttggaggagctgttggaagaattgattgggatcgctcgggtcaccaaagggaagaaaccgctcaagatcgacctaactccattcaaggaatgatttggcagtggatagcaataggaataaccttgtcgctgccaattggtttcaccaacatggtcgtgtcgaggcgagttgctctttgtatgcggtgctttcatttaccgttggcttgaagctttgttggattgcctgcatgtattagtttctttccaagcgtagcatagcagccacagattgctgttttgaatcactctgtctcgagagtcaatctgaaagaagtcgacttttgatttgtggtgtttcagttggagcacatttttcgaaatcggacagcaggaatggctgcgaacaagctaaatacataatatctctttgagaa

SEQ ID NO: 10333 - DNA, 902 bp, Antirrhinum majus
cagatccatagagaaacacacactctgctcgagcaaacagccatggattcttcaacaatgctctacaatcagctcaagactgcggagccctttttcgtgctagctggtcccaatgtgattgaatcggaggatcacgttatgtacatggcggagcatatcaaggccatcacttctaagcttggattgccgttggttttcaagtcgagcttcgacaaagctaatagaacgtcttccaagtcgtttcgaggccctggattggccgaaggattgaaggtccttgagagggtgaaagcgacttatgacattccgatagttactgatgttcatgagtcggcccagtgtgaagcagttggcagggttgctgatataatccagattcctgctttcttgtgccgacagacggatctgcttgtggcagctgccaagactgggaaaatcatcaacataaagaaaggccaattttgtgctccttctgtcatggcgaattctgctgaaaaaattagaatggctggaaatgacaatgttatgctttgtgagagaggcacaatgtttggctacaatgacttgattgttgatccacgcaacttggagtggatgagggaggctaattgtcctgttgtggcagatataacacattcactgcaacaaccagctggaaaaaagcttgaaggtggtggtgttgccagtggaggtcttcgtgagctgattccttgtattgcccgcacagcagttgctgttggggtggatggaatctttatggaggtgcatgataatccattagaagctccagttgatggtccaactcagtggccccttcgccattttgaggaactgctcgaagaactcatagcaattgctagagttagcaaggggaagcaaacatatcacatcgacctcactcc

SEQ ID NO: 10334 - DNA, 1330 bp, Chrysanthemum coronarium
ctcactgatcatctgcttcgatctctcttcttcaatccatattatttttacgctttaattcttcaaagctatggactcatcaactctcctatacaaccagcttaaggaagctaagcctttttttgtgttggctggtccgaatgtgatcgaatccgaggaacatattatgtatatggccaaacaaattaaggctgttactacaaagtggttggcatcagtttttaagtcgaggtttgacaaacctaacaggacttcgccaaaatctttccgagggcctggattagccgaaggattgaagatcctcgaaaaggtgaaagtgacatatgacttgcccatagttactgatgtacatgaatccagccagtgtgaagcagtcggcagagttgcagatataattcaaattccggcctttttgtgccgacagactgatcttctagttgcagccgccaagactggaaaaatagtaaacataaagaaaggccagttctgtgctccctctgtcatgaccaactctgctgaaaaagttagattggctggaaatcaaaacgttatggtttgtgagagaggaaccatgtttggatacaatgatttaattgttgatccacgtaacttcgagtggatgagagaagctaattgtcctgtcgtagcagatatcacacatgcgttacagcaacctgctggtaaaaagctggaaggtggtggtgttgcgagtggaggtcttcgggaactaataccatgcattgcaaggacagcagtttctgttggagtggatgggcttttcatggaggtgcatgatgatccacttagtgctccagttgatggtccaacacaatggccactacgccattttgaggagctgctagaagagcttgtggcaattgctagggttaccaaggggaagcagcaattcaaaattcatcttactcctttccgcgagtaaagtgttctggagaccggttttcccaatgtgcctgaatatgtgaaagatctcgacattatatataatctattcatagtgtcttaatttacatttttgtcagattcatggtctgtatcacactacaacaaaatagtggcatattcacacttattagagcatgttgctacattttaaagtgtgaagaataaaaaagttcacactagtatgcgtgtgaaccaattgggtgtagcaaatattgtcacacttttatgtgtgatgctttatgaatattttcacacttttaagtgcgagggttacaaagcaattcttcacacttttaagtgtgatgattttgatttgaaaataattttttacacttttaagtgtgagattgaaattcttcgcactttt

SEQ ID NO: 10335 - DNA, 1183 bp, Centaurea maculosa
agcttaaggaagcacagccattctttgtgttggctggtcccaatgtgattgaatctgaggaacatatcttttatatggccaaacacattaaggccgttactacaagactcgggttgccgttagtttttaagtcaagctttgataaagctaacagaacttcgtcaaaatcttttcgaggacctggattggctgagggattgaagattcttgaaaaggtgaaagtggcttatgacttgcccatagtgacggatgtacatgaatctagccagtgtgaagaagttggcaaggtggcagatataattcaaattccagcctttttgtgccgacagaccgatctactagttgcagctgccaaaactggaaaaatcataaatataaagaaaggccagttctgtgcttcctctgtgatggccaactctgcagaaaaagtcagattggctggaaatcaaaatgttatggtttgtgagagagggaccatgtttggatacaatgatttaattgttgatccacgcaacttcgagtggttgagagaagctaattgccctattgtagcagatgttacacatgcattacagcaacctgctgggaaaaagctggaaggtggtggtgttgccagtggaggtctccgagaattaataccttgcgttgcaaggacagcagttgctgtcggagtggatggacttttcatggaggtgcataatgatccacttaaagctccagttgatggtccgacacaatggcctctacgccatttggaggagctgctagaagagcttgtgggtattgctagggtcacaaaggggaagcaacaatacaaaattgatcttactccatttcacgagtaacaacttctggatgctggtttttcacgcgtaatgaagaaaggcaagatcctgccgggacctcagatgtggctgaacgtgtgaaagatggcaacaccataatctatagtttgagaaatacatttcaagtatctaaacattattgttgttcctttcatttaggggtcttgttcgtctttatgtagtataggcaactcttgtgatcattgggtgctataagcgttagaaatgacggcgaggctagaccttagaagtcttgttaaggttatggagtgatttatgaaagataaatattcatatcatatatacataaacacatgttttcctattattaaaaagaa

SEQ ID NO: 10336 - DNA, 1741 bp, Hordeum vulgare
tgactatgctcaagccttgagatgtttggtgtggctataatggtatttctgtttctgtgtttactttgagtgaattacagagaaatttcctttcgggttctgtgtttctgcctcttggatggtagtaaaattgcttttgggggctcgtatcatgtccttggcttgtcgtcatatgaatgaatgatactagcagcgttatcgcagctgaggatgtcatatatgtgagaattgacccatccgattcttgcaccaggctgctcaaccattcttcttgtttgctgggcccaatgtgattgaatcagaggaacatgtcatgaagatggccaaacacatcaaggccatcacaaccaaacttggggtacctcttgtgttcaaatcaagctttgataaagcaaaccgtacatcgtcgaaatccttccgtggtcctggtctggagcaaggcctaaagatccttgaaaaggtgaaggccgcatatgaccttccagtggtcaccgatgtgcatgaaagctcccagtgtgaagctgttggaagagttgctgatattatacagattccagctttcctctgtcgccagactgaccttctagtggctgcggctaagactgggaaaattatcaatatcaagaaaggacaattctgtgctccgtctgttatggtcaactctgcggagaaaattagacttgctggaaatcaaaatgtgatggtctgtgagcgaggcaccatgtttggctacaatgatctaattgttgatccaaggaactttgagtggctgagggaagcaaattgcccagttgtagctgatgtaacacatgcgctacaacaaccagctgggaaaaagcttgatggtggcggggttgcaagtgggggcttacgagaactcataccatgcattgcaaggactgctgttgcagttggtgttgatggtattttcatggaggtacatgatgatcccctgaattcaccatgtgatgggccaactcaatggccattgcgcaatttggaggagctgttggaagaattgattgcgatcgctcgagtcagcaaaggaaagaaaccgctcaagatcgacctaaccccattcaaggaatgatttggcagtggatagcagtaggaataacctcgtcgccgccatttggtttcaccaatatggccgtgtccaggcgagttgctctttgtatgcggtactttaatttactgtcggcttcaagctttgttggattgtctgcatgttttagtttctttccaaacgtagcatagcagccacatgttgctgttttgaatcactctgtctggagagttaatccgaaggaagtcgacttttgatttgtggtgtttcagttggagcacattttttgaaatcaaacagcagggtaaagaaacacacacggttgcatgagcatgatgatggcagcttcctctatggctctatttatccctggtgataaactgatacagttgcgaacaataataaatacataaattctccttgaaaaatcataatgcctagagtttttcttgcaaatgcaaatggatctgataatttgggtaccaaatgaacccctgtcatattagaattttagaagaagagaaatctacttcgaggtaagacagaacatataagtgcaaggaataaatgttcggcaggaacactggaaatttgaatggcctttctagcaacagttcgctacacaataatctgactacaagttaattaaccgtttatgtttgttcaggaaaaaaa

SEQ ID NO: 10337 - DNA, 1306 bp, Saccharum officinarum
ccgtcgctcgcggcccgcccggattccggccacacccgccttcgctctgctcaggcttccactctccgctccgctccggtgcgcggtccggcactcgcatctcgatccctcgatctgtcgtcttctctcggggaggaagaaacgtgagaatggaggctccacccgtggcgctgttcgactccctcaaggcggccaaaccgttcttcttgctagccggtcccaacgtgattgaatcggaggagcatgtcctgaagatggccaaacacattaaaggaatcacaaccaagcttggaattccacttgtgttcaagtcgagctttgataaagcaaaccgtacatcgtcaaaatcgttccgtggtcctggtcttgaagaaggcctaaagatccttgaaaaggtgaaagcaacatatgaccttccggtagtcactgatgtgcacgaaagccaccagtgtgaagctgttggacgagttgctgacattatacagattccagccttcctttgtcgccagactgatcttctagtggccgctgctaagactggaaaaattatcaacatcaagaaaggacaattctgtgcgccttctgttatgatgaactctgcagagaaagttaggcttgctggaaacccaaatgtgatggtctgtgagcgtggtaccatgtttggctacaatgatctgattgttgacccaaggaactttgagtggctgagggaagccaactgcccagttgtagctgatgtaacacatgctctacagcaaccggctggaagaaagcttgatggtggaggtgttgcaagtggggggctacgagaactaataccatgcattgcaaggacttctgttgctgttggtgttgatggtattttcatggaggtacatgatgatcccttgaatgcaccatgcgatggcccaactcaatggccattgcgcaatttggaagagctattggaggaattgattgcaatcgctcgagttaccaagggaaagtgcaagcgcttggcagtggctagagactgggcattcagagcaaccaggcttggccttgtacataatgttgctcctaattccatcattgcttggttgaagtctcctggcctcaaaggatcaaccatctgacctgcaagctccctatgatgaaaaatgtacattgggggcagattctgagattggtgtaaagcttcccaattcagaattggattcacagcaagacaacgtgattacagatgaatcagtatcaatcaatgtgtgtccaactatggataaatcctgtattgaggttaggaggggtttgaaaatgcaaatcaaga

SEQ ID NO: 10338 - DNA, 867 bp, Ambrosia trifida
cgttctttgtgttggctggtcctaatgtgattgaatccgaggaacatgttttgcatatggcgaaacaaattaaggctgttactcaaaacttggattgccttagtttttaagtctagctttgacaaagctaacagaacttcttcaaaatcctttcgagggcctggattagctgaaggattgaagatcctcgaaaaggtgaaaacaatatatgacctgcccatcgtgaccgatgtacatgaatctgaccagtgtgaagcagtcggcagggttgcagatataattcaaattccagcttttttgtgccgacagacggatcttctagttgcagctgccaagactggaaagatcgtgaatataaagaagggccagttttgtgctccctctgtcatgaccaactccgcagaaaaagttagattggctggaaatcaaaacgtcatggtttgtgagagagggaccatgtttggatacaatgatttaattgttgatccacgcaacttcgagtggatgcgggaagctaattgtcctattgtagcagatgtcacacatgcattacagcaacctgctgggaaaaagctggaaggtggtggtgttgcgagtggaggtcttcgagagttaataccttgcattgcaaggacagcagttgctgttggagtggacggacttttcatggaggtgcatgatgatccacttaacgctccagttgatggtccaacacaatggcctctacgccattttgaggagctgctagaagagctaatggcaatcgctagggttaccaaggggaagaagcaatacaaaatcgatctcactccatttcgtgagtaaaaactcctgtatgcatgatcaaacaacaaggcaagattctgt

SEQ ID NO: 10339 - DNA, 931 bp, Daucus carota
cgagtctctcactcagtcttttcttcgcgactccaatttgattgatcaattcggatcttcatttgaaggaggatctaggctgagaattttaagcttgaaaaatggattcatcggcattgctatataataagctcaagtcagcggaaccattttttgtacttgcgggtccaaatgtgattgaatcagaggagcatgtattacgcatggctagtcacataaagactatcacttcaaaacttggcctgccactggttttcaagtccagttttgacaaagctaatagaacatcatctaagtcttttcgtggtcctggcttagccgaaggcttgaagattttggaaaaggtgaaactagcatatgacctccctatagtgactgatgtacatgaagctggtcagtgtgatgcagttggtagagtagctgatgtgattcagattcctgcatttctatgcagacagacagacctactagtcgcagctgcacagaccggaaagattattaatattaagaaaggtcaattttgtgcgccttctgtcatgacaaattctgctgaaaaagttaggctagcaggaaatcagaatgtcatggtttgtgaaagaggaaccatgtttggctatagtgatttgattgttgatcctcgaaacttggaatggatgagggaagctgattgtccaatcgtagctgatattacacattcattacagcaacctgctgggaagaagctagaaggtgggggtgttgctagtggaggtcttcgtgaattgataccttgcattgcaaggacagctgttgctgttggagtagatggaatctttatggaggttcatgatgatcctctgagtgctcctgtggatggccccacgcagtggcctttgcgccatttagaggaactgctagaagaacttgtggcaattgctagggttaccaaggg

SEQ ID NO: 10340 - DNA, 1148 bp, Panicum virgatum
tctcctgcgtgttcgagaaaaaaaaagaattgaaccatctgagtcttgcaacaggctgccaaaccattcttcttgctagccgggcccaatgtgattgaatcggaggagcatgtcctcaagatggccaaacacattaaaggcatcacaaccaagcttgggatcccacttgtgttcaaatccagctttgataaagcaaatcgtacatcatcaaaatctttccgtggccctggtctggaagaaggcctaaagatccttgaaaaggtgaaagcaacatatgaccttccagttgtcactgatgtgcatgaaagccaccagtgtgaagctgttggaaaagttgctgacattatacaaattccagctttcctctgtcgtcagactgatcttctcgtggctgctgctaagactggaaaaattatcaatatcaagaaagggcaattctgtgcaccttctgttatggtcaactctgcagagaaaataagacttgctggaaatcctaatgtgatggtctgtgagcgtggtaccatgtttggctacaatgatctaattgttgacccaaggaattttgagtggctgagggaatctaactgcccagttgtagctgatataacacatgctttacaacaaccagctggaagaaagcttgatggtggaggtgttgcaagcgggggcttccgcgaattaataccttgcatcgcaaggacttctgttgctgttggtgttgatggtattttcatggaggtacatgatgatcccttgaatgctccatgtgatggcccaacccaatggccattgcgcaatttggaggagctattggaggaattgttagcaatcgctcgaattaccaagggaaagaagccgttccagattgatctcacaccgttccaggaatgatctggtttggtagatagagagcacaatgccactgtccactggtttcaacagggtgtatttctcttcgctgtacttgttattgtttcgggcatagctgccgtagacgacttatatctgaactactgaattgaagcctgttgttgctttgtgctgtttcatcagttgtaccatgttataatttcacacaaaataaatgtgatttattgctgattaccagcattctgcttaggttaacccagacgacatattaacagact

SEQ ID NO: 10341 - DNA, 1391 bp, Musa acuminata
atgacgagatccgacccggacgagttaccgtcctccgtttcctgtatctggcagtacccatggaaggcatcccgaggacgacggttcatccaaaaccctttcgtcgtcctcttcgcaaccgagatccagagctccaggctgcagggatcgcgcggttcttcctccgatcgaaatctcttcaagctcgtcgacgagttctggaactctactgacgaatcaaaggcaatggattcttctgttgcacttttcaaccagctcaaggctgcagaaccatttttcgtactagcaggccctaatgttattgaatctgaggagcatatactgaagatggccaaacatataaaagccatcacatcaaggcaagcatataataatgcatgcaatgcttatctaatggttttgcagctcggtttgcccctagtgttcaagtcaagttttgacaaagctaatcgtacttcattgaaatcattccgaggtcctggtttggagcaaggcttgaagattcttgagaaggtaaaagtggcatatgatcttcctatagtaactgacgtgcatgagagcagccagtgtgaacttgttggaagagttgcagacatcattcaaattccagcttttctgtgccgtcagactgaccttctagtagcagcagcaaagactggaaaaataataaatattaagaaaggccagttttgtgccccttcagttatggtgaattctgcagaaaaggttagacttgcaggcaacccaaatgtaatggtttgtgagcgaggcaccatgtttgggtacaatgatttgatcgttgatccacggaatttggaatggatgagggaagcaaattgccctgttgtagcagatgttacacattcactacagcaacctgcagggaagaagcttgacggcggtggtgttgcgagtgggggactgcgtgaactaataccatgtattgcaaggactgcagttgttgttggtgtggatggaatttttatggaggtacacgatgatccccttagtgcaccggttgatggtccaacccaatggcctttgcgcaatttggaggagctactcgaagagctcatcgcaatcgctagggtcaccaaggggaaaaaggcattcaaaattgatcttacaccttttcgcgattgaagtgatgacatcggcagagcacgaaggcataaatcatttatttagctgcagtttatccatccactcactctcaagggaataaccagactttggtgcgtttgtgcatttgcttgttcggcctagcacaagaaccatgtcttatcaaatgtaacattttgctcatcaatttgttgtttcctattttttaaggagtacttaaagattttagatatccgctggatgtagattttggcaacatattggaccag

SEQ ID NO: 10342 - DNA, 1435 bp, Vitis vinifera
atggattcttcaacaatgctgtacaaccagctcaagtcatcagaaccctttttcttgttggctggtcccaatgtgattgaatctgaggagcacattatgtatatggccaaagccatcaagagtctcacatcaaaatttgggttgaagctggttttcaagtcgagctttgataaagccaatcgaacctcctcaaaatcatttcggggtcctggcatgattgaaggcctgaagatccttgagaaggtcaaagtagcatatgacatccccatagtgactgatgtacatgaaattgaacagtgtgaaccagttggcagagttgcagacatcattcagattccagctttcctctgtcgtcagatctcctagtcgctgctgccaagactggaaaaattatcaatattaagaaaggccaattttgtgctccctctgtcatggtaaattctgctgaaaagatcagattggctgggaatgaaaatgtgatggtttgtgagaggggaactatgtttggctataatgatctgattgttgatccacgcaacttggagtggatgagggaagctaattgtcctattgtggcagatgtcacacattcactacaacagcctgcggggagaaaactggaaggcggaggtgttgccagtggaggtcttcgtgaattgataccatgcattgcgaggacagcagttgctgttggagtggatggaattttcatggaggtgcacaatgatcctctaaatgctccagtcgacggtccaacacaatggcctctacgccatttggaggaactgctggaagagcttgtggcaatagctgcttataggcttatgaatgaaacccttatggatatgacttacgtcgctccaccgttattcattgccatttttatcacatttgaaggcccaaaaaggattagaggagatatttttgtggggagcttctggagcttgaagggacaagctagaggaaagggaagagcgtatacagttttgagtgaggagaggaggggtattttcagtaagttacagagagatattctcgctttcctgaagagtaagtttgaggagaaagaggctttcagagactttcaagctttaagactggaaatctggggagattggctgatggagaatgatgatgatatgaagaggtggttggcagctccagaatctgaatctgaaaatgtctgaaggggatatcagtagtttttgggattccaggagtctttgcttgagaatgtggcaaacattggtgagaacgaaatggactcacaatagaagaattctgtacagtaaatgacagactccttgcctggaccttcatgtaaaataaattggattttgcattgtattgcgaaatgggcattctgatggttggcaagttaggtgcaagaatgattgctcaagttgtaagaatatgggtagaatgaagaacctag

SEQ ID NO: 10343 - DNA, 1007 bp, Trifolium pratense
cgtggctatataatttaaaaaattatattgccactattgatgcacgctgagttcccacttccattgcttttgtttttctcccaaatcactgaaaccctaactttatcaaaatctcacatgctcccgtttcaactcatctcgtctaatagatctgacaccacgaattcttgaaaattcctcaatcaaaattccgattctgtgcttttcattcccctgcagattcactttctcaaaatatggatccctcattactgtatgaccagctcaaggctgcagacccgttttttctgctagctggtcccaatgtgattgaatcagaggagcacattatgcgaatggctaagcatatcaagactatttcatctaaatttggaattccattggttttcaaatcaagctttgacaaagctaaccggacatcatcaaaatcatttcgtggcccggggatggttgagggattgaagatacttgagaaggttaaaatagcttacgacctccctatagtgacagatgtgcatgaggccatccagtgtgaaccagttggcaaagttgcagatatcattcagattccagcattcttatgtcgccaaacagatcttctagttgcagcagccaaaactgggaagattatcaatatcaagaaaggccagttctgtgctccttcggtgatgacaaattcagcggaaaaggttcggttagctggaaatcctaatgtgatggtttgcgagagaggaacaatgtttggctataatgatttaattgttgatccacgtaacctggagtggatgagagaagccaattgtcctactgtagctgatataacccactcactacaacaacctgctggaaagaagttggatggaggaggtgttgcaagtggaggtcttcgagaactaataccttgcattgcaaggacatcagttgctgttggagtggatgggatcttcatggaggtgcatgacgatccgctgaatgcaccagtagatggtccaacacagtggcctttg

SEQ ID NO: 10344 - DNA, 839 bp, Chelidonium majus
accttcagtgtctcgaaaccctaacccacattgaagatcagttagagagagagagagagagatgaattcccatacagatctgtttaaccaactcgagggtgcagaaccatttttcctgttagcaggtcccaatgtaattgaatctgaagaacacatttttcgaatggccaaacatatcaaggccatctccaccaaagtcggtgtgccgctggttttcaaatcaagctttgataaagctaaccgtacgtcttcaaaatcatttcgtggtcctggtatggttgagggcttgaagatccttgaaaaggttaagatagcatacgacatccctattgttactgatgtgcacgatgctagccagtgtgaagctgttggaaaagttgctgatatcattcagattcctgcttttctatgccgtcagacggatcttttagttgcagctgccaagactgggaaaattatcaatattaaaaaaggccaattttgtgctccttctgttatggcgaattctgcagagaaggttaggttggctggaaaccagaatgtgatggtttgtgagcgaggcaccatgtttggctataatgatttgattgttgatcctcgcaacttggagtggatgagggaagcaaattgcccaattgtagcagatgttacacattcattgcaacaaccggcagggaaaaagctggaaggtggaggagttgcaagtggaggtcttcgtgaattaataccatgcatagcaaggacttcagttgctgttggggtggatggaatcttcatggaggtacatgatgatccactaaatgcacctgttgatggtccgacacaatggcctttacgtc

SEQ ID NO: 10345 - DNA, 1028 bp, Festuca arundinacea
tacaacacaccgatcccactgcccacccacagagcaattcctcctccgcgtgctccacgccgacgatctcatctcgagggcggaaacgaaatggacgcctcgtccgtggcgctgtacagccagctcaaggctgctcagccgttcttcctgttagccgggcccaatgtgattgaatcagaggagcatgtgatgaagatggccaagcacatcaaagccatcacaaccaaacttggggtgcctcttgtgttcaaatccagctttgataaagcaaaccgtacatcatcaaaatccttccgtggccctggactggaagaaggcctgaagatccttgaaaaggtgaagacagcatatgaccttccagtggtcaccgacgtgcatgaaagctggcagtgtgaagctgttggaagagttgctgatattatacagatcccagctttcctctgtcgccagactgaccttctagtggcggccgctaagactgggaaaattatcaatatcaagaaaggacaattctgtgctccttcagttatggcgaactctgccgagaaaattagactggctggaaatcaaaatgtgatggtctgtgaacgtggcaccatgtttggctacaatgatctaattgttgacccaaggaactttgagtggctgagggaagcaaattgcccggttgtagctgatgtaacacatgctctacaacaaccagctgggaaaaagcttgatggtggtggggttgcaagtgggggcttacgagaacttataccatgcatcgcaaggacttctgttgcagttggtgttgatggtattttcatggaggtacatgatgatcctgtgaattcaccatgcgacgggccaactcaatggccattgcgcaatctggaggagctattggaggaactgattgcgattgctcgagtcacgaaggaaagaagccgtccaaatcgatctaactccattcaggaatgatctggcacggtggatggaaaagggctcaccttctcactgctcaatgttgttgcatcggacgaatc

SEQ ID NO: 10346 - DNA, 1395 bp, Pinus pinaster
atagtgaagccttttgtcacaaggccatcacattgcagtccagtttgctaaatttcagacatctccgaattcgtgggctccgtccgagaaaggatcagcatggtttccccttcagcattgtacaatcatctcaaggaagcagaacccttctttttgcttgtggggcccaatgtaatagaatcagaggagcacgtcctcaaaatggcaagacagattaaatctgtagcagaaaagcttggattgcaattagttttcaagtcgagctttgacaaagccaatcgaacttcagcaaagtcattccgtggccctgggctagaagagggtttgaagatattggaaagggttaagaccacttttgacttaccgattgtaacagatgtccatgaagcttatcagtgtgagcctgttggcagaattgcagatattattcaaataccggcatttctatgtcgccagacagatcttcttgaatctgcagcaaagacagggaaaattatcaatatcaagaaaggtcaattttgtgcttcatcggtaatggtaaactctgctgagaaagtcagattagcaggcaacccaaatgtaatggtttgtgagcgcggcacgatgtttggatataatgacttgattgttgaccctcgcaatatagagtggttaagggatgcacattgtccggtggtagcggatgttacacatgcattgcagcagccagctggtagaaagcttgaaggtggaggagttgcaagcgggggcctgcgggaattgataccttgtattgccaggacttgtgtagcagtaggggttgatggcatttttatggaggtacatgataatccacttgaagctccagttgacggcccaacacagtggccacttcagaatttggaggagttactcgaggagcttatggcgattgcaagagtaaccaagggaaagcaaaagtttaaaataaacctgactcctgttgatgaagaattctgacatcatatatgtgtaggtgctctatgtcaaggatcaaggtagtacaaaattgatgaggcatattttggaaattaggaagtaaaaagggcaatctctcataggaaaaattgccaaaccatagagttgagtctaggctgaaactaatcgaactctaaatattttcactgctttattcgaactgcaacctttccaaggaagaatttgaaggtctgtttttcttgaaggactgctcttcatagagatttccatttttcatggaagttcatgtcgatgcctaaattgaaaattatgaaaaatgtcgtgattcctccattgaattgcttgaatttaataatatcaaggaaatttatatatatctttatttgtagaataacatgttttgttgaaatatacagcttagaaaagtaaatttgttag

SEQ ID NO: 10347 - DNA, 1490 bp, Gossypium hirsutum
gtgtacctctaaggctaaggtgaccacaggcaccactcatgttgaaataacaccacctgctgtcgcccggatcaatgggcgtcctgtccttcagcctacttgtaatcgtgttcctagccttgatcgtcgtaattccttgaaaaaaataccacccatctctcctccaccacctgcatcactaccatttacgccatcagccaccagtactacaactgttgccaatggtagcagggctaaggcctcactcacaccgcctttatccccaagctcaaagttcaccaccaccaagcgatggagtgatcccaatgcgttgaactcaagttctgaaaaggttgccattcccagaaacaccacaaaaaccttggataggaagaaatccaaaagtttcaaagagggtatggggaataatggattatcttcttatattgagccatcattgagttattcttcttctctgctggttgaggctccaggaagtattgctgcagtcaggagggaacaggtagctcttcaacaagcacaaagaaagatgaaaattgcacactatggaagatcaaaatcggccaaatttgaatctaaggttgttcctctcgacaataccaagcctgccgaggaaaagaagaggtgcagtttcattacgcccaactcagatcctatctatgtggcttaccatgacgaagaatggggagttccaatccatgacgatagcatgctcttcgagttgttggttctaagtggtgctcaagtaggctcggattggacttcaatcttgaagaaacgtcaagatttcagggatgcattttcagggtttgatgcagaaactgtagccaacttcactgaaaaacagatgaccacaattagctctgaatatgggattgacataagcagagttcgaggtgttgtggacaacgccaaccgtattcttgaggttaagagggagtttggatcatttgacaaatatatatggggatttgtgaatcacaagccgatgtcgacgcaatacaaattcgatcacaagatcccagttaagacatcaaagtctgagagcataagcaaggacatggtgagaagggggtttaggtttgttggaccaacggtggtccattccttcatgcaagccgccggtctaaccaacgaccacctcatcacatgccacaggcacctcccttgcgccttgttagccatccaaaggccaccggtccactcactccctgatttgtagatgattatgaattgacatttagacatatccaggcaacaataatgcattgcatgggacgacatcaaagcagtagcccagatgcatatacgtaactaaaacccaatttctaactaattaaaacctttttttcccctcttttcctcgtcttttgtgtgattatcatgaatgatgataataattaaacatatatgtatgtatgtatgtagtagaaaaggtttttgtgacttgtgactcaagaaacggtgtgaaggtttggatttgcttagct

SEQ ID NO: 10348 - DNA, 2106 bp, Theobroma cacao
cactttctcccttttatataacccccaccagtgcttccccccttcaatcattcagcaatccttcataaccctctctcgacccatttccttttcttttgcaagcttctgaggaacccaattgtcattagtctttcttgtttcatccttgcactaattctgttccttcatctatccgaaagacagaaaaacacaaggaaaatgtgtagctccaatgccaaggtgaccgcaggtgttgaaataacacctgcggtggccaggatcaatggccgcccggtcctgcagcctacttgcaatcgtgttcctagccttgaccgtcgaaattcgttgaaaaaaataccacccctgtcccctccaactcctccatcactagcatcaacgctcccagcaacaagtgcaactgttggtaatggtggcagggccaaggcctcgttgacaccacctatatccccaaagtcaaagtccccccggccagctgctattaagcgaggcagtgatcccaatgcattaaacacaagttccgaaaaggttatgactcctagaaacatcacaaaaaccttggagaggaagaaatcaaaaagtttcaaagagggaatggggaatggattatcttcttggattgagccatcattgagttattcttcttctttgatcgttgaggcgccgggaagtattgctgcagttagaagggaacagatggcacttcaacaagcacaaagaaagatgaaaattgcccactatggtagatcaaagtcagccaaatttgaatctaaagtcgttcctcttaatacttcaagcgctatgactaagcctgatgaggaagagaagaggtgcagtttcatcacgcccaattcagatcctgtctatgtggcttaccatgatgaagaatggggagttccagtccatgatgacagcatgctcttcgagttgttggttctaagtggtgctcaagttggctcagattggatttcaatcttgaagaaacgtcaagatttcagggacgcattttcaggctttgatgcagaaactgtagccaagttcactgataaggaaatgaccacaattagctcagaatatggtattgacataagcagagttctaggtgttgtggacaactccaaccgtattctcgaggtgaaggggcagtttggatcatttgataaatacatatggggatttgtgaatcacaaggcaatctccacgcaatacaaatttggtcacaagatcccagttaagacatcaaagtcagagagcataagcaaggacatgttgaggagggggtttaggtgtgttggaccaacggtggtccactccttcatgcaagccgccggtctaaccaatgaccacctcatcacatgccacaggcacctcccttgcaccctgttagctgcctcatctatagatggattgacatttaaaaggagacaatgatgacgggagatatatacataactaaactcaactgctaactaaatgttgttcttctttggtgtggctatgtacaataacagattacagatataggaggtacaattagggggacttggaaaagggttggtttgtttttcttttttttttttgggatttgggatttgggatttgttttgtttgttgaaagctttctaagagagcgagtgagtgtggtgagatagattatcagagagacgaaaggttgggaaggtgcttgggaggcagagagcatgtgcaaatgggaggcagcggcatgtgtggggtgtcagttacttttgaatgctcctccatgtgatgtgtgcaatcgccctttgcattatttgggtctgcctctcctttttaacagcctgtggtggtgggatacttccttaggaccaccaaccatccctttcctttttcagttggggtttgagttgtaattttcttccttttttattttttcctttaatctttgttttcctaacctttcaagtaagctttgggaggaatattaatgccccgaatgcgtcttggatttggtgtgaattttccatttttctaggtgatgcttttgatacatttttccatgtgattctgcactgtttgctactaaatacaccttttaaaatgtttaacttgacaggattaagtaccttcccc

SEQ ID NO: 10349 - DNA, 771 bp, Zea mays
acagccctcagcccaccacaaacgcgcctccgtaccatccgtcgccgccggcgcaccgcgatggctgcctccgccacggccgcgaggcctctcgccgggaccgccgtcccgctcccgctctcgacgcggacgcggcctgccagggtcgccttgctctccctgattcctcctgctccggcccagcgccttgctctcaggcgtggcgcgtggctctcacccccggagcgcagccggtcggtgcggtgcctggcggctatgagcccggagatgcgggcaacgctggacaaggtcgtaggatccagcaaggtggtgctgttcatgaagggcaccaaggacttcccgcagtgcggcttctcccacaccgtcgtgcagatcctgcgctcgctcgacgtgcccttcgagacgctcgacgtgctcgccaacgaggcgctccggcaggggctcaaggagtactccagctggcccaccttcccgcagctctacatcgacggcgagttcttcggtggatgtgacatcaccgttgaggcatacaagagtggagaactgcaggaaactctagagaaagcaatgtgctcatagagaaaagaaattagaaccaggagtgcacgacatacagttaatcaaaatgttatagtatttgctgtacaattcaggcaatgttaagctggagataccaaagttgtaggcaatccatgtccaaatgctcagtgcacttggtttggaacacatttgttttctgcaatttgtgattaatcatccagctttaaccca

SEQ ID NO: 10350 - DNA, 833 bp, Setaria italica
taatctgccacgtgcgagtaattccgctccgtccgagtcgtccagcagaccaccacacccacggctccgtaccatccgtcgccgccggcgcgcgctcaccagacgccagccaccgcgatggccgcctccgccacggcctcgaggcctctcgccggggcctacgtcccgctccccctccccgcgcgggggctgccgtctagggtcgccttgctcccgcgggctccgccggcggttcagggcctcaccctcgaccggcccgcgcagctctcggtgcgagcgcgcggccggtcggtgcggtgcctcgcggggctcagcccggagatgcgggcgacgctggacaaggtggtggggtcgagcaaggtggtgctgttcatgaaggggaccaaggacttcccgcagtgcggattctcccacaccgtcgtgcagatcctccgctcgctggacgtgcccttcgagacgctcgacgtgctcgccaacgaagcgctccggcaggggctcaaggagtactccagctggccaaccttcccgcagctctacatcgatggcgaattcttcggcggatgcgacatcaccgttgaggcatataagagtggagaactgcaggaaactttagagaaagcgatgtgttcttagagaccattgaaccaggagcacacaacatacaattaatcaaaatgttgtagtatttgctgtaaaattcaggcatgttaaagaactgaagatgctcagtgcactttcattgaaataagattttctgcaatttgtgattttaatcgtacagtttccattgcaatgttatgctactggattgtttgttccattcaactcccagc

SEQ ID NO: 10351 - DNA, 2220 bp, Sorghum bicolor
cataaatatttctatagtcaaacaatgatgacaacaatgcatgttgactgtatagtaacaaaaaaacgaggtgccataaatactatagccaaggaatgacaacattgcatattgattgaatataataataaaaaatcaggacccctacataaaggacacagatgtgacggtcatcttgggtcactgtcactcatggattctcctctgatggagcccctgctagtgcccaaggaccacgctccggccgtcgccgccacaccgggcgatcacggcggtgctgcggccgacgagaacagcaccgtcgtggacactaccagtggcccgggcagggcactcggcgacgccgaggagaagacaaacgacgacggagaggtagaaggggacgagctgtcggcgtccgtgcagcgccggctggacgagagcagcggcggcgtggagaaggaggatgaagaggaggaggaagagatcggtgacgacgcgggggccgacgacatggcagcgcgcatggcacgccgcctggcggcgctgcccgggaaggcgcacgagagtgagccgttcaccatcttccgcgtggcggggtcgatgcgcgagcgcaaccggcacctcttcgacccgcagatgatctccatcgggcccttccaccgcggcgccggccggcacctcgccgccatggaggcgcacaagtggcggtacctccgcgacatcctgtcccgccccggcggcgcgacgctggccacgtacgcccgcgccgcgcgcgcgatggaggcccgcgcccgccgccgttacgccgagcccgtggcgcttcccccggccgagttcgccgagatgctcctcctcgacggctgcttcgtcgtggagttcttcctcaagggccacgacagcgaggaggacgcgctcatcgacgcgacgtgggcgatccagaacgtgtacaacgacatgctgctgctcgagaaccagctccccttcttcgtcctggagcgcttctacgacctcgccaccggcgggctcggccgggactacttcgtcaccaacgtcctcgtcaactacctcaccgtcgacatgacctccggcccgcgggacccggagagcacgcggccccccgacggcgagatccaccacctgctccacctctactactactggttcctgccgccggagcaacggttcgggagcggcgccgccagcaagagcgaggacgaggcgctggaggagatgacgtccaggtccatggacgacgagcggtcgccgagtctgctgccgccggcgtcggagctgcaggactccggggtgacgttccgcgtcaagaagtcgccgcggagcatggtggacgtgacgttcgaccggcgcagcgggacgctggagatccccgccgtggagagctacacgaaccacgccgtgttcgcgaacctgctggcgtacgagcagagccggggccggtgggagctgcagcggctggtgagctacgtgctgctgatggcgtcggtggtggacgcgcggcgcgacgtggaggcactgcagcgcgccggcgtgctggcgcgcggggacgaggagacggcggcgttctacgcgaacctcggggagctgtgcccgccgcccgagttcgtcgacaactgctacgccgcgctgctgcgcgacgtcagggagtactgcggacgcagctggaaccggcaccgcgccgtgctggtgcacgactacttcagcaacccgtggaccagcatgtccgccgccgccgccgtcttcctgctcgtcctcaccgtcgtgcagacggtctacaccgtgctgccttactacagcccgaattagccccccgccggcgagattggccgccgtcacactacagcagattgggtgatgtcctgtgtttttcctgctagcgattctgcggatcaaagtacgattcccatgttttcttcttcttcaatttctcaacaaatctaaaaggggatccatatgaatgataatcctatatgcttattttctttatttcttacaatccgtttacaaatatatcgaacgcgattttgaaactgtgtagtcttaattggttgttagagtacgacgttggtcacgtcgtgaatagcgattaacgtagtacgtgtcaagttggggtggatctgatgctcaaaaaaaaaaaaaaaaaaaacaccggtggcgcgtatggtggtcgtgtgaacgcatcaagttcctgggtcaaattacggaaaactaaagcccctcgcc

SEQ ID NO: 10352 - DNA, 3084 bp, Sorghum bicolor
tcctgcctgtccctgtcccccccggccggccatctccgatcctctcgccgcctgctgatgtgaaagagatcctccggccggctgcaagcagagagacgacaggcagcacgcacgcacgccccgtccggccgggtagtagtagctaggcgcagcgcggtagtgccagtgcaacagctactagtactagtacatatacggcagggggtgcagctggcggcggtcgcggaggatggtgaagttctcgcgggagtacgaggccagcatcatccccgagtggaaggccgccttcgtcgactacaagggcctcaagaagctcgtcaagaggatcaagatcgcccgccgcgacgccgcgccgctgctcgccgccggcgccggcggtggccgtagaagtagcgacgccagcagcggcagctacggcttctccgtcctcgaccccgtccgcgccctcgccgcccacttcgccgcgacgccggcctcaccaacgacgcaggtgggcgacgacgacggcgactcggacagcggcttggaatcggattcgggggagctcgtaagagccacggacaagcatgagcaggagtttctggagaaggcggacgaggagctggagaaggtgaacaagttctacgcggcgcaggaggcggacatgctggcgcgcggcgaggccctcatcgagcagctccgcatcctggccgacgtcaagcgcatcctcgccgaccacgccgcggcgtcccggcgcgggcggtcgcggctcgcccggacggcggcctcgtcgccgccgccgtccgtgaacgggtccaacagcggccgccacctcctctcctcccccttcgtggtggcctcgccgcagtccatgtcagacgggagcgtggagctgcagcaggcgcgcgtggcggagggcgcggcggtggcggaggaggtgatggcggcgctggagcggaacggcgtcagcttcgtgggcggcgggctgggcaaggccaagaaggacggcagcgggaagcagctcatgggccgcgccgcgctgctgcagctgccggcgacggtgcgcatcgacatcccgcccaccagccccggccgggcggcgctcaaggtgtgggaggagctcgtcaacgtgctccgcaaggacggcgcagaccccgccgccgccttcgtccaccgcaagaaggtccagcacgccgagaagaacatccgcgacgccttcctcgccctctaccgcggcctcgaactcctcaagaagttcagctctctcaatgtgaaggctttcaccaaaatattgaagaaattcgtcaaggtgtcggagcagcagcggaaaactgacctgttttcagagaaggtgaagaggtcgccgttcagcagctccgacaaggtgcttcagctggcagacgaggtggagtccatcttcttgaggcatttcgcgggcaacgacaggaaggtggccatgaagtacctgaagccgcagcagcccaggaacacccatatgatcaccttcctcgtaggcctgttcacaggaacatttgtgtccttattcatcatatattcagttctagcccatgtcgccggcattttctcctctaccggaaacacagcatacatggagattgtttaccatgtcttcagtatgtttgcactcatcagcctgcacgtcttcctgtacgggtgcaacctcttcatgtggaagagcaccaggatcagccacaacttcatatttgatttctcctccagcaccgccctgacacaccgggacgccttcctcatgtcggcatccatcatgtgcaccgtcgtcgcagcactggtcatcaacctgttcctcaggaatgccggggcaacctacgccaatgcattgcccggggcacttctgcttctgtcagcagtggttctgttctgcccattcaacgtcttctaccgctcgacgcgctactgtttcatgcgcgtcatgcgcaacatcatgctctcgccattctacaaggttctgatggcagatttcttcatggctgaccagctaaccagccagatcccactgttaagacacctcgagttcacggggtgttacttcatggctggaacttttagaactcacgaatatggaagctgtaccagcagctctctatacaaaaacctggcgtacgtgctttccttcctgccatactactggagagcaatgcagtgtttgagaaggtacctggaagaaggccatgatctcaaccagcttgctaatgcgggcaagtacatatcagcaatggtagcagctgctgtcaggttcaagtatgctgcgacaccgacaccattctggatgtggatggtcataatatcatctacaggcgccaccatttaccagctctactgggattttgtcatggactggggcttcttaaacccaaaatctaaaaacttctggctccgagatcaactcatcctgaagaataagtcagtctactatgcttccatgatgctcaaccttgtgctacgcctagcctgggcccaaagtgtaatgaaactccatcttggtatggtggagtctcgcttgctggatttctcactcgcttcactggaaattatccgacgtgggcattggaacttctacaggctggagaatgaacacttaaccaacgctggaaagtttagagcagtgaagactgtcccattaccattccgtgaacttgaaactgattgatgaagacaaagacaagaacttgccagcatgttcccagtatgaaaggaatttaggggggcagaagagttccaggaatggatactgtccctgctagtgcttgtgcaagaattggtgtttaagtggtaataaaaaaatcagagagcataactgcacaagaccaagacgttgcagattttaagatggaataagctcagacggtgcattgtaaatgaggcaccagggttcaacatgaggcgttctggtcaggcaagatgatgttgatttacttactggtcgattgagaattgttgcatgtcaatcgactaacaagatcttaattttgtcaatcattaagttatgaatgtatctgggaattgatgactgaaaaatattgcatgaaaacatatggtcgtcaagcagaaattgaaccatgtctc

SEQ ID NO: 10353 - DNA, 2816 bp, Zea mays
tccctgtccctgtcgacccctcgaggcggatcccacgatggtgaagttctcgcgggagtacgaggccagcatcatccccgagtggaaggccgccttcgtcgactacaagggcctcaagaagctcgtcaagaggatcaagatcgcccgccgcgaccgcgctgcccgtagtaccagcaacgaccacgacgacgccaccaccaccacctatggcttctccgtcctcgaccccgtccgcgccctcgcctcccacttcaacaacgccacgcccccggcctcgccagagggcggcagcgacgacgccttgaggagcttggaatcggattcaggggagctcgtgagagccacggacaagcatgagcaagagtttgtggagagggcggacgaggagctggagaaggtgaacaagttctacgcggcgcaggaggcggacatgctggcgcgcggcgacgcgctcatcgagcagctccgcatcctggcggacgtcaagcggatcctcgccgaccacgcggcggcgtcgtcccggcgcggccgcgcgcggctcgcccggaccggcgggaactcgtcgccgccgtccgtggacggctccaacagcggccggcacctcctctcttctcccttcgtggcctcgtcgccgcagtccatgtcagacgggagcgtgcagctgcagcaggcgcgcgtggcggagggcgcggctgtggcggaggaggtgatggcggcgctggagcgcaacggcgtgagcttcgtgggcggcgggctgggcaaggccaagaaggacggcagcgggaagcagctcatggggcgcgccgcgctgctgcagctgccggccacggtgcgcatcgacatcccgcccaccagccccggccgggccgcgctcaaggtgtgggaggagctcgtcaacgtgctccgcaaggacggcgccgaccccgccgccgccttcgtccaccgcaagaaggtccagcacgccgagaagagcatccgcgacgccttcctcgccctctaccgcggcctcgacctcctcaagaagttcagctccctcaacgtgaaggctttcaccaaaatactgaagaaattcgtcaaggtgtcggagcagcatcggaaaggagacctgttttcagagaaggtgaagaggtcgccgttcagcagctctgacaaggtgcttcagctggcggacgaggtggagtgcatcttcttgaggcatttcgcgggcaacgacaggaaggtggccatgaagtacctcaagccgcagcagcccaggaacacccacatggtcaccttcctcgtaggcctgttcacaggcacatttgtgtccctgttcatcatatactcggtcctagcccatgtcgccggcattttctcttcgaccggaaacacagcctacatggagatcgtttaccatgtcttcagcatgtttgcgctcatcagcctgcacgtcttcctgtacgggtgcaacctctccatgtggaagggcaccaggatcaaccacaacttcatcttcgacttctcctccagcaccgccctgacgcaccgggacgccttcctcatgtcggcgtccatcatgtgcaccgtcgtcgcggcgctggtcgtcaacctgttcctcaggaacgccggggcgacctacgccaacgcgctgcccggggcacttctgctgctgtcagcaggggttctgttctgcccattcaacattttctaccgctccacgcgcttctgcttcatgcgcgtcatgcgcaacatcgtgctgtcgccattctacaaggttctgatggcggatttcttcatggctgaccagctaaccagccagatcccactgctaagacacctcgagttcacggggtgctacttcatggctgaaacattcagaactcacgcgtatggaagctgtaccagcagctcccaatacaagaacctggcatacgtgctctctttcctgccatactactggcgagcgatgcagtgtctgagaaggtacctggaagaaggccacgacatgaaccagcttgctaacgccggcaagtacgtatcagcgatggtggcagctgcggttaggttcaagtacgccgcgacgcctacgccgttctggatgtggatggtcattgcatcatctaccggcgccaccatctaccagctctactgggatttcgtcatggactggggcttcctgaacccaaaatccaagaacttttggctccgggatcagctcatcctcaagaacaagtcgatctactatgcttccatgatgctcaacctcgtgctgcgcctagcctgggccgagagcgtgatgaaactccgtcttggtatggtggagtctcgcctgctggatttctcgctcgcttcgctggaaatcatccgacgagggcactggaacttctacaggctggagaatgaacacttgaacaacgctggaaagttcagagcagtgaagactgtcccattaccattccgtgagcttgaaactgactgatgaagacggagctccaagttgaacagcaggaatttaggggaagaattccaggaatggatacactgtcccctgcaagaactggtgtttaagtggtaataaaacgaatcggagagcgtaactgcacaagaccgagacgctgcagattttaggatggaataagctcaggcgggtgcgccagggtataacatgaggcgttctggtcaggagagatgatgtgcatttaactagctagtggtcgattgagaattgttgcatgtcaatcgactaacaagatcttaattttgtcgatcgtttaagttgtgaaaatgtatctgggaattggtgactgaaaaaaattgcatggaaggaaacatatggt

SEQ ID NO: 10354 - DNA, 3193 bp, Setaria italica
agcccagctgctgcttcccttcgtttccctttagatttccccctttagttacctttctctctctacctaatattgctatctcctggctgttgcaacaccactactctctctcagcagtcagcagcatcacagcgactccggcctgcgagcgagctcgatcgtttgcatataaaaacgagcagagctgggcgagtagaggacgcctccctcctccgttctccatctatataagcagggttgcttccgccaccacccctgccctgtccctgtcccctagctccgatccgatccgatccgatccgcatgtaaattgacatacctccggtcaggtagtatactacatatacggcggtgccggcaggcggttgcggaggatggtgaagttctcgcgggagtacgaggccagcatcatccccgagtggaaggccgccttcgtcgactacaagtgcctcaagaagctcatcaagaggatcaaggtcgcccgccgcgacgccggcccgccgccgccgctcctcgccggtggcacgaccaccgccggctatggcttctcggtccttgaccccgtccgcgccctcaccgcccgcttcgccaggagcacggcggcttcaccagagggcgaggaggagagcttggagtcggattcaggggagctcgtgcgagccacggacaagcatgagcaggagtttttggagcaggcggacgaggagctggagaaggtgaacaagttctacgcgtcgcaggagggagagctgctggcgcgcggcgacgcgctcatcgagcagctccgcatcctcgccgacgtcaagcgcatcctcgctgaccacgtggcggcgtcccggcgcggcgggcccgccgggaggagggcgctgggccgggccgcctccatgccgccgccctcgcactcgccgtccgtgaacggctccagcggccgccacctcctctccggcctcgcctcgccgcagtccatgtcagatgggagcgtggagctgcagcaggcgcgggtggcggagggcgcggcggtggcggaggaggtgatggcggcgctggagcgcaacggcgtcagcttcgtcggcggcgggctggccaaggcgaagaaggacggcagcgggaagcagctcatggggaggggagcgctgctgcagctgccggcgacggtgaggatcgacatcccgccgacgagccccgggagggcggcgctcaaggtgtgggaggagctcgtgaacgtgctccgcaaggacggcgccgaccccgccgccgccttcgtccaccgcaagaaggtccagcacgccgagaagaacatccgcgacgccttcctggcgctctaccgcggactcgagctcctcaagaagttcagctctctcaatgtaaaggccttcaccaaaatattgaagaaattcgtcaaggtgtcagagcagcagcgagccactgacttgttttcagagaaggtgaagaggtcgccgttcagcagctccgacaaggtgcttcagctcgccgacgaggtggagtgcatcttcttgaggcatttcgccggcaacgacaggaaggtggccatgaagtacctcaagccgcagcagcccaggaacacccatatgatcacattcctcgtaggcctgttcacaggcacattcgtgtcgctattcatcatatattcagttctagcccatgtcgccggcattttctcttctaccggaagcccagcctacatggacatagtctaccatgttttcagcatgtttgcactcatcagcctgcacgtcttcctgtacggctgcaacctcttcatgtggaagagcaccaggatcaaccacaacttcatcttcgatttcgcctccaacaccgccctgacgcacagggatgccttcctcatgtcagcctccatcatgtgcaccgtcgtcttgtcgctcgttatcaacctgttcctcaggaacgccggcgcaacctacaccgacgcattgcccggtgcactcctactgctgtcaacaggggttctgttctgcccattcaacatattctaccgctcgacgcgctactgcttcatgcgcgtcatgcgcaacatcatattctcgccattctacaaggttctgatggctgatttcttcatggctgaccagctaacgagccagatcccactactaagacacatggaattcgcagcatgctacttcatggctgggacctttaggaatcaggcatatgagacctgcaccagcagcccacaatacacacacctggcctatgtgatttccttcctaccttactactggagagcaatgcagtgtctaaggaggtacctggaagaaggtcatgatatcaaccaacttgctaatgctggcaagtatgtatcagcgatggttgctgctgctgtgaggttcaagtacgctgcaactccaacaccactctggatgtggatggtcgtcatttcatcctcaggcgccaccatttaccagctctactgggactttgtcatggactggggcttcttaaaccccaaatccaagaacttatggctccgggatcagctcatcctgaagaataagtcgatctactatgtttccatgatgctcaaccttgcgctgcgtctagcctgggcccagagtgtaatgaaactcaaacttggtcgggtggagtcccgcttgcttgatttctcactcgcttcactggaaattatacgacgaggacattggaacttctacaggctggagaatgaacacttgaacaacgctggaaagttcagagcagtgaagactgtcccattaccattccgtgaacttgaaactgactgataaagacaaagttaagaacttgttggcatgctcccaacatgaagggaatttaggggaagagatccaggaacgaatacactaccccagctaatgcttgcgctacaattggtgtctaagggataataaagtaatcagaaagcataactgcacaagaccatgacattgcagatttaagatggaataagctcagatggtgcattgtaatgagggtgccagggcacataaacatgaggcactgtggtcaggaaagattgggtggattccttattggtcgattgaagagtgttgtgtgttaatcagctaacaagatctttgttgataactaagttatgtatttatcgaattcatgccagaaaaatattgcatggaattgtaagctccagggcatcaaacataattttaacaatgtt

SEQ ID NO: 10355 - DNA, 3395 bp, Oryza sativa
agagagagagagagagagaggagcggaagagaaggggagaaccaggaggaggaggaggaggaggaggaggcggtgggagggatcgatggcgtcgcgcgtgctcccacgagagggttcctgatcgcgtccgtggtggttcgcaggctgatgcttaggttggatgtggaagccaactcgacagatttgaagctactgcatgaggggctaataaataagtttgcatgcttcaatttcttgtgtctctagagaaaaatcaactcattggcggaaaaaaaaaaacatcctggtgcgttcataagtcagccatctagaggacaatgtcagcttcggagttcaggattccttatcagcaagtatcatcttcacagactgctgagaatgcaggtcagtacaagatctgccggtgtggggaaggagacccaaacacatctgaaactggtgacagttcgccaactagttgtcctaattgccaggttcttaagagtgggcatctactgctctcatctaaaggaattggttggacaacatggaaaaagcgctggtttattcttacaagggcatcattagtgttcttcagaagtgatcctaatgcacctgtcagaggaaatgaaccggttgttacactaggtggaattgacttgaataacaccggaagtgttgtggtcaaagaagacaggaaacttttaacggtgttatttcctgatagccgtgacggccgaaccttcactctgaaggcggaaactacagaagagctcaatgaatggaaaagtgcattagagaatgctctggcacaagcacctgctgtagcaaatgctgttggccaaaatccaattttcagcactgacatagcagagcctgctgaagctccagctgaacagccggacgacaaatctgttattggtagacctgcagagtttgcccttgtagatgctgatggtagtccatctttcctggagaaggccttgaagttcattgaagattatggtgtcaaggtggaaggaatcctccgtcagtctgctgatgttgaagaagtcaaacgcagagtccaagactatgaaaaggggaaaaatgagttctccccagaagaggatgcacatgttattggtgactgtatcaagtatgttcttcgagagatgccatcatctcctgttcctgcaccatgttgcactgcgctggttggagcttaccgaaccgacaaaacaaaaaggcttgatgctatgagtaaagtgatttatgaagtttttccggaaccaaaccagcaactattgcagaggattcttaagatgatgcagattgttggatcacacaaagctgtgaataggatgtctccatcggctttggcggcttgcatggcaccactccttctccgacctcttcttctcggtgaatgtgaaattgatagtgactttagtatggctggggatggttcattccagctgcttcaagctgcagctgctgccaaccatgctcaagcaattgtcatcattatgctcgaggaatacgacgagatatttgatgacttggaagacggttcctgctcttcagatgcatatactgattcagaagatggcgatgttgacaaggaatattctacggacaatgatgtggatggctcttatgattctggtgaagataacattgaagaagacatggaagatgatactgagtactcctctggtggcagtgaatgtgatgacaaggttaaaaggaataactctggcaaggcatctaatggtaatgataagggttttcaacctcctaagaaagcagcaagaacagaacatggtgtgctaagggaagacactaatcaaatttcttctgttccaccagtggagaatacttcccaaatggagagcaatgatccatcccatcgaaaattacacgaatcaaatggatccacagatcaaatagaaaagtcaaatgttcgcgcatcatcatcaagagcaaaatttatggagaaatcaagctcaagaaataagagcaaaaagaccttattgggccgtgcttcagcaagaagagacctgtcggcagatgagactgacttttgcagtgatgatgagactcttattgagaagcttgagaacaacaagacggatctccaatctaaaattacaaaggaggtgaaagaaaattcaatcctccaggcaagtcttggaaggaggaaagaagaattgcatgaacgccgcttagcacttgaaaaagaagtggaaaatttgcgggatcagctacagaaggagagaaaattgagggcctcattggagtctgggctgatgaatttgcgtagaggacagactaaggctgatcttgaggaagttgctactgctgaagctgatattttgaacttgaagcaaaaggtttctgatctccgtggacaactcaacaacaatgtccagatgagctccacctcattatgtgactcttgcaacaaacgactcctaagtacagacaagcttttcgaagatgaacagaatacttcaccatcaaatgttgggcccaattctatgtctgacatggcatcggctacagacatggcagatattgagcaatcaaggaagcaaaccacacaacattcatcttcttccatagacaagccaactctccacaagcatcaaaagagtattgcatccaatgaacaatcaagtaccatcagccaaagggctcaaaggatcttatcttctaagggtgggattatgaaggatggccaagatggatcatttacatcaaagtggaaccttgcacagaaacaatactcaaacaatccactgttaggcaggcttggatcaaatgcctattcgagcactagaacagaggaatctggggcagtgccatttgcattagccaagctgacaaaccggctcaattttttgaaagaaaggagggcgattcttgcaagtgagatgcaaaacttaaatttggctcgcccaccagggcctacagctccagcaccaaagaaagactccacatgagaagttagaattttaacatggcatcattctcaggctacggatatttgtactgtcaagtgtcaaatgtgagcgatgcacatatatatgatggacgctacacaagctatttcacatcctgcttctggaagatgggggtggtgcaatattgtaaccttaccggaggttacccagtccgagatgcgtcatcatgcaagaaaataagaggatgctggtggtgtttacataaatcgtggattggacaaatatccatagttctaggtaaacgtaatctgtaaatttatcaggttgtcttgtttttaccacgatgtttcataagtaattttgcagcgacattgatttatccgggttgcaccatttcatgtagaaaatagttaaaccacagtgctattgcaaatgcaattacctgctgcattcgacgcccattaactt

SEQ ID NO: 10356 - DNA, 1890 bp, Nicotiana benthamiana
gtttctaatttgggaattctgcaaaatgtgtttgattttaggtatttatgtttgcaggtggttgctgttgctgtatttctggcattgggatttgctttttatgttttctttgcaccttttgcggggaagaaattgtttcagtatattgtgatggggctttatactcctcttataataagtgcatttggcttgtatatctggtgcgctggtgctgatccggctgatccaggagtttttaaatccaagaagtatattaagaagctagacaacaaaaagcaagttcaacttaaagaatctaagttagggtgtgagacgaattcgtctatacaggacgctaatgctgcttcaatcggagaaaatgcatctgtaaaaagcaataaaggagctgaaccatctgcagatcacaatgcaactcaaaagaaaattgcagctactcatcgaagaggtttgttggcgctactaccacgtgctcgcacaggtagacatgaagaatcttcacagcaacagttgagtgaagatggcatgttctactgcagtttgtgtgaagtagaggtatttaaatacagcaagcattgtagagtatgcgacaagtgtgtagatcagtttgatcatcattgcaggtggctgaacaactgcataggtaaaaggaactatcgcaagttctttacgctcatggtttctgcggtcctcctgcttatacttcagtggtcaactggaatttttgtactgatctactgcttcattgagaagaaattttctgtggaaatcacctccaaattaggaagcagtttctccctcgttccctttgttattgtggtggcagtctgtaccatattggccatgatagcaaccctgccacttgctcagcttttcttctttcacatacttctcataaagaagggaattagcacctacgactacatcattgctctcagagatcaagaacaacaaggagttgcaggtcagcaaagtcctcaaatgtcaactgtcagctccttgactggattaagcagtgcaagctccttcaatactttccatcgagcagcatggtgcacaccgcctcgcctttttgttgaggaccagtacgatgtagttgctccagacactgtatcggtcagttcacttggtaaaaggtcaatggtagaggaaccaatcaagaaaaggaatcctgctgctgtgaagattagtccatggacgttggcacgattaaatgcagaggatgtttcaaaagctgctgctgaagcgaggaagaagtccaaaattctccagccagtggtgagaaacaaagaaccttacacccttgaaacaaatagcagtttaggaagtagtggtcgtcgcatggtgcctaggcctgataacaatagaaggagagctagtaaacgtgtgcgactccccacagagctaccctttgaaaacttgagcaaaattcctagtgatatagctcaaaacagtagaaatgctattatgtccgagacatcaagtagtttggctccacttcagcttgaagcacggagcgatttccgaacaagccgagggttgtcctcaggtggtgttgctgcttcttcccccgagagtagtttggactctcctgacatgcacccactacgggtgtcatcatcaggagttgaagacactacatgcttcgtgggtctatcatctgggatgactcttcagaaggacactccactgtctaggtcgactagtgatggatacgaggcatctggtggagaggatagcgatcgagtgcctactcgcattgtgcaaaggtcaacaaggtggagtagtattctttttggatctgatcagcaagatgatagagtgagaagattgatggtaccatcttcatcaagccaggctaacatcaggaaacattgagcctcgaaaacatac

SEQ ID NO: 10357 - DNA, 1309 bp, Secale cereale
ggctggcggcgattgccgggcggatcggcgtggtcgggtccgtcgcgctgaacatcgtggcgctggcgatctacctccgtggccgcgccgccgctgagaagcaggccagcaagaaagtcaagaaggcggcggctgtcgccccgtcgtctggcaaaccgcccgtattatccaactcggtggtcaatttggatcacggtgatccaacgatgtttgagacgttttggcgcggaccaattggcgagagcgctacgctggtgattccgggttggcagacgatgagttacttctccgacgtgggcaacctctgctggttcctcgagccaagcttcgagcgtgaggtgcgccgcctccaccggctcgtcggcaatgccgccaccgaaggctaccacgtcctggtcggcaccggatcctcgcagctcttccaggccgcactctacgcactcgccccgcccactgccgacgcgcccgtcagcgtcgtatctcccacccccttctactccatgtacccgcccttgacggacttcctcaactccgggctctaccgatgggccggtgaccccaacacattcgacggcgatgactacattgaggtcgtctgctcaccaagcaacccggacggcggcatccgcgaggccgtcctcaagtccaagtccggcaaggacatccacgacctggcttactactggccgcagtacactcccatcacccacatgctcgcccacgacatcatgctcttcaccgtgtcaaagtgtacgggccacgccggcacgagaatagggtgggcgttggtgaaggacaaggaggtggcacagaagatgaacaagttcatggagataaacaccataggcgtgtccaaggacgcgcagctacgcgccgccaaggtactcggggcggtcaccgacggctacgagcgccagcttgccaccgatgccggtggggacacaaacctcctcttccattacgcgcggcggaagatggcgcaccgctggcgtgcactccgttctgccgtggcagcttccggcatctttagcctccccgacgaggtggccggcttctgcaccttcaccaaggacactgtcacagctaatcctgcattcgcatggctgcgctgtgggaagcaagaagtggaagacctagagagcttcttgcgtgagacaagatcataccgcggcgggactaagtcggagctgatccaaaggtggtcgaggactcagtatggttcgacactagatgaagcagttcggcatatttcgtactaactcgtccttgccaaccactaaaatgaggacaccgaataagacgaatgatg

SEQ ID NO: 10358 - DNA, 1563 bp, Hordeum vulgare
ttagtacttgtattttggattctgtctgagcgatggcgagagatcatggcgatgggctggcggcaattgctgggcggatcggcgtggtcgggtctgtggcgctaaatctcgtggcactcgtcatctaccttcgtggccatttcttctcgagtgttggcaccgtcgtcgagaagcggccaagcaaaaaggaggagctagcggttgtggcgccgtcctgtggcaagccgtccgtgttgtccgactcgatgattagcttggatcacggtgatccaacaatgtttgagacgttttggcgcggcccgattggcaagagcgctacgctggtgatcccggggtggcaaacgatgagctatttctccgacgttggcaacctgtgttggttcctcgagcccggcttggagcgtgaggtgcgccgcctccatcgcctcattggcaacgctgccgtcgagggctaccacgtcctcgtcggtaccggatccatgcaactctttcagagcgcactttatgcgctcgccccgcccattgctgactcgccaattagtgtcgtgtctcatacccccttctactcgtcgtacccgtccgtgacggacttccttgactcgaggctctatcgatgggccggcgacgccaatacattcgatggtgacaactacatcgaggttgtatgctcgccgaacaaccccgacggcgccatccgtgagaccatcctcaagtccaagacaggcaaggccatccatgatctggcttactactggccacaatacactcccatcacccaaatgctcgctcacgacatcatgctcttcaccgtgtcaaagtgtacgggtcacgccggcacgaggatagggtgggcattggtgaaggacaagcaggtggcacaaaagatgaacaagttcatggagctaaacaccattggcgtgtccaaggacgcgcagctacgtgccgccaagatactcggggcagttgccgacggctacgagttccagcttaccatcccctctggtggggacgtgaacctcctcttccattatgcgcggcggcagatggcgcaccgctggcgcgcactccgtgctgccgtggcagtttcgggcatcttcagcctccctggcgaggtcggtggcttctgcaccttcaccaaggacatggtcatcgctaatcctgcatttgcatggctgcgctgcgagaaggaagaagtagaagacctggagagcttcttacgtgagcacaagatcataacccgtagcgggactaagttcggagttgatcgaaaggtggtcaggatcagcatggtcgacaccgacgaagcgttcaacatatttgtcgatcgtcttgccacaatgaaatgagggcatcaaatcagaagatgaagtgttattttccttagctaatttactttcataactccctggttagggatccaaagtttatgtctatgtcagatgcatgcacattattggtgtgggttatgtgccatggtatatgtttggtttcgtggataatgatagtattgaatactagaatacccaacttaagttatccagctaaataatttcatttttcaaa

SEQ ID NO: 10359 - DNA, 1853 bp, Avena sativa
ggatagagggaacggccgacggcggactctgcttccgttttggtttccgcttctgctccaatcccattcatggcagccatgattgggatttccgctttacgctccctccacccgctccatctcaccttctcgggctcggccacggctcctccccgcgccacgttgacgctgccgctgccgttgcaccaacaaccccgctcctgcacgactccacgatgccgatgccgatgccgagccaacgacggagccttccccactccactccccgcgtcagggcagctgcgtcttcgcctcgctcaggcgacaccagctccgctgccttcatggcgacgcctcccgacaatgccgccctccgccaccgcctgatcgcccccaactccaccggcggcaccggagactccaccaccgccgccgcttcaggaatcctgcccagcgttcttggggtcgcgcacctggcggtgtcgctgggcatcgtgctggccacggacaagtacctgaagcaggcgttcgtggccgcgtccatcaagttccccagcgccctcttcggcatgttctgcgtcttctccgtgctcgtcgtcctcgacgtcgccgcccccgcgctcgccaagggcttcatggacttcttcgagcccgcctcgctcttcatccagcgctggctgccgctcttctacgtcccatccctcgtcgtcctcccgctcgccgtcagggacgtcccggccgccgccggcctcaagatctgcctcatcacgtttgctggctggttcgcctcgctcacggtggcggggtacacggcgctgaccgtgcggaagatcgtcaagacggagctcgtcgcggccgagccgatgggcaagccgtctgccttcgccacgctggagttctgggcgtggggcgccgtctttgtcgcctcgtttgccacggcgttcgtcaatcccacggcgcttggcaccacggcgaggacgtgcctcccgttcatgctcgcctccactgtactgggatacatggttggttctgggttgccctctggtatcaagaaactgttgcatccgatcatctgctgcgctctctctgcaaatttcgcggcggtggcatatgggtacctctccgggtctggaatcgacgctgcgctaggtgattacctgacaaaggtgccatcgaatcctggagccggtgacgtcctgatgggctttcttgggtctgtcatcatatccttcgcgttctcaatgttcaagcagagaaagcttgtgaagagacacgcggcagagatcttcacatcgatcgccgttgcttcaactttctccttgtactcgactgctatcctcggacgcctgatcgggctggagccgacactgaccatctcgatcttgccgaggtgtataactgtggcgttggctctgagcatagtatctttcttcgaaggtgcgaatacttcggtgaccgctgccgtggttgtcctgacgggcctgatcggtgcaaacttcgtgcaagcagccatggataagcttggcctgaacgaccctatcgctagaggaatcggaacagcgtccagcgctcatggtctgggaacagcagcgctgtcggctaaggagcccgaggcgctccctttctgcgccatcgcctacgcgctcaccggcatcttcggctccctcatttgctcctctgcggccgtcaggcaaagccttgtgttcatagccggctgacttacgtgtgtatgtacacaatgacgacagcaacctttgatgagattttttttttatatataaacgaatgggaagtgctcggtaaaaaagtgctaattttttgttgtcatgtaaagatcaatggttcaaagttgtgagtagtactccctttgcttc

SEQ ID NO: 10360 - DNA, 3549 bp, Setaria italica
cctaaacccgcaaccgcactcgccttcccgccgccggcgagcaccgtagccaccatggtcgccgccgaatactccatagaccgcaagctctccaagctcgtggaggaggctcggctgagtgcagcggccctccgcgccgccgcccaggccgctgacgccgtagcggagctcatcaagagggtgccgcagcagcaggcgacgccggaggcagcgcggggtttcatcagggacctggggctagaagcggagaagctcgcgttcaccttccggccgccggaggaggtgcggctcgccgggagccacgcggccggcgcggtcgcgaggcccgatgtcgctgcggaccttctcgtacgcttgcccaaggaatgcttccacgagaaggatttcctaaatcaccggtaccatgcaaagaggtgtctttacctctgtgtcattgagaagaacttgaggtcctctcgattaatccgcaaagttttatggtctacctttcaagatgaggctcgaaagcctgtgcttcatgtatatccagcaactgaaattgcagaccttcctgggttctatgtcagaataatcccaactgcgaattctttgttcaatgtttcaaagttgaatgtatcaacaagaaacaatgttcgcgcatataccaaagatggcataaacctacccacagcaaagtacaattgtagcatattggaggatatgtttttggaggaaaatgcagaatttataagcagcaccgttgctgactggaaagccttgcaagaggccttggtgttagtgaaagtttgggcacgtcaaagaacttcaatatacacacatgattgcctcaacgggtacttaatatctgccatccttgtgtttcttactgtggactccggaggaagcataattactagatcaatgactacaagacaaattttccgtgtcgtgatgaattttttggcaacttccaaggtgtgggcaaagggtttggtgattcagtcaatgaagaagcgtacaatcaccaaagaggacattgccaattgcctgaaaacatttgatgttgccatatgtgatatatcgggccacgtaaatctgtcgtttcggatgacaaagtctgcttttctagagcttcaagatgaggcagcttgtgcgcttaattgccttgataaatgcagagatggtggatttgaagagctatttatgaccaaagttgactttggtgctaagtttgactcatgcttgaggataaacttgaaaggaaactctaaggttactgcattaagctgttgcgtggatgatgaatcttggagaattcttgaaaaagatgttcagtctttgctgcaacaaggacttacagatagaacaaagatgatccgagtcctatggagaagcacgccttccgaatggaaaataatggatggtttctcagaatttggtagcagtcccctgctcgttggcataatgcttagctcattggaaaagagttttcgtcttgtggatattggtccaaaccctgagaaccgcagtgaggctattaaatttaggaaattttggggagagaaagctgaacttaggagattcaaggatggaaatattgctgaaagcacagtgtgggaatctgaatcttgggagaggcacacaattatcaaaaggatcgctgattatgtgcttatgaaacatttgtcgctgcagaaggatgatttgactcatgttgttgatcagctggacttttgcctcttagttgatggccaagatccggtctcatcttctggagctttgctcgaagcttttgatactttatctaagcagttacgtctgttggatgatgtccctcttaaaatatctaccgtgcaacccctagactcagcttttaggcacacctctgtgtttcctcctgaacctcatccactggcatatggaaagaattctcagaggctgccgaatttcgcaacaacttgcattagatctatggaagttatgattcagctagagggatctggtaactggccattggatcctgtggccatggagaagacaaagactgcatttcttttgaaaattggtgaaagcttggaggatcgaggaatgtatgtttcagccagtgaagatgaggtgaatgtccttacatctggatactcattcttactcaaaatatttcacgaaagaggcttagtgttgcaaaagcaagctggagatgataacacacaaagtgctctatcacaagataaggtgctttttcagcggagccagcactcaagtatgattaatggtctgcatggccgttaccagatgtatggaccagtagtcaggctagcaaaaagatggatatctgcacatctgttttcttcaattatctcagaggaggcagttgagttggtggttgcatatctatttttgaagccattcccattccatgccccttcttctcgggttgctgggtttctcaggtttttgcggttgttatccagttttgattggaccttttcacccatggttattgacataaataatgacttcaatctgaaggatgagaaggagatcaatgaaaacttcatgatgagcagaaaatcttatgagcaaaatcctcatgatatagagcctgcaatgtttctcgctacgtcatatgataaagcatctgaagcatggacaaaacagtcaccaagcaagtcggttcttaaacggatggctgtttatgctaaaagcagtgcagaacttttaacaaatcttatactaaatggccaatcagggcaatatacttgggagtgcctgttccaaacacctatgggcaattatgatgctgttgttctcctccatcaagagaagctttgccgtccccatcatgtacttttccctgccgagattcctaatggtaagttggtgatctggggcaaaccgagtaaagatttccacccctatatgccacttaataaaggggttgtgaaaagtttgcatgatgcaagagataaacttttggtaaacttcgacccaactacatacttcctgcgagacttgaagtgtgcatttcccaaaaccttcaagctgtggtatggttcagaaggaggagatgctgttggtcttacatgggagaacccaaagaagcgtggcagagaggaggccgatgaaaccatgccagagctgacatctatccttaaggaggttggagatgttggtaaaggtttggtgaggggtgtgtatctcctgaaagcaccaaagcttcagtaaactactttgtgaagaactgaagatctcaacgaactagctgatgcgcaagaacgatgccttctattatttgcaggatagcacaacttctaactggttttttacccactggcaagatagaagcataggttccaggacagtgtttgtgcatgctggcaatagattaaatgtggcaatgttctcatgaaatcataatgatctgtagtgtttaaaatttatactcgacaactgaaaagataaaagatcaaaggttttggggtctgtatccaaattttgatttagtatatatcgaaatgtattttttgccacatctattgcaatgagaatgccaatcctcaagcttcaagt

SEQ ID NO: 10361 - DNA, 3942 bp, Panicum virgatum
cggaccatgtacaggtccgactcccaccacacgcgctccattcatgggccttttcctttctcagcctactaagggaaagtatgctcttcctcattcgaagcgtggctaaaccctaaacccgcaaccgcactcgccttcccgccgccggcgagccccgtagccaccatggccgccgccgctgccgctgccgaatactccatcgatcacaagctctccaagctcgtggaggaagctcggccgagcgccgcggccctccgcgccgccgcccaggctgctgacgccgtggcggagctcatcaagagggtgccgcagcagcagacgacgccggaggccgctcgaggtttcgttagggacctggggatggaagaagagaagctcgcgttcaccttccggccgccggagatggtgcggctcgctgggagccacgcggccggcgcggtcgcgaggcccgacgtcgctgccgaccttctcgtacgcttgcccaaggaatgcttccatgagaaggatttcctaaaccaccggtaccatgcaaaaaggtgcctttacctctgtgtcatcgagaagaacttgaggtcctctcagttaatccgcgaagtttcatggtctacctttcaggatgaggctcgaaagcctgtgcttcatgtatatccagcaacagaaattgcagaccttcctgggttctatatcagaataatcccaaccgcgaattctttgttcaatgtttcaaagttgaatgtatcaaccagaaacaatgtccgtgcacatatcaaagatgatggcgtaaccctacccacaccaaagtacaattgtagcattttggaggatatgcttttggaggaaaatgcagagtttatgagcagcacctttgctgactggaaagctttgcaagaggccttggtgttagtgaaagtttgggcacgtcaaagaacttcaatatacacacatgattgcctcaatggatacttaatatctgccatccttgtgtttcttactgtggattctggaggaagcataattactaaatcaatgaccacaagacaaattttccgtgtcgtgatgaattttttggcaacttccaaggtgtgggcaaagggtttggtgattcaatcaatgaagaagcgtacaatcaccaaagaggaccttgccaattgcctgaaaacatttgatgttgccatatgggatatatctggccatgtaaatctggcatttcggatgacaaagtctgcttttgtagagcttcaagatgaggcagcttgcgcgcttagttgccttgataaatgcagagatggtggacttgaagagctttttatgaccaaagttgactttggtgctaagtttgactcatgcttgaggataaacttgaaagagaactctaaagttacttctttaagctattgtgtggatgatgaatcttggagaatccttgaaaaagatgttcagtctttgctgcaacaaggacttacagatagaacaaagatgatccgagtcctgtggagaagcacaccttccgaatggaaaataatggatggtttctcagaatttagtaacagtccactgcttgttggcataatgcttagctcattggaaaagagttttcgtcttgttgatattggtccaaaccctgagaaccgcaatgaggctattgaatttaggagattttggggagagaaagctgaacttaggagattcaaggatggaaatattgctgaaagcacagtgtgggaatgcgaatcttgggagaggcacacaattatcaaaaggatagctgattatgtgcttatgaaacatttggcgctgcagaaggatgatttgattcatattgttgatcagctggacttttgcctcttagttgatggccaagatccggtctcatcttctggagctttgctcgaagcttttgatactttatctaagcagttacgcctgctggatgatgtccctcttaaaatatctaccgtgcaacccctagacccagcttttaggcacacttctgtgtttcctcctgaacctcatccgctggcatatggaaagagttctcagaggctgccgaatttcgcaacaacttgcattagatctatggaagttatgattcagctagagggatctggtaactggccattggataatgtggccatggagaagacaaagactgcgtttcttttgaaaattggtgaaagcttggaggatcgaggaatgtttgtttccgccagtgaagatgaggtgaatgtccttacatctggatattcattcttactcaaaatatttcatgaaagaggcttagtattgcaaaaacaagctggagatgataacattcaaactgctctatcacaagataaggtgctttttcaatggagccaacactcgagtatgatcaatgggctgcatggccgttaccagatgtatggaccagtagtcaggctagcaaaaagatggatatctgcacaccttttttcttcatttatctcagaggaggcagttgaattggtggttgcttatctatttttgaagccattcccatttcatgccccttcttctcgggttgctgggtttctcaggttcttgcggttgttatccacttttgactggaccttttcacccatggttcttgacataaataatgacttcaatctgaaggatgagaaggagatcaatgaaaactttatgatgagcagaaaatcttatgagcaaaatcctcatgatatagagcctgcaatgtttcttgctacgtcatatgataaagcatctgaagcatggacaaaacagtcaccaagcaagtcggttctcaaacggatggccgcttatgctaaaagcagcgcagaacttttaacaaatcttatactaaatggtcaatcagggcaatatacgtgggagtgcctgttccgaacacctatgagcaattatgatgctgtgattctcctccatcatgagaagctttgctgtccaagtcatgtacttttccctgctgagactcctaatggtaagttggtgatctggggcaaacccagtaaagatttccacccatatatgccactcaataaaggtgctgtgaaaagtttgcatgatgcaagagagaaacttttggtaaacttcgacccaactacatacttcctgcgagacttgaagggcgcattccccaagaccttcaagctgtggtatggttcaataggaggagacgctgttggtcttacatgggataacccgaagaagcgtggcagagaggaggctgatgaaaccatgccagagccgacatctatccttaaggaggttggggacgttggtaaaggtttggtgaggggtgtatatctcctgaaagcaccaaagcttcagtaagctactttgtgacgagttgaagatcttaagaaccagctgatgcgcaagaatgaaggcttttttattatttgcaagataacacaacttaactggtttttccactagcaagatagaaacaaaggttccagagggcagtgatggagcagatgtgggaaagtaatcatgaagtcgtaatgttgtgtttcaactttagactcagcaactgaaaaatgaatctaggttgtggggtctgtatccaaattttgattgagcagtatatatggaaatgtaatttttttacatctattgcaatgaaaatgccaatcctcagctgaagcgccaagttgtgtctgtttggtttcccgtgaaacgtgtatgcgcttgttcttaaacagtgctaatgttttttttttttgaatgaagactgcggaggagttctccacagcgtatgcattaaggttagaaaagttctggttagttaaaagtacagggattagaaaaatacaaggaattgagccagaactgaactaagggaatttggccttctcgcattttgtggagttgtagcagaacttgatccttgaatttagattgatggaggctctcgcagcatcaaaaatctttctgttcctc

SEQ ID NO: 10362 - DNA, 3439 bp, Brachypodium distachyon
gcgcggccatcgtcttcccgccgcaccccactcacccacccaccgtactcgcaccccaccatggcctccgccgactactccctcgaccgcaagctctcggcgctcctcaccgaggcgcggccgagcgccgcctcgctccgcgccgccggagaggcggccgacgccgtcgcggcgctcgtcaagagcgtgcccccgcagcaggcgaatcccacggccgcctccgggttcgtggcggacctgggcctactcgcggaggcacacaagctggcgttcgacttccgtgccccggaggtggtgcggctcgccgggagccacgcggccggcggctccgtcgccaggcccgacgtcgccgccgacctccttgtccgcttgcccaaggaatgcttccatgaaaaggatttcctgaatcatcggtaccatgtaaggaggtgcctttacctctgtgtcattgagaagagcttgctttcttctcctttaatacgtaaggtttcatggtccaccttccaagacgaggcacggaagcctattctccatgtatatccagcaacagaaattgcagaacttcctgggttctatgtcaggataatcccaactgcgagctctttgttcgatgtctcaaagctgaatctgtcaacacgaaacaatgtccgtgcatatacaaaagatggcataaaccaacctacaccgaaatacaatagcagcatattggaggatatgtttctggaggaaaatgccgaatctatcagtagcacctttgcaaactggaaaaacttgcaagaggcattggttttactgaaggtttgggcacgtcaaagaacttcaatatatacacatgattgcctcaatggatacttaatatctgccgtgctcgtgtttcttactatggactctggaggaagcataattaatagatcaatgaccacaagacaaattttccgtgttgcaatcaatttctttgcaacttctaagatgtggcctaagggcttggtgatgcagccaatgaagaagcgtacaatcaccaaagaggacattgctcatctcctgaaaacatttgatgttgtcatatgtgatgtatctggccacgtcaatctggcatttcggatgaagaaaacagcttttctagagcttcaagatgaggcagccagcgcacttaattgccttgacaaatgcagagatggtgggttagaagagctttttatgactaaggttgattttggtgctaagtttgactcatgtgtgaggataaacttgaaggggaactccaaagttactgcattaagcttctgcttggatgacgaatcttggcgagtacttgaaaacaatgttcagtccttgctgcaacaaggacttacagatagaacaaagatgatccgtgtcctgtggagaagcactccttctgaatggaatataaaggatggcttctcaaaatttggtagcagcccggtgattgttggtataatgcttagctcgttggagaagagttatcgtcttgttgatatcggtcctaaccctgagaatcgtgatgaggctgttaaatttaggaaattttggggagagaaagctgaactcaggaggtttaaagatggggttattgctgaaagcacagtttgggaaacagagccttggaagaggcacacaatcgtgaaaagaattgctgactatgtgctttcgaagcatttgctattgcagaaggaagatttggttcatgttgttgatcagctggacttttgcctcctggttgctggccaagatccagtgtcatcttctggagatttgctcgtagcctttgatactttatctaagcagttgcgtctattggatgatgttcctcttaaaatatccactgtgcaacctctagacccagcttttaggcacacttctgtgtttcctcctgaacctcatcccttggcgtatgaaaagagttcgcagaggctgccgaattttgcagcgacttgtgttcgatctttggaagtcatgattcagctagagggatctggtaactggcctttggatcctgtagccatggagaaaacaaagtctgcgtttcttttaagaattggtgaaagcctggagggtcgaggaatgtttgttaaagccagtgaagatgaggtcaatgtttttacttctggatattcattcttgctcaaaatatttcatgaaagaggtttggtgcaaaagcaagctggagatgttaacacacaaagtgctccatcggaagacaaggagctctttctgcggagccagcactctagtatgatcaatggtctgcatggtcgataccaggtttatgggccagtagtcaggctagcaaaaaggtggatgtctgcacatcttttttcttcatttatctctgaggaggcagttgaattggttgtcgcctacctatttttgaagccatttccattccatgccccttcttcgcgggttgttgggtttcttaggttcttgcggttgctatccagttttgactggacctttacacccatggtcgtcgacataaataatgacttcaacctgaaggatgagaaggatatcaatgaaaactttatgctgagcagaaaatcttatgaacaaaatcctcatgatatagagcctgcgatgtttctggccacatcatatgataaagcatctgaagcttggacaaaacattcaccaagcaagtcggttcttaaacggatggctgcttatgccaaaagcagcgcagaactgttaacaaaccttataattcatggtcaatcaggccaatatacatgggagtgcctcttccggacacctttaagcaattatgatgctgttgtactcctccatcaagagaagctttgtcgtcctcaccatgttctttttcctgccgagactcctaatggtaagttggtaatccggggtaatccaagtaattctttccacccttatatgtcactcaatagcacagttatgagaagcttgcatgatgcacgagataaacttttggtaaattttgaccctaccgcatacttcctgcgtgacttgaagtgtgcattccctgtgaccttcaagctgtggtatgattcgaatggaggagatgcagttggtcttacatgggagaactcaaagaagcgtggcagagacgaggctgatgaagccatgccggatccaacatctatactcaaggaggttggagacgttggtaaaggattggtgaggggtgtatatctcctcaaagcaccaaagctttagtagggttttgggcgaagaccttgccgaaattactgtcatgcacgagagaactcctaactgaatggccaacggaacacaaattatctataggaatgtataaagttgcaatgccatctgtttatatattagactccaattgaaagagccaagtctgcaaaaaaacaaaaactgtatccaaattttgattgagagttgcagaaaagtgtagcgatgtagttttcaattc

SEQ ID NO: 10363 - DNA, 3782 bp, Secale cereale
gactaccaccaaaagccctttctttgccttcccgccgccggcaaccgaccaccgaagccgcaatggtctccgccgagtactccatcgacctcaagctctccgagctcctcaagcaagcacggccgagcgccatctccctccgcgctgcgggggaggccacggacgccgtcgcggagctcatcaagagcgtgctgccgcagcaggctgcgccggaggctgcctcggggttcgtgagggacctgggcctcgcggccgagaagctagcgttttccttccggccgccggaggtggtgcggctcgccgggagccacgcggccggcgcggtcaccagacccgacgtcgctgctgaccttctcgtccgcttgcctaaggaatgctttcatgaaaaggatttcctgaatcaccggtaccatgcaaagaggtgtctttacctctgtgtcatcgagaagagcttgaggtcttctcctttaatccgcaaggtttcatggtctacattccaagatgaggcacgaaagcctgtcctccatgtatatccagcaacagaaatcgcagaacttcctgggttctatgtcaggataatcccgacggcaagctctttatttgatgtttcgaagctaaatctgtcaacaagaaacaatgtccgtgcatatacaatagatggcataaaccaaccgacacctaggtataataacagcatattggaggatatgtttctggaggaaaatgcagaatgtaccggcagcacctttgcaaattggaaaaccttgcaagaagcattggttttactaaaagtttgggcacgtcaaagaacttcaatatattcacatgattgcctcaatggatacttaatatctgccatccttgtgtttcttaccatggactctggaggaagcataattaatagatcaatgaccacaagacaaattttccgtgttgcaatcaatttttttgcaacttcgaagatgtggtcgaagggcttggtgattcagccaatgaagaagcgtactatcagcaaagagggcattgctcatctgctgaaaacatttgatgttgccatatgtgatgtatctggccatgtcaatctggcattccggatgacgaagtcagccttttcagagctccaagatgaggcagcttgcacgcttaattgccttgataaatgcagagatggtggatttgaagaactttttatgaccaaagttgattttggtgctaagtttgattcatgtttgaggattaacttgaaggggaactctaaagttactgcactaggcttctgctcggatgatgaatcatggcgagtacttgaaaaagatgttcagtccttgctgcaacaaggacttgcagatagaacaaagatgatccgcgttctgtggagaagcacaccttctgaatggaatataatggatggcttctcagagtttggtagcagcccactgattgtcggtgtaatgcttagcttgttggagaagagttatcgtcttgtcgatattggtccaaatcctgaaaatcgtgatgaggctattaaatttaggaaattctggggagagaaagctgaacttaggagatttaaagatggggctattgctgaaagcacagtgtgggaaacggagacttgggagaggcatacaatcataaaaaaaattgctgattatgtgcttaccaagcatttgctgttgcggcaggaagatctgactcatgttgttgatcagcttgacttttgtctcttggttggtggccaagatccagtgtcatcttctggagctttgcttgaagcctttgatactttagctaagcagttgcgtctattggatgatgttcctcttaaaatatctactgtgcaacctctagactcagcctttaggcacacttctgtgttcccccctgaacctcatccgttggcatatgaaaagaattctcagaggctgcccaaatttgcagcaacttgtgttcggtctttggaagtcatgattcagctggagggatctggtaactggcccttggatcctgtagccatggagaagacaaagtctgcatttcttttaagaattggtgaaagtctggaggatcgaggaatgtttgttacagccagtgaagacgaggtcaatgttcttacatctggatattcgtttttgctcaaaatatttcatgagagaggtttggtggtacaaaagcaagctggagacagtaacacccaaagtgctccatcagaagataaggagctcttttttcgtagtcagcactcaagtatgatcaatggtctgcatggtatttatcaagcgtatgggccggtagtgaggctagcaaaaaggtggatttccgcacatctattctcttcatttatctcagaggaggcggttgaattggtggttgcgtacctatttttgaggccatttccattccatgccccctcttcacgggtcactgggttccttaggttcttgcggttgctatctagttttgactggaccttttcacccatgattgtggacataaataatgacttcaacctgaaggacgagaaagaaatcaacgaaaactttatgctgagcagaagatcttatgaacaaaatcctcatgatatagagcctgcaatgtttctggctacatcatatgacaaatcatctgaagcgtggacaaaacaatcaccaagcaagtcggttcttaaacggatagcttcttatgctaaaagcagcgctgagctgttaacaaatcttatcatgcatggtcagtcaggccaatatacatgggagtgcctcttccgaacacctttaagcaattatgacgctgttatactcctccataaagagaagctttgccgtcctcaccatgttctttttcctgctgagattcctaacggtaagttggtaatccagggcaaaccaagcaatgatttccacccttatatgccactcagtaaaagtgttgtgagaagcttgcatgacacaagagataaacttttggtgaattttgaccctaccgcatacttcttgcgagacttgaagtgtgcattccccgtgaccttcaaattgtggcacgattcgattggaggggatgcaattggtcttacatgggagagctcaaagaagcgtggcagagatgagggtgatgaagccatggcggatccaacgtctatactcaaggagattggagatgtgggtaaagggttggtgaggagtgtatatctcctcaaagcaccaaagcttgagtaagcttttgcgtgaaggagtttgctgatgtgccggagagaactcctggctgattttctgccactggcaagagaaaggaagacccagagccagtggacaacatgttctacagcaaagcaatgtataaagtcgtgacgatatcatgtggttgttgtaactccaatcggaagatcaagtcagcaaaaatctgtacccaaattttgactctaagttccagaaaagtacagcgatgaagttctatttcctggtcattttagcaaaaaagggaaggaaaaaaactgcaatgctgtgtcgatgtgagacgaaatggaatcaaaattgagcagctactaacgcagggttacagtgaagttacatttctctatgccaagaggaattctcatgtaaaatttgttattctcggaaatggcctatttcatttgtcttgtaaaattcttctgcatactgagtgctctttgaaagacaatacatgcatctctctagaaaaacaaaaaaaaaaaaaaaaaaaaaataaaaaaaaaaaaaaacaaaaaaaaactgaagtaactgaacaagacaacacgaagggagtag

SEQ ID NO: 10364 - DNA, 3624 bp, Sorghum bicolor
gctaaaccctaaaccccgtagccgcgctcgccttcccgccgccggcgagcaccgaagccagtaagccaccatggccaccaccaccgccgcctccgagtactccgtcgaccgcaagctctccgcgctcgtggagcaagctcggccgagcgcggcggccatgcgcgccgccgccgaggccgttgacgccgtcgcggagctcgtcaagagggtgccgcagcagcaagcgacgccggatgccgcgcgcgggttcgtgagggacctggggctgggagccgagaagctctcgttcaccttccggccgccggaggtggtgcggctggccgggagccacgcggctggcgcggtcgcgaggccagacgtcgctgctgaccttctcgtgcgcttgccaaaggaatgcttccacgagaaggatttcctgaatcaccggtaccatgcaaagaggtgtctttacctctgtgttgtcgagaaaaacttgaggtgctctaaattaatccacaaagtttcatggtctaccctccaagatgaggctcgaaagcctgtgcttcatgtatatccagcaaccgaaattgcagaccttcctggattctatgtaagaataatcccaactgcggattctttgttcaacgtttcaaagttgaatgtatcaacgagaaacaatgtccgggcatatacaaaagatggtgtaaacctacccacaccaaagtacaattgtagcatattggaagatatgtttttggaggaaaatgcagactttattagtagcacctttgctaactggaaagctttgcaggaggccttggtgttggtaaaggtttgggcacgtcaaagaacttcaatatacacacatgattgtctcaatggatacttaatttctgccatccttgtgtttcttactgtggactctggaggaagcatgattactagatcaatgaccacaagacaaatttttcgtgtattgatgaattttttggcaacttccaaggtgtgggcaaagggattggtgattcaatcaatgaagaagcgtacaatcaccaaagaggacattgccacttgcctgaagacatttgatgttaccgtatttgatatatctggccacgtaaatttggcgtttcggatgacgaaatcggcttttttagagcttcaagatgaggcagcttgcgcgcttagttgccttgataaatgcagagatggtggacttgaagagctttttatgaccaaagttgacttttgtgctaagtttgactcatgcttgaggataaacttgaaagggaactctaaggttactgagttaaactattgtgtggatgacgagtcttggagaattcttgagaaagatgttcagtctttgctgcaacgaggacttacagatagaacaaagatgatccgagtcctgtggagaagcacaccttctgaatggaaaatagtggaaggtttctcagaatttggcagcagtccgcttctcgttggtatgatggttagctcattggaaaagagttttcgccttgttgatattggtccaaaccctgagaaccgcgttgaggctattaaatttaggaaattttggggagagaaagctgagcttagaagattcaaggatggaaatattgctgaaagcacagtttgggaatgccaatcttgggagaagcacacaattattaaaaggatagctgattatgtgcttatgaaacatctgtcactgcagaaggatgatttgattcatgttgttgatcagctggacttttgcctcttagttgatggccaagatccggtctcgtcttctggagctttgcttgaagcttttgatactatttctaagcagttacgtatcttagatgatattcctcttaaaatatctaccgtgcaacccctagactcagcttttaggcacacttctgtgtttcctcctgaacctcatccactagcatatggaaggaattctcagaggctaccgaaattcgcaacaacttgcataagatctttagaagttatgattcagctagagggatctggtaactggcccttggatcctgtggccatggagaagacaaaggctgcatttcttttaaaaattggtgaaagcttggaggatcgaggaatgtttgtttcagccagtgaagatgaggtgaatgtccttacatctggatattcatttttactcaaaatatttcatgaaagaggtttagcgctgcaaaagccagttggagatgacaagacacaaagtgctctatcagaagataagatgctttttcagcggagccaacactctagtatgattaatggtctgcatggccgttaccagatgtatggaccagtagttaggctagcaaaaagatggatttctgcacatctattttcttcatttatctcagaggaggcagttgagttggtagttgcgtacatatttttgaagccattcccgttccatgccccttcttctcgggttgctgggtttctcaggtttttgcggttgttatcaagttttgactggaccttttcacccatggttattgacataaataatgacttcaacctgaaggatgagaaggaaatcaatgataactttatgctgagcagaaaatcttatgaacaaagccctcatgatatagagcctgcaatgtttctcgctacgtcatatgataaagcatctgaagcatggacaaaacagtcaccaagcaagtcggtccttaaacggatggctgcttatgctaaaagcagtgcacagcttttaacaaatcttatacttcatggtcaatctggagaatatacatgggagtgcctgttccgaacacctatgagcaattatgatgctgttattctcctccatcaagagaagctttgttgtccccatcatgtactttttcctgccgaaactccagaaggtaagttggtggtctggggcaaaccaagtaaagatttctgcccctatatgccactcaacaaaggggcagtgaaaggttttcatgacgcaagagataagcttttggtgaactttgacccaactacatacttcttgcgagacttgaagtgtgaattctccaagactttcaagttgtggtatggttcaattggaggagacgctgtgggacttacttgggagaacccaaagaagcgtggcagagaggaggctgatgaaactgagccagagcccacatctatccttaaggaggttggagacgttggtaaaggtttagtgaggggtgtgtatcttgtcaaggcaccaaagcttcagtaaaagaacacgggtacaactgaagatctgaccgaacaagccgatgcacaaggaagacttgtatcatttgcacaccaacacaacttccaaatgtggtagtcttccaactggcaagagaagcaaaggttcgagggcgtttagaggctggcaatgggggagcaattgtatgtagtcatggagtcgtaaacaagtgaagattgtgttgtgtttagactactactacacagctgccaaaaaaggaaatcgaggttgtagagtctcgaaattttgacactgcaggatatgtgaaatgaaatgtaattttgcaatatctgctgcaatgaaaatgccaatcaatttgacgtgccaagttgtgtctatttggtttcagatggaacatgtactggatgtgcatt

SEQ ID NO: 10365 - DNA, 3426 bp, Lolium multiflorum
catcaagagcgtgccgccgcagcaggcggcgccggaggccgcctcgggcttcgtcagggacctgggcctcgcggcggagaagctgacattttccttccggccgccggaggtggtgcggctcgcagggagccacgcggctggggcggttgccaggcccgacgtcgcggccgaccttctcgtccgcttgcctaaggaatgctttcatgaaaaggatttcctgaatcaccggtaccatgcaaagaggtgtctttacctctgcgtcatcgaaaagagcttgaattcgtctcatttgatccgcaaggtttcatggtctaccttccaagacgaggcacggaagcctgtcctccatgtatatccagcgacagaaattgcagaacttcctgggttctatgtcaggataatcccgtccgcgagctctttattcgatgtttcaaagctgaatttgtcaacaagaaacaatgtccgtgcatatacaaaagatggcataaaccaaccgacacctaagtacaataacagcatactggaggatatgtttctggaggaaaatgcagaatctatcagctgcacctttgcaaattggaaagccttgcaagaggcattggttttactaaaagtttgggcacgtcaaagaacttcaatatatgcacatgattgcctcaatggttacttaatatctgccatccttgtgtttcttacaatggactctggaggaagcataattactagatccatgtccagaagacaaattttccgtgttgcaatcaattttttgcaacttccaaaatttggtcgagggggttggtgcttcagccaataaagaagcgtacgatcaccaaagagtacattgctcatctcgtgagaacatttgatgttgccatatgtgatgtatctggccatgtcaatgtggcatttcgaatgacaaagtcggcttttttagagcttcaagatgaggcagcttgcacacttaattgccttgataaatgcagagatggtggatttgaagagctttttatgaccaaggttgactttgctgctaagtttgattcatgcctgagggttaacttgaaggggaactctaaagttactgcgttaagcttttgcttggatgatgaatcttggcgagtacttgaaaaagatgtccagtccttgctgcaacaaggacttacagatagaataaagatgatccgcgtcctgtggagaagcacaccttctgaatggaatataatggatggtttctcagagtttggtaccagcccactggttgtcggcgtaatgcttagcttgttggagaagagttatcgttttgttgatattggtccaaatcctgagaatcgtgatgaggctattaaatttagaaaattttggggaaagaaagctgaacttaggagatttaaagatggggctattgctgaaagcacagtgtgggaaactgagacttgggagaagcacacaatcatcaaaagaatctctgattatgtgcttaccaagcatttgctgttgcggaaggaagatttgactcatgttgttgatcagcttgacttttgccttttggttggcgggaaagatccagtgtcgtcttctggagctttgcttggagcctttgataatctaactaagcagttgcgtctgctggatgatgttcctcttaaaataaccactgtgcaacctctagactcagcttttaggcacacatctgtgtatcctcctgaacctcatccattggcatatgaaaagagttctcagaagctaccgaagtttgcaccaacttgtattcgatctttggaagtcatgattcagctcgaggggtctggtaactggcccttggatcccttagccatggagaagacaaaatctgcatttcttctaagaattggtgaaagcctggcggatcgagggatgtttgtaacagccagtgaagatgaggtcaatgttcttacatctggctattcgtttttgcttaaaatatttcatgaaagaggtctggtggtacaaaagcaagctgcagacgctaacacacaaagtgatccatcagaagataaggagctctttctgcggagccagcactcaagcatgatcaatggtctgcacggtcgttaccaagtgtatgggccggtagtcaggctagcaaaaagatggatttctgcacatctattctcttcatttatctcagaggaggcaattgaattggtggttgcatacctatttttgaagccatttccatttcacgccccatcttcacgggttgctgggtttcttaggttcctgcgattgctgtccagttttgactggaccttttcacccatggtcgtggacataaataatgacttcaacctgaaggatgagaaagaaatcaatgaaaagtttatgctgagcagaagatcttatgagcaaaatcctcatgatatagagcctgcaatgtttctggctacatcgtatgataaatcatctgaagcttggacaaaacattcaccaagcaagtcggttctcaaacggatggcttcatacgccaaaagcagcgctgagctgttaacaaatctcatcgttcatggtcaatcaggccaatatacatgggagtgcctcttccaaacacctttaagcaattatgatgctgttatactactacatcaagagaagctttgtcgtcctcaacatgttctttttcctgctgagactcctaatggtaagatggtaatcaagggcaatccaagtaatgatttccacccttatatgccactcagtcaaagtgttgtgagaagctcaagagataaactcttgttaaatttcgaccctaccacatgcttcttgcgagacttgaagtgcgcattccctgtgaccttcaaactgtggcatgattcggttggaggagacgcaattggtcttacatgggagaactcgaagaagcgtggcagagatgaggccgaggaagccatgccagatccagcttctatactcaaggaggttggagacgtgggtaaaggtttggtgaggagtgtatatctcctcaaagcacccaagcttcagtaaccttttgggtgaaggatcttgctgaggttgctgatgggcacgagagcacctaacccagtttcctccaccagcaagagatagaaggagcgcccacccagtggatcagatgttatttatagcaatgtataaagtcgtgacgatatcagtggttctccttggactctaatcggaagatggagtctgcaacaatctgtatcccaattttgattctgagttgcagaaaagtatagcaatgtagttgtattgcctggttatgtcattttttatcggcgcaatgatgcgccactttgactcgagatggaatcaacattaaggaggttggaaaagcagggttatatgaacatttgcatttgattgtattgccaagcagaattctcatttaaaattgcattttcgaaagca

SEQ ID NO: 10366 - DNA, 9506 bp, Oryza sativa
gaaaatgaaagaaaaaagtggatatcgtcgcccaatgactcggacgaggcgacctccatcgctgccacatcgctactctgcgcagccgacttccaccgctgctgcgatctctccacctcatttgcgccaccccgttcttccttctaccacgccagttgcagccctcctcagccacgctgctctccatattcccctccaccctctgtcgcttgctaccgttggtggacagatccgacggctgtgagctcgtagccgccggatccggcggtctggcgactagagaagggaggggagggcggtggcaatgacggggaccgctcttctcgctccatgcagttcgtcaccgtcatcggggatctagaagccgaagctcgttgtttttggaatctggtgcgtgggtgggagctcatcaagggaggaagcaaccggcgaggaagacggtgccgccgacggtgaggatgggaagagaaaggcaatggaggctgtggcggcggcgccccttgacctcgagtgtctagatacatcatcgacttcttcatcttccttcttcctactgaatcgtgtgtgagcaaatgtgagaaggtggtgaggggatgcaagccggccctgcctgcgttcctcctcggcctggctcggagaggcaattttgcacccgcccatcctggctcgctcctccgtccaggcaaccaaacagtgagctcgctgcatgcaccgtaccggtgcgagccaccgttgatgcgggcaaccaaacacatcctacatgttcatgttcaacagtcaaaatcccgcccacatagaaagctcccagacccgttctcatggatccacgtgatccgtcagcagtcatcagacggccagagtaccacccaacatccatccaagcgtcaaaacacccctgccacccgtcgtacgcaagtacgcaccacatgtaaaacacaccacaccaccccctccggaggcccccacccactgacaagcacacgtaaaacggaggcggatccgtttgcgccgcttgcctttgacacagggacagagagagagagagagagagagaggagttttgagcgcgcgtcccggagcagagtgagtgaagtgccttcactgttcggttcggtggtggtgagagtgacgaggagcgaggcgaggcggcaacttccatggagaggaggagttggcggtagattaactcccaccacctgaccggaggaggagacgaggccgccggacgagagggatcaacgccgccgcttcctgccgctgccgcgagcagaggcacagtctgatcgcttcgatcatcgcggtgattgccggagcttggttcgacctgcattgtagtactcttgctgcttactttcgtaaagaatcaggactgcttgccttttgggttcaagctctggctagtaatcaacagaatggatgcgaaagacttggtggaaataggcatgaaggaggaggacattacaacaatgctgtttggaaagaaggttatcgagctgacggaagacgcatttgatggttcgaaagaagaaaggaagatctttgaggagctcttctgcagaacaggcactagcggagcaagcacccgccatccacgccgggatggaaagagcagttcactgagagatgcaagcaaagaattgatatcaactaacacaccttcgagctctgcctccaatcacaagtcggcgcgctgccgtgtggttgagtcttttacatatggcaacttatcaagctatcttgtgttctgcaacaatgacaaacaaaaaatgcagaagacagtgggctttccggatatggccagtgcttctgatctcgtgatacagtggacaccgccttccgttgagagggtgtacacccgtagggcagtggctcgcaggaaccaaagagcaaaactttgcagtgttcttgatctggagagggttgacattaccagtgttagacagcgtagggacagagggcagcataagtatggccacagccatgcagtgctttgggatcatctccgtctacacgctaatcttctgatgatggatgctgggtggaagattgatggcaaggaaagatgggacaagagtaaggttgatcatatttatgagtcacctgacaaagtaatgcgcctgttttctcttcccagggcatggaaatgctttggccagtggttgcttattaattcatccggctttggtggaaatgactacggtcggatatggttcaacatccatgactttcttagtgatttgaagaatacactgctatgcttagaatatgaagtccggctcccgaagcaatctctatcttttctcaaccagtggcagctccttgaccctttcatggcagtagtttgcattgataagaaggttagagccctgaagaagggagtagcactgaaagctgtaaacagcactgttacatttgtcagctgcatcgagagtgagctgtcaaatccccggaatgccgacaatccacttggtctaaaccattcgaacaattttaacagcacacatcccaggtcacggaaaaatcttctgccactgcttcaatctgatgacctcgatggaaattcttcgcgcagcaaacatccttctactgttggaaaacgtaaatctagccaatataaaatggatgaaagattgccaatcatggcagaaatacaagaaaaaagcatcagaagtactgctcatcgtatagtgatgggtctccaagattcaacagcttttcctggttcaaggactagtttaaatatgaaaaataagccttcatacagcaagtctaatttgacacagagcattcaagacaaatctgatccactatattttccacctaattattctcccagtgatcttgttgaaaatgctgaaataaatgatccgagttttcatgcctatgacatgatagaatctgcaaacgtggacaattctgcagatagtcctgacgagttgctcctaggagcaaacttactgttttctcacgaagtggacgagatgctccttgacgacatcagcaatgaacattactgtactgcagctgtttctgagccacaagcaaaaaacatagatttagaggatggaccgtctggtccatcatcagtagtatcagagaaggacacaggtttgaaagctaataaagatgttatcaacaatgaacagcatgatgatggagttgtcgctgagtcccaattggcaaatacagatgtgatggatagacctgctggtgcactgtcatttctaccaacgatggatacagttttggaaggtaatgagatgagctcagaagagatgacaaaaggagggcagttatcatgtgaaggcaccaacaatgcgatggtgatatcggagccacagttattgtttgtgtcccctcatgatggaaccctttctttcatgaatgatagtatgtgcagccaagagatgcggagttgcctcaatgcttcaaatggcaccatggggactaacgtgcagctaggcatccaatcctcagtatatgaagcaagtttgattcggggattcctataccttgacaatgagggttctccaatttgttggacggtcctaaacccagaacctcctaggcagttgatctgttctgaaccaatctcaaaggcatctgaacttcatggtgaaatgaacatggagtgtgggatgttaacttctggaccgaagcaaacgtcaaaattagactcgagcaaaaacaatcggaaaaggtccaagaaagctgcaaatattgaagacaaaggcagtcaaaagaaacagaaggtaaatgatgttcctcaagttcccataaaaaatagtgacaatgatcaagccagagtacgcattgggtcagcagaaaagattgtgccagaaaaaactcccaaaaaagatgtcaaacggcaaaaggcatcatcgcggcataaatgcaagtttgacgacaatgatcttctggtgacagctgtcatacataagttaactgcacgctacaggaatcgttttagccgaaggctcgccaagaaatctggtttcaaacgtctacctagatgtcgctggaagagtgaagagagacgtgacaggaagacgtttcctaaaggagcaagaacagtgttgggaaagttgcttgaaatgggcattgtttgtaaagtaaatattcttcaatatcgaagaccaggaagcaaaaatgtattaaaggatggaaacattacaaagaagggcattagatgccgatgctgtgatatggtgtttacaatgtccatgtttaagtaccatgcaggtctgcggcaagaaattccctctctgaatcttttcttgggttctggcaaatcatacactctttgccagcttcaagcatggtctattgaacataaggccaggaaagaacgtgcaaaatgtactatgccactccaagctgatgaaaatgatgatacttgtggattatgtggtgatggcggtgaactgatatgctgcgacaactgtcctgctagttaccatcaggactgcttgccttgtcaggatattccagatggcagctggtattgctatagatgcctttgcgatatatgtggggaagtgataaatttgaaggagctcagaagttccctgcctgctttagaatgcgcacagtgtgaacgccaatatcatgcaaaatgcatatatggtaaacttttgtgcaacgaggaaggtggaccttgtgcctggttttgtggaagaagatgccagcagatttatatgaatttgcgatctcgtgttgggatccccattcacacaattgatggcttctcttgcactgttctccggaacaacggtgatcaacgggtctctacagctgcagatattgcaatcctcgctgagtgcaacatgaaattagtgattgccttgagtataatggaagaatgcttcttacctataatagacgcacgaacaggaatagatattatcccacctatactatataattggaggtctgactttgttcatttggattacaaggggttctatactgtagtattggaaaatgatgacaggatcatttctgtggcatccatcaggttacatggtacagttgtggcggagatgcctctaatagctacttgccttgagaatcgtcaacaagggatgtgcaggcgtctcatggattacattgaacagatgctgaaatctctgaaggtagagatgcttcttctatccgcgatacctagcctagtcgacacatggacgatggcgttcgggttcgtaccgatagacgacctcgacaggaagaatctcagcaggctgaggctggtgtcggtcccggggaccgttctactgaagaggaacctgtacgagtgtccgggcaccaatgcggcgggtggtggtggtggtggtggtggtagcaaggagaatctcgcgttcgtcgatcggtcggtggcggtgacggctgcggatgctggacagcagaggccgtttgaggatcgctcgccggtttcttgtgcagtggacagcctcgccgacgagctgcggagtttgaagatcaattcgtcctgtgaaaatcgtcgtcgtcttggcaaaactactgtaaattcagctagtaccttgtctgctgcttgcagaattcaaggcctagagcgtcttcaagctccatccattgagaaggcctggcgttctctacgcaacactcaggttgcacggaagaattatttaagacctggtttatctggaaaagtgaaagattgtgatagcgaccatgctcatacttatgggacaagttcttcatataatgttaacaaaatggacagtgtgtccagaaataggaatcccacccaggaaagtatgcatcagacgactgaaagtggtactatggagaagaacagtagccatctgcctgcaggcaccaagtcctgtacaaggacttacctgaacaatcatgtggtgcaggcagataccattacaacaacaaatcaaagtcttgcaagaactggtcctgaattattcaagactgctccttttattgacaacatgtgtgatgatgctaaattagatgccatggatgaggatgagcttctagcgagtattgatgtggaccgaatagtcatggaacattatcaagcaacaaatacacccagagggtcatccaaatctccattagagaagtgcaacttcaatggatttgatgagaataatttaccacaagaactctctataatgtgtgaccacggtagcaagctagctttttgcccagaggcgaagtctcatttgcttgaaatgaaggataacttgcttgcaatatcccatgagcttattgacggtcaactcagccctcaacaatctgatgatcttcatcaaaagagagcactcctaaagaagcagattgagctgcttggggagtatacggcgaggttaacccaagatgaagagcgacagcaatctcattctatggcctccacaacagctcatcagggccatcaccccactagcatcctaagtagctcttttgtaaaggataccaatatattccaatcaccgatttacaccaggaatgaacctggggaaagtggtttatgcttttcttctgctccatattcctatatggatggtttaagcatgccattaccgtctgttcagagagattacactccaagggctattgatatcagttacactgaaggttctggtgataaacagtggagtagtacacactttgcatggactaaggaactcgaggccaacaacaaaagagtatttggaaaccgttcttttcgcccaaatcaacgagaaataatcaacgccacaatgagtgggaatgatgtttttgttttgatgccaactggtggtggaaaaagtttgacatatcagcttccagcactcatttgtaatggcgttacattggtagtttctcctctcgtatcgctcatccaagaccagatcatgcatttattgcaggcaaatatttctgcagcttaccttagcgccagcatggagtggtcagaacagcaggagatattaagagaattaatgtctcctacatgcacgtacaagttactgtatgttacgcctgaaaagatagccaagagtgatgctctgttgagacaattggaaaatttatattcgcgaggccatctctctagaattgtcattgatgaagcccactgtgttagccagtggggtcatgatttccgacctgattaccagttctttatccatcagcatctaggcattttaaaacagaagttcccgcagacgccagtcctggccttgactgcaacagcaactgcaagtgtcaaggaagatgtcgtgcaagttctaggccttgcaaactgcattattttcagacaaagttttaatcgtccaaatctgaggtattttgtatggcccaagacaaagaagtgcctcgaggatatccataactttatacatgcaaatcataataaagaatgcggcatcatatattgcctttcgaggatggattgtgagaaagtggctgctaaattaagggaatatgggcacacggcatcacattatcatggtagcatggatcctgaggatagagcaaatatccagaaacagtggagcaaggataggatcaacataatatgtgctacagttgcatttgggatgggtattaataaacctgatgtccgttttgttatccatcattccctgcccaaatcaattgaaggatatcatcaggagtgtggacgtgctggtcgtgacagtcagctttcaacttgtgtcctgttctacaattattctgattatattcgtctcaaacacatggttacccaaggatttgcggagcaaggaacatcagcaccacgaggaggttcttcgcaggaacaagcgcttgaaacgcataaggaaaatctcctgcgaatggttagttactgcgaaaatgatgtggactgcagacgtctactacagctgatccactttggagagatgtttaatccttcatgttgtgcaaaaacatgtgataattgcttgaaagagttgagatgggtcgaaaaagatgtgaccaacattgctagacaattggttgatctggtaatgatgacaaagcaaacatattcaactactcatattctcgaagtatacagaggttcagtaaaccaaaatgtcaagaagcaccgccatgatactttgagtcttcatggagctggaaagcatctagctaaaggtgaagcagcgagaatattgcgccatctagtaattgaggaaatactcattgaggatgtcaaaaagagcgaaaactatggatctgtatcatctgtcttaaagactaatcataagaaaagtggtgatcttctctctggcaagcacaacgttgtcctcaagttccccactcctgagaaggctcctaagatgggtgtactcgatgaatcgtcagttccacgaattaataagactaatcaacagagtcaagtggacgggagccttgcagccgagctttatgaagctttgcaatgccttaggactcagataatggatgaaaatccacaattattggcataccacatatttaaaaacgagacattgaaggaaatcagcaaccgaatgccaagaacgaaagaggaacttgtggagataaatggcatcggcaagaacaagctgaacaagtacggggaccgtgtgcttgcaaccatagaggatttcctcgccagatatccaaatgcgaccaggaaaaccagcagcggcggcagcaacgagcacagcgaggcggtcaagaagcgaagaggcttctccgtcaccaacacctctaccaactgtgacgactttgaggaacgcacggtccagtccaagaaacgcgctgcaaagacacgtacaaggcaggaaatatctgatgctgccagcatcgtccaggacgtccgctacatagatcttgagctagatggttgtgaacaagtcaatgaagtgccatacagtgtacaaaagcctgtggcttctggtagggttttacctgcgtggcagtccgccagaatagcctagggttaacaccccctagtagtttctaatttatgtgaagaatttatatgcattaagtaggatcctaggctaaccccattgagctttatgtaggccttgggccaactacttgtaagatggcaccaaccagaccacatgttaggttgcttctgaacatatatggtagtagtccttttcagtatagttcccgtagcgcatgtaactaacatgatattactatggcaaattttgatgtcaacagcttcaggaagtggacatcgaaaggtcctagtactgctgtaagttgattatttatagatgagccttacgcttgtttttttattctgatgttgatgagagccttgtacaatgtactgtggcctgtgggcttgattctattgccatcttcgaccattgagccgaaaaacgaattacgatttgtttgtggtcaagtagaagcgttgccttatttgtttgttcactcagtagcactatttgtctctgaatcttgaagcatgctgcatcatcatgagaccagacgtgggtacatacatttctagctccacctttcagtttgagcgctgacgtcacggatgaccc

SEQ ID NO: 10367 - DNA, 3509 bp, Trigonella foenum-graecum
atataataagcaagagaggggagagagagtggtagttcgagtgtgagaatcaatgtcgaaccctcaaaacgcgaagccatggaaagcagaatacgcaaagtcaggtcgttcatcatgcagaacctgcaaaagccccattgccacggagaagcttcgtctcggcaaaatggttcaatcctccaaattcgatggcctcatgcccatgtggaatcatgctgagtgcatattgaagaaagcaaaccagataaaattagttgatgatgttgaaaacttagagtcgcttcgttgggaagatcagcagaagattaggaaatacattgagagtggtggtggtggtggtggtggtggcacaccgaagtcgaatgctggttcaaagtcgaatgccgcctcaaggttgagtgctggaaaaatgttgaatatggtattgaagtttcgcaaacttcacgtgctgcttgcaagcattgtggtcaaaaaattatcaaaggagaggttcgcatatctactaagcctgagggtcaaggtcccaggggtttggcttggcaccatgccaaatgtctcttggaactatctccatcaattcaagtggataatttgcctggatggaatagtctctcatcttctgatcaattggctgtcagtgagttggctatgaaagacaatcctacaaataaaggaggtggtagtggtgcaaatgtcaagactgaagatgttaaagaatccacacaacaatcctcttccaaaggtggcacaaaacgggggaaagatgcagagggtgagcagaagtcaaaggctgctaaagtcaagggagatgtgtctgtgagcagggtagtggcagtgaaaaatgctgatgactccggggaggcacgtgatcttgagaatagactggaggcccagagcaaagatctctgggctctgaaggatgatcttaaaaagcatgtgacaacagcagagatgcgtgaaatgctggatgccaatggtcaagattcaacaggatcagagcttgatttgcgtgaccgctgtgctgatggaatgatgtttggaggacttagtccttgctcactatgttctggttttctgcgttattctggaggaatgtaccggtgcactggatacatttctgagtggagtaaatgttcctactctacctgcgaaccaaagcgtgctgaagggaagtggaaaatcccaaaggaaacagataatcagtaccttaaaaagtggttcaaatctcaaaaagggaagaaaccaactaggatattgcctccgccatcatcaaggacttctgctgaaagtcaaatttctgcaggccagcaccaatcatcaaacagtgaaactttggctgatttgaaagttgccatctcggggttgcctgaagattccattaaggaatggaaacataaaattgatgccataggtggagtgcttcatgcaaaagtgaagaaagatactaactgcttggtggtcagtggagcgcttaaggatgaagttgagatgcggaaggcaaggaggatgaaaataccgatagtcagagaggactatttggttgactgtatggaaagaaagaagaagcttccatttgatatgtacaaagttgaaatgattggtgaggcttctagcatggtcaccatcaaagtgaaggggcaaagtgctgttcatgatgcttctggcctacaggattctggccacatactagaggaagggaaaagcatatataatacaactttgaatatgtctgatttgtctactggtattaacagctactacatcctgcaaataattgaagaagataatgggtcagattgctacgtgtttcgcaaatggggtcgagtgggaaacgacaagattggagggaacaaactggaggaaatgtcgaaatcggatgcaatcagggaattcaaacgactattctctgagaaaactggaaacccttgggaggcctgggaacaaaagactattcagaagcaacctggaagattcttccccttggaaattgattatggagttaacaaacaagttgcgaaaaagagtagaaacaatgcagacagcaaattaccccctccattaatagaattgatcaagatgctctttaatgtggaaacatacagatccgccatgatggaatttgagatcaatatgtccgaaatgccactcgggaaactgagcaaaagtaatatccaaaagggttttgaagcattaacagatatacaaaatctttttaaaagcagcaatgctgatccatcagtcagggatagcttgcttattgatgctagcaataggttcttcactgtgatcccttccattcatccacatattatcagggatgaggatgattttaagtcaaaggtgaaaatgttggaagcccttcaagacattgaaattgcctcaaggttagtgggatttgatgccaacaacgatgactccattgatgataattataagaagctccactgtgatatatctccacttcctcatgatagtgaagattttagattagttgagaagtttctacaaaatactcatgcccccacacatacggactggagtcttgagctagaagaagttttttcacttgaaagggaaggtgaatttgataagtatgctccttacagggacaaagttggtaacagaatgctcctatggcatggttctaggttgacgaactttgtgggcattcttaaccaaggactcagaattgcacctcccgaagcccctgcaactggctacatgtttggcaaagggatttactttgctgaccttgtcagcaagagtgctcagtattgcttcactgataaaaaaaatcctgttggtctaatgcttttgagtgaagttgcccttggaaatgtgtatgagctcaaaaaagccaagtatatcgataagcctccgcaaggaaaacattcaactaaaggactgggcaagaaaatgccccttgaatcagaatatgtgaagtggagaggtgacgtcgttgttccttgtgggaaaccagtgccatcaaatgtcaaggcatctgagctcatgtacaatgagtttattgtctacaatacctctcaagttaaactgcaattcttgttgaaggtgaggttccatcacaagaaatgaggttggaaactagaggtgtgctgttttggggtatcatctgtacgaagcagttttttgacaaggacttgtacatagtccatgtgggtttctcgtaacttctcttgataaggtctcatttcgagttgaacggagatctttcaccttttttttggggtgtgtttgttagtgcaaggatgtagttgaaactcttcatgtagagcagaaatctcatgcatgatctggttatgtgtatatagaactgccagtttaacatcaaacttcatgttatcaagttcttcactttgaatttgtgttgcatcactactcttaagtgcttttaccttctaaaagcttcttatattaccccaacatgtattcattttaagcagcattggtaggttgtttcactttttgtttgaggtaattattatgatctt

SEQ ID NO: 10368 - DNA, 3243 bp, Glycine max
cacgtttgtgaacccagctcatccaacctcttaacaaattcgcatggtttcgtacccacacaactgaactcacacaaacttctccaccacaccgacaacctcgccggaaaattcctcgccgtttccggttaccggcgatggcctcggcgacgtcgtttttgggcctcggtcttcgcccctccgtcccaatttgcgccaacagaaacaacggcattcgattctctcagtttcaagtctcctttggctttcgtgagaactccacttccctcaagactttgaattcaacaccgttgaagaaaagagaagctttctcaaatgggtcttcgagaacgcgaagaaacccgttgttctctgttcgctgcacagtttcatcaagtggaaagattacacaacaggaattcacggaaatggcatggcaagcaattatctcggcaccagaagtggctaaggagaacaagcatcagattgtggagactgagcacttgatgaaagcattgttggagcaaaagaatggacttgctcgccggatcttttctaaggttggggtagataatactcggcttctagaggccactgataagcacattcagcggcaacccaaggttgtaggggaatctgctggttcaatgctagggcgtgatttggaggcattgattcagagagccagggacttcaagaaagaatatggggactcatttgtgtcggttgagcactttgttcttggttttgcccaagataaacgatttgggaagatattgtttagagattttcaaatatctcagcaagctctaaaatctgccatagaatccataaggggacgccagtcagttattgaccaagatcctgaaggaaagtatgaagccttggaaaagtatgggaaagatttgacggcaatggctaaagcaggaaaacttgacccagtcataggaagagatgatgaaatacgcaggtgcattcagattctctccaggaggacaaagaacaatcctgttctaattggggagcctggtgttggaaagactgcaatctctgaaggacttgctcaaagaattgttcaaggagatgttcctcaagctttgatgaatcgaaggcttatatcccttgatatgggtgcacttattgctggagcaaagtaccggggagaatttgaggatagactgaaagctgttctgaaagaagtaacagaatctgatggtcagactatccttttcattgatgaaatccatacagttgttggggcaggtgcttcaaatggtgctatggatgctggtaatctcttaaaacctatgcttggtcggggggagctgcgatgtattggtgcaacaacattagatgagtatcgaaagtatattgagaaggaccctgcacttgagcgtcgtttccagcaagtttatgttgaccaaccttcagttgaggataccatttcaatactaaggggactgcgggaaagatatgagctgcatcatggagttcgcatttctgacagtgctcttgtggatgctgcaattctctcagatcgatacataagtgggaggtttttgcctgataaagctattgatctggttgatgaagcagctgctaaactaaaaatggaaattacttcaaaacccactgcacttgatgagattaatcggtcagtcttgaaactcgagatggagagactctctctgatgaatgatacagacaaggcttctaaagatagattaaatcgtcttgagaccgaactctctctcttaaaagagaaacaggacgaattgactggacagtgggagcatgaaaagtctgtaatgactaatctgcaatcgattaaagaggagatagacagggtaaatcttgagattcaacaggctgagcgagagtatgatcttaatcgcgctgctgaattgaagtatggtagtctaaactccttgcaacgccaacttgaaagtgcagagaaagaattgcatgaatatatgaactctggtaagtctatgttaagagaggaagttactggaaatgacattgctgatattgtaagcaagtggactggtatccccatttcaaaacttcaacaatcagatagagagaagttgttgtatctagaggaagagctccacaagcgtgttgtcggtcaagatcctgctgtcaaggcagtagctgaggctatccaacgttcaagagcaggtctttcagatccccatcgcccaatcgctagcttcatgtttatgggaccaacgggtgtaggaaagaccgagctagccaaggcccttgcttcatatttgttcaacacagaagaagcacttgtacgaattgatatgagtgagtacatggaaaagcatacggtttcaagattgattggggctccacctggatatgttgggtatgaagagggagggcaactaacagagacagttcgtcgccgaccatatgctgtcattttgtttgatgagattgagaaggcacactcagatgttttcaatgtattccttcaaatcttggatgatggaagggtaactgattcacagggccgaaccgtaagttttaccaacacagttatcattatgacctcaaatgttggatcacagtacattctcaacacagatgatgacactgtgcccaaagagtctgcatatgaaactataaagcagcgggtaatggacgctgcaagatccatctttcgccctgagttcatgaatagagttgatgaatatattgttttccagcctctagaccgcaaccaaataagtagtattgtcaggttacagttggagcgtgtgcagaagagaattgcagatcgtaagatgaaaatccaagttacagaagctgcaatccaacttcttggtagtttggggtatgatccaaactacggtgctaggccagtcaagcgagttattcagcaaaacgtggagaatgaacttgctaagggtattcttagaggagagttcaaggaagaagacacaattttagtagacacagaagtcacggtatttgccaatggtcaacttccccaacaaaagctagtttttaggagggttgaagctgattccaattctactgttgaagacagaagggaaggctttccacagattctgtgaacgcacgttactgctccttatttctccacatgctaggtttcacaacaaattttgagtataggtcgttttcttacactaatgcaactctgatcttgttcatagcatgatatagtttatagttcttcacacaataacttttattggtcaatacaaataccatgcttaagaa

SEQ ID NO: 10369 - DNA, 3328 bp, Glycine max
gaaccacgtttgtgaacccagctcatccaacctcttaacaaattcgcatggtttcgtacccacacaactgaactcacacaaacttctccaccacaccgacaacctcgccggaaaattcctcgccgtttccggttaccggcgatggcctcggcgacgtcgtttttgggcctcggtcttcgcccctccgtcccaatttgcgccaacagaaacaacggcattcgattctctcagtttcaagtctcctttggctttcgtgagaactccacttccctcaagactttgaattcaacaccgttgaagaaaagagaagctttctcaaatgggtcttcgagaacgcgaagaaacccgttgttctctgttcgctgcacagtttcatcaagtggaaagattacacaacaggaattcacggaaatggcatggcaagcaattatctcggcaccagaagtggctaaggagaacaagcatcagattgtggagactgagcacttgatgaaagcattgttggagcaaaagaatggacttgctcgccggatcttttctaaggttggggtagataatactcggcttctagaggccactgataagcacattcagcggcaacccaaggttgtaggggaatctgctggttcaatgctagggcgtgatttggaggcattgattcagagagccagggacttcaagaaagaatatggggactcatttgtgtcggttgagcactttgttcttggttttgcccaagataaacgatttgggaagatattgtttagagattttcaaatatctcagcaagctctaaaatctgccatagaatccataaggggacgccagtcagttattgaccaagatcctgaaggaaagtatgaagccttggaaaagtatgggaaagatttgacggcaatggctaaagcaggaaaacttgacccagtcataggaagagatgatgaaatacgcaggtgcattcagattctctccaggaggacaaagaacaatcctgttctaattggggagcctggtgttggaaagactgcaatctctgaaggacttgctcaaagaattgttcaaggagatgttcctcaagctttgatgaatcgaaggcttatatcccttgatatgggtgcacttattgctggagcaaagtaccggggagaatttgaggatagactgaaagctgttctgaaagaagtaacagaatctgatggtcagactatccttttcattgatgaaatccatacagttgttggggcaggtgcttcaaatggtgctatggatgctggtaatctcttaaaacctatgcttggtcggggggagctgcgatgtattggtgcaacaacattagatgagtatcgaaagtatattgagaaggaccctgcacttgagcgtcgtttccagcaagtttatgttgaccaaccttcagttgaggataccatttcaatactaaggggactgcgggaaagatatgagctgcatcatggagttcgcatttctgacagtgctcttgtggatgctgcaattctctcagatcgatacataagtgggaggtttttgcctgataaagctattgatctggttgatgaagcagctgctaaactaaaaatggaaattacttcaaaacccactgcacttgatgagattaatcggtcagtcttgaaactcgagatggagagactctctctgatgaatgatacagacaaggcttctaaagatagattaaatcgtcttgagaccgaactctctctcttaaaagagaaacaggacgaattgactggacagtgggagcatgaaaagtctgtaatgactaatctgcaatcgattaaagaggagatagacagggtaaatcttgagattcaacaggctgagcgagagtatgatcttaatcgcgctgctgaattgaagtatggtagtctaaactccttgcaacgccaacttgaaagtgcagagaaagaattgcatgaatatatgaactctggtaagtctatgttaagagaggaagttactggaaatgacattgctgatattgtaagcaagtggactggtatccccatttcaaaacttcaacaatcagatagagagaagttgttgtatctagaggaagagctccacaagcgtgttgtcggtcaagatcctgctgtcaaggcagtagctgaggctatccaacgttcaagagcaggtctttcagatccccatcgcccaatcgctagcttcatgtttatgggaccaacgggtgtaggaaagaccgagctagccaaggcccttgcttcatatttgttcaacacagaagaagcacttgtacgaattgatatgagtgagtacatggaaaagcatacggtttcaagattgattggggctccacctggatatgttgggtatgaagagggagggcaactaacagagacagttcgtcgccgaccatatgctgtcattttgtttgatgagattgagaaggcacactcagatgttttcaatgtattccttcaaatcttggatgatggaagggtaactgattcacagggccgaaccgtaagttttaccaacacagttatcattatgacctcaaatgttggatcacagtacattctcaacacagatgatgacactgtgcccaaagagtctgcatatgaaactataaagcagcgggtaatggacgctgcaagatccatctttcgccctgagttcatgaatagagttgatgaatatattgttttccagcctctagaccgcaaccaaataagtagtattgtcaggttacagttggagcgtgtgcagaagagaattgcagatcgtaagatgaaaatccaagttacagaagctgcaatccaacttcttggtagtttggggtatgatccaaactacggtgctaggccagtcaagcgagttattcagcaaaacgtggagaatgaacttgctaagggtattcttagaggagagttcaaggaagaagacacaattttagtagacacagaagtcacggtatttgccaatggtcaacttccccaacaaaagctagtttttaggagggttgaagctgattccaattctactgttgaagacagaagggaaggctttccacagattctgtgaacgcacgttactgctccttatttctccacatgctaggtttcacaacaaattttgagtataggtcgttttcttacactaatgcaactctgatcttgttcatagcatgatatagtttatagttcttcacacaataacttttattggtcaatacaaataccatgcttaagaagtgttggtgtggttcatttcttcaattaacaaattatcatagttgtagtgtgtgtggtcggtccatggtgtggttcctaac

SEQ ID NO: 10370 - DNA, 3482 bp, Glycine max
acatataaactgaaccacgttggtgaacccagcgcatccaacctcttaacacattcgcatgcttccgtactgaactcacacaaccttctccacaacaccaacaacctcgccggaaaatcctcgccgtttccggttaccggcgatggcctcggcgacgtcgttttcgggccccacccttcgcccctccgttccaatttgcgcccacagaaacaacgacactcgattctctcagcttcgagtctcctttaactttcccgcgaaccccacttccctgaagggtttgaattcgacaccgttgaagaaaagagaagctttctcaaatgggtcttcgagaacgcgaagaaacccattgttctttgtccgctgcacagtttcatcaagtggaaagattacacaacaggaattcacggaaatggcatggcaagcaattatctcagcaccagaagtagctaaggagaacaagcatcagattgtggagactgagcacttgatgaaagctttgttagagcaaaagaatggacttgctcgccggatcttttctaaggttggggtagataatactcggcttctggagactactgataagcacattcagcggcaacccaaggttgtaggggaatccactggttcaatgttggggcgtgatttggaggcattgattcagagagccagggacttcaagaaagaatatggagactcatttgtgtcagttgagcactttgttcttggttttgcccaagataaacgatttgggaagatattgtttagagattttcaaatatctcagcaagcactaaaatctgccatagagtccataaggggacgccagtcagttattgaccaagatcctgaaggaaaatatgaagccttggaaaagtatgggaaagatttgacagcaatggctaaagcaggaaaacttgacccagtcataggaagagatgacgaaatacgcaggtgcattcagattctctccaggagaacaaagaacaatcctgtgctaattggggagcctggtgttggaaagactgcaatctctgaaggacttgctcaaagaattgttcaaggagatgttcctcaagctttgatgaatcgaaggcttatatcccttgatatgggtgcacttattgctggagcaaagtaccggggagaatttgaggatagactgaaagctgttctgaaagaagtaacagaatctgatggtcagactatccttttcattgatgaaatccatacagttgtcggggcaggtgcttcaaatggtgctatggatgctggtaatctcttaaaacctatgcttggtcggggggagctgcgatgtattggtgcaacaacattagatgagtatcgaaagtatattgagaaggaccctgcacttgagcgtcgtttccagcaagtttatgttgaccaaccttctgttgaggataccatttcaatactaaggggactgcgggaaagatatgagctgcatcacggagttcgcatttctgacagtgcacttgtggatgctgcaattctctcagatcgatacataagtgggaggtttttgcctgataaagccattgatctggttgatgaagcagctgctaaactaaaaatggaaattacttcaaaacctactgcacttgatgagattaatcggtcagtcctgaaactcgagatggagagactctctctcatgaatgatacagacaaggcttctaaagatagattaaatcgtcttgagacagaactctctctcttaaaagagaaacaggatgaattgactggacagtgggagcatgaaaagtctgtaatgactaatctgcagtcgattaaagaggagatagacagggtaaatcttgagattcaacaggctgagcgagagtatgatcttaatcgtgctgctgaattgaagtatggtagtctaaactccttgcaacgccaacttgaaagtgcagagaaagaattgcatgaatatatgaactctggtaagtctatgttaagagaggaagttactggaaatgacattgctgaaattgtaagcaagtggactggtatccccatttctaaacttcaacaatcagatagagagaagttgttgtatctagaggaagagctccataagcgtgttgtcggtcaagatcctgctgtcaaggcagtagctgaggctatccaacgttcaagagcaggtctttcagatccccatcgcccaatcgctagcttcatgtttatgggaccaacgggtgtaggaaagaccgagctagccaaggcccttgcttcatatttgttcaacacagaagaagcacttgtacggattgatatgagtgagtacatggaaaagcatacggtttcaagattgattggggctccacctggatatgttgggtatgaagaaggagggcaactaacagagaccgttcgtcgccgaccatatgctgtcattttgtttgatgagattgagaaggcacactcagatgttttcaatgtattccttcaaatcttggatgatggaagggtaactgattcacagggtcggaccgtaagttttaccaacacagttatcattatgacctcaaatgttggatctcagtacattctcaatacagatgatgacactgtgcccaaagagtccacatatgaagctataaaacagcgggtaatggacgctgcaagatccatctttcgcccagagttcatgaatagagttgatgagtatattgttttccagcctctagaccgcgaccaaataagtagtattgtcaggttacagttggagcgtgtgcagaagagaattgtggatcgtaagatgaaaatccaagttacagaagctgccatccaacttcttggaagtttggggtatgatccaaactacggtgctaggccagtcaagcgagtgattcagcaaaacgtggagaatgaacttgccaagggtattcttagaggagagttcaaggaagaagacacaattttagtagacacagaagtcacagtacttgccaatggtcaaattccccaacaaaagctagtttttaggagggttgaagctgattccagttctgctgctgaagacagacgggaaggctttccacagattctgtgaacgcacttcactgctcctcgtttctccacatgttaggtttcacaacaaattttgagtatagggcctataggacactagtattctatggagagctaagaaaaatatcttcaattgtgtcacaaataagcttggggtatttctgccatttcgagggtcaaattcggcttgaaagtgagaattgggatgtgaatttggattttgttttgtgtaattagtttaattaggtagattagataagcctaatcaaggctaatccctttcttttgagtagtcactatattttagtggaagttagttagttagtttattttttgtaaagaatagatttagttacttgttgtgtaagctttagaatcaaattcttttttctctttattttctcaactgttcttcctttctcttg

SEQ ID NO: 10371 - DNA, 3377 bp, Glycine max
cacgttggtgaacccagcgcatccaacctcttaataaattcgcatgcttccgtactgaactcacacaaccttctccacaacaccaacaacctcgccggaaaatcctcgccgtttccggttaccggcgatggcctcggcgacgtcgttttcgggccccacccttcgcccctccgttccaatttgcgcccacagaaacaacgacactcgattctctcagcttcgagtctcctttaactttcccgcgaaccccacttccctgaagggtttgaattcgacaccgttgaagaaaagagaagctttctcaaatgggtcttcgagaacgcgaagaaacccattgttctttgtccgctgcacagtttcatcaagtggaaagattacacaacaggaattcacggaaatggcatggcaagcaattatctcagcaccagaagtagctaaggagaacaagcatcagattgtggagactgagcacttgatgaaagctttgttagagcaaaagaatggacttgctcgccggatcttttctaaggttggggtagataatactcggcttctggagactactgataagcacattcagcggcaacccaaggttgtaggggaatccactggttcaatgttggggcgtgatttggaggcattgattcagagagccagggacttcaagaaagaatatggagactcatttgtgtcagttgagcactttgttcttggttttgcccaagataaacgatttgggaagatattgtttagagattttcaaatatctcagcaagcactaaaatctgccatagagtccataaggggacgccagttagttattgaccaagatcctgaaggaaaatatgaagccttggaaaagtatgggaaagatttgacagcaatggctaaagcaggaaaacttgacccagtcataggaagagatgacgaaatacgcaggtgcattcagattctctccaggagaacaaagaacaatcctgtgctaattggggagcctggtgttggaaagactgcaatctctgaaggacttgctcaaagaattgttcaaggagatgttcctcaagctttgatgaatcgaaggcttatatcccttgatatgggtgcacttattgctggagcaaagtaccggggagaatttgaggatagactgaaagctgttctgaaagaagtaacagaatctgatggtcagactatccttttcattgatgaaatccatacagttgtcggggcaggtgcttcaaatggtgctatggatgctggtaatctcttaaaacctatgcttggtcggggggagctgcgatgtattggtgcaacaacattagatgagtatcgaaagtatattgagaaggaccctgcacttgagcgtcgtttccagcaagtttatgttgaccaaccttctgttgaggataccatttcaatactaaggggactgcgggaaagatatgagctgcatcacggagttcgcatttctgacagtgcacttgtggatgctgcaattctctcagatcgatacataagtgggaggtttttgcctgataaagccattgatctggttgatgaagcagctgctaaactaaaaatggaaattacttcaaaacctactgcacttgatgagattaatcggtcagtcctgaaactcgagatggagagactctctctcatgaatgatacagacaaggcttctaaagatagattaaatcgtcttgagacagaactctctctcttaaaagagaaacaggatgaattgactggacagtgggagcatgaaaagtctgtaatgactaatctgcagtcgattaaagaggagatagacagggtaaatcttgagattcaacaggctgagcgagagtatgatcttaatcgtgctgctgaattgaagtatggtagtctaaactccttgcaacgccaacttgaaagtgcagagaaagaattgcatgaatatatgaactctggtaagtctatgttaagagaggaagttactggaaatgacattgctgaaattgtaagcaagtggactggtatccccatttctaaacttcaacaatcagatagagagaagttgttgtatctagaggaagagctccataagcgtgttgtcggtcaagatcctgctgtcaaggcagtagctgaggctatccaacgttcaagagcaggtctttcagatccccatcgcccaatcgctagcttcatgtttatgggaccaacgggtgtaggaaagaccgagctagccaaggcccttgcttcatatttgttcaacacagaagaagcacttgtacggattgatatgagtgagtacatggaaaagcatacggtttcaagattgattggggctccacctggatatgttgggtatgaagaaggagggcaactaacagagaccgttcgtcgccgaccatatgctgtcattttgtttgatgagattgagaaggcacactcagatgttttcaatgtattccttcaaatcttggatgatggaagggtaactgattcacagggtcggaccgtaagttttaccaacacagttatcattatgacctcaaatgttggatctcagtacattctcaatacagatgatgacactgtgcccaaagagtccacatatgaagctataaaacagcgggtaatggacgctgcaagatccatctttcgcccagagttcatgaatagagttgatgagtatattgttttccagcctctagaccgcgaccaaataagtagtattgtcaggttacagttggagcgtgtgcagaagagaattgtggatcgtaagatgaaaatccaagttacagaagctgccatccaacttcttggaagtttggggtatgatccaaactacggtgctaggccagtcaagcgagtgattcagcaaaacgtggagaatgaacttgccaagggtattcttagaggagagttcaaggaagaagacacaattttagtagacacagaagtcacagtacttgccaatggtcaaattccccaacaaaagctagtttttaggagggttgaagctgattccagttctgctgctgaagacagacgggaaggctttccacagattctgtgaacgcacttcactgctcctcgtttctccacatgttaggtttcacaacaaattttgagtatagggcctataggacactagtattctatggagagctaagaaaaatatcttcaattgtgtcacaaataagcttggggtatttctgccatttcgagggtcaaattcggcttgaaagtgagaattgggatgtgaatttggattttgttttgtgtaattagtttaattaggtagattagataagcctaatcaaggctaatccctttcttttgagtagtcactatattttagtggaagttagttagttagtttatttttt

SEQ ID NO: 10372 - DNA, 3396 bp, Cajanus cajan
ttccgctctccggcgatggcctctgcgacgtcgttttcgggcctagctcttcgccacaccgctccaactcgcgcccgcagaaaccacgcccgattcgcgccgtttcaagtatccttcagctttcccgcgaaccccacttgcgtcaagactctgaattcggttgctttgaagaaaagagaagctttctcaaatgggtcttcgagagcgcgaagaaaccctacacggttctctgttcgctgcacggcttcttcgagtggaaaggaatttacagaaatggcatggcaagcaatcatctcgtcaccagaagtggctaaagagaacaagcatcagattgtggagacggagcacttgatgaaagctttgttagagcaaaagaatggacttgctcgccggatcttttccaaggttggggtagataatactcggcttctagaggctaccgataagcacattcggcggcaacccaaggtactaggggaatcagctggttcaatgttggggcgtgatttggaggcattgattcagagagccagggacttcaagaaagaatatggagattcatttgtgtcagtagaacacttggttcttggttttgcccaagatcaacgatttgggaagatattgtttagagattttcaaatatctcaacaagctctaaaatctgccatagagtccattcggggacgccagtcagttattgatcaagatcctgaagggaagtatgaagccttggaaaagtatgggaaagatttgaccgcaatggctaaagcaggaaaacttgacccagtcataggcagagatgatgaaatacgcaggtgcattcagattctctccaggagaacaaagaacaatcctgtgctaattggggagcccggtgttggaaagactgcgatatctgaaggactcgctcaaagaattgttcaaggagatgttcctcaagctttgatgaatcgaaggcttatatcccttgatatgggtgcacttattgctggagcaaagtaccggggagaatttgaagatagactgaaagctgttctcaaagaagtaacagaatctgatggtcaaactatccttttcattgatgagatccatacagttgttggggcaggtgctacaaatggtgctttggatgctggtaatctcttaaagcctatgcttggtcggggagagctgcgatgtattggagcaacaacattagatgagtatcgcaagtatattgagaaggaccctgcacttgagcgtcgttttcagcaagtttatgttgaccaaccttcagttgaagataccatttcaatactaaggggactgagggaaagatatgagctgcatcatggagttcgcatttctgacagtgcacttgtggatgctgcaattctttcagatcgatacataagtgggaggtttctgcctgataaagctattgatctggttgatgaagcagctgctaaactaaaaatggaaattacttctaaacctactgcactcgatgagattaatcggtcagtcttgaaactcgagatggagagactctctctcgttaacgatacaggcaaggcttctaaagatagattaaatcgtctagatgcagaactctctctcttaaaagagaaacaagatgaattgactgagcaatgggagcatgaaaagtctgtaatgactcgtcttcagtcaattaaagaggagatagacagggtaaaccttgagattcaacaggcagagcgagagtatgatcttaatcgcgctgctgaattaaagtatggtagtctaaactccttgcaacgacaacttgaaagtgcagaaaaggagttacacgaatatatgaactctggtaagtcgatgttgagagaggaagttagtggaaatgatattgctgaaattgtgagtaagtggactggtatccccatttcaaaacttcaacaatcagagagagagaagctgttgtatttagaggaagagctccacaagcgtgttgtcggtcaagatcctgctgtcaaggcagtagctgaggctatccagcgttcgagagcaggtctttcggatccccatcggccgattgctagcttcatgtttatgggaccgacaggtgtaggaaagacagagctagccaaggcccttgcttcatatttgttcaatacagaagaagcacttgtacgaattgacatgagtgagtacatggaaaagctttcagtttcgagattgattggagctccacctggatatgttgggtatgaagagggagggcaactaacagagacagttcgccgcagaccatatgctgtcattttgtttgatgaaattgagaaggcacattcagatgttttcaatgtattccttcaaattctggacgatggaagagttactgattcacagggcaggaccgtaagttttaccaacactgttatcattatgacctcaaatgttggatcacaatacattctcaacacagatgatgacactgtgcccaaagagtcagcatatgaaaccataaagcagcgggtaatggatgctgcaagatcaatctttcgcccagagtttatgaatagagttgatgaatatattgttttccggcctctagaccgtgaccaaataagtagtattgtcagattacagttggatcgtgtgcagaagagaattgcagatcgtaagatgaaaatccaagtgacagaagctgctatccaacttcttggaagtttggggtatgatccaaactatggtgccaggcccgtcaagcgagtaattcagcaaaatgtggagaatgaacttgccaagggtattcttagaggagagttcaaggaagaggacataatattagtagatacagaagtcacagcattttccaatggtcaacttccccagcagaagcttgtttttaggagggttgaagctgattcagaatccagttctattaaagacagctgggaaggcttttcacagattctgtgaatgcatgtcatggctccttgtttctccacaagctaggtccgtttcacaacaaattttgagtatagatcgttttcttatactaatggtactctggtcctgttcatagcttgatgttttatagatcttcatacaataacttctattggtcaatacaaataccatgctaaagaagtgttggttttatgaaaataaacggtagtgtaattgtgtaaaggaggagctatgattttttgttcaattaataaattcatagtagcaatatatttttggtccatggatggattaggagcaaatttttggtatatatgtaatatatttaatggtaattgttatccttaatttattttaaaaattgatattagaaaaagaataactattcatgtcaagtatctaaattagaaggaaaagaaaatattctacaagaggattgtattttcaatttttcatggatta

SEQ ID NO: 10373 - DNA, 3217 bp, Medicago truncatula
caacgtggtcacatttcaacaaacacttcaccatggtttcaaactctcaataaactttcactgttcactctctcatcgccgcataattgatcggagttttcattctccgacgatggcttcaacgacgtcgttttcaagtctcatacttcatcattctgttccaattttccggaacggaaacaatgctcaattgggtccgtttcaagcttcttgtacctctcaattgaaacccacttccttgaattcgattccattgaagaaaagagaagctttttcaaatgggttttcgagaaggagaagaaattctaagcagtttattgttcggtgtacagattcaagtggaaaggtttcacagcaagaattcacagaaatggcgtggcaagcaattgtgtcatcaccagaagtggcaaaggagaacaagcatcagattgtggagacagagcacttgatgaaagctttattagagcaaaagaatgggcttgctcgccggatctttaccaaggttggggtcgataacacccggcttctggaggctaccgacaagcacattcagcgccaacccaaggttctaggggaatcggccggttcaatgttagggcgtgatttggaggcattgattcagagagccagggaattcaagaaagaatatggggattcatttgtatcagttgagcacttggttcttggttttgcccaagatcggcgatttgggaagatattgtttagagattttcaaatatctcaacaagctctaaaaactgctatagagtccgtaaggggacgccaatcagttattgatcaagatcctgaaggaaaatacgaagccttggaaaaatacggaaaagatttgacagcaatggccaaagcaggaaaattagatcctgttataggaagagatgatgaaatacgaaggtgcattcaaattctctccaggagaacaaagaacaatcctgtgctaattggtgagcctggtgtcggaaagactgcaatttctgaaggacttgctcagagaattgttcaaggagatgtccctcaagctttgatgaatcgaaggcttatatctcttgatatgggtgcacttattgctggagcaaaatatcggggagaatttgaggacaggctgaaagctgttctcagagaagttacagaatctgatggtcagactatacttttcattgatgagatccatacagttgttggggcaggtgctacaaatggtgctatggatgctggtaatctcttaaagcctatgcttggtcgaggggaactgcgatgcattggtgcaacaacattagacgagtataggaaatatattgagaaggatcctgctctagaacgccgttttcagcaagtttacgtagatcaaccttcagtggaaaataccatttcaatactaagggggctgcgggaaagatacgagttgcatcacggagttcgtatttctgacactgcacttgtggatgctgcaattctctcagatcgatacataagtgggaggtttttaccagacaaagctattgatctggttgacgaagcagccgctaaactgaaaatggaaatcacttctaagcccactgcacttgatgagattaataggtcagttttgaaactagagatggaaagactatctctcatgaatgatacagacaaggcttctaaagataggttaaaccgtcttgagacagagctctctctcctaaaagagaaacagggcgagcttaccgagcaatgggaacatgaaaagtctgtaatgactcgtcttcagtcaatcaaagaagagatagacagagtaaaccttgagatccaacaagccgagcgagagtatgatctaaatcgtgctgctgaattaaagtacggcagtttaaattctttgcaacgacaactcgagggtgcagagaaggagttacatgaatatatgagctctggtaagtctatgttgagagaggaagtaactgggaatgatattggtgaaattgtgagcaagtggactggtatcccgatttctaaacttcaacaatcagagagagagaaactattatatttagaagacgaactacataagcgtgttgtaggtcaagatcctgctgtcaaggcagttgccgaggcgatccaacgttcaagagcaggtctatcagatcctcatcgtccaattgctagcttcatgttcatgggccccacaggtgtaggtaagaccgagctagccaaggccctcgcttcctacatgttcaatacagaagaagcacttgttcggattgatatgagtgagtacatggaaaagcatacggtttcaagattgattggtgctcctcctggatacgttggatacgaagagggagggcaactaacggaaacagttcgtcgaagaccttatgcagttattttgttcgatgagattgagaaggcacactcggatgttttcaatgtattccttcaaattttggatgatggcagagtaaccgattcacaaggccgcacagtaagttttactaacactgtcatcatcatgacctcaaatgtgggatcacagtacattctcaacatggatgatgactctgtaccaaaagattcggcatatgaaaccatgaaacagcgtgtaatggatgctgcaagatccatttttcgccctgagttcatgaatagagtcgatgaatatattgttttccggcctcttgaccgtgaccaaataagtagcattgtcagattacagttggagcgtgtgcaaaagagagttgctgaccgcaagatgaaaatccgagtaacagaacctgctatccaacttcttggaagtttagggtacgatccaagctatggtgctagaccggtgaagcgagtgattcaacaaaatgtggaaaatgaacttgcaaaaggtattcttagaggagaatttaaggaagaggacacaattttaatcgacacagaagtcacggtacttgccaatggtcaacgtcctcagcaaaagctagtttttaggagggttgaagctgattcagaatctactgctaaagacagcagggaaagttttcctcagattctatgacattttaatgctttcctttaatcttccatgccaagttttacacgaattttgagaatagatcgttttgttattatagatttgaactctggttctgtgtatagcttgcatataatttatagttatttatattttactttttattagtcaatacaaattatcatacttaagaaagtactgtta

SEQ ID NO: 10374 - DNA, 3100 bp, Trifolium pratense
ttttcattctccgaggatggcttcaacgacgtcgttttcaagtctcatacttcatcactctgttccaattttccgtaacggaaacaatcctcaatcttctccgtttcaagcttcttttaactcttcattgaaacccatttcccttaagagcttaaattcacttcctttgaaaaaaagagaagatttttcaaatgggttttcgagaattcgaagaaaccctaaaaagttcactgttagttgcacaagttctagtggaaaggtttcacagcaagaattcacagaaatggcgtggcaagcgattgtgtcatcgccagaagtggcaaaggagaacaagcatcaaattgtggagacagagcacttgatgaaagctttattagagcaaaagaatgggcttgctcgccggatattttccaaggttggaattgataacactcggcttctggaggctaccgataagcacattcagcgccaaccaaaggttctaggggaatcagccggttcaatgttagggcgtgatttggaggctttgattcagagagccagggatttcaagaaagaatatggtgattcatttgtatcagttgagcacttggttcttggttttgcccaagatcgacgttttggaaaaatattgtttagagattttcaaatatctgagaaatctctaaaaactgctatagagtccgtaaggggacgccagtcagtcattgatcaagatcctgaaggaaaatatgaagcattggaaaaatatgggaaagatttgactgcgatggccaaagcaggaaaacttgaccccgtcataggaagagatgatgaaatacgcaggtgcattcaaattctctccaggagaacaaagaacaatcccgtgctaattggtgagcctggtgttggaaagactgcaatttctgaaggacttgctcagagaattgttcaaggagatgtacctcaagctttgatgaatcgaaggcttatatctcttgatatgggtgcacttattgctggagcaaaatatcgcggagagtttgaggacaggttgaaagccgttctcagagaagttacagaatctgatggtcagattatacttttcattgatgagatccatacagttgttggggcaggtgctacaaatggtgctatggatgctggtaatctcttaaagccaatgcttggtcgaggggagttgcgatgtattggtgcaacaacattagatgagtatcggaagtatattgagaaggatccggcactagaacgccgctttcagcaagtttacgttgaccaaccttcagttgaaaataccatttcaatactaagggggttgcgcgaaagatacgagttgcatcatggagttcgcatttctgacactgcactagtggatgctgcaattctctcagatcgatacataagtgggaggtttttgccagacaaagctattgatctggttgacgaagcagccgctaaactgaaaatggaaatcacttctaagcctactgcacttgatgagattaataggtcagttttgaaactagagatggagagactatctctcatgaatgatacagacaaggcttctaaagatagattaaaccgtctcgagacagagctctctctcctaaaagggaaacaagatgagctgaccgaacaatgggagcatgaaaagtctgtaatgactcgtcttcagtcaatcaaagaagagatagacagggtaaaccttgagatccaacaggccgagcgggagtatgatcttaatcgtgctgctgaattgaagtacggcagtcttaattctttgcaacggcaactcgagggtgcagagaaggaattacatgaatatatgagctctggtaagtctatgctgagagaggaagttactgggaatgatatcggtgaaattgtgagcaagtggactggtatcccaatttctaaacttcaacaatcagagagagagaagttgctatatttagaggacgaactccataagcgtcttgtaggtcaagatcctgctgtcaaggcagtagccgaggcgatccaacgttcaagagcaggtctatcagatcctcaccgcccaattgctagcttcatgttcatgggtcccactggtgtaggaaagactgagctagccaaggcccttgcttcgtacatgttcaacacagaagaagcacttgtacggattgatatgagtgagtacatggaaaagcatacggtttcaagattgatcggagctccacctggatatgttgggtacgaagagggagggcaactaacagagacagttcgtcgaagaccatatgcagttattttgttcgatgagattgagaaggcgcactcagatgttttcaatgtattccttcaaattttggatgacggaagagtaaccgattcacagggccgcacagtaagttttaccaacactgttatcatcatgacctcaaatgttggatcagcatacattctcaacacagatgatgacactacaccgaaagatttagcatatgagaccataaagcagcgggtaatggatgctgcgagatccatctttcgccccgagttcatgaatagagttgatgaatatattgttttccggcctcttgaccgtgaccaaataagcaggattgtcaggttgcagttggagcgcgtgcagaaaagaattgcagaccgcaagatgaaactccgagtaacagaagctgctatccaacttcttggaagtttagggtacgatccaaactacggtgctaggccggtgaagcgagtgattcagcaaaatgtggagaatgaacttgcaaagggtattcttagaggagattttaaggaagaggacacaattttagtagacactgaagtcacagtacttgccaatggtcaaattcctcagcaaaagctaacttttaggagggtggaagctgattcagagtcttctgctaaaaacagcagggaaagctctccacagattctatgaagggattgcaattaatgttcttttatctccacatgccaagtttacacaaattttgagaatagatcattttctttattatagaattgaactctggtcctgtgtatagcttgcatataatttatagttatttatgttttactttttattggt

SEQ ID NO: 10375 - DNA, 3525 bp, Cicer arietinum
ttacctaattaaaaattaaaataagacatttcaattcactttcattccataattaatagtgaactttaagataaattaaaatgcaataaaaaaatgaaaataaaaaataaaaaataaaaaataaaaaaatatctattaaagaagtggccacgtgtgtgaagctaggagttacttaagttagtgtactgtgcaccaagcgtagcgtaccctataacgtgttccactcttcactctcaccgcgtcggagtttccattctccgatgatgccttctacgtcgtcgttttcgactctcattctaaaccactccgttcctattttccgcaaccttaactattttcaattctctccgtttcacttctccgttgcctcttccttaaaatccaattcccttaagacgttaaattcactccccttcaagaataaagaacatttttctaatggctatttgagaattagaagaaaccctaaacaattcactgttcgctgcaccgattcaactggaaaggttacacagcaggaattcacagaaatggcatggcaagcaatcgtgtcatccccagaagtggcaaagcagaacaagcatcagattgtggagacagagcacttaatgaaagctttattagagcaaaagaatgggcttgctcgccgcatcttttccaaggctggggtcgataacacccggcttctagaagctaccgataagcacattcagcgccagcccaaggttcttggggaatcagccggtgcaatgctggggcgtgatttggaggcattgattcagagagccagggatttcaagaaagaatatggagactcatttgtatcagttgaacacttggttcttggttttgcccaagatcgacgatttgggaagatattgtttagagattttcaaatatctcagcaagctctaaaagctgctatagaatccataaggggaaaacagtcggttattgatcaagatcctgaaggaaaatatgaagccttggaaaaatatgggaaagatttgacagcgatggccaaagcaggaaaacttgaccctgttataggaagagacgatgaaatacgcaggtgcattcaaattctctccaggagaacaaagaataatcctgtgctaattggtgagcctggtgttggaaagactgcaatttctgaaggacttgctcagagaattgttcaaggagatgtccctcaagctttgatgaatcgaaggcttatatctcttgatatgggtgcacttattgctggagcaaaatatcggggagaatttgaggacaggctaaaagctgttctcaaagaagttactgaatctgatggtcagactatactattcatcgatgagatccatacggttgttggggcaggtgctacaaatggtgctatggatgctggtaatctcttaaagcctatgcttggtcgaggggagcttcgatgtattggtgcaacaacattagatgagtatcggaagtatattgagaaggatcctgcactagaacgccgctttcaacaggtttatgttgaccaaccttcagttgaaaatacgatttcaatactaaggggcctgcgggaaagatatgagttgcatcatggagttcgaatttctgacactgcacttgtggatgctgctattctctcagatcggtacataagtgggaggtttttgccagacaaagctattgatctggtcgacgaagcggctgctaaactgaaaatggaaatcacttctaagcctactgcacttgatgagattaataggtcagttttgaaactagagatggagagactatctctcatgaatgatacagacaaagcttctaaagatagattaaaccgtcttgagacagagctctctctcttaaaagagaaacaagatgagctgactcaacaatgggagcatgaaaagtccgtaatgactcgccttcagtcaatcaaagaagagatagacagggtaaaccttgagatccaacaggccgagcgggagtatgatcttaatcgtgctgctgaattaaagtatggcagtttaaactctttgcaacgacaactcgagggtgcagagaaggagttacatgaatatatgagctctggtaagtctatgttgagagaggaagttactgggaatgatattgctgaaattgtgagcaagtggactggtatcccaatctctaaacttcaacaatcagagagagagaagttgttatatttagaggacgaactccataagcgtgtggtaggtcaagatcctgctgtcaaggcagtagccgaggcgatccaacgttcgagagcaggtctttcagatcctcatcgcccaatcgcaagcttcatgttcatgggccccacaggtgtaggaaagactgagctagccaaggcccttgcttcctacttgtttaataccgaagaagcacttgtgcggattgatatgagcgagtatatggaaaagcatacggtatcaagattgatcggagctccacctggatacgttgggtacgaagagggagggcaactaacagagacagttcgtcgaagaccttatgcagttattttgttcgatgagattgagaaggcacattctgatgttttcaatgtattccttcaaattttggatgatggaagagtaaccgattcacagggccgcacgatcagttttaccaacactgttatcattatgacctcaaacgttggatcacagtacattctcaacccagatgatgacactgcaccaaaagactcagcatatgaaaccatgaagaaccgggtaatggacgctgcaagatccatttttcgccctgagttcatgaatagagttgatgagtatattgttttccgacctcttgaccgtgaccaaataagtagcattgtcaggttacagttggagcgcgtgcagaagagaattgcagaccgcaaaatgaaaatccacgtaaccgaagctgctatccaacttcttggaagtttagggtatgatccaaactacggtgctaggccagtgaagcgagtgattcagcaaaatgtggagaatgaacttgcaaagggtattcttagaggagaatttaaggatgaggacaccattttagtagacacagaagtcacgatacttgccaatggtcaaattcctcagcaaaagctagtttttaaaagggttgaagctggttcaggatctaatagtactaaagacagccgggaaggttttccacagatgctatgaagacattgattgaaaatgtttcttatatttacatgctaagtttacacaaattttgagaatagattgttttgttaatatagaattgaactctggtcctgtgtatagcttgcatataatttatagtttttcatataataataccttttattggtcaatatttatatagtacttcaaataaaagggtgcatcaatgtttgagaaccgatcaatgtttgagaaccgacgcatgtagttacgatcaattatttttatttttttaaattattattggtcaattatttttatttttttaaattattattggtgtttaagtgttggtctgtgt

SEQ ID NO: 10376 - DNA, 3181 bp, Trifolium pratense
ttttcattctccgaggatggcttcaacgacgtcgttttcaagtctcatacttcatcactctgttccaattttccgtaatggaaacaatcctcaatccgctccgtttcaagcttcctttaactcttcattgaaacccatttcccttaagagcttaaattcacttcctttgaaaaaaagagaagatttttcaaatgggttttcgagaattcgaagaaaccctaaaaagttcactgttagttgcacaagttctagtggaaaggtttcacagcaagaattcacagaaatggcgtggcaagcgattgtgtcatcaccagaagtggcaaaggagaacaagcatcaaattgttgagacagagcacttgatgaaagctttattagagcaaaagaatgggcttgctcgccggatattttccaaggttgggatcgataacactcggcttctggaggctaccgataagcacattcagcgccagcccaaggttctaggggaatcagccggttcaatgttagggcgtgatttggaggctttgattcagagagccagggatttcaagaaagaatacggtgattcatttgtatcagttgagcacttggttcttggttttgcccaagatcgacgatttggaaagatactgtttagagattttcaaatatccgagcaatctctaaaaactgctatagagtctgtaaggggacgccagtcagtcattgatcaagatcctgaaggaaaatatgaagcattggaaaaatatgggaaagatttgactgcgatggccaaagcaggaaaacttgaccccgtcataggaagagatgatgaaatacgcaggtgcattcaaattctctccaggagaacaaagaacaatcctgtgctaattggtgagcctggtgttggaaagactgcaatttctgaaggacttgctcagagaattgttcaaggagatgtacctcaagctttgatgaatcgaaggcttatatctcttgatatgggtgcacttattgctggagcaaaataccggggagaatttgaagataggctgaaagctgttcttaaagaagtaacagaatctgatggtcaaactatccttttcattgatgagattcatacagttgttggggcaggtgctacaaatggtgctatggatgctggtaatctcttaaagcctatgcttggtcgaggggagctgcggtgtattggtgcaacaacattagacgagtatcggaagtatattgagaaggatccagcactagaatgtcgctttcagcaagtttacgttgaccaaccttcagttgaaaataccatttcaatactaagagggctgcgggaaagatacgagttgcatcatggagttcgcatttctgacactgcactagtggatgctgcaattctctcagatcgatacataagtgggaggtttttgccagacaaagctattgatctggttgacgaagcagccgctaaactgaaaatggaaatcacttctaagcctactgcacttgatgagattaataggtcagttttgaaactagagatggagagactatctctcatgaatgatacagacagggcttctaaagatagattaaaccgtctcgaaacagagctctctctcctaaaagggaaacaggatgagctgacccaacaatgggagcatgaaaagtctgtaatgactcgtcttcagtctatcaaagaagagatagacagggtaaaccttgagatccaacaggccgagcgggagtatgatcttaatcgtgctgctgaattgaagtatggcagtcttaattctttgcaacgacaactcgagggtgcagagaaggagttacatgaatatatgagctctggtaagtctatgctgagagaggaagttactgggaatgatatcggtgaaattgtgagcaagtggaccggtatcccaatttctaaacttcaacaatctgagagagagaagttgttatatttagaggacgaactccataagcgtgttgtaggtcaagatcctgcggtcaaggcggtagccgaggcgatccaacgttcaagagcaggtctatcagatcctcaccgtccaattgctagcttcatgttcatgggtcccactggtgtaggaaagactgagctagccaaggcccttgcttcgtacatgctcaacacagaagaagcacttgtgcggattgatatgagtgaatacatggaaaagcatacggtttcaagattgatcggagctccacctggatatgttgggtacgaagagggtgggcaactaacagaggtagttcgtcgaagaccatatgcagttattttgtttgatgagatagagaaggcgcactcggatgttttcaatatattccttcaaattttggatgatggaagagtaaccgattcacagggccgcacagtaagttttaccaacactgttatcatcatgacctcaaatgttggatcatcatacattctcaacacagatgatgacactacaccgaaagatatagcatatgaaaccataaagcagcgggtaatggacgctgcaagatccatctttcgccccgagttcatgaatagagttgatgaatatattgttttccggcctcttgaccgtgaccaaataagcaggattgtcaggttacagttggagcgcgtgcagaaaagaattgcagaccgcaagatgaaactccgagtaacagaagctgctatccaacttcttggtagtttagggtatgatccaaactacggtgctaggccggtgaagcgagtgattcagcaaaatgtggagaatgaacttgcaaagggtattcttagaggagattttaaggaagaggacacaattttagtagacactgaagtcacagtacttgccaatggtcaaattcctcagcaaaagctaacttttaggagggtggaagctgattcagaatcttctactaaaaacaacagggaaagctctccacagattctatgaaggcattgcaattaatattcctttatctcccacatgccaagtttacacaaattttgagtatagatcattttcttattgaattgaactctggttctgtgtatagcttgcatataaatttatagttatttatgttttactttttattggtcaatagtcaatacagattatcacacttgaataaaaaagagtatgggtataaggtaacattatctttaatttcatggaaacaaa

SEQ ID NO: 10377 - DNA, 3148 bp, Lupinus angustifolius
ttcactctctcttccatggcctctacgacgtcgttttcacgtctcacttttccactttcctctcacagaaacgatgctcgattctctcactttcaatcttttcttcattttccttccaaacccacttccctaaagacactaaatacggtgccgtttaataaaagagaacctttctcaaatgggtttcatagaattcgaagaaatcccaaacaattctctgttctctgcgcaactgcttcaaacggaaagatcacacagcaggagttcacggaaatggcatggcaagcaattgtctcgtcaccagaagtggcgaaagagaacaagcatcagattgtggagacagagcacttgatgaaagctttattagagcaaaagaatgggcttgctcgccggatattttctaaggttggggtagataacactaggcttttagaggctactgataagcacattcagcggcaaccaaaggtcctaggggattcaggtggttcaatgttggggcgtgatttggaggcattgattcagagagccagggacttcaagaaagaatacggggactcatttgtgtcagttgaacacttgcttcttggttttgctgaagataaacgatttggaaaaatattgtttagagattttcaaataactcagcaagctctaaaatctgccatagagtccataaggggacgccagtcagttattgaccaagatcctgaagggaagtatgaggccttggaaaaatatggaaaagatttgacagcaatggctaaagcaggaaaacttgacccagtcataggaagagatgatgaaatacgcaggtgcattcagattctgtcaaggagaacgaagaacaaccctgtgctaatcggtgagcctggtgttggaaagacggcaatttctgaaggacttgctcagagaattgttcaaggagatgttcctcaagctttgatgaatcggaagcttatatcccttgatatgggtgcacttattgctggagcaaagtatcggggagaatttgaggatcggctgaaagctgttcttaaagaagtaacagaatctgatggtcaaactgtccttttcattgatgagatccatacagttgttggggcaggtgctactaatggtgctatggatgccggtaatctcttaaagcctatgcttggtcgaggggagctgcgatgtataggtgcaaccacactagatgagtatcggaagtatattgagaaggacccagcacttgaacgtcgtttccagcaagtatatgttgaccagcctacagttgaagataccatttcaatactaaggggactgcgagaaagatatgagctgcatcatggagtgcgcatttctgacagtgcccttgtggaagctgcaattctctctgatagatacataagtggaagatttttgcctgacaaagctattgatctggttgatgaagcagctgcgaaactgaaaatggaaattacttctaaacctactgcgcttgatgaaattaacagatcagttttgaaactagagatggagaggctctctctcatgaacgatacagacaaggcttctaaagataggctaaatcgtcttgaaacagagctctctctcttaaaaaagaaacaggatgaactaactcagcaatgggagcatgaaaagtctgtagtgacccgttttcaatcgatcaaagaagagatagacagggtgaatcttgagatcctacaggctgagcgggagtatgatcttaatcgtgctgctgaattaaaatatggcagtctaaactccttgcaaagaaaacttgaaagtgcggagaaagagttacaagaatatatgaactccggtaaatctatgctgagagaggaagttactggaagtgatattgctgagattgtaagcaagtggacaggtatccccatctcgaaacttcaagaatcggagagagagaagttgttgcatttggaggaagagctccataatcgtgtagttggtcaagatcctgctgttaaggcagtagctgaggctatccagcgttcaagagcaggtctttcagatccacatcgcccaattgctagcttcatgtttatgggacccacgggtgtaggaaagacagagctagctaaggcccttgcttcctacttgttcaataccgaagaagctcttgtgagaattgatatgagtgagtacatggaaaagcacacggtttcaagattgattggggctccacctggatatgttgggtacgaagagggagggcaactaacagagactgttcgccgcaggccatatgctgttattttgtttgatgagattgagaaagcacactcggatgttttcaatgtattccttcaagttcttgacgatggaagagtaactgattcacagggtcgcacagtaagttttaccaacaccgttatcatcatgacctcaaatgttggatcacagtacattcttaatacagatgatgatactgtgcccaaagagttagcttatgaaactataaagcagcgggtaatggatgctgcaagatccatctttcggcctgagttcatgaacagagttgatgagtacattgttttccagcctctagaccgtgaccaaataagtagcattgtgaggttacagttggagcgcgtacagacgagaatcgcgtatcgcaagatgaaaatccaagtaacagaagctgctacccaacttcttgcaaatttggggtatgatcccaactatggggctaggccagtgaagagagtgattcagcaaaatgtagagaatgaacttgccaagggtattcttagaggagactttaaggatgaggacacaattttaatagacacagaagtcacagcattctccaatggtcaacttccacagcaaaagctatcttttaggagacttgatactgactcagaatctaccaccagagacagtgagaaaagctttaaacagattttgtgaattccttttagtgcttagttcttctctagtcttgtgcacagcttccatgtaatttatagttctttaatactttttataagttaataaaatggtatgcaatatgaggtacattaatcttaatttgatggatacagcatgtgatgtaacatgtttctttatgacaatgaaatataaagcttaaagccctctaaacttgatgttgctcaaa

SEQ ID NO: 10378 - DNA, 3354 bp, Cajanus cajan
tttcaggaagttcccagaatgctctacgctcactctattccatttcccttcgctctgttcattccattaaaccctttttcttttttcctttcttttctttacccaatacccacgcaacgcaaacttctacttctctctcttctcttcccttctataattttccactctcattccttctcactcgctcttcctctcccatggcctccacgacgtcgttttccctctcgcatgctgttcccttctcctgcaccaccaacgttcctcgcttttctcaccgactctctttcacttccccaccaaaacccgtttccctcaagccccttcaatcgcttcccttcaacaaaagacaccattttgcaaatgggtttcagacaattcgaagaaattcctcgcctttcatcgttcgctgtgaagcttccagtggaaggattacgcagcaagagttcacagagatggcatggcaggcgatagtttcgtctccggaggtggccaaagagaacaagcatcagattgtggagacagagcacctgatgaaggctttgttggagcagaagaatgggcttgctcgcaggatcttttccaaggttggggtggataacactcgccttctagaagctactgataagtacattcagcggcaaccgaaggttctaggggaatcacctggttcaatgttgggacgagatttggaggcattggttcagagagctagggaccacaagaaaaagtatggggattcatttgtttcagttgagcacttggttcttgcttttacacaagatcaacgattcgggaagcaattcttcagagattttcaaatatctgagtcggctttaaaatctgcaatagagtccattaggggaaatcagtcagttattgatcaagatcctgaagggaagtatgaagccttggaaaagtatggaaaagacttgaccgcaatggcaaaagctggaaaacttgacccagtcataggaagagatgatgaaatacgcaggtgcatccaaattctttctaggaggacgaagaacaatcctgtgctaattggtgagcctggtgttggaaagactgcaatttctgaaggacttgctcagagaatagtgcaaggagatgttcctcaagctttgatgaaccgtaggcttatatctcttgatatgggtgctctgattgctggagcaaagtatcggggggaatttgaggataggctgaaagccgtactaaaagaagtaacagaatctgatggtcagactatccttttcattgatgagattcatacagtggttggggcaggagccacaaatggtgctatggatgctggaaatctcttaaagcctatgcttggtcggggcgagctgcgatgtattggtgcaacaacactggatgagtatcggaagtatatcgagaaggacccagcactagagcgtcgtttccagcaagtttatgttgaccaacctacagttgaagatacaatttcaatactaagggggctgcgggaaagatatgaactacatcatggtgtccgaatttctgacagtgcacttgtggaagctgcaattctgtcagatagatatatcagtgggagatttttgccagacaaagctattgatctagttgatgaggccgctgccaaattgaaaatggaaatcacttctaaacctacagcacttgatgagataaatcggtcagtgctgaaactggagatggagagactttctctcatgaatgatacagataaggcttctaaagataggcttaatcgtcttgaggcagagctttctctcttgaaagagaaacaggttgagctgactgaacagtgggagcatgaaaagtctgtaatgactcgcattcaatcaatcaaagaagagatagacagggtgaatctggagatccaacaggctgagcgggagtatgatcttaatcgcgctgctgaattgaagtatggcagtctaaactccttgcaacggcaacttgaaagtgcagagaaggagttagatgaatatatgaactctggtaagtctatgctgagagaggaagttacaggaaatgatattgctgaaattgtaagcaagtggactggtatccctgtttcaaaacttcagcaatcagagagggagaagttgttgtatttagaggaagtgcttcataagcgtgttgtaggtcaagaccctgctgttaaggcagttgctgaggctatccaacgttcaagagcaggtctttcagatcctcatcgtccaattgctagctttatgtttatgggaccaacaggtgtaggaaagacagagctggctaaggcacttgcggcctacttgttcaacacagaagaagctcttgtacgaattgatatgagcgagtatatggaaaaacatgctgtttcaagattgattggggctccacctggatatgttgggtacgaagagggagggcaacttactgagacagttcgccgcagaccatatgctgttattttgtttgacgagattgagaaggcacacgcagatgtcttcaatgttttccttcaaattttggatgacggaagagtaaccgactcacagggtcgcactgtgagttttaccaacactgttatcattatgacctcaaatgttggatcacagtacattctgaacacagaagatgaaaccgtgccaaaagagttggcttatgaaaccataaaacagcgcgtaatggatgctgcaagatccatctttcgccctgagtttatgaatagagttgatgaatatattgttttccagcccctagaccgtgaccaaataagtagcattgtcaggttacagttggagcgtgtgcagaagagaattgcagatcgcaagatgaaaattcaggtgacggatgctgctatccaacttcttgggaatttggggtatgaccccaactatggtgctaggccagtcaagcgagtgattcagcagaatgtggaaaatgaacttgccaagggtattctcagaggagaaattaaggaagaggacgcaattttaatagacacagaactcacggcatttaccaacggtcaacttccccagcaaaagcttgtttttaagaagctagcagctgattctgaacctaccactcaagactccttggaacccttcccacaggctccatgaattccttctactgcttcttaattttcatttacacaaattttagtatacaatttccttgtaccaattgaacagtgatcccggggtagcttgcatctaatacatattgtctattatcaatacgaataccatgtcaaagtgtctcacggttgtcagtcgaaatcattgcaaatataataaatttttaccttagttgaacaagtcgcttcctgcagaattagccaggccaacccatcat

SEQ ID NO: 10379 - DNA, 3272 bp, Glycine max
ctctccttgcaatttctgttctgttacaaccttttttctttcttctctcttctcttttttgttttctcaatacccacgcaacgcaaagttccctcttcttctcttccctttaattttccactctcattccttcccactcgctcttccctcaacgctcttccttctcgctcatggcctccacgtcgtcgttttctctctcccacgccgttgttcccttctcatgcaacacaaaacatggtcatttatctcacaacctcctctatctctcattcgcaaaacccatttccctaaagcccctccaatcgcttcccttcaacaaaagacacccttttgcaaatgggtttcagagaattcgaagaaattcctcacctttcatcgttcgctgtgaagcttcaagtggaaggattacgcagcaagagttcacagagatggcgtggcaggcaatagtttcgtcaccagaggtggccaaggagaacaagcatcagattgtggagacagagcacttgatgaaggctttgttggagcagaagaatggacttgctcgcaggatcttttccaaggttggggtggataacactcgccttctagaagctactgataagtacattcagcggcaacccaaggttctaggggaatcctctggttcaatgttgggccgtgatttggaggcattgattcagagagctagggaccacaagaaaaagtatggggattcatttgtttcagttgagcacttggttcttgcttttacccaagatcaacggtttgggaagcaattcttcagagattttcaaatatctgagccagctctaaaatctgcaatagagtctgttaggggacgtcagtcagttattgatcaagatcccgaaggaaagtatgaagccttggaaaaatatggaaaagatttgaccgcaatggcaaaagctggaaaacttgacccagtcataggaagagatgatgaaatacgaaggtgcattcaaattctctccaggaggacaaagaacaatcccgtgctaattggtgaacctggtgttggaaagaccgccatttctgaaggactggctcagagaatagtgcaaggagatgttcctcaagctttaatggaccgtaggcttatatctctggatatgggagcacttattgctggagcgaagtaccggggagaattcgaggataggctgaaagctgtactaaaagaagtgacagaatctgatggtcagactatccttttcattgacgagattcatacagttgttggggcaggagccacaaatggtgctatggatgctggtaatctcttaaaacctatgcttggtcggggtgagctgcgatgtattggtgcaacaacactggacgagtatcggaagtatatcgagaaggacccagcactagagcgtcgcttccaacaagtttatgttgaccaacctacagttgaagatacaatttcaatactaaggggactgcgggaaaggtatgaactacatcatggagtccgaatttctgacagtgcacttgttgaagctgcaattctctcagatagatatatcagtggaagatttttgcctgacaaagctattgacctggttgatgaggcagctgccaaactgaaaatggaaatcacttctaaacctactgcacttgatgagatcaatagatcagtcctgaaactagagatggagagactctctctcatgaatgatacagataaggcttctaaagataggctgaatcgtcttgaggcagagctttctctcttaaaagagaaacaggctgagctgactgaacagtgggagcatgaaaagtctgtaatgactcgtattcaatcaatcaaagaagagatagacagagtgaatcttgagatccaacaggctgaacgggagtatgatcttaatcgtgctgctgaattaaagtatggcagtcttaactccttgcaacggcaacttgaaagtgccgagaaggagttagacgaatatatgaactctgggaagtctatgctgagagaggaagttacgggaaatgatattgctgaaattgtaagcaagtggactggtatccctgtttcaaaacttcaacaatcagagagggagaagttgttgcatttagaggaagtgcttcataagcgtgttgtaggccaagaccctgctgttaaggcaattgctgaggctatccaacgttcaagagcaggtctttcggatcctcatcgtccaattgccagcttcatgtttatgggacctacaggtgtaggaaagacagagctggctaaggcacttgcagcctacttgttcaacactgaagaagctcttgtacggattgatatgagcgagtacatggaaaaacatgctgtttcaagattgattggggctccacctggatatgttgggtacgaagaaggagggcaacttactgagatagttcgccgcagaccatatgctgttattttgttcgatgagattgagaaggcgcacgccgatgtcttcaatgtatttcttcaaattttggatgatggaagagtaaccgactcacagggtcgcacagtaagttttaccaacactgttatcattatgacctcaaatgttggatcacagtacatcttgaacacagatgacgacaccacgccaaaagagttggcttatgaaaccataaaacaacgtgtaatggatgctgcaagatccatcttccgccctgagtttatgaatagagttgacgaatatattgttttccagcctctagaccgtgaacaaataagtagcattgtcagattacagttggagcgcgtgcagaagagaattgcagatcgcaagatgaaaatccaagtgacggatgctgctgttcaacttcttggaagtttggggtatgaccccaactatggtgctaggccagtcaagcgagtgattcagcagaatgtggagaatgaactcgccaagggtattctcagaggagaatttaaggaagaagatgcaattataatagacacagaactcacagcatttaccaacggccaacttccccagcaaaagcttgtttttaagaaacttgcagctgattcagaatctacccctcaagacaccttggaacccttcccacaggctccatgaattccttctactgccccataactttccatcatacaaattttagtatacagtttccttacaccaattgaacaatgatcccggcgcagtttgcatctaatatatattttctattaccaatacgaataacatgtgtcactcaaaaatagtgtaaatatatatatttttaccgctgttgaa

SEQ ID NO: 10380 - DNA, 3494 bp, Glycine max
atgaacatatatctaaacatttcacgaacttccgagaatgctctactctcactctattccaactctctccttgcaatttctgttctgttacaaccttttttctttcttctctcttctcttttttgttttctcaatacccacgcaacgcaaagttccctcttcttctcttccctttaattttccactctcattccttcccactcgctcttccctcaacgctcttccttctcgctcatggcctccacgtcgtcgttttctctctcccacgccgttgttcccttctcatgcaacacaaaacatggtcatttatctcacaacctcctctatctctcattcgcaaaacccatttccctaaagcccctccaatcgcttcccttcaacaaaagacacccttttgcaaatgggtttcagagaattcgaagaaattcctcacctttcatcgttcgctgtgaagcttcaagtggaaggattacgcagcaagagttcacagagatggcgtggcaggcaatagtttcgtcaccagaggtggccaaggagaacaagcatcagattgtggagacagagcacttgatgaaggctttgttggagcagaagaatggacttgctcgcaggatcttttccaaggttggggtggataacactcgccttctagaagctactgataagtacattcagcggcaacccaaggttctaggggaatcctctggttcaatgttgggccgtgatttggaggcattgattcagagagctagggaccacaagaaaaagtatggggattcatttgtttcagttgagcacttggttcttgcttttacccaagatcaacggtttgggaagcaattcttcagagattttcaaatatctgagccagctctaaaatctgcaatagagtctgttaggggacgtcagtcagttattgatcaagatcccgaaggaaagtatgaagccttggaaaaatatggaaaagatttgaccgcaatggcaaaagctggaaaacttgacccagtcataggaagagatgatgaaatacgaaggtgcattcaaattctctccaggaggacaaagaacaatcccgtgctaattggtgaacctggtgttggaaagaccgccatttctgaaggactggctcagagaatagtgcaaggagatgttcctcaagctttaatggaccgtaggcttatatctctggatatgggagcacttattgctggagcgaagtaccggggagaattcgaggataggctgaaagctgtactaaaagaagtgacagaatctgatggtcagactatccttttcattgacgagattcatacagttgttggggcaggagccacaaatggtgctatggatgctggtaatctcttaaaacctatgcttggtcggggtgagctgcgatgtattggtgcaacaacactggacgagtatcggaagtatatcgagaaggacccagcactagagcgtcgcttccaacaagtttatgttgaccaacctacagttgaagatacaatttcaatactaaggggactgcgggaaaggtatgaactacatcatggagtccgaatttctgacagtgcacttgttgaagctgcaattctctcagatagatatatcagtggaagatttttgcctgacaaagctattgacctggttgatgaggcagctgccaaactgaaaatggaaatcacttctaaacctactgcacttgatgagatcaatagatcagtcctgaaactagagatggagagactctctctcatgaatgatacagataaggcttctaaagataggctgaatcgtcttgaggcagagctttctctcttaaaagagaaacaggctgagctgactgaacagtgggagcatgaaaagtctgtaatgactcgtattcaatcaatcaaagaagagatagacagagtgaatcttgagatccaacaggctgaacgggagtatgatcttaatcgtgctgctgaattaaagtatggcagtcttaactccttgcaacggcaacttgaaagtgccgagaaggagttagacgaatatatgaactctgggaagtctatgctgagagaggaagttacgggaaatgatattgctgaaattgtaagcaagtggactggtatccctgtttcaaaacttcaacaatcagagagggagaagttgttgcatttagaggaagtgcttcataagcgtgttgtaggccaagaccctgctgttaaggcaattgctgaggctatccaacgttcaagagcaggtctttcggatcctcatcgtccaattgccagcttcatgtttatgggacctacaggtgtaggaaagacagagctggctaaggcacttgcagcctacttgttcaacactgaagaagctcttgtacggattgatatgagcgagtacatggaaaaacatgctgtttcaagattgattggggctccacctggatatgttgggtacgaagaaggagggcaacttactgagatagttcgccgcagaccatatgctgttattttgttcgatgagattgagaaggcgcacgccgatgtcttcaatgtatttcttcaaattttggatgatggaagagtaaccgactcacagggtcgcacagtaagttttaccaacactgttatcattatgacctcaaatgttggatcacagtacatcttgaacacagatgacgacaccacgccaaaagagttggcttatgaaaccataaaacaacgtgtaatggatgctgcaagatccatcttccgccctgagtttatgaatagagttgacgaatatattgttttccagcctctagaccgtgaacaaataagtagcattgtcagattacagttggagcgcgtgcagaagagaattgcagatcgcaagatgaaaatccaagtgacggatgctgctgttcaacttcttggaagtttggggtatgaccccaactatggtgctaggccagtcaagcgagtgattcagcagaatgtggagaatgaactcgccaagggtattctcagaggagaatttaaggaagaagatgcaattataatagacacagaactcacagcatttaccaacggccaacttccccagcaaaagcttgtttttaagaaacttgcagctgattcagaatctacccctcaagacaccttggaacccttcccacaggctccatgaattccttctactgccccataactttccatcatacaaattttagtatacagtttccttacaccaattgaacaatgatcccggcgcagtttgcatctaatatatattttctattaccaatacgaataacatgtgtcactcaaaaatagtgtaaatatatatatttttaccgctgttgaatgggtcgcgttctgcataatcagccaagtcaccccgtcatactgttactggtaatgtaaatgattgagttggatcaattccagcttggttaataattaatgcctagctatgagaagcattaaactgttcctgctggaaagatacaagcaataaggctg

SEQ ID NO: 10381 - DNA, 3399 bp, Glycine max
tctcactctattcctattcctattcctgccccaactctctccttgcaatttctgttctgttacaacctttctcttttcttctgttgtcttctcttttttctttcctcaatacccacgcaacgcaaagttccctcttctctctttcctttaatttttcactatcattccttcccactcgctcttccctcgacgctcttcctcctcattgctcatggcctccacgacgtcgttttctctctctcacgctgttgttcccttctcctgcaacacaaagcatggtcatttatctcacaaccgccactatctctccctcccaaaacccatttccctgaagcccctccgatcgccttccttcaataaaagacactcttttgcaaatgggtttcagacaattcggagaaattcctcacctttcaccgttcgctgtgaagcttcaagtggaaggattacgcagcaagagttcacagagatggcgtggcaggcaatagtttcgtcgccggaggtggccaaagagaacaagcatcagatagtagagacagagcacttgatgaaggctttgttggagcagaagaatgggcttgctcgcaggatcttttcgaaggttggggtggataacactcgccttctagaagctactgataagtacattcagcggcaacccaaggttctaggggaatcatctggttcaatgttgggccgtgatttggaggcattgattcagagagctagggaccacaagaaaaagtatggggattcatttgtttcagttgagcacttggttcttgcttttacccaagatcaacgatttgggaagcaattctttagagattttcaaatatctgagcctgctctaaaatctgcaatagagtctgttaggggacgtcagtcagttattgatcaagatcctgaagggaagtatgaagccttggaaaaatatggaaaagatttgaccgcaatggcaaaagctggaaaactcgacccagtcataggaagagatgatgaaatacgaaggtgcatccaaattctctccaggaggacaaagaacaatcccgtgctaattggtgaacctggtgttggaaagactgctatttctgaaggactggctcagagaatagtgcacggagatgttcctcaagctttgatgaaccgtaggcttatatctctcgatatgggagcacttattgctggagcgaagtaccggggagaattcgaggataggctgaaagctgtactaaaagaagtgacagaatctgatggtcagactatccttttcattgacgagattcatacagttgttggggcaggagctacaaatggtgctatggatgctggtaatctcttaaaacctatgcttggtcggggtgagttgcgatgtattggtgcaacaacactggacgagtatcggaagtatattgagaaggacccagcactagaacgccgtttccagcaagtttatgttgaccaacctacagttgaagatacaatttcaatactaaggggactgcgggaaaggtatgaactacatcatggagtccgaatttctgacagtgcacttgtggaagctgcaattctctcagatagatatatcagtggaagatttttgcctgacaaagctattgacctggttgatgaggcggctgcaaaactgaaaatggaaatcacttctaaacctactgcacttgatgagatcaacagatcagtcctgaaactagagatggagagactctctctcatgaatgatacagataaggcttctaaagataggctgaatcgtcttgaggcagagctttctctcttaaaagagaaacaggctgagctgactgaacagtgggagcatgaaaagtctgtaatgactcgtattcaatcaatcaaagaagagatagacagagtgaatcttgagatccaacaggctgagcgggagtatgatcttaatcgtgctgctgaattaaagtatggcagtcttaactccttgcaacggcaacttgaaagtgcagagaaggagttagacgaatatatgaactctgggaagtctatgctgagagaggaagttacgggaaatgatattgctgaaattgtaagcaagtggactggtatccctgtttcaaaacttcaacaatcagagagggagaagttgttgtatttagaggaagtgcttcataagcgtgttgttggccaagaccctgtagttaaggcagttgctgaggctatccaacgttcaagagcaggtctttcagatcctcatcgtccaattgccagcttcatgtttatgggacctacaggtgtaggaaagacggagctggctaaggcacttgcagcctacttgttcaacactgaagaagctcttgtacgaattgatatgagtgagtacatggaaaaacatgctgtttcaagattgattggggctccacctggatatgttgggtacgaagaaggagggcaacttactgagatagttcgccgcagaccatatgctgttattttgtttgatgagattgagaaggcacatgctgatgtcttcaatgtattccttcaaattttggatgatggaagagtaaccgactcacaaggtcgcacagtaagttttaccaacactgttatcattatgacctcaaatgttggatcacagtacatcttgaacacagatgatgacaccacgccgaaagagttggcttatgaaaccataaaacagcgcgtaatggatgctgcaagatccatctttcgccctgagtttatgaatagagttgacgaatatattgttttccagcctctagaccgtgaacaaataagtagcattgtcagattacagctggagcgtgtgcaaaagagaattgcagatcgcaagatgaaaatccaagtgacggatgctgctgttcaacttcttggaagtttagggtatgaccccaactatggcgctaggccagtcaagcgagtgattcagcagaatgtggagaatgaactcgccaagggtattctcagaggagagtttaaggaagaggatgcaattctaatagacactgaactcacagcatttaccaacggccaacttccccagcaaaagcttgtttttaagaaacttgcagctgattcagaatctacccctcaaggcaccttggaacccttcccacaggccccatgaattccttctacttgctctatatttttccttcacacacaaatttgagcatacagtttccttataccaattgaacaatgatgccggtgtagtttgcatctaatatatattttctattaccaatgtagatgagccaggctgagcttatttcagtaatattgagttggattaattccagcttggttaaaaattaatgcttggctatgagaagcattaaactgttcctgctggaaagatacaagcaataaggctgtatttgattcaat

SEQ ID NO: 10382 - DNA, 3607 bp, Glycine max
cttggtacatagtagctccaaaagggaacatgagcatcatatccaacgcaagccaagccaccacgtggtgtatggctgctcatctaaacaattcacgaacttcccagaatgctctactctcactctattcctattcctattcctgccccaactctctccttgcaatttctgttctgttacaacctttctcttttcttctgttgtcttctcttttttctttcctcaatacccacgcaacgcaaagttccctcttctctctttcctttaatttttcactatcattccttcccactcgctcttccctcgacgctcttcctcctcattgctcatggcctccacgacgtcgttttctctctctcacgctgttgttcccttctcctgcaacacaaagcatggtcatttatctcacaaccgccactatctctccctcccaaaacccatttccctgaagcccctccgatcgccttccttcaataaaagacactcttttgcaaatgggtttcagacaattcggagaaattcctcacctttcaccgttcgctgtgaagcttcaagtggaaggattacgcagcaagagttcacagagatggcgtggcaggcaatagtttcgtcgccggaggtggccaaagagaacaagcatcagatagtagagacagagcacttgatgaaggctttgttggagcagaagaatgggcttgctcgcaggatcttttcgaaggttggggtggataacactcgccttctagaagctactgataagtacattcagcggcaacccaaggttctaggggaatcatctggttcaatgttgggccgtgatttggaggcattgattcagagagctagggaccacaagaaaaagtatggggattcatttgtttcagttgagcacttggttcttgcttttacccaagatcaacgatttgggaagcaattctttagagattttcaaatatctgagcctgctctaaaatctgcaatagagtctgttaggggacgtcagtcagttattgatcaagatcctgaagggaagtatgaagccttggaaaaatatggaaaagatttgaccgcaatggcaaaagctggaaaactcgacccagtcataggaagagatgatgaaatacgaaggtgcatccaaattctctccaggaggacaaagaacaatcccgtgctaattggtgaacctggtgttggaaagactgctatttctgaaggactggctcagagaatagtgcacggagatgttcctcaagctttgatgaaccgtaggcttatatctctcgatatgggagcacttattgctggagcgaagtaccggggagaattcgaggataggctgaaagctgtactaaaagaagtgacagaatctgatggtcagactatccttttcattgacgagattcatacagttgttggggcaggagctacaaatggtgctatggatgctggtaatctcttaaaacctatgcttggtcggggtgagttgcgatgtattggtgcaacaacactggacgagtatcggaagtatattgagaaggacccagcactagaacgccgtttccagcaagtttatgttgaccaacctacagttgaagatacaatttcaatactaaggggactgcgggaaaggtatgaactacatcatggagtccgaatttctgacagtgcacttgtggaagctgcaattctctcagatagatatatcagtggaagatttttgcctgacaaagctattgacctggttgatgaggcggctgcaaaactgaaaatggaaatcacttctaaacctactgcacttgatgagatcaacagatcagtcctgaaactagagatggagagactctctctcatgaatgatacagataaggcttctaaagataggctgaatcgtcttgaggcagagctttctctcttaaaagagaaacaggctgagctgactgaacagtgggagcatgaaaagtctgtaatgactcgtattcaatcaatcaaagaagagatagacagagtgaatcttgagatccaacaggctgagcgggagtatgatcttaatcgtgctgctgaattaaagtatggcagtcttaactccttgcaacggcaacttgaaagtgcagagaaggagttagacgaatatatgaactctgggaagtctatgctgagagaggaagttacgggaaatgatattgctgaaattgtaagcaagtggactggtatccctgtttcaaaacttcaacaatcagagagggagaagttgttgtatttagaggaagtgcttcataagcgtgttgttggccaagaccctgtagttaaggcagttgctgaggctatccaacgttcaagagcaggtctttcagatcctcatcgtccaattgccagcttcatgtttatgggacctacaggtgtaggaaagacggagctggctaaggcacttgcagcctacttgttcaacactgaagaagctcttgtacgaattgatatgagtgagtacatggaaaaacatgctgtttcaagattgattggggctccacctggatatgttgggtacgaagaaggagggcaacttactgagatagttcgccgcagaccatatgctgttattttgtttgatgagattgagaaggcacatgctgatgtcttcaatgtattccttcaaattttggatgatggaagagtaaccgactcacaaggtcgcacagtaagttttaccaacactgttatcattatgacctcaaatgttggatcacagtacatcttgaacacagatgatgacaccacgccgaaagagttggcttatgaaaccataaaacagcgcgtaatggatgctgcaagatccatctttcgccctgagtttatgaatagagttgacgaatatattgttttccagcctctagaccgtgaacaaataagtagcattgtcagattacagctggagcgtgtgcaaaagagaattgcagatcgcaagatgaaaatccaagtgacggatgctgctgttcaacttcttggaagtttagggtatgaccccaactatggcgctaggccagtcaagcgagtgattcagcagaatgtggagaatgaactcgccaagggtattctcagaggagagtttaaggaagaggatgcaattctaatagacactgaactcacagcatttaccaacggccaacttccccagcaaaagcttgtttttaagaaacttgcagctgattcagaatctacccctcaaggcaccttggaacccttcccacaggccccatgaattccttctacttgctctatatttttccttcacacacaaatttgagcatacagtttccttataccaattgaacaatgatgccggtgtagtttgcatctaatatatattttctattaccaatgtagatgagccaggctgagcttatttcagtaatattgagttggattaattccagcttggttaaaaattaatgcttggctatgagaagcattaaactgttcctgctggaaagatacaagcaataaggctgtatttgattcaatgatttagtttaagtaattattttaaaatgtttagttcatgagaatttaaagtttactaattaataaaaaattattgatatatttttcctta

SEQ ID NO: 10383 - DNA, 3272 bp, Medicago truncatula
ctcaaacagtctctctcttattcctttctcagtattaacgcaaacacaaacactttcttactatcaatattcaatatcatcactctttctttcttctttcaattcagtgatggcttcaacgacgtcgttttctcttccctattcaactcccatttccttcaacagaagaaacagtgctatatatttttctcatcatcaccgtgtttctctctctttctccgctaaacgcgtttcactcaaatcatcacttccattaaatcaaagacggtttctagcaaatggaatttgcagaactcaaacaaattcgaagcgtttctctgttcgttgtgaagcttcttcaactggcactggaaggattacacagcaagagttcacagagatggcttggcaggcgatagtttcatcgccggaggtggccaaagagaacaaacatcagattgtggagacggagcacttgatgaaggctttgttggagcagaagaatggtcttgctcgcaggatctttaccaaggttggagtggacaatactcagcttctagaagctactgataagttcattcagcggcaacccaaggttataggggaatcagctggttcaatgttggggcgcgatttggagggattgattcagagagccagggacttccagaaagaatatggggattcatttgtttctgttgagcacttagttcttggttttatccaggaccaacgattcgggaagcaactctttaaagattttcagatatctcagcagggtctaaaatctgcaatagagtccattaggggacgccagtcagtaattgaccaagatcctgaagggaagtatgaagcattggaaaaatacgggaaagatttgacagcaatggctaaagcaggaaagcttgatccagttataggaagagatgatgaaatacgcaggtgcattcaaattctctccaggagaacaaagaacaatcccgtgctgattggtgagcctggtgttggaaagactgcaatttctgaaggacttgctcagagaatcgtgcaaggagatgttcctcaagctttgatgaaccgtaggcttatatcccttgatatgggtgcacttattgctggagcaaaataccggggagaattcgaagataggctgaaagctgttcttaaagaagtaacagaatctgatggtcaaactatccttttcattgatgagattcatacagttgttggggcaggtgctacaaacggtgctatggatgctggtaatctcttaaagcctatgctcggcagaggagagctgcgatgcattggtgcaacaacacttgatgagtatcggaagtatatcgagaaggatccagcactagagcgtcgtttccaacaagtttatgttgaccaaccaactgttgaagataccatttcaatactaaggggactgcgggaaaggtatgaactgcatcatggagtccgaatttctgatagtgcacttgtggaagctgcaattctctcggatcgatatatcagtggaagatttttgcctgacaaagctattgatttggttgatgaggcggctgccaaattgaaaatggagatcacttcaaaacctactgcacttgatgagatcaaccggtcggtcctgaaactagagatggagagactctctctgacgaatgatacagacaaggcttctaaagataggttaagtcgtctcgaggctgagctctctctgttaaaacataaacaggctgagctgactgaacagtgggagcatgaaaagtcagtaatgactcgacttcaatcaatcaaagaagagatcgacagagtgaaccttgagatccaacaggctgagcgggagtatgatctgaaccgcgctgctgaattaaagtatggaagccttaactcattgcaacgacaacttgagagtgcggagaaagagttagatgaatatatgaactctgggaagtctatgctaagagaggaagtaacagggagtgatatagctgaaattgtaagcaagtggaccggtattcctgtttcaaaacttcaacaatcagagagggagaaattgttgtatttagaggaagtacttcataagcgtgttgtaggtcaagatcctgccgttaaagcagtagccgaggctatccaacgttcaagagcaggtctttcagatcctcatcgtccaattgctagcttcatgtttatggggcctacaggtgtaggaaaaaccgagttggctaagacactggcttcatacatgttcaatacagaagaagcacttgtaagaattgatatgagtgagtacatggaaaagcatgcagtttcaagattgatcggggcaccacctggatatgttgggtacgaagaggggggacagcttaccgagacagttcgccgcagaccttatgctgttattttatttgatgagattgagaaggcacattcggatgtcttcaacgtattccttcaaattttagatgatggaagagtaaccgactcacaaggtcgaacagtaagttttaccaatactgttatcattatgacctcaaatgttggatcacagtacattctaaacacggatgatgacacggcgcctaaggaattagcctatgaaaccataaagcagcgggtaatggatgctgcaagatccatctttcgtcccgagtttatgaatagagttgatgaatatattgtcttccagcctctcgaccgtgatcaaattagtagcattgtcaggttacagttggagcgtgtgcagaagagaattacagatcgcaagatgaaaatccaggtgacagatgctgccatccaacttcttggaagcttaggatatgaccctaactacggagctaggccagtcaaaagagtgattcagcaaaatgtggagaatgaacttgccaagggtattctgagaggagaatttaaagatgaggacacaatcttagtagacacagaactcacagcattagccaacaatcaacttccacagcaaaagctagtttttaggaagattgaagttgattcacgatctacaccgcaagaaagcctggaacattcttcacaagctccctgaatgaatgttttctgctgctcctgatttttcagcgtactagattcatttaatatgtaattatgttttctatctattgattaatacgaatatcatacatgacaaagtatcacctttgtcactacaaagcattgtaaatatattgaattaatgttatctattgaatgagttgcatccttcagaattgactaaacgaacccatgataatattactattgagtatatatga

SEQ ID NO: 10384 - DNA, 3536 bp, Cicer arietinum
aaattcttcatcacactctcttccttattctttcctcagtaagaaagtaacacaaacataaaagagtttccttcatttcttcttcaattcccaattctattctcattctcaaagatggcttctacgacgtcgttttcaattcctcattcagttccaatttcctgttacagaaacagttctcgaaattctcaccattacaatgtttctctatcgttctctgctaaacccttttccctcaaatcacttccattgaatcaacgatacaaacatgcaaatggattttgcggaattcaaacaaattctacgcggttctctgttcgttgtgaagcttcttcagctggaaggattacacagcaagagttcacggagatggcctggcaggcgatagtttcatcaccggagatggccaaagagaacaagcatcagattgtggagacagagcatttgatgaaggctttgttggagcagaagaacgggcttgctcgcaggatcttttccaaagtcagtgtggataacacccggcttctagaagctactgataagtacattcaacggcaacccaaggttataggggaatcagctggttcaatgttggggcgcgatttagaggcattgattcaaagagccagggactacaagaaagaatatggagattcctttgtttcagttgaacacttggttcttggttttaccgaggatcaacgtttcgggaagcaactttttagagattttcaaatatctcagcagggtctaaaatctgcaatagagtccattaggggacaccagtcagtaattgaccaagatccggaagggaagtatgaagccttggaaaaatatggaaaagatttgacagcaatggctaaagcaggaaaacttgatccagttataggaagagatgatgaaatacgcaggtgcatccaaattctctccaggagaacaaagaacaatcctgtactgatcggtgagcctggtgttggaaagactgcaatttctgaaggacttgctcagagaatcgtgcaaggagatgttcctcaggctttgatgaaccgtaggcttatatcccttgacatgggtgcacttattgctggagccaaataccggggagaattcgaagataggctgaaagctgttcttaaagaagtaacagaatctgatggtcaaactatccttttcattgatgagattcatacagttgttggagcaggtgctacaaatggtgctatggatgctggtaacctcttaaagccaatgcttggtagaggggagctgcggtgtattggtgcgacaacactagatgaatatcgaaagtatattgagaaagacccagcactagagcgtcgtttccagcaagtttatgttgaccaacctactgttgaagataccatttcgatactacggggactgcgggaaaggtacgagctacatcatggagtccggatttctgatagtgcacttgtggaagctgcaattctctcagatcgatatattagcgggagatttttgcctgacaaagctattgatttggttgatgaggcagctgccaaactgaaaatggaaatcacttcaaaacctactgcacttgatgagatcaaccggtcggtcctaaagctagagatggagagactctctcttatgaatgatacagacaaggcttctaaagataggctgtatcgtcttgaggcagagctctctctcttgaaagagaaacaggttgagctgactgaacagtgggagcatgaaaagtctgtcatgactcgaattcaatcaattaaagaagagatagacagggtgaatcttgagatccaacaggctgagcgggagtatgatctgaatcgtgctgctgaattgaaatatggcagcctaaactccttgacacgacaacttgagagtgcagagaaggagttagttgaatatatgaactctgggaagtctatgctgagggaggaagtttcaggaaatgatattgctgaaattgtaagcaagtggactggtattcctgtttcaaaacttcaacaatcagagagggagaagttgttgtatttagaggaagtgctccataagcgcgttgtcggtcaagaccctgctgttactgcagtagccgaggctatccagcgttcaagagcaggtctttcagatcctcatcgtccaatcgctagcttcatgtttatggggccgaccggtgtgggaaagactgaactggctaaggcgctagcttcctacatgttcaatacagaagaagcgcttgtaagaattgatatgagtgaatacatggaaaagcatgcagtttcaagattgattggagccccaccgggatatgttgggtatgaagagggagggcagcttactgagacaattcgccgcagaccttatgctgttattttgtttgatgagattgagaaggcgcactcggatgtcttcaatgtattccttcaaattttggatgatggaagagtaactgactcacagggtcgaacagtgagttttaccaacactgttatcattatgacctcaaatgttggatcgcagtacattctcaacacggatgatgacactgcgcctaaagaattagcttatgaaacaataaagcaccgggtaatggacgccgcaagatccatctttcgccctgagttcatgaatagagttgatgaatatattgttttccagcctctcgaccgtgatcagataagccacattgtaaggttacagttggagcgtgtgcagaagagaatagcggatcgcaagatgaaaatccgcgtgactgatgctgccatccaacatcttggaagcttggggtatgaccccaactatggagctaggccagtaaagcgagtgattcagcaaaatgtggagaatgaacttgccaagggtattctgagaggagaatttaaggacgaggacacaattttagtagacacagaactcaaagcattttcaaacaatcagcttccacagcagaagctagtttttaggaagatcgaagctgattcacaatctacaccaaaagaaaactttgaaccctctccacaagctccctgaatgaatgccgtcaactgctccttgtttgataatatggttatgttttctatttatcaatcaatatgaatatcatacaaaacaaagtatttcatttgtcactccaaagcagtgtaaatatatttatttaatgttatctgttggatgagttacatcatacagaattggcaaaacgaaccattcatgatgttactagtaagtatatgagcaacgctaagcttatttcaatcttaatgaactgaattaatttcggactcgttaacagttaaagtttggatttgagaagcacgacttcaataaagcaagaagaaaaaagtattcaaataacgaaccaaagaactgcaaatatgactcgctttgcaatacagtacatgctaagttagtggttggaaccccacaagatatctttgattaagtcctaaatcaaaaattagttttgtagttggtctaagagatcgaagttgtggaaatacattacagtactgccgaaatatgaagtattt

SEQ ID NO: 10385 - DNA, 3400 bp, Lupinus angustifolius
catctttttcttctttccttaattccccacacaaatgcacacttcttcatttctcactctcatcttaatttccactctctaatctcactttcccttatcatcatcatcatggcttctacgacgtcgttttcatctctcttcttttctcactcagttccaatttcaagtaaccgaaatcatcatccccaaatttccctcgctttttacgctaaacccagtttcccaaatcatcttaaatcgttatcgttgaacaaaagaaacgttttttcaaatgggtttcagagaattctaagaaattctactcctttctctgttcgttgtgaagcatcatcgagtggaaggattacacagcaagagtttacagaaatggcatggcagtcaatagtttcgtcaccagaagtggcgaaggagaacaagcatcagattgtggagacagagcacttgatgaaggctttgttggagcagaagaacgggcttgctcgcaggatattttccaaagtcggcgttgataacactcggcttctagaagctactgataagtacattcagcgacaacccaaggtgctaggggaatcggctggttcaatgttggggcgtgatttggaggcattgattcagagagccagggactacaagaaggaatatggggattcatttgtttcagttgagcacttggttcttggatttgcccaagatcaacgatttgggaagcagttctttaaagattttcaaatatctcagcaggctcttaaatctgcaatagagtccgttagaggacgccagtcagttattgaccaggatcccgaagggaagtatgaagccttggaaaaatatgggaaagatttgacagcgatggctaaagcaggaaaacttgacccggtcataggaagagatgatgaaatacggaggtgcatccagattctctccagaaggacaaagaacaatcctgtgctaattggtgagcctggtgttggaaagactgcaatttctgaaggacttgctcagagaattgtgcaaggagatgttcctcaagctttgatgaaccgtaggcttatatcgcttgatatgggttcacttattgctggagctaagtaccggggagaatttgaggataggctgaaagctgttctcaaagaagtaacagaatctgatggtcagaccatcctttttattgatgagatccatacagttgttggggcaggtgctacaaatggtgctatggatgctggtaatctcttaaagcctatgcttggtcggggggagctgcgatgcattggcgcaacaacactagatgagtatcgcaagtatattgaaaaggaccctgcactagagcgtcgtttccaacaagtttatgttgaccaacctacagttgaagataccatttcaatactaaggggactgcgggaaaggtatgagctgcatcatggtgtccgaatttcggacagtgcacttgtggaagctgcaattctctcagatagatatatcagtgggagatttttgcccgacaaagctattgatctggttgacgaagcagctgctaaactgaaaatggaaattacttccaaacctactgtacttgatgagataaatcgatcggttttgaaactagagatggagagactctctctcatgaatgacacagacaaggcttctaaagataggttaagtcgtcttgatgcagagctatctctcttaaaagaaaaacaggttgagctgactgagcaatgggagcatgaaaagtctgtaatgactcgtattcaatcaattaaagaagagatagacagggtgaatcttgagatccaacaggctgagagggagtatgatcttaaccgtgctgcggaattgaagtatggtagtctaaactccttgcagcgacaacttgaaagtgcagagaaggaattagatgaatacatgaactctggtaaatctatgctgagagaagaagttacagagaatgatattgctgaaattgtaagcaaatggactggtataccagtttcaaaacttcaacaatccgagagggagaaactattgtatttagagcaagtgctccataagcgtgttgtaggtcaaaacccggctgttaaggctgtagctgaggctatccaacgttcaagagcaggtctttcagatcctcatcgtcccattgctagcttcatgtttatgggacctacaggtgtaggaaagactgagcttgctaaggcccttgcttcctacttgtttaataccgaagaagcacttgtacgaattgatatgagtgagtacatggaaaaacatgctgtttcgagattgattggggcgccgcctggatatgttgggtatgaagagggagggcaacttaccgagacagttcgtcgtagaccatatgctgttatcttgtttgatgagattgagaaggcacactcagatgttttcaatgtatttcttcaaattttggacgatggaagagtaactgactcacaaggtcgcacagtgagttttactaacactgttatcattatgacctcaaatgttggatcacaatacattctcaatactgatgatgacactgtggcaaaagagttggcttatgaaaccataaaacagcgggtgatggatgccgcaagatccgtctttcgccctgaattcatgaatagagttgacgagtatattgtcttccaacctctagaccgtgaccaaataagtaacattgtcagattacagttggaacgggtgcaaaagagaatcgcggatcgcaagatgaaagtccaagtgacagatgctgctatccaacttcttggaagtttggggtatgaccctaactatggtgctaggccagtcaagagagtgattcagcaaaatgtggagaatgaacttgccaagggtattttaagaggtgaatttaaggatgaagatgcaattttaatagatacagaactcacaccatttggcaatggtcaacttccccaacaaaagcttgtgtttaagaaacttgaagctgattcaaaatctaccactcaagatagcttggaaagagcacaggctccttgaatgcatttttcagcatcttatttctccacatagctaagtttcacacagatactagtgtacatgattttcatacatagattgaacaatgatcctagcatatttagcatccaatatataatatatttattgatcaatatagtatttagacttgacaaaggattgatttttctgcatggacacttttagtccctaagaaaatataagtcagaaagtttcaaatgttcaacaagttttcataatttcaataatacaagtctgtaaatcagcagtagtgatatataagtagttatataaattggtataattggtcgaaatgttgcttgagatagattggacttgagcaaggaacttaggcagattttgcagtata

SEQ ID NO: 10386 - DNA, 3146 bp, Arachis hypogaea
atggcttctacgacgtcgtttccgggtctctcttcactttcccactctgttccaatttcatgcagcaggaaccaccgtgctcttctttctaatccccgctactcctcccttgctttcccttcaaagcccttcaaccttctgagatcgcttcccatcaccaaaaggaaccattttgcaaatgggtttcggacaacaactcacagaaatccccaacgtttctctgttcgctgtgaagcttcaagtggaaggattacgcagcaagagttcaccgaaatggcgtggcaggcgatagtttcctcgccggaggtggcgaaggagaacaagcatcagattgtggagactgagcacttgatgaaggctttgttggagcaaaagaatggtcttgctcgcaggattttttccaaggctggagttgataacactcggcttctagaagctactgacaagtacattcagaggcaacccaaggttctaggggaatcagctggttcgatgttggggcgtgagttggaggcattgattcagagagccagggactacaagaaagaatatggggattcatttgtttcagttgaacacttccttcttggttttacccaagatcaacgtttcgggaagcagttatttagggatttccaaatatcgcagcagacgctaaaatctgcaatagagtctgttaggggacgccagtcagttattgaccaagatccggaggggaagtatgaagccttggaaaaatatgggaaagatttgacagcaatggctaaagcgggaaaacttgacccagtcataggaagagatgacgaaatacgtcggtgcatccagattctctccaggaggacaaagaacaatcctgtgctaattggtgagcctggtgtaggaaagactgcaatttctgaagggcttgctcagagaattgtgcaaggagatgttcctcaggctttaatgaaccgtaggcttatatcacttgatatgggtgcacttattgctggagcaaagtaccggggagaatttgaggacaggctaaaagctgtccttaaagaagtaacagaatctgagggtcagacaatcctttttattgatgagatccacacagttgttggggcaggtgccacaaatggtgctatggatgctggtaatcttttaaagcctatgcttggtcggggagagctgcgttgtattggcgctacaacattagatgagtatcgcaagtatattgagaaggacccagctctagagcgtcgttttcagcaagtttatgttgaccaacctacagttgaagatactatttcaatactgagggggctgcgggaaaggtatgagcttcatcatggggtccgaatttcggacagtgcacttgtggaagctgcaattctctcagatcgatatatcagtggaagatttttgcctgacaaagctattgatctggttgatgaagccgctgccaaactgaaaatggaaattacttctaaacctactgcacttgacgagatcaaccggtcagtcttgaaactagagatggagcgactctctctaacaaatgatacagataaggcctcaagagacaggctaaatcgtctcgagacagagctctctcttttgaaagagaaacaggctgagctcactgaacagtgggagcatgaaaagtcagtaatgactcgaattcaatcaatcaaagaagagatagacagggtgaatcttgagatccaacaggctgagagggagtatgatcttaaccgtgctgctgaattaaagtatggcagtctgaactccttgcaacggcaactggaaactgcagagaaggagttggatgaatacatgagctccggccagtctatgctgagggaggaagttacaggaaatgatattgccgaaattgtaagcaagtggacaggtatacctgtttcaaaactacaacaatcagagagggagaagttgttgtatttggaagatgtgctccataagcgtgtggtcggtcaagaccctgctgttagggcagtagccgaggcaatccaacggtcaagagcaggtctttcggatcctcatcgtccaattgctagtttcatgtttatgggaccaacgggtgtgggaaagacagaactggctaaggcacttgcttcctacttgttcaacacagaagaagcacttgtaagaatcgatatgagtgagtacatggaaaagcatgcagtttcaagattgattggagctccacctggatatgttgggtatgaagagggaggtcaacttactgagacggttcgccgcagaccttatgctgttattctgtttgacgagatcgagaaggcacatgcggatgttttcaatgtattccttcaaatcttggatgatggaagagtgaccgactcgcagggccgcacagtgagttttactaacacagttatcattatgacctcgaatgttggatcccaatacataatcaacactgatgatgagaccgagtcgaaagaatcaacttatgaaaccataaagcagcgcgtactggacgcagcaagagctgttttccgcccagagttcatgaacagagttgatgagtatattgttttccagcctctagatcgtgaacaaattagtagcattgtgaggttacagttggagcgcgtgcagaagagaatttcggacaagaagatgaaaatcaaggtgacagatgctgctattgaacttcttggaagtctagggtatgatccaaactatggtgcaaggccagtaaagcgagtgattcagcagaatgtagagaatgaacttgccaagggcattcttagaggagaattcaaggatgaagacacaatcttaatagacacagaggtcacagcattttccaacggccaacttccccaacaaaagcttacttttaggaagattgaacctgattcagcagaaccttccactcaagacagcttggaaccttttccacagacatcttgaaaggctctatagttccttatcgtatcacatgctaagtatcatataattttgagtgtatattggttttgttaaaccgattgaataatgatcctggtatagtttgcatcaaatatatagtaacaaaattgcttagtgaccaatgatcaatacaaatacaacacttcataattcacatttgtcttccaaaaagtattgtaaatatt

SEQ ID NO: 10387 - DNA, 3109 bp, Trifolium pratense
agtgatggcttctacgacgtcgttttctcttccttattcagttccaatttcatgctacagaaactcttctcgacgcaatgtttctctttccttctcagccaaaccaatttccatcgaatcatcacttcaattcaaccaaaggaagcttcttgctaatggattttgcagaacaattcaaaccaattcatcacgtttctctgttcgttgtgaagcttctgcaactggaactggaaggattacacagcaagagttcacagagatggcctggcaggcgatagttttgtcaccagaggtggccaaagagaacaagcatcagattgtggagacagagcatttgttaaaggctttgttggagcagaagaatggacttgctcgtaggattttttccaaggttggggtggataacactcggctgctagaagctactgataagtacattcaacggcaacctaaggttataggggaatcagctggttcaatgttggggcgtgatttggaggcattgattcaaagagccagggactacaagaaagaatatggggattcatttgtttcagttgagcacttggttcttggttttatccaagaccaacgatttggaaagcaactctttaaagaatttcaaatatctcagcaaggtctaaaatctgcaatagagtcaattaggggacgccaggcagtaattgaccaagatccggaaggcaagtatgaagccttggaaaaatatggaaaagatttgacggcaatggctaaagcaggaaaacttgatccagttataggaagagatgatgaaatacgcaggtgcatccaaattctctccaggagaacaaagaacaatcctgtgctgattggtgagcctggtgtcggaaagactgcaatttctgaaggacttgctcagagaattgttcaaggagatgtgcctcaagctttgatgaaccgtaggcttatatcccttgatatgggtgcacttattgctggagcaaaataccggggagaatttgaagataggctgaaagctgttcttaaagaagtaacagaatctgatggtcaaactatccttttcattgatgagattcatacagttgttggggcaggtgctacaaatggcgctatggatgctggtaatctcttaaaacctatgcttggtagaggagagttgcggtgtattggtgcaacaacacttgatgagtatcggaagtatattgagaaggacccagcattagagcgtcgtttccagcaggtttatgtcgaccaacctactgttgaagataccatttcaatactaaggggactgcgggaaagatacgagctacatcatggagtccggatttcagacagtgcacttgtcgaagctgcaattctctcggatcgatatatcagcggaagatttttgcctgacaaagctattgatttggttgatgaggcagctgccaaactgaaaatggaaatcacttcaaaacctactgcacttgatgaaatcaaccgttcggtcctgaagttcgaaatggagagactctctctcatgaatgatacagacaaggcttctaaagataggctaaatcgtcttgagacagagctctctctcttaaaagagaaacagtctgagctgactgaacagtgggagcatgaaaagtctgtaatgactcggattcaatcaatcaaagaagagatagacagggtgaatcttgagatccaacaggctgagcgggagtatgatctaaaccgtgctgctgagttaaaatatggcagcctaaactccttgcaacgacaacttgagagtgcagagaaggagttagatgaatatatgaactctggaaagtctatgctcagagaggaagtaacaggaagtgatattgctgaaattgtaagcaagtggaccggcattcctgtttcaaaacttcagcaatcagagagggagaagctgttgtatttagaggaagtacttcataagcgcgttgtaggtcaagaccctgccgttaaagcagtagctgaggctatccagcgttcaagagcaggtctttcagatcctcatcgtccaattgctagcttcatgtttatgggacctaccggtgtaggaaagactgagctagctaagacactagcttcctacatgttcaatactgaagaagcactagtaagaattgatatgagcgagtacatggaaaagcatgcagtttcaagattgattggggcaccacctggatatgttgggtacgaagaaggagggcagcttactgagacagttcgccgcagaccttatgctgttattttgtttgacgagattgagaaggcgcactcagatgtcttcaacatattccttcaaattttggatgatggaagagtaaccgattcacagggtcgaacagtgagttttaccaacactgttatcatcatgacctcaaatgttggatcacagtacattctcaacacagatgatgacacgacgcctaaagagttagcttatgaaaccataaagcagcgagtaatggacgctgcaagatccatatttcgccccgagttcatgaacagagttgatgaatacattgttttccagcctctcgaccgcgatcaaataagtagcattgtcaggttacagttggagcgtgtgcagaaaagaatagcggatcgcaagatgaaaatccgtgtaacagatgctgccatccaacttcttggaagcttaggatatgatcctagctatggagctaggccagtcaagagagtgattcaacaaaatgtggagaatgaacttgccaagggtattctgagaggagaatttatggaggaggacacaattttagtagacacagaactgacagcatttgccaacaatcaacttccacagcaaaagctagtttttagaaagattgaagctgattcacaatctacaccacaagaaatggaaccttctgctcaagctccctgaatgaatgaatgcttgccactgctccgtatttttcactatactatagatttcatttaatatttgattgtgttttatatctatcaatcaatacgaatatcataatacatgacaaagtatcacctttatcagtccaaagcagtgtaaatatatttacttttctgttttctttaagtctttcataaatat
